United States Patent 7,750,207 (ZEA MAYS RIBULOSE BISPHOSPHATE CARBOXYLASE ACTIVASE PROMOTER) - sequence listing, part 3

SEQ ID NO: 2869 - DNA, 6605 bp, Zea mays
  misc_feature (5200)..(5200): n is a, c, g, or t
tatggctaccctcactgccggatcttggagggtgattactgtggacctgcccattcctgcacacgaaggctaagggctattttgagaaccataaaatcaaaagaaattggaggagctagattcaacttcttattcaattttgccatgaacactgtggtctgcggtgccacttgatactttgccatctcatgtttgcatcgcagaaggcgccctggcagcgccaccacccagcaaccaaaaaaaaaaaaatcgagtcacgccgccttgctatgacgtaagcacgggaatccccggtgacatcctccacaggtcctaaactgtaactcactctggacgctgcctgcccctcgcaggacggacagacgctgaccgggtcaacaacgcccgtccagaatgcagaagggtggctatcgtcttgggcagctgatctggtgtgtgcctgtgtggagatggcgtgccgtgggccgtggcccgtgagctagcagctgtaactgtaatgcgcagcgcaggtatggtcctcctcctccatcccctttttaccattttctatatcctttgcatcggcgccgtagataattgttggctgaaattcatgccagctatatgctatgtttcgacctaggattggctgcgcagagatggtggtagggcacgccaatttatttgagatacaggttctccatacgttccttcacttcattgcaatgcagcagagtcatatatatacctgaatcccaatcccaacaaaggtacggacctctgtgtcgtgtcgtcctcctcctccggatacattgcgtttaatttcgaccgtatggatggatggatggatgtggatgtggtggccgtaatcatgtactagcttgctttggggggtcatacgattgattgattgattgattgcacgggcataccaggcttcagtgtatttgctgctctgtagatactttactcatgtgaaacccataagggtcggagtgagctagggcctgtgcggccggcacatagggatcggacggatggatcggtggtggtatgctagtatatatgcatggtactacagctactacccctcctcctcctcctcctcccatagtgtatgtgtatgtgtatgagcagcagcaggccgtatcgacaggcccaacagacagacgatggatcagatcggatctccacaccttgcctggctcgagtagatcttgaccatccgtgctccaatcatggccatggccgccggactgcagagcaccaggcatgccatccggaccctactactactaccagtcgcttacacacctctgccccaaccgtgtctcattcttggcagtttggggaggaaggaagcccaatcttgtccctaaaaaacgctgttccatgtaagtgaccagacgacgactatactagatcactagcccctcgaatcctcgatgaaaagaaaaaataaaagtcgcgagcagtcacgctcgccgaactcaacgtccggccgggaaggaaattaacggcgacagagggtcggtcccctttcgttcggaagtcggaactgtcattggtcgccgtcgtcgtcgcgtcactggcatgtgggggcctcggtcggcaaaccatcgagagccgagagccgggagagagagagagaggatggcaggtgcacatgcatgtgtgtgatgtactcatgtgtagtataaaggatgtgatgggatgagacggttccttttaccaatcattccctacttatattacccgtccatcatgcagccatccgatttttctttcttgttttaccgtatactacagcacaaggataaattcctacagaccgacctcatatgcatcgcatggtgagcccttccacatatacacacatgcatgtagtggcgggtgctaggcgagctagctttttttctatatagatatccagccgtagtgctctcacatcgatcgctcgcactcgcactcgcactcgcactgacctgacgctacgctgcctacaatctatctacctctaccctccctcatcacttgttccactacgaccggccacctcgccgcgcgcgcaagcctgcgtcaccacccaccgtgcagcacgacagccagcaatggccgccgcccactgaggcagagtcgcagtgacggcacgggacgcacacccacgggcgctggcggcatgccgggcgacgcctacgacctcctgtgcgccgaggacgacgccgccggcagcgccctgctgtgcaccaccgacgacgacgacgggtgctgctccgctgtcgaggacgactcggcggcggcggcggcggcatccatcgccgagctcatcggcggcgaggcccagtactcgcccaggccggactaccccgacaggctccgctccaggtccatcgacccggccgcccgcgccgagtcggtcgcatggattctcaaggtgacggacgccggatcgccagtccatatatattatatatacacacactcgcaagcttttcacatcgtttggattagattagacgccgcaccaccatgcttgcttgctggctagctttctcgctcgctctctcaccatgcttttcgtgctctgctagtcttatcagtttaatttgtacaatatgcatgcatatagatagatatatgaactcagcaagcaatctcatcttatatactgttcttctcgctctgtctccttcttcgtcgccatcaggtgcaagaatactatgggtttcttccattgacagcctacctcgccgtcaactacatggaccggttcctctctctccaccgtttgccggtaagcaagctaagctccttatgcatggcatggcatggccccccaccgccgcagccgccatttctcttttcgccacacacgacacacactacttactaataaattacattctgtatatgatggtgtgtcacacactcacacgcagtgtgtgtgtgttgtactgtcgtcagtgggaagttgatagtgctgctgttgttggcgcggggaaaagaaagtgtttggaggagcgtgtccgcgtggattaatcaatcgattataagcatctgcctaattacctccctgcccctaaacggaatgaaggagggggcagctacagggggcaagggggtttttgtttatgcactcaagacagaggggtcttttgcctttgcagttgctgcagccagccgcgctttagcgcaagagcgagcagcctccgcctgacgctttttatcatcgtgtgtggaacacaccttatcattgtgcctcgccatccatccatccatccatccatccacatttttattccgtccatccatccatccgtggcctggcctgctgcctgtgatagcgagacttgcagcagcctctgtgactgtgcgctagctgtgggcgggtgtggtgctacgagttgtttatctgaatccattctgagccaaaggagagagagagagagagagagagagagagagagagagagagagagagagaacacaagctgccgcaagctagctgtaaacactgcaaagtggtctcgctcacacatctctcactgtaggcaggcaccaagtcatatgcagcaccatctgcccctggttgaatctgcagcattatttttctgacttttggttgccttgtgctgctgctgttttcctgaactgaacacatgctcttggatttattatacatgtttagatgaaacaaccaaccatagaatatatacatgtagagtaggagtgtaggactccactgtaaaaaagcaaagcaagcatgggccaccctctgaaacttcagggatttacactaagatagtagggttatccagactctgctttgactgaaacctcaagaccttagacagttagacctcaccaacctttgttccaagcaacgtacacatatcttttttcaaagccgtacagatgcgtttgttctctctgcagctgtgtaatggttggttaggtctctaatgtaacagtgtttcctgtctaacttggccctaaaataaaggtatcccctaatcttctctatctcctcatattctaatgtaataaactcttacaaggactactcctgaatatgtagtaggtagcaaacaatcaatgtggatgtggtcttcagagtcggtcacctctctgtggtttgccatgtgaacatctctatcagaatcttgatgggccctacgtgacgtatagcttagctaggtgtatgtgtacgtatacgtatatacgtccttgcttgcttccatatatgccaacgaacaaaataacttcggaatttaaagtttgagactttataatgcatgttttcttcacataatagaaggacaagagagatgacatataatgcaagaacatagaacacacgatctgtccttggtttcgtgataatccttgctagctccaacatatttattgctgtgtgttttgtgcgtttctctttctccatgaatgcacgcacggcagcaggaggacgggtgggcgatgcagctgctggccgtgacctgcctctccctcgctgccaagatggaggagaccctcgtgccctccctcctggacctgcaggcaaggcaattaggacactatacatatatgccactatggctatacgtttgatcccaataatactcatgactctcatgagctctttcttagttaatgaaggctgatgaacgtcgattggttgttgttgattgcactgcattgcaggtcgagggaaccagcaggtacgactgcttcgagcctgggacggtcggccagatggagctcctcgtcctgatggcgctcaactggcggctgcgctcggttactcccttcaccttcgtcgacttcttcgcgtgcaaggtcgacccaggagggaggcacaccaggtgcctcattgcccgggccacgcaagtgattctggctgcgatgcatggtaatataataatgcactgcttgtgcttggggctgggggccgccggggtaaacttggtgctgcgctgcagtgcatgcagttccaacctccagtgtactaactgcggaactgccacagacgtcgagttcttggaccactgcccgtcatcaatggcggcagcggccgtgctctgcgccatcggtgagacgccgtcgctggagtcggtcagccctggggctgccgtcagctggtgcatcggccttgcagaggtatatactccacacaaagaactattagtctattacgatatgccaatttttttagctttataantttggaagtatatacgtgccaaacatttggtttttttttttgcctgaatataggaagggatcagcagctgctacagactgatgcagcggctggtgataggcaacgtccggacaagggtcgccagcacgacgaccattaccatggcagcagtgaacctgtgctgctcggatgaggcgctgtcctcgcattcctctgccacctcctcgccacccccggccaagaggaggaagaggtcgccaacggccacgtgaaaactgaagaacgcaagtagataggattatttatacgctttttgggggggcagattaacagggtttgatcgatttctttgcagtttgtttgtcgttttttcttctttgtgattctttctcctttttttcccccttttgccatttatttgttctgttcttttgggttggatctctactcctcggtggggggattctgcctgcctgctcgaccggcccagtcatcatggtggcctctggcctctgcaacgcgcgccagccagtatgtgaaggcgacgagactcgagagagagagaaagaaagacagctactacgtataacagacacatctgtgtttctctgtgcaacactctgtggggcttcttcaaccccgacgcagagctgcagagagggaccattgattggtgagcgagggcagccatggcggcagatggagatggagagggtgggggaaagaggcaatgagttgcggtggatggatgatgattggtagggttaaatgaggtggtcaaagggccgggcggtcagtgctcctgccaagatgcagccctgcctgcaaagtttctgttcatattcatgagggcaaaaattgtttgtttccgagtggtttgtttgtattttgttgatgccgctgaggcgagggcgtcagagagagagaaagagagagagagaaagaggggcatgctttgctttgctgtgatgggagtcacatggatatgccctactgtggtggtgctctggagggaaatatttgtccatctccagagctaacagtgtccaagcatggggcttttgggggcccttgctgattgtttgtatctcttttttcttgcttgtgtatcaatgaagattttgccatttgaattggcctgagaagagagtacaagctgaagagagagtttctgtgttttgcctgctgctggattatatgtttgtacctcttccttcttgtttatgtatcaataaagattttgccatttgaattggcttgagaagagagtaaaaaagagaaaattggtgtttttacctgctgctggattatactgcatggtttagcactgtgttactgctctgttattctcagtcagagactcagatcagaggttgcagctggccagactggcattttttttttgtactacttgagcttgcagata

SEQ ID NO: 2870 - DNA, 1037 bp, Zea mays
cattgggaccctcgaggccggccgggataatctcggtttttagcacgcaaacacacggcacgagcagctgagcgcccatggcaggtccccggcgtctcctcctcctcctcctcccgctgctcgtgctcctcggcgcgcacccgccgcagcgcgggtccgcggaggaggggacgaaggtctccctggagctctactacgagtcgctgtgcccgtactgctcgcggttcatcgtcaaccgcctcgcggggatcttcgaggacgggctcatcgacgccgtccacctccggctcgtcccctacggcaacgcgcgcgtcgcatccaacagcgagatctcttgccagcatggtccgtacgagtgtctgctcaacaccgtggaagcttgcgccatcgacgcctggccggatctggatgtgcatttcagcttcatctactgcgtggaggacctggtggtgaaacggcagtacaaggactgggagtcctgcttcgagaagctgggcctcgaccccaagcccgtaacagaatgctacaaaagcgagcatggccacaagctcgagctcaagtacgcgaaccagaccgacgctctcgagccgccgcaccggtacgtgccctgggtggtcgtcgacgggcagcccctgcttgaggattacgagaatttcgaggcttacatctgcaaggcttacaagggcactccaccgaaggcctgccagggcctgggacgtctgcagatggccctcgagacagcggcggaggcgcgcaacggcgtcagctacaactccggtgtcagcaagcttgcgactgctgaagatgagggtggggagcataaggtgggagaatactagtacataattgactagcgacgtgccccttttttgggtcatgtgaagttgaaggaccgttccatctcgttgtccggttttttattgtacagtaatagctaatatgataatgataataattacatttctaaaaaaaaaaaaaaaaatagtacggctgtccttgcgagcagcgtgcgatatttgctgcggacagactgctct

SEQ ID NO: 2871 - DNA, 1481 bp, Zea mays
ccggccgggacgccgctcccctttagcgtcccgtgcgtcccggccgggccgggcggcattccgaccgatcccaccgaatggacagccgcctcgccatcgccgcgctcctcctgctcgcctccgcctcctccgctgccgctgccgcggacggcgggaaggtggccgtggcgctgtactacgagtcgctgtgcccctactcggcgcgcttcgtggtgaaccacctcgccaaggtcttcgcggacggcctccgcgaggtcgtggacctcacgctcgtcccctacggcaacgcccggatccaccccggcggagagatctcgtgccagcatggtccgtacgagtgtctgctcaacaccgtggaagcttgcgccatcgacgcctggccggatctggatgtgcatttcagcttcatctactgcgtggaggacctggtggtgaagcggcagtacaaggactgggagtcctgcttcgagaagctgggcctcgacgccaagcccgtaacagaatgctacaaaagcgagcatggccacaagctcgagctcaagtacgcgaaccagaccgacgctctcgagccgccgcaccggtacgtgccctgggtggtcgtcgacgggcagcccctgcttgaggattacgagaatttcgaggcttacatctgcaaggcttacaagggcactccaccgaaggcctgccagggcctgggacgtctgcagatggccctcgagacagcggcggaggcgcgcaacggcgtcagctacaactccggtgtcagcaagcttgcgactgctgaagatgagggtggggagcataaggtgggagaatactagtacataattgactagcgacgtgccccttttttgggtcatgtgaagttgaaggaccgttccatctcgttgtccggttttttattgtacagtaatagctaatatgataatgataataattacatttcgaaaaaaaaaaaaaaaaaaaaacggccgatcttgcgagcagcgtgctcttttcatcgttgaatggttcacatctaccaggtacgtacaaccaaacaagaagcgtgtagccactccgcttgcaaagtacgtaagcttcatctgtgtttgtgacagaaacattttcctcgcaggaacagcaagcttgcgaccaaattggtactattagatttgttatggaatatacttcgatcctgcacttattttgtgtcagttttaatagttccacgtataaatctagttaaacttaagatatttgacttaagacagttctaacatatcatttttagacacaaaatcactaacccctcagttgaaagagagaaacatatgataccaaagggtcctaacctcctttaaagataaacataccatatatctatgtcaggtattgaacaagattcatagtgtggctgagttatatcctctttatatctatcatttatatcccttcaatatatatcttatttatatccggcctttatgaattctaaaata

SEQ ID NO: 2872 - DNA, 1828 bp, Zea mays
cagcagatgttgtataggctttcccggccgtaagctactgcctgcctacacatttaagcgacgtgattaaggaatggtggaaaagcaagctggaggagtcgaatctacttcccgtaatcagatgatccactgcagcccggggatgccaatcacgcttggaatgttcctcccatgctgcacttgcacccatcgatcggtagtgtgtgtgtgtgcagcagaggaaacagacgagatcgccccggccccaccccggagaacagggcctgcatgttccccggaactcttccgcgtaccattaaaaaaaaacaagtactagcagagggaaggaaaacaggaagcaaaaccaaacgggtctcacggaatcccggcccggcccggcccggcccatcgccatccatcggtccatccaatccaccggcccccaccacccttcctccctcactccctcgtgtccccttcaaattaaaaacgcaatcctccgtccctgcacctgcgcttgcttctcttcgtctactctactgaactctacttccacaccttccccctccggccctccactccgcatcccgccccagtgtcccctccccctccctccacccccgcacccgcgatgccgccggacagagaagacgccgcgggcgcgggcgccggcgcggacgtcgcggccgacgagctgcagagcgtgagcttcggctcgtcctcggaccgctcgcgctcgcgctcggcctccacggcgtccacggccacggcgtcctgctccacgtcctcgtcggggccgctacaccagcacctctcgctcccggccccgcgccgcaacccctccccctcccccgcgccaaccccaaccctgcccacgcagatcccgcgcctcggcgccgtctcgctctccgacatccgcttcctgcgccggctcggcgccggcgacatcggcagcgtgtacctggccgaggtccgccgccccacccccaccgccggggccgccggcaaggagaagcacacctcgactttggcggcggcggcggtggtggtggccgccaaggtgatggaccgcaaggagctggaggggcgaaacaaggagggccgcgcgcgcacggagcgcgagatcctcgaggccgtcgaccacccattcctgccccgcctctacggcgtcgccgagggcgaccgatggtcctgcctcctcaccgagttctgccccggcggggacctccacgtgctccgccagcgccagccgcaccgccgcttctccgaggccgccgtcaggtgcgtccgtgcgtgctcgctttcatctcattcgttcccttgatccgttgctgcttacgctagccattctaggtttttttttgggggggtgggggggagaaggagaagaatcaggcaggtttcctgcggggctgtgattgccgcggcgctctgtctgtttacttgcacaaatattttcttcctaaatctcacggaccacacttgtttgttgtttctgtttccttttgtgtgttggtgttgctgcgcgtagtttagtcgggcccacgtgtcttgggttgggcacgcacccgcctggtttcctccctcttccacctgatggacgcgtttgttttgttccattccatgatgaccaccaacacacgcacgctacactacagcgtaggtgtaatgtcatttgcgcacagcagctgcacagcgcagtctaccgcattgcatttgtgccgtgcacgcgctgtgagtgagcccggccggccgaaccactcaagtcaagcctgtcctgccgctcactgcctccatcaacaggccaagcgctacaaggcggtcgcagcgcgtcgtatgcatcctgcag

SEQ ID NO: 2873 - DNA, 3067 bp, Zea mays
cgcaaaggcttcattgcttcacctgcaatggagactgaaaggtccgcgcataataaagtgcatattcagtctggtaatgcttcaaggaaaactgagggatttatacaacagagcatcaatgccaatcgacaaaagaatgggacatcagtacaacattctgaaagcttcaccacttctgctcgaagaactgctggtggctttccaccagcacctacaacggaggataaattcaaagctgcaaggctttcatccagtaatgaagctgcacccagaaaagagggggttggacagcgaatcagtaacattagcatatcgcttcaaaagagaactgagaacacaaacaaagatgtcgcgaagaaagaagttggcacctcctctccattgcctccaaatcctgctaatgctatgcataagggaaatggcaaggttggtaggccaatggacaacacacaaggatccatgcagagatttggcagcccatcaacatcaagtgcaacatgggggatggatagaggagcacctaggtcatccatcccaagcccgagcattacaatacggagaccgaatggcatggtacgaccagctgaaaatctttctgtctctgctaagaaacctgatgcaggaggcctttcacctgctatgggtaaggaaaaggaacaaggtggaaggttgctgcaagctaatatttcaactgatcagaaactggcagctgaaagtcgttctgcctctgctaagaaacctgatgcaggaggcctttcacctgctatgggtaaggaaaaggaacaaggtggaagattgctgcaagctaatatttcaactgatcagaaactggcagctgaaagtcgttctgtctctgctaagaaacctgatgcaggaggcctttcacctgctatgggtaaggaaaaggaacagggtggaaggttgctgcaaggtaatatttcaactgatcagaaactgggagctgaaaaccgttctgtctctgctaagaaacctgatgcaggaggcctttcacctgctatgggcaaggaaaaggaacaaggtggaaggttgctgcaggctaatatttcaactgatcagaaactggttatgtcaaagcctccagctgtggagaaagctgcagatgggagagctgaaaggatggagaaggtcagagatggggcaccagatattgccaagaaagaggacaaaaagagtgatcggcatgagaaaaagaaaaggaaagagaaagataaacacaaagagaagaaaaaggagaaagaggcaaagaaggagaaaagggaacataaccacaaagagcataataaaacaagagaaaacagtataagttatcccatagatagtcttaacttgaagcactcggtccctcctttagccccaccagttgatgatggaaaatctgttgtgcctgatgagaacctgaagaagcgaaagaaccatgaaacgaatggttacttacaaagtgtctgcctcgctggccccccccccttttgcacttaacagcatgcgagtcttgtatgacaccattatccttttttatggtgctttatattataagacttctgatgctgctgtacagacaaccttgatatgcggcctacaaagttgccgagaccagcactccccagcaatcgtgtggagaatggtacagcatctcatgtagccgcgccactctcttctgtgaagcaggaagccataaatattgaaaaggctgaaaggctccacaaggaagagaaagtcaatggcaaccaacagggtcagcagcgagctccagtcgatccggtggctgcttatgagaatggcacaagctctaggaagccacctcaccccgactgcaagtatcttagccagatatacagcattcctgaagcacctcaaatgatggaattgcctgggcaggaaggtgaggactggctgttcgacaaaggcggcacccagccaaggaagccggccagttcagcgcctgaggctgatggagtcccccaagtgtgggctcaggctctgaaaattgaccatgctgatgtcattgctctgccatacgtgatacccttttagctgagtgacaaacacctgtgaagctgagacatcaatgaacaacagcaactttgtgtggctgggatgtgttgccagcttttacaagtagcttgtgtggcatagatagatagcttcatgcaccactcccttttgccgtgggcgtgctgcgtggaaagtcgaacaaacagtgttggctaccaagaggctgggatctgtaatggagttggttaggtgttatcgctgcacaattttgatctgttgaggtgtaatagcatttttaataccaaagatgtacattagagagaaaaaaaaaaaaaaaaagacttgagattcttcttcatttattacagtagttggatggatttgagctgctgctgctggtggtggtggctgagataaatctgcttgtggttgatttgttccaaaccaaagttggcacttgtggctctcctcatgtttcctgtgtatatataactctagcttacgtatatgctcatgtggcggcgggtattttgacctacctgaagtttgtaattctattttactctgtccgaccgacggcagtgatgttgacttgttgagaagtgaagccagcgtcgaaagaacacgtaccaatatgcattgatgttataacggcccacgggcccaggctgtagcagatgtcgaagcctgcgaaggcgaaggaggaagcagtgtgatgggctgacaccacagcgacgtattgggctgggcctcctgagaattaatgtgaagcctcctttatagccagcccagtaataagcataatgatgactgacgatacgggatggctagctcgtgtcgtgtgtgcagtcagtgactgtcgaggtggtcagggcacccaacccaacccaacccacctccatccttttgcagctgcagggcgaagagaatgagaatgagaatcgcttgcaccccactccagaaatccgcggccatccctattgctattccatcccggacgccaggagttggaagcggttggtcggctgcacttgccgtgcagttcctgccggct

SEQ ID NO: 2874 - DNA, 1105 bp, Zea mays
  misc_feature (1000)..(1000): n is a, c, g, or t
tcgacaaaagaatgggacatcaatacggcattctgaaagcctcaccacttttgctcaaagaactgtgggtggctttccaccagcaccttcaacggaggaaaaattcaaagctgcaaggcctttatccagtactgaagttgcacccagaaaagaggggattggacagcgaatcagtaacattagcatattggttccaaagagaactgaaaacacaaacaaagatgttgcgaagaaagaagttgggacctcctctccattgcctccaaatcctgctaatgctatgcataagggaaatgacaaggttggtaggccaatggagaacacacaagcacccatgcagagatttggcagcccatcgatgtcaactgcagcagtggggatggacagaggaacacctaggtcatccatcccaagcccgagcattacaatccggagaccgaatggaattgtacggccgcctaaaaacatttctgtctctgctaagaaacctgatgcaggaggcgtttcacctgctattggtaaggaaaaggaacaaggtggaaggttgctgcaagcaaatatttcaactgatcagaaactggttatgtcaaaaccaccagctgtggagaaagctgcagacggaagtgctgaaaggacggagaaggtcagagatggggtgcctgatgttgccaagaaagaggacaaaaagagtgaccggcatgagaaaaagaaaaggaaagagaaagataaacacaaagagaggaaaaaggagaaagaggcaaagaaggagaaagagaagcataactacaaggagcatgataagacaagagagaacaatataagttatccggtagatagtcttaacttgaagccctcggcccctcctgtagccccaccagttgatggcggaaaatctgttgtgcccgatgagaacctgaagaagcgaaagaatcatgaaacgaatggttacttacaaaaccatcttgaaatgcggcctacaaagttgccgagaccagccctncccatcaatcttgtggagaatggtacagcatctcatgtagccgcgccactctcttctgtgaagccagaagccattatcaataatattgaaaaggctgaaaggctg

SEQ ID NO: 2875 - DNA, 4324 bp, Zea mays
  misc_feature (2497)..(2497): n is a, c, g, or t
tgcaaaacagtgtttttgggaaaactatggatagactgctgcagacggccctagaactttgactaaacttcagttgacttgttagcatttctattttgtttttaggggctaaagtttagtagctacttgagatccagatagttttgtaagaacttttttcattgttggattcattacaattttttgtaacgaagtacaattccgtgttgccctaaatgcattgctggtagtcctagcacgcatgttactcgaatagtatatagcaaaggacaaaaaagaggacaacatttatggtcaagaaagtaagacgatttgtacaaaactaaatatatgcttatttttagtcgtcgtcctgaagtatagatgcttaatgagcctcctcctccagcggcagtgaagtcatccaatgcacagttattagaatcagatgaaacatcaaaccaacgttgctggttcacgtggttacggtttgattgaggatccaaccagcactgttaatgctaaagtaaaaaaatgggccatgcaagaaatagtagatgagggaaggttctcatgagccatgcatgcatgcatgatgacccatgtccatgatgtggtatccccttctgcgtgctataaaaccaccctccaccctcctccctttcccaaacctctgaaccccgctctaataaatcttcctcccatctctctcgctcccaaccctcaagtccccaccaacccaaccctggtggcaccggccgcacacacgaaagcaagctagctagtcactattagagctatttggttgggagcggtttagctgagcaagatcgaactggcattgtcacacacatctcagcactcagctccttgggttcccctccatgagcagcagctgagcagccacacattgccgtcttccttgctgcacttgtagttacagctagatccattgatttttttggcaacaacaagagcaggagctactgagcaagaagtgcgtacgtgcttggtgagtgttacttatactagcttgcgatggagctggtgactatggtgacgctgacgctgctggcgtactcggcggcgatgctggcgcggcttctggtggcgcgcgcgcagcggcgtcggtgctacctgctggactacgtgtgctacaaggcgacggacgaccggaagctgccgacggacctgtgcggcgagatcatccagcggaacaagctgctggggctggaggagtacaagttcctgctgaaggtgatcgtgaactcgggcatcggcgaggagacgtacggcccgcgcaacatgatcgagggcggggaggcccggccggaccgcctccgcgagggcatggaggagatggacgagaccttccacgccgtcctcgacgagctcttcgcccggtcggcggcgcccggcggcgtcggcatccgccccgccgacgtcgacgtgctcgtcgtcaacgtgtccatgttctcgccggcgccgtccctgtcggcgcgcgtcgtgcggcgctacggcctccgcgaggacgccaaggtgtacaacctcacgggcatgggctgcagcgccacgctcatcgcgctcgacctcgtcaacggctacttcaggtgcgtgctcgacctagctcgttaattcttgctagtaattaattactactcgttgtcatgaagagataaaggtctcgttcacgcatggtgtgctcctgtaaatagacgtctgagtttgacaaactgacaatagattattgaccgcagccaagtctatcgtctctctggccaaataaatatttaatcacaagtttaggaaaaaaattgtaataaagaattctataactcacaaagtctaaagctgttttgttacgaaaaggcaaaaacaaaaaaaaacaaaaaagggggctagagctgaaaatgtatatatgttgcacaggtaaaaaaaaagcccaaagctgggcaaaaatttatgcctgatgggccctagcatagctgctctggtaattaagggcatggatggatacacacgccagctgtgaggcatcttgtttggttgcacgccattgaatccatcgtctgtgtagctactgagaccagataaatgttcagtactcccctcctactacttgtaaattaatgcctatcaatcggaacatgtaccgtacgtgctctacctactagctagcaacgtagtagtagctcatttttaagaggggtagtactcgtttggtacttgtgctcaccataataatgaacacaatcacaaggatttttttgttatgaacctatggtagttttgttctctcttttttcagcaagataaactaggaaacaaatatatggtggaaggtcttggaaataaagcattaagcagcgtaaccattataagcttaggtcctacattaatattgaagagttaaccactataaagatccatatagtaagtgattgactctattattaaacttgctgcaagaagatccatcccgagatggcagtagccgcatcccccatgaacacgggantaaatgtggccggggccagcaatggcatgaatgctgtgctgtgactgctgcatgtgagccagctacggctacggcctactctggagtctggactgtcctcctttaatgcctgctcaccaagtttggtttgcctttagatgggcatgaatggctcagccgctcaggcaggcacggcatggctggacctggacctgaccggctccgcttgtagttagtagacatgcttgtccattgggctgaactgtctggttcaggcagatctccatctatcccaggccgacgagaaagtcggcggtggcacagccgcacaggcaacgaccaacatagcatacttgaaaatggctggcgtgtgcatagcatacttgaaatcttaatgaacttgtttgtcagtcatggatgctggattacgtgtggttggttgcttgcaggacgcacgccgggcaggtggctctggtgatgacgtcggagtcgatcgcgcccaaccgggccccgggccgcgggcgcaccttcatgctgggcaactgcctgttccgctccggcggctgcgcctacttcctgaccaacgacccgcggctccggccgcacgccaagctccgtctccgccacgtggtgcgcacccacacgggcgcctccgacgaggcctacaactgcgcgctccagatggaggacgaggccggccgcccggggttccacctgggcaaggagctgccgcgcgccgcggtgcacgccttcgtgcacaacctccgcgtgctggcgccccgcgtgctgccgctcccggagctgctccgcctcgcctgcgccaccctctcggcgcgcctggcgcgcaagaagcggcagcgcggcgcgggccatggccatggccacctcaccatccgcatgaaggccggcgtcgaccacttctgcgtgcacacgggcggcgccgccgtcatcgacggcgtcggcaagggactcacgctcacggagcacgacctggagccctcccgcatgacgctgcaccgcttcggcaacacctccgccagcagcgtctggtacgtgctcgcctacatggaggccaagggccgcctgcgccagggcgaccgcgtcctcatgctcaccttcggcgccggattcaagtgcaacagctgcgtctggaccgtcgagaggcccgccaccgacgccggcgtctggaaggaccgcatccaccactacccgctcaaggacgtctccaacccattcatggacaagtacggattcgtcaaggacctcatagacttgtgatcgcccctagctgctgctgctcaactcaaccccaccaacgcacatactttttatttacaccattattattgtattcattgtcatgttagtactactctgttctagtattcagcaactactagttaattaaggtgagcacaacaatgctagctgaggattcatagtagcttatgattcttttggtggtggcgggaagatccacttttacgtagcaacggatatggcttcgctctttgttctttcttcagttctgtcatttcgtgtctgtcaatttagatgccccatgtcgtccgtcagtcagtcagtcagtgtcgtcctgttcctatttactatatcaaatgattatggtgcaatcattttttaaactaagttatttattatttattgtgtaatggtaaatggtgctgtaataaagagcatactctcactccaaagatgcatgttttatgatctgaaagtccactgcggcatagtattcatcagccctcatggcgatgtacatacgtagaagtcggttcttcgatttctaaataaatacaatacaaatttaaactacattctagtttatct

SEQ ID NO: 2876 - DNA, 2193 bp, Zea mays
cgctctaataaatcttcctcccatctctctcgctcccaaccctcaagtccccaccaacccaaccctggtggcaccggccgcacacacgaaagcaagctagctagtcactattagagctatttggttgggagcggtttagctgagcaagatcgaactggcattgtcacacacatctcagcactcagctccttgggttcccctccatgagcagcagctgagcagccacacattgccgtcttccttgctgcacttgtagttacagctagatccattgatttttttggcaacaacaagagcaggagctactgagcaagaagtgcgtacgtgcttggtgagtgttacttatactagcttgcgatggagctggtgactatggtgacgctgacgctgctggcgtactcggcggcgatgctggcgcggcttctggtggcgcgcgcgcagcggcgtcggtgctacctgctggactacgtgtgctacaaggcgacggacgaccggaagctgccgacggacctgtgcggcgagatcatccagcggaacaagctgctggggctggaggagtacaagttcctgctgaaggtgatcgtgaactcgggcatcggcgaggagacgtacggcccgcgcaacatgatcgagggcggggaggcccggccggaccgcctccgcgagggcatggaggagatggacgagaccttccacgccgtcctcgacgagctcttcgcccggtcggcggcgcccggcggcgtcggcatccgccccgccgacgtcgacgtgctcgtcgtcaacgtgtccatgttctcgccggcgccgtccctgtcggcgcgcgtcgtgcggcgctacggcctccgcgaggacgccaaggtgtacaacctcacgggcatgggctgcagcgccacgctcatcgcgctcgacctcgtcaacggctacttcaggacgcacgccgggcaggtggctctggtgatgacgtcggagtcgatcgcgcccaactggtacgcgggcaacaagcgcaccttcatgctgggcaactgcctgttccgctccggcggctgcgcctacttcctgaccaacgacccgcggctccggccgcacgccaagctccgtctccgccacgtggtgcgcacccacacgggcgcctccgacgaggcctacaactgcgcgctccagatggaggacgaggccggccgcccggggttccacctgggcaaggagctgccgcgcgccgcggtgcacgccttcgtgcacaacctccgcgtgctggcgccccgcgtgctgccgctcccggagctgctccgcctcgcctgcgccaccctctcggcgcgcctggcgcgcaagaagcggcagcgcggcgcgggccatggccacggccacctcaccatccgcatgaaggccggcgtcgaccacttctgcgtgcacacgggcggcgccgccgtcatcgacggcgtcggcaagggactcacgctcacggagcacgacctggagccctcccgcatgacgctgcaccgcttcggcaacacctccgccagcagcgtctggtacgtgctcgcctacatggaggccaagggccgcctgcgccagggcgaccgcgtcctcatgctcaccttcggcgccggattcaagtgcaacagctgcgtctggaccgtcgagaggcccgccaccgacgccggcgtctggaaggaccgcatccaccactacccgctcaaggacgtctccaacccattcatggacaagtacggattcgtcaaggacctcatagacttgtgatcgccccctagctgctgctgctcaacgtctcaaccccaccaacgcacatactttttatttacaccattattattgtattcattgtcatgttagtactactctgttctagtattcagcaactactagttaattaaggtgagcacaacaatgctagctgaggattcatagtagcttatgattcttttggtggtggcgggaagatccacttttacgtagcaacggatatggcttcgctctttgttctttcttcagttctgtcatttcgtgtctgtcaatttagatgccccatgtcgtccgtcagtcagtcagtcagtgtcgtcctgttcctatttactatatcaaatgattatggtgccatcattttttaaactaagttatttattatttattgtgtaatggtaaatggtgctgtaataaagagcatactctcactcc

SEQ ID NO: 2877 - DNA, 1045 bp, Zea mays
gccggccgggttcccgccggcccggccgggccccaacctctaaaccccgctctaataaatcttcctcccatctctctcgctcccaaccctcaagtccccaccaacccaaccctggtggcaccggccgcacacaccaaagcaagctagctagtcactattagagctatttggttgggagcagtttagctcagcaagatcgaactggcattgtcacacacatctcagctccttgggttttccctctccatgagcagcagccacacattgccgtcttccttgctgcacttgtagttacagctagatccatctccccgccacttgattttttggcaagaacaagagcaggagctactgagcaagaagtaagtgcgtacgtgcttagtgagttatacttatactagcttgcgggcgggcgggcgcggctgcgatggagctggtgactatcgtgacgctgacgctactggcgtactcggcggcgatgctggcgcgggtgctggtggcgcgcgcgcagcggcgtcggtgctacctgctggactacgtgtgctacaaggctacggacgaccggaagctgccgacggacctgtgcggcgagatcatccagcggaacaagctgctggggctggaggagtacaagttcctgctgaaggtgatcgtgaactcgggcatcggcgaggagacgtacggcccgcgcaacatgatcgagggcggggaggcccggccggaccgcctccgcgagggcatggaggagatggacgagaccttccacgccgtcctcgacgagctcttcgcccggtcggcggcgcccggcggcgtcggcatccgccccgccgacgtcgacgtgctcgtcgtcaacgtgtccatgttctcgccggcgccgtccctgtcggcgcgcgtcgtgcggcgctacggcctccgcgaggacgccaaggtgtacaacctcacgggcatgggctgcagcgccacgctcatcgcgctcgacctcgtcaacggctacttcaggtgcgtgctcgacctagctcgttaattcttgctagcgtttgtatga

SEQ ID NO: 2878 - DNA, 1514 bp, Zea mays
ttccccacgcgtccgaaattacaggaaaaggtgcataacaaccatctgcatctagaacgttgccctgtctttgtcatctctagatcacatgtacccgatttttagaatttccatcgaaccgttgccctgtactagcaaataatctgtactttatttggcttgaatttgctgatggagacagttttcctgtctcaactgctagagaaaaagtaggctggcattattgtcgattaaaacagaaggcaccttttgcttcaggcattaaacctttgattttaatgcacgtctatgctgggacctaacaacttgtgttctctcattcaggttttgccaaacaactgcctagggcatgttgtggggctccatcgactcccgagaaagcagcttacaacttcaatgtcacggccaaatgcggtgagcctggtgcgactgcctgtgctgatccgacaacccattggagctgggatggcattcacctgacggaggctgcgtaccgccatatcgctaaaggctggttatacgggccttttgcggaccaaccaatcatccaatcctcatgatcacgccactcctgctgtagagtttcatcaaagtagcgcactggaaaaaaaatggagcgggggaaagtagttcttccatacagtttcaatgtttgcatacatgtacatctccattttgattgtattcatttaacttgggtggtacaaaggtgggatagggaggctgcacaaaggcctgatttcttgatttgtcagggggtataaatatgaaaaatataacgtacatataatcatgtatattgtgtcctggaaatgtgatacagactgtctgcttgagcagcttctgattctctgattaaagatgtgccagttctgcgattcttatcctgcagcttctgtctcaacatgtgtgcatcgttcttcagcgatggatgagctgtgtgtgaaataatatgaacacacatgcaatgcaagtccgatttatagctgtaaacaattagaatactgccaggagaagaatctgtaatatatacgccattataaaaaccgaggattctataattcgtgatatcaggtggttgctattattagcttcaaaaatttgactcatggactcgcctgaaaagacaaaaatgtcttcattgaggacgtgctcgtgcatgacatggcggtgaaactgtgcttcaccctcgctcgcatggaaggagatggccggtctgcgcagaccccgcgcactcgcacgctcggagagcgtcggcggcaggtggtcgctcggagacctgtttggcatgtctctagtgagggtatttttatcttttcagatgagttatgtacacgtgaagcgtatataatggcatggaccaaattttggtaattaataatggtaaccacagcatatcacagattatagtggcatctttagaatccttagtttttataatgacttatatctgaaaaaccctatatataaaagtgtctgtggtctgaatagaaggattttagaacagtgctgca

SEQ ID NO: 2879 - DNA, 2017 bp, Zea mays
attgggtacctcgaggccggccggacagccacctaatcattccccactggcgcctgcccgccggccggggccaaacaccgagtgaaccacgccaccacacgcagcaagcgagcgcccaaagaaacgccgtagcagccaccaccaccaccaaccccttcctccctttccctctccgccgcccgcctctctacaagaaccctcacccgaccgccgataactacctagctcccacctcgctcctcgactccgtcttctctattcttccattcagcggagatcctagaacctaggggcagccagccagggggaacgggccgcgatgggaggaaggggcgcgatgctcgctgtggtgttggtggttcttgcggcggttggcgccgcggcggaatcgatggaggcggcagccaaggggaggtaccacgcgctcttcaactttggggactcgctagccgacgctggcaacctcatccagaacggcaccccggagatcctggccaccgcgcgcctgccctacggccagacctacttcggaaagcccaccggccgctgctccgatggacgcctcgtcatcgaccacctcgcgcaagagttcggcctgccgctgctgccgccgtccaaggccaagaacgccagcttcgcgcacggcgccaacttcgccatcaccggcgccaccgcgctcgacacgccctacttcgaggccaaggggctcggtgccgtcatctggaactccggagcgctcatgacccaaatccagtggttccgtgatctcaagcctttcttctgcaacaccacggaggcatgcaagaaattctttgcgaaggcgctgtttgtggtgggtgagtttggaggcaacgactacaatgctcccctctttgcgggcatgggcatccctgaggcctacaaattcatgcccgatgtcatacagggcatctctgacggtattgaggcactgattgctgagggggctgttgagatgattgtgcctggtgtcatgcccacgggctgcttcccagtttacttgaacatgcttgatgagcccaaagaaggatacggcccccacagtggttgtgtccgccggtacaacacattctcctgggtgcacaatgcacatcttaaggccatgcttgagaagctccgggctaagcaccccaatgtgaggatcatatatggcgattactacactccagtcgtccagttcatgcttcagcctgagaagtttggttttgccagacaactgcccagggcatgttgtggggcgccatcgactcctgagagagcagcttacaacttcaatgtcacggccaaatgcggtgagcctggtgcaactgcctgtgctgatccgacaacccattggagctgggacggcattcacctgacggaggctgcctaccgccatatcgccaaaggctggctatacgggcctttcgcggaccaaccgatcatccaatcctcatgatcatgccgttcctgcggtagagtttatcaaagtagcattgagagtgagagaaaaaaaatggagcggggaaagtaggtcttccatacagttccaatgcttgcatacttgtacatctccatttgattgtattcatttgccatgggggtacaaaggtgggatagtaggtcgcacaaaggcctgatttcttgatttgtcaggttggggggtataaatatgaaagttgttacgcacagataatcatgtatattgtgtcccggaaatgtgttacagattctgctcgagcagcttctgattctctgattaaaggtgtgccttttttcgcgaaaaaaaaaaaaaaaattctgtctgaacatggtgtgcgtccgtgcttcagggatggatgagctgtctgtgacacacacatgcaagttcggtttgtagctgtaaacaactagaatactgccagcaactatctttgtagtaacgattagcgaacatggcttggctgtggctaaggagacgaatctgtaatataaaattggcagtgatctgaatggaaggatttgatgacagtgcatgcag

SEQ ID NO: 2880 - DNA, 1781 bp, Zea mays
cattgggtacctcgaggccggccgggaaaatccgccaacaccgcgccggccgcgccacgccaccacacgcagacgcagcgagcggcgaaggcaagcgccagaaaacgccgctacagccaccaccaccaaccccttcctcccttcccttttccctctccgtagcccgcctctcctacaagaaccccgacccgaccgccgatagctacctagctcccaccccgcacccctgactccaccttctccattcttgatcccttcgccgcgcggagatccaagaacaggggcagcctgacaggggaacgggcggctatgggaggaagcagcgcgatgctcgccgtgttggcggtggtggttcttgcggcggtcggcggcgctgacgccgcggcggaatcgagtgaggcgtcggccaaggggaggtaccacgcgctcttcaatttcggggactcgctagccgacgctggcaacctcatccagaacggcaccccggacatcctggccaccgcgcgcctgccctacggccagacctacttcggcagggccaccggccgctgctccgacggacgcctcgtcatcgaccacctcgcacaagagtttggcctgccgctgctgccgccgtccaaggccacgaacgccagcttcgcgtacggcgccaatttcgccatcaccggcgccaccgcgctcgacacgccctacttcgaggccaaggggctcggtgccgtcatctggaactccggagcgctcatgacccaaatccagtggttccgtgatctcaagcctttcttctgcaacacaacgcaggcatgcaagaaattctttgccaaggcgctgtttgtggtcggtgagtttggcggcaatgactacaatgcacccctctttgcgggcatgggcatcccagaggtttacaaattcatgccggatgtcatccagggcatctctgacggtattgaggcactgattgctgagggggctgtggagatgattgtgcctggtgttatgcccactggctgcttcccagtgtacttgaacatgcttgatgagcccaaagagggatatggctcccgcagtgggtgtgtccgccggtacaacacattctcctgggtgcacaatgcacatctcaaggccatgcttaagaagctccgggctaagcatcccaatgtgaggatcatatatggcgattactacactccagttgtccagttcatgcttcagcctgagaagtttggttttgccaaacaactgcctagggcatgttgtggggctccatcgactcctgagaaagcagcttacaacttcaatgtcacggccaaatgcggtgagcctggtgcgactgcctgtgctgatccgacaacccattggagctgggatggcattcacctgacggaggctgcgtaccgccatatcgctaaaggctggttatacgggccttttgcggaccaaccaatcatccaatcctcatgatcacgccactcctgctgtagagtttcatcaaagtagcgcactggaaaaaaaatggagcgggggaaagtagttcttccatacagtttcaatgtttgcatacatgtacatctccattttgattgtattcatttaacttgggtggtacaaaggtgggatagggaggctgcacaaaggcctgatttcttgatttgtcagggggtataaatatgaaaaatataacgtacatataatcatgtatattgtgtcctggaaatgtgatacagactgtctgcttgagctgcttctgattctctgattaaagatgtgccagttctgcgattctc

SEQ ID NO: 2881 - DNA, 998 bp, Zea mays
attgggtacctcgaggccggccgggtacatgtctctcggcaacggatatctcggctcttgcatcgatgatctctattcagccacgcaatcacgtgggtcaggaaaaggacgagagcggaaaggaccgaacggctcgggttgatccatcggatccgaaggggcatggctctggtcagattggcgtttcccgtgttcttcttcctcgcagcggcggagttcgcggcggggacgcggtcgccgtcggctttcgtacaaaacgccatctactccaaccgcatcaccatcttctccaagacttactgcccctactccatgcgtgctaagcacatatttcgagaccttaaggaagatccatatgttgttgaactagatacccgagtggatgggcgtgacattcaaagtgttctcctggacctagttgggcgtcgtactgtgccacaggtgtttgtcaatggacagcatattggtggctcagacgatacagtaaatgcgctttcaaatggacagctccagaaacttctcgggaagagtcagtcacaatgatgggtcgctggacaagcttgcactgtcaagaacacgtgagtatatgtttgggaggggtgttcttttgtgtttagggctgaacagaatctggtgttgtgacaaccatctgtactgctggatttgtgatctgctcaattgcacccatctatgttttaccttgttcattatggaaattattagtataggtagctcaatgaactagctgcataggctatcctcagaaaaaaaattcctaaacttctgacgactttattggtatcgacatcctccgttacaaagtcattttagattttctaggtacataatttttgctatatatggacctcagacatagcacatttaggtccttttaacttgcgtcgcttgtttcagtcctctctcaattgtatttgtatcacgtcactctaaaatcatactaccctcgtttttgaaataaaaaaaaaaaaaaagcggcc

SEQ ID NO: 2882 - DNA, 1778 bp, Zea mays
attttagaggttctaaacagggccttaatcagtagtaatagtaacgtttgtatcagtatcgactctaatttaacctgtactaagtgttaccggtctatgcaagggccggcgcgcctgcagcctgcaaggaaacaaggttggtccccgaaagatggggcatttattcgacgcgacgcgacgcaagcggagaaggttcctacggttttttaacaccaacaacaccccgcccatgaggctgacgagggctgtttgttccctccgacccacgagggctgtacagctcagctcacttacttggcctccccactttccagctcggtttgctaacccatggtcgcctcgcctcatcctctcgcccacctccataactttgcatggcctattacatgtcgtccctatccctccctaaagcaatcttcttcttcctccttcagtcacccggcctgtcgtgtcgatctcactctcagggtccggtccggtgcatcatatatacccttggtcgatcgatcgaccagatagatacactagatagctaggattgcattgtgttccaccaaaagccagccacaacacatcgacatgatgcaggacttgttctcggtcccttcgtgtttctcggcgggcgagaagcttccggacgtcccggcgtccgctgcggccaccaccaggtccgggcagagcgcggcgacgctggtctaccgcgcgggaatcgccggccacgaccgcctggtgacggtgacgtggtgcaggaacctgctcacccacgggctgaccgtgtcgatcgaagggtcggcgggcggcggcaaggacaagagcggcggcggcagggagtggggcgacgccgacggtggcgcggcctcgtcctccaacaagggctgcagcaccgcctgcaaggtggagatgcagccgtggcacttttggcgcaagtacggcgccaagcagttccacgtcgacggcagggccgtggacgtggtctgggacctcaggagcgcgaggtactccgacgagcccgagccgctgtccgactactacgtcgccgtggtgtcggacgaggaggtggtcctcctcctcggcaacctcaagaaggaggcgttccggcgcaccgggtcccggccgtcgctgcgggacgccgcactggtgtgcaagaaggagcacgtctttagcaagaagcggttcctcaccaaggccaggttccacgacaggggcaagctgcacgacatcagcatcgagtgcagcagcagcaacctcggcggcggcggcgtcgacgtcgacatggtcatcaagatcgacggctacgtcaacgtcctcgtcaggcacctgcagtggaagttcaggggcaacgagtgcatctccatcaaccagctcaaggtgcaggtgtactgggacgcgcacgactggatctttggcacgggggtgaggaacgcgctgttcatcttcaagcccgagccgctgccgtccgccaccaatgagtactctgatttctgcctgtttctgtacgcatggaagcttgagtgagctaggattcctgttcctgcattatactggacacctcaccatatatgttatgaaccaataattcatacgtatcatgtaactgatggattattgggcgatggaagtgtatgcgaaatgaatgattggggccgttttccctttcccttccaaaaaaaaaaaaaaaactatgggagtgtgttgtgcacatggaggatcggactggaggggcacaggatagtcctggggattaggaacaggcgggtcctgatacagaaacatgacag

SEQ ID NO: 2883 - DNA, 1113 bp, Zea mays
tatggtctttttgacactgatataaagcttaaagatcctccgggaaactagtggaagaagctattcaaatctctgccataaaggagatactaagtgaccgtgtggaccagaaacaagtcctcaatgcaacaaaaagagagaacaccagaaaggacaaacaagagaaaaatcttaacactgaaattgccatgaaaagtcaggagaatcagacagatgatgtgcaagttggtcatgggggtgtagatgagctggttaggagaaaagaagaaaatgacaagagcaatatttctcggagtagaacagaagggaaacgacacttggtacagcaccttgagacggagattgagaaattatccatccgatccagcccacttggtaaagacaggcagtacaataggtactggtttttcaagcgtgaaggaaggctttttgttgaaactgcagattccagagaatggggttactacaacactaaggaagagctttgaaacggcaactagagaagttttacagtaagataagtaatgccctagagaaacgatcaaaagatatcgcaaacaggatgttacttgaagagggtgtactgcggcgttccacacgtgtccgggctcagccaaaggacatggcattcctcaagtacgtcaacaagtggaaggataactgaggtggcggtctgccagcggtggtggtggtctgccagcggtgggaggataacttgagccactgggtgacagggtttgcagtagatgtgtttggtttgaggttaaagtgggatgggacgggggcgacaccgtgctctcaattttttaattttttgggatcacgccgctacaaaaaaactactctggtgtttacctcgtccctacgtgactcccatttaaccactagagtaactgtgaccgtcccatttcatcctttcgtatacttggttaggtcgtcacagtggttcgccatactcgtcgcattagctaatgaaaactgtactagaacctagttttcttccctttgctactgaaatgaacactggttcactaaaaaaaaaaaaaaaaaaaaaaaaaacttttgctgctgtgaaaaaaaaaaaaaaaaactagagggggggcccggtaccca

SEQ ID NO: 2884 - DNA, 1671 bp, Zea mays
attgagctcgagctctaccgcatcttccaggccatagacgtcgagcacaacggatgcatcctccccgaggagctctgggacgcgctcatcaaggctggtatagagattaatgatgaagagctggcaagatttgttgagcatgtggataaggacaacaatgggattattacttttgaagaatggagagattttcttctactgtaccccaatgaggcgaccattgagaacatttatcatcactgggaaagagtctgccttgttgatataggtgaacaggctgctataccagaaggcataagtaaacatgtcaatgcaagcaaatatcttattgctggagggattgctggtgcagcatctcgtactgcaactgctcctctggatcgcctcaaagtgatcatgcaagtacaaacaacacgtacttcagtcatgcatgcaattaaagatatctggactaaaggtggcatgctgggattttttagagggaatggattgaatgttgtaaaagttgctccagaaagtgcaatcagattttatgcctatgaaatgttaaaagaatatattatgaagagaaaaggagaaaataagagtgaagttggtgcttctgaacgtctcattgctggtggtttagcaggtgcagtggctcaaacagcaatttatcctatagagttagtaaagactcgtctacagacttattcaggtgaggttggttatgttcctagaattggtcagctctcaagggatattttggtgcatgaaggtccccgagctttttatagaggtcttgttccatctttgcttggtatcgtaccttatgctggaattgatcttgctgtatatgagactttgaaagatgtgtcgaagacatatatactgaaggacagtgatcctggtcctctagtacagcttggttgtgggacggtctctggagccctaggggcaacatgtgtttaccctttacaggttatcagaacaagactgcaagctcaacaagccaattcagaatctgcctatagaggaatgtctgatgtcttttggagaaccctacatcatgagggtgtttctggattctacaagggaattctaccaaatctccttaaagtggtgcctgctgcaagtattacctatctagtttacgaggcgatgaagaaaaatttgtctcttgattaaattgtggagttgttggggggaaaaacagccatcattattggcatggctgactgtagagataatgacgacacatgaattttactggttgaatagttcctttttgaagataaagatggtgccttcaatatagaactagaagcaacggtggcatttttctcctaattttgattcagcagaaatgaagtgataattatgagatcatcgagacatccatgcctggcatactgcttacgacaccatcgacaccgagttaactgttcatgaatttccgaaggcttgttttatcccccgtctggggcgagttttgttagtctgtaacactctgggaaactctcctaacttaattgcaatcccttgtgctcctcaacttgactggagctgtgacatttgctgacagccaaaaaaaaacggcaaaaagggtgctggtgatacctgtacgtattttccacggcgacttggcataaatcaatgcctagtgaatgtaataatccgcccgttcccgtt

SEQ ID NO: 2885 - DNA, 1191 bp, Zea mays
gccggccgggctgggaacagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgacgaagttcaggcaggagtcgcgagaactggaagccacttctggggattcgaagggcatggtgtcatcccggacatagtcaccatggccaagggtatcgggaatggcatacccataggagctgtagtaacgacgccagagatcgctcaggtgttgacccgcagaagctacttcaatacctttggtggtaaccctgtcagcactgcaggcgggcatgcggtgctcaaagtgctggagaaggagaagctccaggagaatgcgtttgttgtgggctcctacctaaaggaacagcttaacaatctgaaagacaagcatgagatcatcggtgacgttaggggcaaaggcttccttcttggagttgagctggtgacagaccatgaaaagaaaaccccagccaaagctgagatctcacgtgtcatgaaccatatgaaagatatgggagtgttggttggtaagggtggtttctacgggaacgtttttaggataacaccaccgttgtgcttcaccaaagaggattccgacttcttcattgaggtgatggacattgcgctctcgaagctgtgaggcaagcagggcgaagatgatgtgcaaaccctggtccgtcgccatgggatttttgcccatgaataatattaagattaatgagacagcacctcgttgtctcttaatctaagacgatgccatgtcatccggtggcatggtattcctaatcctacctgcccataaataagggacgagttgtgagacagcacctcgctgtctcgtaatcagacccatggagcaatatgattcttgtaaactctagcttcatccaatctgttcctcctgatctaactagtctgaatagcagctgttcgtttgtgaccaatatcaacttcttttcagatgctccatatattcctgctctctgtaaacaaaccattatcactgttcaatagatgcggagatgtggatataaaaattacatatacgggtactctttggtgtaccagtgatttggcaagaaagaaaaggtttaa

SEQ ID NO: 2886 - DNA, 1478 bp, Zea mays
gcactccacagttctatatctcaatcatgcaattgcagattttgccgaccgtcaatgcctggtgatctgaaggttgtttgcttcacaaattcaggcacggaggcaaatgagcttgcactgatgattgcacggctttacactggttgcaatgacattatctctcttaggaatggataccatgggaatgctgctggaacaatgggtgctactgctcaatccaattggaaattcaatgttgtccagacgggagtacaccatgcgcttaatccagaccccttcagaggtgcttttggttctgacggggagaaatacgccagagatgttcaggaaatcatcgaatttggaactacagggagagttggtgggttcatttcggaagccatacagggggttggtggaatagtggaactggcaccaggatacttgcccgtggcatacagtatggtaaggaaagccggtgggctctgcatcgctgacgaagttcaggcaggagtcgcgcgaactgggagccacttctggggattcgaagggcatggtgtcatcccggacatagtcaccatggccaagggtatcgggaatggcatacccataggagctgtcgtaacgacgccagagatcgctcaggtgttgacccgcaaaagctacttcaataggagtacctttgatggtaaccctgtcagcactgcaggcgggcatgcggtgctcaaagtgctggagaaggagaagctccaggagaatgcgtttgttgtgggctcctatctaaaggaacagcttaacaatctgaaagacaagcatgccctcatcggtgacgttaggggcaaaggcttccttcttggagttgagctggtgacagaccgtgagaagaaaaccccagccaaagctgagatctcacgtgtcatgaaccatatgaaagatatgggagtgttggttggtaagggtggtttctacgggaacgtttttaggataacaccgccgttgtgcttcaccaaagaggattccgacttcttcattgaggtgatggacattgcgctctcgaagctgtgaggcaggcagggcgaagatgatgtgcaaaccctggtccgtggccatgggttttttgcccatgaataatattaagattagtgagacagcacctcgttgtctcttaatctaagacgatgccatgtcatccggtggcatggtattcctgcttgcccataaataagggacgagttgtgagacagcacctcgttgtctcgtgatcagacccatggtccatggagcaatacgattcttgtaaactctagcttcatccaatctgttcctcctgatctaactagtctgaatagcaactgttcgtttgttaccaatatcaacttcttttcagatgctccatatattcctgctctctgtaaacaaacaattatcactgttcaatagatgcggagatgtggatataaaaattaaaaaaaaaaaaaaaagaaaaagacaagaaaaaa

SEQ ID NO: 2887 - DNA, 1958 bp, Zea mays
tcgaggccggccgggccgaaatcaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggcgccttccccaagatgccggccttcgactacacgccgccgccgtacgacgggccgcgcgccgaggagatcttccggaagcgcgctcagttcctcagcccatccctctttcatttctacgatcgcccattgaacatagtcgaaggaaagatgcagtacctatttgatgaggatggccgtcgttacctggatgctttcggtggcattgcaacagtttgttgtgggcactgccatccagatgttgttgaagccatagtaaaccaggcaaagcggatccagcactccacagttctatatctcaatcatgcaattgcagattttgccgaggcattggcttccaaaatgcctggtgatctgaaggttgttttcttcacaaattcaggcacggaggcaaatgagcttgcactgatgattgcacggctttacactggttgcaatgacattatctctcttaggaatggataccatgggaatgctgctggaacaatgggtgctactgctcaatccaattggaaattcaatgttgttcagacgggagtacaccatgcgcttaatccagaccccttcagaggtgcttttggttctgacggggagaaatacgccagagatgttcaggaaatcatcgaatttggaactacagggagagttggtgggttcatttcggaagccatacagggggttggtggaatagtggaactggcaccaggatacttgcccgtggcatacagtatggtaaggaaagccggtgggctctgcatcgccgacgaagttcaggcaggagtcgcgagaactggaagccacttctggggattcgaagggcatggtgtcatcccggacatagtcaccatggccaagggtatcgggaatggcatacccataggagctgtagtaacgacgccagagatcgctcaggtgttgacccgcagaagctacttcaatacctttggtggtaaccctgtcagcactgcaggcgggcatgcggtgctcaaagtgctggagaaggagaagctccaggagaatgcgtttgttgtgggctcctacctaaaggaacagcttaacaatctgaaagacaagcatgagatcatcggtgacgttaggggcaaaggcttccttcttggagttgagctggtgacagaccatgaaaagaaaaccccagccaaagctgagatctcacgtgtcatgaaccatatgaaagatatgggagtgttggttggtaagggtggtttctacgggaacgtttttaggataacaccaccgttgtgcttcaccaaagaggattccgacttcttcattgaggtgatggacattgcgctctcgaagctgtgaggcaagcagggcgaagatgatgtgcaaaccctggtccgtcgccatgggatttttgcccatgaataatattaagattaatgagacagcacctcgttgtctcttaatctaagacgatgccatgtcatccggtggcatggtattcctaatcctacctgccaaatcactggtattgctcgctgtctcgtaatcagacccatggagcaatatgattcttgtaaactctagcttcatccaatctgttcctcctgatctaactagtctgaatagcagctgttcgtttgtgaccaatatcaacttcttttcagatgctccatatattcctgctctctgtaaacaaaccattatcactgttcaatagatgcggagatgtggatataaaaattaaaaaaaaaaaaaaacggcggcctcccgcggatttggcaag

SEQ ID NO: 2888 - DNA, 2364 bp, Zea mays
gtttatcgtatttatatgatttatataattcacatgctctatgttctcttgattcatactggtatggatcaatttgagatcacaatttctatggttaattatttgttatatgtcatcatcataatgtttatttatggaattaaaataatacggaaaatgcctatatttctaacagaaactaacctgctcttttgtgaaatctattttagaaaataactaaattagtatatttggctaatattattggctaacctcttgaagttagcttttacaattcatatttcaatggtaccgcacttacgttatctccaataactattctatcttatcccgtaattcaaaatctactttacaaaatacaaaacaatattttctacgtccatatacaggatcccaacagtaccgggcgtacgccgacacgtttcgtcctcctatgtcccacctggcagtctcgcagcgcaaaccatctcaccaactagccatctatttataggcgtcgccatggccctcctccaacatcaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggcgccttccccaagatgccggccttcgactacacgccgccgccgtacgacgggccgcgccccgaggagatcttccggaagcgcgctcagttcctcagcccatccctctttcatttctacgatcgcccagtacgtgtgccgctcccccatcgccactccagtcttcagttctgtgggaaggaatatactgctacgaccaaaaagaaaaacaaaaaaaactcgagcccgccttcggatttcaatatttttttcggtaaaaactgcaccgattgtcgccctggtgatcagttaaaatacgaagaatcgaactactagcatttttcgtaactaaaacattttttgtttactgttttgagaaatgcggtcttcttggtagtcctttggcacagagcagcagtgatctttgtcgttttccgagaggtttgataggattgctgatactgcatgtgctctgttcttatctgaagtaaaatgagatctgagataaatatacaaaagtatgcaaccaagatctgtgtcagaacccaataaaatgtcagcactcaacagccgcaaattctgtattgcaggcagtatgactcgaacaggagtcttaagtgaatcaataaaagaaacttgtaataccagtaccacaagctgtcgagtgtcgacagcaggagtattgttttttttttcagtgactagtagatccttttgccaaatgaacatgccggatgggttgacaaatgaataagtgacaggcttttcctgggttgttgcaaattgcaatgacgtggctgcccagttttgcctgcaaacttgtagaaaatctaggttgtaccgattaatttccacttttttactaatggtcagatgcctgatttctatcttctcttcaaaagatactgtatccatctttttgcttatttttttttcctgtattaagatgctcagctttacatgctcatgaactaacagtgaaggttgttgtctgaaaacatactatatttcaggtgggcacctgaaatataacaactctctaatttccgcaactatttttttgtgccctcttagatctcaaatatatgtagctgcgccactttttctttgtttgtcagaatatacatggttactgacaacacaacatttaattttttttacgcattgccaaagtacataaacaaggtcaagattggatttctggagacagtacttaccgtgtacctaacttactgactcccgtcccattaaaaaataatgttgaagcatatatacttatataatttgatagaagttggcacaaaggaagaggaaaaaaacgctagcattttgagattcatttgcatctctgaaatgaagcaaacagcaaagtaaccagtgcatgttatcattctgtaattacttaatatatgagatcgtctgagtgcctcctgtagtatatggtgaaccccgatcaagtagtattagttttccaaccaagcaacacaagctttggccctccttccaagcaacacaagctaagagcatctccaagaaaacaagcaaaggcttccataaaccatttttatagaagaaacgctgatttccatactccaacagaatccccttccttgctcgtattttttcgcgacccacatgcgcgacaaaaaagttcccccaatcgactgcgtacgtgcgcac

SEQ ID NO: 2889 - DNA, 1725 bp, Zea mays
gcacccccgcggccgcctgcctgcaagatcccgcgcttcgcaccgcagcgcgttccattccagcttccatctgccgcctcccggcccccatcatggcgccctcgtcgcctcaactcaaggaaccgtcgtccgcggtgaagcaggcgtcgacgggcccggcggcgctgcccgagcgcacaaagaggaagacgtcgccctcgctccccgaggcctcgggtgccacacagcagccggccaagcggaagccgccgccgttccagcgcgcgtggtcccccggcgacgaggtccggatcctgaaggccctcgccacgtaccgccgtgaacatggcgggcgcctgccaacgccggttgagctcttcggcgcgctcgatggcagcctcgagaaggaaggcgtcggagcaaaggagctcgccatcaagcagcgcagcttcaagcgccgctacgaccgggacgtcatgaagaatgctccgcccgccgataaacacgaacgccgcctctacctcctctccaagcacgtatggggacgcgttccccctcccagaccaccggttgccaaggtcggaagtgctactcaagcgaagggcgccggcgcccaagcaagcaaggccgatgcccaagcccaagcccaagcaaagagcgccgaccaccagtccggcaaggaggcgctgaagcccaaggccaagactttggatgagatgcgcgagctgtatccttacctggttgatgaggccacgatccttgtcgaaccggcggtgctggagagagtgctcctcaacattgaagacatcgacgcccaggtgttggacaagaagatcaggaaggcgaggaagcagctcgccgatgccatcacggaatcggcaaggattaacgacatggaagtgcctacaatatttctgtttacatccagcaagcttcaaccagaaaagttaagagtggaaaatgagaataatcttttggttgatcatttggagaaaatggatgatgtggatatttgtgctaaacaacgattggcaagagtggaacgtgaagtaaaggagttgagacagactgtaatagcttaccagtctcaggcaaagggtataatatgtgaatcagccaagggtggccttcaatcaattgtagctgaaaatcagactccagccaatatactacaaaagaagacagaagtaccaaatgacttgatccataaaaagaatgcggcggttacatcaaaatatcattgtgccgttccccacaatgttcctcccaataagccgaaaatgcaaggggtgatgttgccaccatctaaggcgtttcctggtatgcctaggaagattgacaaaagtccgactccacgcaaagcgatttggaaggggcccatatgttgactaggttctaaaggcgacgaccaggtttcccttgtaacatagctctactgtgtgtttgactaggttttcattttggtccaagctgcacatgatccagcacagcagtatgtatggctcggacggttctgggtctcataagactaccgcaccctgtagtgggtctatattttggtgaaatatctgcaaaaaggttatctagatgttgcagatgtcctgtcaaactgatgacattattagcaacgagtgtcctctggtgcacatgcactaagattgttgaactctggttgtagtcctagttaagcaatgaagctcacatctcatatgctgatataaaaataaacaaaaaaaaaaaaaaaaa

SEQ ID NO: 2890 - DNA, 1847 bp, Zea mays
aatctcactcttcctccctcctgcctgaaaaaatcagatcccgcgcttcgcagcggagtgcgtgccaatccagcttccatctcccgcctcccccacgcccccggccccccatcatggcgtcctcgtcgcctcaactcaaggaaccgtcgtccgcggtgaagcgggcgtcgacgggcccgacggcgctgcccgagcgcaacaagaggaagacgtcgccctcgctccccgaggcctcgggtgccacacagcagccggccaagcggaagccgccgttgttccagcgcgcgtggtcccccgacgacgaggtccggatcctggaggccctcgccacgtaccgccgtgaacatggcggccgcctgccaacgccggttgagctattcggcgcgctcgatggcagcctcgagaaggaaggcgtcggagcaaaggagctcgccatcaagcagcgcagcctcaagcgccgctacgaccgggacgttatgaagaatgctccgcccgccgataaacacgaacgccgcctctacctcctctccaagcacgtatggggacgcgttccgccaaccagaccaccggttgccaaggtccgaagtgctactcaagcgaagtgcgccggcgcccaagcaagcaacgccgctgcccaagcccaagcgaagagcgccgaccgccagtccggcaaggaggcgctgaagcccaaggccaagactttggatgagatgcgcgagctgtatccttacctggttgatgaggccacgatccttgtcgaaccggcggtgctggagagagtgctcctcaacattgaagacatcgacgcccaggtgttggacaagaagatcaggaaggcgaggaagcagctcgccggtgccatcacggaatcggcaaggattaacaacatggaaatgcctacaatatttctgtttacatccagcaagcttcaaccagaaaagttaagagtggaaaatgacaataatcttttggttgatcatttggagaaaatggatgatgtggatatttgtgctaaacaacgattggcaagagtggaacatgaagtaatggagttgagacagactgtaatagcttaccaggctcaggcaaagggtataatatgtgaatcagccaagagtggtcttcaatcaattgtagctgaaaatcagactccagccaatgtactacaaaagaagacagaagtaccaaatggcttgatccataaaaagaatgcggcggttacatcaaaatattattgtgccgttccccacaatgttcctcccaataagccgaaaatgcaaggggtgatgttgccaccatttaaggtgtttcctggtatgcctaggaagattgacaaaagtccaactccaagcaaagcgatttgtaaggggccatatgttgattaggttataaaggcgacgaccaggtttcctttgtaacatagctctactatgtgtttcataaaaaaaaatatgtggcagcgagatcgtgctttgttgattctgcccagcatcgtctacatttcttgctgggtatgtcttgccgcatctcattttggtccaagctgcaccatgatccagcacagcagtatgtatggctcgaactgttctgggtctcataagactaccgcaccctgtaaatatagtagtgggtctatattttggtgaaatgtctgcaaaaaaggttatctagatgttgcagatgtcctgtcaaactgatgacattattagcaacgagtgtcctctgatgcactagtaccactgtaagattgttgaactctggttgtaatccttgttaagcaatgaagctcacatcaaatatgctgaaagtaaaaaaaaaaagggcggctgctcgcgatctagaactag

SEQ ID NO: 2891 - DNA, 1432 bp, Zea mays
acaattcggcttcgtcaagtgagagtgagacccgcgttcttcttcctcggctcttccacgcattcagaacagggaggatcggatcggagctacgatggagcaggtcgtgaacacggtgatggacctggtgatgccgccggcgagcatggtgatgctggcgttcgcgtggccgacgctgtcgttcctgcgcggcgtcgagtgggcgctcaagaccctcacgaaggaggacatgctcggcaaggtcgtcgtcatcaccggcgcatcctccgcaatcggcgagcaaatcgcgtacgagtacgcgcggcggaacgcgaacctggtgctggtggcgcggcgggagcagcggctgttcgcgatccgcgacaacgcgcggctgctgggcgccggccacgtcctcgtcatcgccgccgacgtcgtcaaggaggacgactgccggaggctcgtcgccgacaccgtcagctacttcgggcagctgaaccatctggtgaacaccgtgagcttgggccacgacttcagcttcgaggaggccggcgacaccacggccttccctcacctcatggacatcaacttctggggcaacgtgtacccgacgcacgctgcgctgccctacctccggcggagccacggccgcgtcgtcgtcaacgcgtccgtcgagagctggctgcccatgcccaggatgagcctctactctgcggcgaaggcggcggtggtggacttctacgagacgctccggtacgaggtgaaggaggaggtgggcgtgaccgtggcgacgcacggctgggtcggcggcgacgccggcggcagcaagttcacgctggaccagcaccaggaaggcgcggcggcggatcaggtgcagtggaagcagcagggagagcgcgagccggcggcggcgacgctgctgggagggcacgtggaggcgtacgcgcgggcgctggtggccggcgcctgccgcggcgacgcctacgtgaagcgccccagctggtacgacgtcttcctcgtcttccgcgtcttcgcgcccgacgtcctcgcctggaccttccgcctcctgctgtcgacgtccacgcccgcgcccgccggccccagcgcaatcgccgcgcgtcgcccgcctcccgccgcgctgcctgccccgccgctccgcccgctgctcgagtacccgccggcagcggtgtaccggggccccgcccacgcccagcaggtggtgcagaagctggaatgagacagcgcatgctgcgtgcggtcgagacagagctttcatcatctttacgttactgctgtgatgatcgatgcgacgagtgatctctgatgatgtccttgcatctgcatatatgcatgtcgacgacgccattgtgccgaagtatatatgaactggttttggcgggtgtgtttgaataaatttgatcatctagtatcagtaaattgttttttatttgtt

SEQ ID NO: 2892 - DNA, 1609 bp, Zea mays
gtttactgtagtgtagaggcggtaatggactctatattttacactacaaaaattgaagcatcgaattggattaggaggatggtaacaaccaagaaatcacaaaaaaaatggtaatataattaatgacgcaaatcaatgagtgagcaggctgcgcgcgggacatatctagtgatctagctatatatatacaaatcccacgcgtccgcccgcccggccgcccaagagatcgaggctcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcagggcagccaggccgccagggtgttccgcggcagggacgtcgatggccggactcgggacttcgtcgtcgcctggtacatcccgtgggacaacataccgacacgagcttacacacctgtgttttgatattgtaatactagtagtatacacttgattgtctcgccatcgtcgtctcacacacatttggcatgcttgcaggcttacactgaaattggcagtgaaaactacttcaagactcggtggagtagtgtcaaaacgagtctaggacattcaaggagagtgacccgtgccaaggacgagaactgtgcgtcaactgtcagcatcggtggctacactacagccttctgcatcgcagtcctacaacaccagttccagccgctgccggaagagcgcgaataatcaatcaatcgatcgatcgagtttgcgatcgtgttacctcctaaataaaagttgtacacgcgaagtactactccagtatttacatgtatgtttctagcaggtgtacgtacgctactcctgaataaattgtggtgcacgcaataaataaataattaatgctcctggataagaaacaagcaaaaaaaataaataaataattaatgctcctggataaatttctgcctaccaacgaacatgtcacacacgatcgactacaatcaaacggaagccccagtccagacctaaacgctaatcatcacacaggatgacaggaacgtatggtccatcatcacctggacgagccaacgagataccaaccgcgcgcatcagaaaattaagcacgccagtaaacggctccagccgatcaggtctgcctgctattaacgggagtacgtgatccgccgcccgccgcgcgccggcaggcgcagggcgcacgcgcaccaacaaaaatattcaatttaatgttttgctttaataatgaagatttttacttcagtcattcaatgtttacttcgaccatacaaggtttactttaatgtaca

SEQ ID NO: 2893 - DNA, 1455 bp, Zea mays
aaaaaaagagaaagcatagtcacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaggcatcctctgtggtgaaacctgtgtcttcctaccatgctatacggcagccatgggttgccaatgcattggccaaatctgcatgatgtgatatctggactagcgctatttgtaatttgtgttgggagaaacacaaggacggtacggtggtgttcaacttattgcatgtgtatggtgatctaataagtaaagtataataaaaagggatatgttagatgtgtaaaaaaaaaaaaaaaagggtccctcgagcggccggccgggccgggaagagatcgaggctcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcagggcagccaggccgccagggtgttccgcggcagggacgtcgatggccggactcgggacttcgtcgtcgcctggtacatcccgtgggacaacataccgacacgagcttacactgaaattggcagtgaaaactacttcaagactcggtggagtagtgtcaaaacgagtctaggacattcaaggagagtgacccgtgccaaggacgagaactgtgcgtcaactgtcagcatcggtggctacactacagccttctgcatcgcagtcctacaacaccagttccagccgctgccggaagagcgcgaataatcaatcaatcgatcgatcgagtttgcgatcgtgttacctcctaaataaaagttgtacacgcgaagtactactccagtatttacatgtatgtttctagcaggtgtacgtacgctactcctgaataaattgtggtgcacgcaataaataaataattaatgctcctggataaaaaaaaaaaaaaaaaaaaaaaaaaaaaaaaaaagcgaaaaaaaaaaaaaaaaaactcgggactagtctcgtgc

SEQ ID NO: 2894 - DNA, 871 bp, Zea mays
cacgcggccgttcctatctctatctggtagtataggacggagcggagctactagcaacgtagagtatccggcatgagtcctttcggggcggtgatcacgccagaaaccctcaagtacatgtccaagtaccagggacgagagatcacgcaggtggactgcgcacgggaggcgatgaggctgatccacgcggaagacaagaacctgcaagccgagaattcggcatgggaactcaagaagaagttcggcaacggcgtgagcaccatggtcctcgtctacaacgccaccggggccagcctgagcctggtggacgacggccaagactggatgggctccgtctacagctcgccgatcccggacaccttccacaacgggcagtggatcgccttcctccacgtcaagcccggctcgctggcgcggggcagccaggccgccagggtgttccgcggccgggacgtcgatggccggactcgggacttcgtcgtcgcctggtacatcccgtgggacaacataccgacacgagcttacactgaaattggcagtgaaaactacttcaagacacggtggagtagtgtcaaaacgagtctaggacattcaaggagagtgacccgtgccaaggacgagaactgtgcgtcaactgtcagcatcggtggctacactacagccttctgcatcgcagtcctacaacaccagttccagccgctgccggaagagcgggaataatcaatccatcgagtttgcgatcgtgttacctcctaaataaaagttgtacacgcgaagtactactttacatgtatgttttgagcaggtgtacgtacgctactcctgaataaatttgtggtgcacgcaataaataaataattaatgctcctgg

SEQ ID NO: 2895 - DNA, 1618 bp, Zea mays
  misc_feature (39)..(39): n is a, c, g, or t
  misc_feature (41)..(41): n is a, c, g, or t
cccggtcgacccagcgtccggttgaaagcctattacagnanagcacttatggcaccttatatcttttacgacatgtcacatggccgtgagtctcataggggtgggtcatcttcatatcagaatattcatgaagcgcagtttgcattgcgtttatatgagcaccttcagaagtttctgaaagctaatggtgccaagaaggtttctgttggtataatcacaccatataagttgcagttgaaatgccttcagcgggaattcaaggatgttatgaatactgaggaagggaaggatatctacataaatacagttgatgcttttcaaggccaggagcgtgatatcattattatgtcttgtgtccgtgcttcaaaccatggtgtaggttttgtcgctgatatacgtcgtatgaatgtagctctaactcgagcaaggagagctctatgggttgttggtaatgctaatgctctcatgcagtctgaggattgggcatcactaatagcggatgcaaaggccaggaaatgttttatggacctggatagcattcccaaggacttcttacccatgagggttccatccaatactccaggtaggaattcttccaacaacatccggaggactggtggtggacctagaccaagacgcttggacatgttctcagaaccaagggctggtatgaacatgaggcctgatgaatatgagcgtctgaattctgttccaagaaatggtagctacaggaatttggatgattttgtccaccctggagatcgctccagggataatatgcagtttggacatcctaggaggccaaatgcttctaatggtaggagagaagtctaagtagtgttgctatcaataactctggtacagcatggaacattgatgaagagctctgaacagtccaagattcagcaaggtgcagatgcatgttctgaagatcagttgcttgtgcattagattccttgcaacctttggtgggggtggtcacaataaagcattgctgtcagcggaggatgtgcgaatctaccatgttgtgacctggatcgagacacattcatgataggtgattaaaggctcatgatgtcaggtggaagaaaggctgctgtagccctcagtgttatgaactttgcaggattttcttttttagatcgaagctgtctgctgtgttttgacgttgcagtccttgctttagccagctccatctttccgtatatatgtacatgcatgggcatttccattttgctgctgcgatcgttgcatgccaggagaaagctcactggttctagatgaggataggtctccagcattgttgcctgattgttgctgcgatcgttgcatgcttgatatgtctggtaggatcagtatgctaacataggcaacgcttctgtatcatattcatatgacaaattccttctgtatacagggtcgagatctagagagaaaaaaagttcattatttcattcagctcatgttgttcccctttgttcttgttaatttgttctgtgcatattgttgtaatatgttaccatgtttgtagcactgatatttctgtttatcagtggcatgatactctgcttgtatgttgatctacggatagttctggcactttgcagagtgttgtctt

SEQ ID NO: 2896 - DNA, 1552 bp, Zea mays
  misc_feature (733)..(733): n is a, c, g, or t
ttcggcattcttgggctgcaacacatacagctgctggcacaaacaatggtgtcctaaagaaacaagaaccatggcctttcacgttggtacaaggtcctcctgggacagggaaaactcatactgtgtgggggatgctaaatgttatccatcttgttcagtatcaacattactatgctgctttgcttaagaagcttgctcctgaaagttacaagcaagttagtggtagcactagtaccagctcagagactgttgcagcagggtcaattgatgaactattgcagagcatggaccagaatctatttcgcactcttcccaagctttgccctaagcctcggatgcttgtatgtgccccatcaaatgctgcaacagatgagcttcttgctcgtgttcttgaccgtggttttatagatggtgaaatgaaggtataccgccctgatgttgctcgtgttggagttgattcacagtctcgagctgcacaggctgtttcagttgaaagaaggacagatcagcttttaatgaagggccgtgaagaagtaattgggtggctacatcagctaaaagcccgtgagcagcagctatcacaggagattgcctatcttcaaagggaactcaatatagttgcagcggctggtagatcccagggttcagtaggggtagatcctgatgttcttgctcaaagggatcgtaaccgtgatattctgcttcagaaacttgctgcgtcagttgaaagcanggataaagtattggtggagatgtcacggctgctcataacaagtggatcccccgggctgcaggccccccccccccccccccgctttaatattgaagatgctagggctagtctggaagccagttttgccaatgaagctgagattgtttttacaactgtgtcaagtagcgggcgtaagttattttctcgcctgagtcatggctttgatatggttgttattgatgaggctgctcaggctagtgaagtaggagtcctccctccattggctcttggtgcagctagatgtgtcctggttggtgatccacaacaactccctgctactgttattagcaaagcagctggaactttgctttacagtaggagtcttttcgagaggtttcagcaggctggttgtcctaccattttgttgtcagtgcaatacaggatgcatccccagatccgtgaatttccatcaaaatacttctatcaaggtcgccttacagatagtgagagtgttgttaaattacctgatgaagcctattacagagatgcacttatggcaccttatatcttttacgacatgtcacatggccgtgagtctcataggggtgggtcatcttcatatcagaatattcatgaagcgcagtttgcattgcgtttatatgagcaccttcagaagtttctgaaagctaatggtgccaagaaggtttctgttggtataatcacaccatataagttgcagttgaagtggccttcaccggggaatttcaggatgttattaaatactgggggaagggaaggattatctacctaaataaccgctggaaggcttttccaggccca

SEQ ID NO: 2897 - DNA, 1267 bp, Zea mays
tgttgaattcattaataaagagatggaaataggcaatgcggggttttattcgagtatatcttgtaagtgagaaacggcttagcaaccatgtctttagtgaacttacagattcaactgctgacttgtgcttctctgagatttcattcaactcagttgtacaacttctgagcttttatgtatctgtagcaattggaccccccaaaacagaaaagctttttcgattgcttgatatgtatgaggtcctggatgatcttctccctgaagttgaatccttgtttgaaccaaagtacggtgatatgatcctgaatgagtatcatgaagcactactgcaactgggagaatctgcaaggaagacatttgcagaattcaagtgtgccttccatatcatacacttcatccaatgcagtagctcgtggagaagtgcatccacttacaaagtatgttatgaactacataaaggctctcactgcatacagcaaacctcttgattcacttctcaaggacacggatcgaagatgcctgacttctgatattcagttgatggcaaatacatatcctaatttcacggcaacagctttgcatctacagtctgttactgcagttttggaggcaaatcttgaagctgggtctagattgtaccgagatgatcgactgcagaacatcttcatgatgaacaacacccactacatggttcagaaagtgaagaactcggatctcaaaagttttcttggtgatgactggatccggattcataacaggaaatttcagcagcaagctgtgagatatgagagggcatcatggaataatgttctctcttacctcagtgatgatggcttgtgtgcttctggtgatgctgcttctcgcaaaaccatcagggagaagataaaaaatttcaatctgtcctttgaagaggtttaccgagttcagacagcatggtctgtcccagatgaccaacttcgcgacgacgtccggatttcaatatcactgaaagttatacaggcctataggaccttcgtgggaagatattcaggctttcttgatggctcaaggcatcgagatcgttatgtaaagtacagggcggaggatctggagacacttttgctagacctttttgaaggaactcaaaagacactgcagcattcttgtcgagtgtaagattaaaccagttcttgaagaagagatgcctcagtcttttctgggttccttctttggtttgtaatggactaatggtactgttgaatgagtatagtgatatcctgttctgccc

SEQ ID NO: 2898 - DNA, 414 bp, Zea mays
attgggtacctcgaggccggccgggctcccacgtcgtaccctaaccagcccgacagccgccgccgtttctccatcttcctcgcagcgccggcactacatcttcgctcccaccccgactcgcgctcaacacgcaggcgacggcggcagcgctcaggctcgggctctcagggacggcggggcagtcccagactcggcgtcgtcgtcagcggctacccttcccgcctctcgccaatcgcctcgcgcccgcgactccggtcctccgcacaccggcctgcgaccctgccaatagtgtataacttggagatatggatttgcaagagaagacgaccccaactcataaaggaaaaggaaagaaaaaagaaagcgcaaagaaaaaagaaagagcaaggaagagaacgtcatctgttttggatt

SEQ ID NO: 2899 - DNA, 1243 bp, Zea mays
ggggccacctgcgggggtcggggtatgcatttgcctgtttgctttggaaggaacgcccggagacaacaactgtgcaagtctatccactgcagcttcgacaccgccacgccggcatacatacaaaactataaaggcaccatccatcctaacagtgactcactccattgacgatctgcatccgcctagactcgacacgacggtgccacgtcagactccattagatgtttcaacaatcctaactctattttaatgactagtacgagtgagcctagaccatgtgctagctgctgactggaactccctgcctctgtttctcagatcgtccacagcaaagctccctacttggctggctactgcttgtttcgccgtcggcgggcagggtcaaggggtggtgatgtcgtggatgctcttgcgcttggagttccggctggcggggttgaactgccggttgaagtacttctgcgcgtggctggccacctgcgtcggcgtccgcgtccgcaccgagaagcgcgagatgttacgccagtccccgcgcccgtacttctccagaccttgaagaaacagcctgtgctcctcctcgctccagggtatcccggggcgccgggcctcgcggcgcgcccggtcagcgccggcgccgcggacttggtggtcgccgtcgtcgtcgtcccagcagctgggcgcgtcgaccgcgccgcgctcgatgaggtcgacgtcggcgacgagcgcctcgtagtgctcccaggcgtcccgcggcgtgcgcccggggagctgcgccgcgacgagcgcccagcggtcgggcgtgtgctcgggccacgcaaccagcgcgctctcgaacaccttgtcctccgccctgttccacggccgcgccgcagccggtaccgccggtggccccgccgcgtggacgctgctgctggggttgaagtcctccgccttgatccacggccgcgccgctgccgcgtgcgcgtggacgctgctgctgctgctgtggtggaagtccatgcccgtcgactcaaacaaacctccgctccgctggtcgatcgacacggtcgctgcgttgcgtttgcgcgcggggagttcccggcccgctgtctctcgttcgttgcggctgtggacggatgatgggtcggcggcgccgtgtgccgctggttttctccgcgaatttataaagattcgggtagtgtgggccggtgaggtgaacggaaccgtacgcaaattccgccccggccggcctcgagggacccaa

SEQ ID NO: 2900 - DNA, 2918 bp, Zea mays
gcttgtgtcaattcgaccttgttgcttcgttggctgaccgatcagtgatgcttgacttggttaagcagcacctcgggctcaatcgcgtatgaaaaagcaagctgacaaggggcgttctgagcgttcatttgtagtcggggattcaatctatgtcaagctgcagccatacattcagagttcgctgtctcgccgctcttgtcaaaagttgtcattcatgtacttcaggccttttacaattgtctaagatcggcgccgtcgcatacaaattggccctgccggcttctactgttgtccatccggtcttccacgtttcctagttaaaatcggtgcaccgtcgtccttataaggtcagtcctgctcttcctggtaacctaacaccgttgcgaggagtgcctctccaggttcttcaggaacgacacgttttacgcggcaacacccgcacccatgaacctttgattctttggtcacatcttccacgtgagggcttgtttgggtaatctcggattgaaatgaattgaggtggtacgaagtgtgttgaagtgtaatatgaactaaattctttttcaatcctttgaatacatctcaatccacttcaattcctctttacccaaacaaagcctgaattggagacatgggaggatgtcgtcgtctacgccaggattttcccacagctccggcatggggacacgtcggttctcaaggaagagaggcgacagaaggtgggtcgtctgctcaggaagtggtcgaagtcggcccacatcgaggctctcgctaaccccgacccagcacaaggctgagggaggttgtctgatggcatatattatagggataagagagaagaggaaaagagttttaccatggatgtaataacctaaatgattcggaactaaactcccttccgcgcctacatttttcttcctccccacgtctctccttctgctgctaatcgtctttctcaccgagcgctaccctaacactttctcaccctccccgctcgagaaatgcatggctagttgagactagaggctctggcaagcatgctggccttcatccgtcctctgtttattggatcatataacgtagtatcaaaaatcttagggcttgttcgatttggtctcaatccatatagattaggtggaattgagtgagtttaaattccaaacaaattaaaatctttgatattttttttttctaattttatctaattcatatgggttaggaataaccgaagaagatcaccatatggggtaatttttttttttttttttattggaaatccagacaaacttgcaaaacttatttattcgatagtcattgtagtgccgcttaatacagttataccggaccccagattccagccaggctagcttagctttgcctacatttctacaaccacagggacggctgtttgtttttttttgttcccgtctcgcaaaggtaaagataaaatgcaggtagcagcagtagccaggtctggatctctcggtgctagctttgtcctccacgagcaggagccatcacggggtggtgacgtcgtggatgctcttgcgcttgctgtcgccgcggctggcggcgctggcctggcggatgaagtacttctgcgcgtggctggccacctgcgtgggcgtccgcgtcttcaccgaccagcgcgagatgttccgccagtcgccgcgcccgtacttctcaagcccctccagaaacagcctgcgtcgttgtgaggagaacacggaatcagtttacctaccataccagcagagcagcgaagagagggagagagagataaaggtccggtgggccagaggagtgcgtccggcgtggaaaggtactcggaaggatctaggacgacctcagagaagagaaggcacgtaggtggaatgacagggtggggaaaaggacaaaagcaggagtatgtactgctatacgtcactcaagacagaagagtgttcgaaggcgcgcggcgcgtacctgtgctcgtcctcggtccacggcaccccgcggcggcgctcctctccgctgccgctgccgcccccgcggccgcggcccgagcgtccccctccggcggcagccgcgtcgtcgtcccaggagtccggggcctccaccatgccgcgctcgatgaggtcgacgtcggtcaccagcgcctggtagtggtcccaggcctcctgcggcgtgcggtcgtacagccgggacgccaccagcgcccaccggttcggcaggtgctccgggaacatcaccagcgcgccctcgaacaccttgtcctccgccttggtccatggcctgctgccgcccggcgccgcccacgccgacgactgtccgcccacgccgtagtagaaggccattgctgcgcgcgttccctgacggtgacggtgacggctgcctggagatggagctggagcttcgcgctttggagaactctggttgctggatcttggcacagaactggaggccgacggccgccttttatagatttggagcggggccgggccgagtggagggcgatgccattctgtgtgtgtcgcgcacgttttgggcgtgagaagctggactgtggcgtggcaccggataagcgcacgcgtggccggtacccctgccaccacccccacacccagagtagtggttaagtgcactcattaacccgtggattagaagaatagaggtgcagcaggggggaaaaggaatcatccatgccttttgctaggagagcagtgatgatttgaggaggcaaataaatgagtcactgtcgtctcgctgatgccttgacggaatggcagcgtgtaaagctaaagcgatcagctaggactaggagggaggaatctggttggagttttgcggccgccagtggttgttggttttcctctttgggtacacgcactgtggactgcaggttgagcacgaatgccggaagtggtatactggcatat

SEQ ID NO: 2901 - DNA, 1362 bp, Zea mays
acctgatcttttttgctaaaaaaaactctagaaacaaagacagagagaaaaaagaaagctaaggagtcgaagaggaaaaggagaggtggccaggtggtggtgggggacgaccggacgaggaagtagtggcctgtgcgtgccgtcgcggaggagggggtggcgatggagaagggcgcgggcacgcggcggcggcggctggtggaaaggggatcggatcgccttgccttcatcaccggccagacgcgcagcctctcctgcgacccgattccagattcaccacttcgttcacagtttgaaggtggcactcgtgatgatgggttcagcgagagaaatcagttgcagaagtcagaacctagcgacctggtacctggatttcaagatcctggtactcgccaaggagtcaaggctagaaccttaagctatgatgccctggtacctgaatttgaacgagctggtggccgccaagaaaataacgcaagtaccttgagctatgaagacgaacttttccgcaaatttaagatgggcagtgcagtccctgaaattcagccagtaaatcaaacaccattgcatacccatgatcaggaaactgtgagtaacaatataattcatgctggagttagtaagaatactagtcatgatggagttagtaagaatacaagtcatgatgaagtggcaagtgtccaacctagcagagaagcggaaatgagacccagatctgcacctccaagccaatcaacccaagcggacaattcaggttggtctgtggaaactctgatggaactcttagatttcactccacaggaaataaccaaggccatttcggcgaccgagagtaaccgtttcgtagcatctgtcgtcattgctttcctggtggttctgtcaaactggggccttgacattggtggtgccatcaccagagtattagttggtacaaggcctcttctatttctcattgtaaccaacatcaccattgtcttcacattgttgatggagaacaaagaccccaatgtgagaagcagacccgttggcgtcaatctgggttcagctgatagcttagggcagatgctagagatcgggttgctgctacagaaagcactaggtgctctgctgattgactgcagcgtttgcgctgttattatgatatgttttcttggattctgagggagcctgggtagaagtctcacagaaacctttgtaattttttttgtctcatgctctggactgttattccattttgtaacatctcattttggctgagttctaatttatgcacccatgttttctgtttttaaaaaaaataaaagataacaaaaaaaaaaaaaaaacaggtcaatggatacagactacagagcgaagagcgaa

SEQ ID NO: 2902 - DNA, 588 bp, Zea mays
aagaggaaaaggaggagaggtggccaggtggtggagggcggtgacgggacaaagtagtggcctgggcgtgccggcgcggaggagggggcggccatggagaagggcgcgggcacgcggcggtggcggctggtggaaagagggtcggatcgtctcgccttcatcaacagccagacacgcagcctttcctgcgacccgattccagattcaccacgtcgtccagagtttgaaggtagcgctgaaaatgagttcattgagagaaatcagttgcagaagtcagaacctaacaacgacctggtacctggatttcaacatcctaatactcgccaaggagtcaaagctagaaccttaagctatgatgatctggtacctggaattcaacgagctgatggtcgccaagaaatgaaggctagtaccttgagctatgaagatgagcttttccgcaaatttaagatgggcagttcagtccctgaaatttagccagtaaatcaaacaccattgtgtacccatgatctggaaactgtgagtaacaatgcaatccatgctggagttagtaagaatacaagtgatgacagagttagtaagatgaca

SEQ ID NO: 2903 - DNA, 664 bp, Zea mays
gcgtccggaccgccggcttgcattagtgattcgaaggctgcagcctgcttacggccccaggcaaagtccttggctccgcgcaacattttcatgaaagggagacaccgctcggtggaccgtgagataaatctgttgaacgctgcgagtcttcctgtcaatcattggacatctcgggtcgactgaggtggagccatgtccattatggtctatatcttacttgggtttgcttctatgcctctatgggatactagatagccaagtatcttgccttgccgaatgtcgaatatgcacttttgggggtttaagcaaagtctggcttcacgcatgttggcgaatgtttctgtgaggtcttagagattgtcttctttattcttgcttgcgatgactatgtcatcgacgtaggtgaaattgttgcgacccatcttgctctctagaatgcttttggtagccttgagaaggtggagccgacgtttttaagccttcgggcattcgcacaaagcagtatgtgccgaagggtgttattaaacttgtctttgccttgtcctcctccttcatgtaaatctggtggtatcccgaaaacaatcgagcagggacatgacttcgcatcctgccattgagtcgacaatattgtatattcttggtagggggaaattgtcttttggcc

SEQ ID NO: 2904 - DNA, 3702 bp, Zea mays
  misc_feature (3172)..(3172): n is a, c, g, or t
  misc_feature (3683)..(3683): n is a, c, g, or t
gaaaacatattttagctcaacatacaaatggtacggcaaaaacagtacatgcagtgatgcagcccaaaacaacaactattatgttttagttcggacatagcttctacacattatttaactagttctctaaatcatattactagattaacttgcttgacgcctaaataaaatcgcatagaactccatacagccactctaaaacacctacggacccaagatactcacctatacattttatcggattgttctccgagtttaacagaaatcgaagtatcgacactactcgcttccaaataattttggggcagcgatgatattcacacagtatctcaactcaatcgagatggtatttacctactccctaagtataaaatgtgataactactaaagcaaagcatcgattcaccaaatacaattacacatgcatgtatagaaccgatacactctacagacgacattttaccagcacattctctcacatgaatctacaccttaaacccacatctcacattaacatggcgttcccttttcgaccacgaatactatcacacatatatgcacactgcatacaaggaggcagtttattgagcaatgtatacacttccactacaccctcaacgacacatatatacatgacatcgatcaaaacatatttagaacaactacaaatcacacaaagcgaacaacctggcggaatgaactcggatcgcgcacgcatgccatcggtgaggcgttccgtcaaacaagtgatgcgcgaggtgcgaccacgacaaggactgcgattaaatgacatacacggtaattacacataggcccgaccctgagggtaggcagggtatgccgccgctcagggcccccaaagttagtagggcccccagtccgatctaaatagatatatactcttatatatgtatggtatatatttattctattcccaaaatctctagccgctgctcgctggtaaccattgttaaagatattgcaaatgattttggtgtaaatacatcatttccaataaagcgtaaagcggtgagaaagaaacaatttgatgaaagtaggcgccacgaagaaattctagaaaatgagagagcttttcaagtcaactattttttggtattagttgacatggcgagcacttctttgaggaccagatttgaagaactctccatgtttaggtatatttgggtttttattgagctcaagcacactaagctcactaaatgatagagaacttgaagagttttgcactaaatttgcaaacactttctctcatgatggttcatgtgatgttgagttaaatgatttgatttctaaattgaatattctaaagtttactttgcctaacgacacattatctgctgtggagatttttgagcatattagagttgtggattgctatcctaatgcctctattgcttatagaatattatttactgtgtttgttactgttgcatctgctgaaagaagcttctcaaaattgaagttactgaataattatttaagatcagcaatgagtcaagaaaggttgaatggtttgacgcctttatgatcgagaagaagctattgaatgatatcgatatcaatagtataatcgatgattttgtatcaaaaaatgttagaagaaattttataagatgagaagtgacaagtaaatttttattatttcagccaatgttattttataaacaataatgtgtaatattctatattacagtaacttatatacagtttctttactgatatgtatttagtagatatgtagatgatatatacatatacctagttatatggggcctctatataaatttttgcttagggcccccgaaatgtcaggaccggccctgcacacaatacaggcatctctctcctcgcgaagtcgacgctcgacgatgaacatgccattcctcactccacttgtgcgcctccacgctataaaagcgcacccgatgaaccccggccgggatccaccatcacacagcaatccacacaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactggttgtgcagggtcatcgtacttggctatcgtacgtgcacgcactcagctcctgtacgaattacgacaataagctcgtgacctgaataaaacttcttcgtaatactaatacctaaaacaaaaagcagaccagccgcctcaaaagcggccaatgcaattttaaaatagtactaagccaacaaacgatcataaatctaaccgaatttatatttaaaaatatgttaatatttatcatactgaaaaagtcttattatatccgtcagtcaactggctagtatttggtttagcctttggaattttcattctgtttcgacgacatcaaacttacacaaccgactgaacgaccgatgtctgatgattctaccaagtgaggaggcctaagtgatatgacgcttggtttcgaccttggaatgagcatactacttgccagagacagggaagatgatggcaacgattcaaagacgacgagtttcttatcaagaaagtaaaaaagaggaacataaatggggtgtttgcttgtaatgactaaagttaagccggtgtcatatcaattgtttgaatgtctattacaaatatttaatataatttaattataaagctaattatacaactaaagactaagcgtcgggacaaaatttttttatgtctaattaataaacgattagtaaatatttactgtagcatcacgtgaccgaatcataaactaattggacttaaaagacttgtctcaccgttcagttcttatctttgtaattagactatctttgtaatcacntgaccgaaccataaacaatttttaaatctaattaacaaacgattatcaaatatttattgtagcatcgtatgtcggaatcataaactaattagatataaaagacttgtctcattgtttagtctttatctatataattattccggcgcctgggctttggccctgtttggatccttcaagcccggctagagctagagctaggttctagctctaactctagcccaaactagctctagccctctacgtgtttggatccaagggctagtttacaataaatgctattttataatcatttgtctcgtttaaacctttccttatccggatttagtgtggcaaactcttgtgcggcttctcccacacacaaataacacaaataaatttattttcacaaatcaaacatccaaatcacaataaattagtaaattacaatagtcgaaaatgcattcaataagaaattagacaaaacaaatccgttgttttcctgttctttccaatgtggccagccgtgcccctncactacctttccatggatc

SEQ ID NO: 2905 - DNA, 747 bp, Zea mays
gtgcggcgctcgaggcggcgggctgggaagaagcacactgcacacacaatacaggcatctctctcctcgtgaagtcgacgctcgacgatgaacaggctatggctattcctcactccacttgtgcgcctccacgctataaaagcgccccccaggaaaaccagccgggatccaccatcacacacagcaatccacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcagggagagcttcctcgccagggctaactgagcagcccgggcggccggcatccacgcccgttcgtgcctgcctgcgtgccttatgtatgtctgtgattgtgcagggtcatcgtacttggctagcgtacgtacgtgcacgcactcagctcctgtacgaattacgacaataagctcgtgacctgaataaaacttcttcgtaatactaataccaaaaaaaaaaaagaagccaacgccccaaaaagcggcc

SEQ ID NO: 2906 - DNA, 2417 bp, Zea mays
cgccttcagccgaaccgagctggctcgttatccacccctaatctcactggcagtggcaggcaggcatatggtcgagaaggactaataagagatagaagatttatatacccggctacataattatagccaataaaaaatgtcgtattatctgtattatattattgagctgcagatgcgaatggccgccgctgtgtggccatcttgttgcctgcgtatcacgtagaggcaaaccgggtcggcgcaccacaaccgcagacggtacacatctgtggcctggcctgatcggcggcacggacggcccgcaagcaggatcgtctccaccgaccgaccggacaaactggcgaataggagtgcaagaaggctagggaggagatctcggcatcggcaggcagacgacggcgacgtaccagccgaaccgggatgccgagatggagattggaggtcggcggccgggtgcgtgcgccgcgcgcgtggccgcgtctagatcttgtacggaaagtatatatgcacaagtgacttgtggagcaccgttagcttagggcatccggactccatagtgaaagctatcgactgcgataatggcgtggacagaaacgggcccagacatttgatattgggtattcaaaaattcaaaagattaaagaaattagtgctctaacactattttgtgtaatacattattggtaaattactatagatcacaaaaattttgggtattcaatgaatacccatgaataccccctgggcccgcctctgggcgtggatcggagcagtctgcagtccagtccagtccagtccaggcataacatgtatttttagagctagctagtttagcaagcccattaatttttgccaatatatataatataattgtgcaatatatgttctctattttaataacatatttacttcttcctatacatccttcttgttttactagagagagccaaaaggtggaagaggccaacctagagatagtaatggataacgattttaaatgtttttcttcacataagttaagttccttaaataactttaattttaaaaataaataaaaaaaattaagaatagagtccgattttaatctaatttgattattaaattttatagtataaaatgtaaaacacgttagcacccgtaccactaccttgcgtgcagttatctgttctccaccctccacgtcggtttcaaagcatcaaatcgctagtacgaattgcctttgacatgttattagtatatatatgatgaggttgttttttctacaccaccatttcgccaatcccagccccacagaatcgctttgacacgttattagactgttttgacacgtctccacttcaccagtaaagtcgtcttcttcttcttcttttttttttttttttttttgcttcggctccatgaacaccttcaccaatgaatttatatataactggtataattgtccatccgttcgttcgtatataaatcattttttagagttgactgtcttgagttgctttaggttcgatcgaatttatataaaacgatatgaatgtttatgataataaattaatattatcagatgcgtcataaaatatgatgccattagcgtaatagcactgtttatttggtgtcatatatgtttgtttgcctacttgacgtacaaatgcagccgtatgtcctgcggtgacaaatagattgttatttgattcatgacacttgtgaaaggaagaggctctttttttttcaaatggatagatcgccgagcaacagggtgcaacggacagaaactgcctacttgtcgatcccttccggcggcagatgaaactgctttcggctttccgatgacagcaacggtttgatttctttttttccacggaacaaaggaatggggttgcttgttttggttgacgacgatcactgagtcagttcagttacctactttgctgtaaattaggaaaggagataacagttcttttatttactttttttctatcgtttctataccctctatataactcatcggttcaaacatcactaactgcacacaatagattacctcggtcaaatcccacctagagatggcaatgggtcagctggtgctcgggtggagcgaaaacccgcctaggaattatatctacggattctaagtcttttcacgttgagcaacaacaaagcattccatgaattattagcttagttacttattcaaaacaattactattgtattttaatcattttttgcacgaaataaagaatgaactaaatttcggattgggtatgggttactcgcgggatgaaattgaaacccacacaaacacccgcgaaacttcaggtcgggtgcaggttgcacccgcgtgtcaaaatctgcactcgtacctgtacggctgtacccatcggtacaggtaccggttgggctttaagtttacggattaaat

SEQ ID NO: 2907 - DNA, 2410 bp, Zea mays
ttgagttcgactttttttttaattatatagtgggaatgacctgtttgagtctatgattggcaggataattggaataatttggaaaaaccctatggaagcatatttttaagtattcctacagttcttgatccatcattagctcccgaaggacaccatatacttcatatatttactactgcaggcatagaagcctgggaggtaaggacagtgttcttattgaaatgcaagtttcattgatattgagataccatgtattttagtgtcatttgttttcatctttgacagggtatttctaggaaggaatatgaagagaaaaaagagatggtggccaacgagattataagaaggcttgaaaagaagttgtttcctggtcttcaagattcaatagtcctcaaagaggtactttcctgttttcaattttattctattgttacgttttccacagtttgatttttatcaattctttataaactttaaagtgccttctagcaactgttaagtagttgatgatgaaagggagattgttacatgcttaattatgtactccctctatcccaaaataaaattcgttttagggcattagtggattcatacaatacttgatgtatgtgtttattatatctgtctagattcattataatctatttgaatatagacataaaaatgaagagttaaagcgactactattttggggcggagggagtatatgattatggatcataaaagttcacatattatatttatcattttttatgactttctcacggcatatctttccagtatgtggatacccccctgaggagagtaatgaccactgacacaaatctcttgagcaaactctttcaaatgacccatatcaagtaattatagtgtgttttccagaccttccttttgggtgcagcttctttatgggcaattgccaaagcgagttgaattgtgagttaaaaaaatacccataatttaactcacagctcaactggagaaatgaatcacatgtctagcaacatataataccacagaaacttttgtagcctagtcacatgtgctttagttatatgcagcaaactttaatggaactgttctgactgctgctatcagtaactcttctaatcaaaacttgttttgtttcatcaggtaggctcaccaaagactcaccggagatttcttgctcgaaatgatggtacatatggaccaatgccgcggggtaaacccaagggcttacttgctatgcctttcaatactactgtaagtatcagaaatcatctccctttggctgacttgatatactggatgtcttcacaatgttatatgatttttggaactgaaactgggcttctcaatttacagtcaatagatggcctttactgtgttggtgacagctgttttcccggacaaggtgtaatagctgtagcattctcagggatcatgtgcgctcaccgagtcgctgcagatattggtaagttaattttactgtgtctgtcactgaacagggatagcttaatgtttcagcaagatagaattagtcacgtgcttgctgctaggtcttagagagctgaactctcgacgaacaatgctacgagaatggttcgtgactcacaatttctttttactgctttacccttattccaggactagagcaaaaccctcccgcccgagatgctggtcttcttgggctactcagatggttgagaacacttgcatagaacgatatcagacagttgaaaatggacttcatctttttccccccggaaggctgatgtttcaccagagttaggattctgcacgatctgttatgatgatcttgttatctgtaccatctcagcatcgatttcttgaaactcctaacggaaaaaaaaaggaatacgaatgggtgtacaggtttcagattttgaattatatgattacggtgtcagggccatggcatattggtatgcatataaagactacatcatagagtaaccagatggtgtacatcatctgattaccgcaataagcagagcactacatttgggagcaatgtaaatcatgttacctaggactttgaaagttctgtcttgagatacccttcaactttctgaatatgcataagcttcattgttcttaagccatgatgaaacctagaatgacacatcgtctaagaaaatttaaaactatgatgaaatagtttcacatattgcctagttttatctttgttgtttcttagggcattgtttcctaggctacacacatttattgaaaacagcatacgcaggacacagatactaatattttgaaaacagtatacataggattttatccccatgatttctatttcgtatctgtcatctatttaatgcccacggaaaaaagagcttagtttgtcatcgaggttgggctagcagcatgtgatcgccatcatgagcacctgcag

SEQ ID NO: 2908 - DNA, 1080 bp, Zea mays
agagcctcagaggggggagaggaggctagtagggatagcgcatcgtcatcgcacctccacgcgccggcgagccagaccaccagaggcagcgagcaggcagcgatggcggtggcggagctgtgggagacactgaagcagtcaatcgttgcatacacggggctgtcgccggcggcctttttcacggccgtggcggtggcggccgctctgtaccatgtcgtgtcggggctcttcgcagccccgcccccgccgccgccgcgcccgcgggaggagcccgaggcggagccgctcccgccccccgtgcagatgggggaggtctcagaggaggagctcagccagtacgacggctccgaccctaagaagccgctcctcatggccatcaagggccagatctacgacgtcacccagagcagaatgttctatggacctggtggaccatacgccctattcgccggcaaagacgcaagcagagccctagcgaagatgtccttcgagccacaggatctgaccggcgacatcactggcctaggcccgtttgagctcgacgccctgcaggactgggaatacaagttcatgagcaagtacgtgaaggtgggtactgtcacgaagaccgtcaccgttgaagaccgcagcagcgccgcaagcacagcccctggaaccagcgaggccgccaccgaggccgagaaggcgccgactacgacgaccgcggaggctgtgaaggagaaggaagccgccgccgccgccgcaggtggtgaaggtgcccaggaaaactagagcatttttcagtatgcagcaataattcgacatggtcccattgggttcgtgtcggggccctctcgtatatcgtatcagcagcgtggcctgtgtaactggatatacgtcatctgtacgagcgccatggcccttgaggagctggtgctttgtgttgttattagtcgtccgttgcagattttaaagacatcgggttcaggttgggcgcccctggccctgtttggtcggaaaacaggtgctctttcaaaatgagttatttctttgtaccgcaaaaaaaaaaaaaaaaaaactcgagggcggccccggtacccc

SEQ ID NO: 2909 - DNA, 5355 bp, Zea mays
ctgcagacagccttataactacttctccaacttttcagatgtaactatatatttgcttttttccccctgatgatggagtaatccttgtgacaagtgctcgacctcgaaattttaaggttctgaatgcattgtccatttgagttttatgatagtgtcgtttctgtcctttggatgatgggagtaatctaggttataaatctgctagaatttcctgtttaatgtcttggcgcatccggggagtcagttgcctgggtggcatcaagacatggaaactatcaattaattgctttgttgtttgttatgaggacgtgttgcagcatatgtaactgtctgtagctcagcttgtcgaggtaaaaaaatcaggatcattgaatttactggtcacggcaacatggtttggttgattaatagttgtaaaatatgaagtaccactgtaccactatggttagctaggggatgccttttttttggtaatgggtgaaaatttattgtgtaaatcacaggcagcaggttcgcaagatactttgggggccttgatatcaatcaattccataagctgaactttcctttgttgtctggatgccttataaagcagtatatataatcaatttctatttgattggaatctttttagcacaagttaactgtatgccagctgagatgatggctttagagttgataatggagagtatatttggtgatgattaccttatttgatatagagtttcaatgctcatatataataaaaagttaccggatttttagcttttgcgcttcaagtatcttttcgtctgtgcataagctgggttctattgttgcttctgtaatttgtgcactgtgttccattgttgcttctgtaatttgtacattgcactgttcctggacttttgatatagataggcttcctaaacaaacaaacaaaaaatgttgtgaccttttttcttgtaaagtggttcctgatttcaacgggaagatgaagcgctacttctgcacatgcattttagttggcaccggttgcccggaaggattagcgaaagctgttttaatggtttttcttttatgttgttttattctttctttgtagaagttttgtggttaggtcttggcaatggaataagtaagatatgtcatatgtcttagctagccctttggtatgcaagatgtagttgcttgtgtacgcatatttttgtggtggccgatgcgttattcaaactttctagatctgttgtattattattactatgcacatctatcttcgatatttgtgcagtgcacggctgtccacgcgaaacacatgcaaggcgaagggtcacttttgtattacgcatgctttatgcatatcttattcaagaatagttgtgctgatttggacagttgtgaatcaatctctctcagtccacagccccgcccttcttttacttttacatgttgaattgctcgtatctacgacgtcacccagagcagaatgttctatggacctggtggaccatacgccctattcgccggcaaagacgccagcagagccctagcgaagatgtccttcgagccacaggatctgaccggcgacatcactggcctaggcccgtttgagctcgatgccctgcaggactgggaatacaagttcatgagcaagtacgtgaaggtgggtactgtcacgaagaacgtcaccgttgaagaccgcagcagcgccgcaagcacagcccctggaaccagtgaggccgccaccgaggccgagaaggcgccgactacgacgacgaccgaagagaagccgagggaagtgccagcggaggctgtgaaggagaaggaagccgccgctgccgccgccgcggctggtgaaggtgcccaggaaaactagagcatttttcagtatgcagcaataattcgacatggtcccattcggttcgtgtcggggccctctcgtatatcgtatcagcagcgtggcctgtgtaattggatatacgtcatctgtacgagcgccatggcccttgaggagctggtgctttgtgttgttattagtcgtccgttgcagattttaaagacatcgggttcaggttgggcgcccctggccctgtttggtcggaaaacaggcgctctttcaaaatgagttatttctttgtaccgtaaaaaaaaaaaaaaaaaaaaaatactcaatttggcggcccgctcgcgtgctagaacgtgcggcctggtttgaagaattagtggggattaaattcaaaattaaatagaaagatatttaatcttctctgatccttatgtcagggacatggccttggtgggaatgcaatcataggggtggttgggtactcctataggaggtcaatgaccgcagaaagctttattagagcacctccaacagctccccaatcagtacctttaaaaccttgatttgaaagaatagcaggaaaaaaaaaagtatctctaacagctctgaatgtgtgctcccaatcagagctacaacggcccaagagtgcgattatcagcgaggagaactgctacgctgccgccagtttgccgcacttcggtacttcgcgttcaaccttgggtctggagtagcaggacagcaggttgccgatgagcggaagcggccgcgggcccggcggccgacgcccggaggagcccagcggcggtgccgggttggtcaggtagcagagggtcgagaagacgagcatcgtcacccataggcaccagagctcgggcgtcgccatctcttgatctttcgctcgtctcgtgctcgcatttgcaacgcttggaatacgtgttgctgcatggaaatcgtggctgacctcgttggccaacccaaggcaacccccccccagatgcttggcttggctggtgaccgaaatagaaacatatatattgctctgctacttcactccagtcaacaacaaacaaaggagcagaatcacgggaataggacctaggcggactgtttttcgaacaaaataaggagctattggagttttagtatgtttttttttggggtttctatagtttttggaagaacccgatatagcaatactggaagaataaatattgagagctagatggtcttaaatagtccttagtactatttgtttgtagaactgtatcttctaactttaagatgcaaacatgcggattttccaaaaacccgtttagctgactgaagtttgacatttataattttaaattctaaatcgaaatacacaaaaaccggaccgattttgtaccagttcttttatatcggttagtaccagaaacggtaaattttatcgaaaaccaccgcacgcacatacggccaatgtcacgggaaagaagcccgtgcgacaggcaggcgggccccggtgggcaggagagcccgagagtgtggccaccacgccgacacgcttcgccgctatcatcaggcgcgggcgggaggcgggccatgcgaactcgtgcgcccacctcgcaggtcgcatcacaggccatacaaaagacgagagagataggagcggcagccaccccccaaacttgaggccaccacactcccttcctccggtagtacaaagagcaatccacatgagccctccacattttattttaccatttaccgttgtatcaaaattcacggtaagctttcattaagatacgatacgatctttatatatctaatcacaggaaaaatgtaataattgtgtttgcaaaataaatatactatggtttaaacacaaccaggtgtctcacaagagttctgtatagaactaattcatcaggataagtttctaaaaaaacctagtttggcagaaaagaagaagtccaaggcgatattctctccattggctctatgacgaaggcccatacgtagtatttttttttttggtagcatagaaaattccgggccgacccgaagatctagtttagtagttccaacttccaacgcaccaacaccacgtgagggccccacaggccatgcggctccggctaggcggctacccaacaacccctcccataacctttggctcccaagctgagcagcacagctttcttccttctcccgcatccaactcgttcgttttattacctcgagccaacgcggcgggaccgaaaccaattccacatctcctccccctccctccctcccaccgaggactctttcccaagacctgccccgagtcctagttcgggagagaggtcgagggaggcagcccataaattccttgcccgcgaaaatctctcctcgcctctctctctatatatttccgcttatctgcccgcgcaaatttcttgccgcattggtttggttttccggctcggcaaaggagacggcttttctgtctcccgtgacctacatgatggcgagcacggctccagcggcctccaccgccgtggcattcggggcagccgccacgccgcggggaccggcgtcggcgtcggcggcgctctgcgcgagggtgcctgccgctgccggcggcatgcgtcgctccggggtggccgtgcggtgcgacgccggcgccgacgcccaggtgcgggcggtggccaaggcggccagcgtcgccgcgctcgagcagttcaagatctccgctgaccgtgagtgccttgcccctcgcctgtgtgactgtgtcatcgaatccgccgccgctcttgctctttccagtaataattcccggattgtgcgctggatcggttgcgtcgcttcgaggctgttgctgcagttggggttggttttggtctggtacaggtcaaaagatctcggtggtttggggaaggaaggaaaaaggagtagtaggtgtgaactttgcattgtcccgttgcaactttgccttgaccaagcataatttgaatatgtggagtaggagaccggatcgcatggcgtcgaagagaaattagcttgtgccattttgcaaggggtcgtggggatgatgaaacttctgggcatcccgattcgaacttcgattgctttttttttaacctagtcagactgacaacagggaaacggaaagtaacattcgggggttttgttcaagcagttaactgattgtggagctatatgcttcacaggttcgtggagcttctgtttgtgtacatataaaaaacttaatgactatcgtatctatatccaccaaaacttcatgttgtaagaacctaggagtaaatgatagactatgcatatttaactgtacactcctataaggaggagaaatctatatttaataacgatgccaaataattaatattcatatgcttttgcgatcagctattgggcatccattttgtgcagaaatgttttgggggttctcttgctgtggtcatattcatctagtgcgagcatgttattttcaccctctagaatttgcttggataaacatcttcacaaataaattaagaaagctttac

SEQ ID NO: 2910 - DNA, 1306 bp, Zea mays
atacacataggaaggaaacttctacattcacaattttcaatggaagattttcccacgaaaaatcagggatcggatcccttctcatttctagtccgagatcacccctcttcataaaaatgcggcccccgcggcccgccggcccggcattcactttccaagttgtccgaaaagaccagactaccctgttcccccgaagtcagagggggagaggaggctagggatagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggctgtggcggtggcggccgctctgtaccacgttgtgtcggggctcttcgcggccccgcccccgccgccgccgcgcccacgggaggagcccgagacagagccgctccctcctcccgtgcagatgggggaggtctccgaggaggacctccgccagtacgacggctccgaccctaagaagccgctcctcatggccatcaagggccagatctacgacgtcacccagagcagaatgttctatggacctggcggaccttacgccctgttcgccggcaaagatgccagcagagctctagcgaagatgtcgttcgagccacaggacctcaccggcgacgtctcgggcctaggcccgtttgagctcgacgccctgcaggactgggagtacaagttcatgagcaagtacgtgaaggtcggcacggtcaagaagagcgtccctgtggaaggcggcagcaccgcgagcaccactgaggctgagaaggcgccgacaaccgaagagaagccaagcggggcggtggttgagaaggaagccgtggctaatgaaggtgcccaggaaaactagagcttttctgtgcatgcggcaataattcgacatggtcccatttgggtcttgtcagggccctgctatcctctcgtgtctcgtgtcgtatatcagcagcaatggcccgtgtgactggatacgtccatctgtgccagcgccgtggtgctctataattgctgttagtcccttgtggccttgtgtgttcgatcggataatcgagttattttctttgcagtaccctaaggtcatcaggttccttgtaatgtctcgcgcacgtggggatatgccatgaaattgtcgtggaagtcatgttattgtttactgcaatgtgattcctgtcaacgtgcgtggcattgagccaaaaaaaaaaaaaaaaaaagcccgagaatggtacgagaaccgcccgccctc

SEQ ID NO: 2911 - DNA, 1398 bp, Zea mays
  misc_feature (1195)..(1195): n is a, c, g, or t
ctcctcgcttccctttccgtgtcgccctaaaagaccagactaccccgctgccccgaagtcagagcctcagaggggggagaggaggctagtagggatagcgcatcgtcatcgcacctccacgcgccggcgagccagaccaccagaggcagcgatggcggtggcggagctgtgggagacactgaagcagtcgatcgttgcatacacggggctgtcgccggcggcctttttcacggccgtggcggtggcggccgctctgtaccatgtcgtgtcggggctcttcgcagccccgcccccgccgccgccgcgcccgcgggaggagcccgaggcggagccgctcccgccccccgtgcagatgggggaggtctcagaggaggagctcagccagtacgacggctccgaccctaagaagccgctcctcatggccatcaagggccagatctacgacgtcacccagagcagaatgttctatggacctggtggaccatacgccctattcgccggcaaagacgccagcagagccctagcgaagatgtccttcgagccacaggatctgaccggcgacatcactggcctaggcccgtttgagctcgatgccctgcaggactgggaatacaagttcatgagcaagtacgtgaaggtgggtactgtcacgaagaacgtcaccgttgaagaccgcagcagcgccgcaagcacagcccctggaaccagtgaggccgccaccgaggccgagaaggcgccgactacgacgacgaccgaagagaagccgagggaagtgccagcggaggctgtgaaggagaaggaagccgccgctgccgccgccgcggctggtgaaggtgcccaggaaaactagagcatttttcagtatgcagcaataattcgacatggtcccattcggttcgtgtcggggccctctcgtatatcgtatcagcagcgtggcctgtgtaattggatatacgtcatctgtacgagcgccatggcccttgaggagctggtgctttgtgttgttattagtcgtccgttgcagattttaaagacatcgggttcaggttgggcgcccctggccctgtttggtcggaaaacaggcgctctttcaaaatgagttatttctttgtaccgaaaaaaaaaaaaaaaaagcggccgccggtggtgatactggacacgagcgcccggggcgcacccacgctgcgcgccttcncgcacgtcctctacggggactgcgagggcgccgcgcacgacccgcgcgtccgcgaggccatccaggagatggaagagttcgccgtcttcgtgcgcgtgcttggatgctacgccgccgactccaccgtctacgatctgcagtgagctctcagatatgatctagctactacttactatttcagaagagaaagcagcggcgtaatt

SEQ ID NO: 2912 - DNA, 1139 bp, Zea mays
gcacgaggctagtagggatagcgcatcgtcatcgcacctccacgcgccggcgagccagaccaccagaggcagcgatggcggtggcggagctgtgggagacactgaagcagtcgatcgttgcatacacggggctgtcgccggcggcctttttcacggccgtggcggtggcggccgctctgtaccatgtcgtgtcggggctcttcgcagccccgcccccgccgccgccgcgcccacgggaggagcccgagacagagccgctccctcctcccgtgcagatgggggaggtctccgaggaggacctccgccagtacgacggctccgaccctaagaagccgctcctcatggccatcaagggccagatctacgacgtcacccagagcagaatgttctatggacctggcggaccttacgccctgttcgccggcaaagatgccagcagagctctagcgaagatgtcgttcgagccacaggacctcaccggcgacatctcgggcctaggtccgtttgagctcgacgccctgcaggactgggagtacaagttcatgagcaagtacgtgaaggtcggcacggtcaagaagagcgtccctgtggaaggcggcagcaccgcgagcaccactgaggctgataaggcaccgacaaccgaagagaagccaagcgaggcggtggttgaggagaaggaagccgcggctaatgaaggtgcccaggaaaactagagcttttctgtgcatgcggcaataattcgacatggtcccattcgggtcgtgtcagggccctgctatcctctcgtgtctcgtgtcgtatatcagcagctatggcccgtgtgattggatacgtccatctgtgccagcgccgtggtgctctataattgctgttagtcccttgtggccttgtgttcgatcggataatcggtgctcttttaaaatgagtaattttctttgcagaaaaaaaaaaaaaaaatcatacgtagtcttcaccgaaggttccttgtaatgtttcgcgcgcgtggggatatgccatgaaagtgtcgtgtggttcctgtcaacgtgcgtggcattgagccagaatcatgtgttctgaggggttgaatggcacggtaaaagtccaattgtgtcctgtgccgattcggcacgagatcgtgc

SEQ ID NO: 2913 - DNA, 2204 bp, Zea mays
gcagatgctgaactgtgttgctggattgcgtgaatatttttcgcaaacagatgaaattcatacagttccaaggattccggtgatgcataccatggttaatgcggcctcaatgaaaaaggaccaaaaccttcaagaaccagactcgaagaccaaacaagctgataacaaacatttggatatggtagatgaagagtcggaagatgatgatgactatcaagttcctgatgctgatgtggaggaagaacctaccaaatctgacagtgatgctaagaactcagacccaatagatttgtcttggttttcgggcattattcgtcaggatacaaatgagaaaagtcgtaactgttgggcagtgcctgatagcaagatctttaaagttcgtagcaagaactttccacatgacaaatcaaaggtaccagcaggtaagtatctaatggagctcgtagcagttgactggtttaaggacgccaagcgcatggatcatgtcgctaggcggaaaggatctgcggttcaggttgccgctgagaagggaatgttcactttcctggtaaacatacaaattcctggaccaagtcattacagcttggtcctttattttgtctcaaactccttgaagaaaggatcgctgttgcagcgttttgccgatggtgatgatgattttagaaacagcagactgaagcttatcccatctgttccaaaggggtcttggatagtgcggcaaagtgttggaagcacaccttgcttgctggggaaagccgtggactgcagctatttgcgtggtcctgactacttagaagtggatgtagatatcggttcgtccgcggtagccaacggggtcctgggcttggtgtttggcgttgttaccaccttggtagtcgacatggcgtttcttatacaggcaaacacgtacgacgagctcccagagcagctcctaggcgctgcgcggctgtcacacatcgaaccttctgcggccgtgtatcctgtccttgacaacatttcctgaacgggacggacaaatcaacctgtgcagattctttcgttctttccgtccgccccgccacaaaaaggctctcccaatttgttcagccactgcagcattgtgcagctcgatacatttgaggttcagacagacagactgcagcagtccacaagtgccttgtacccttcatacagttttgccatttttttaggtcttttcttttacattttactttactcggtgtagtttgagcttcctacagatattgtaatgcaatagacacatcaaagtgagatatacagatacagcatggttcagaaacaagttcgtgtactttccgattcccgacccactgaaactcgccttttgtgcattcaccagtttgggcttgcttcattgctcatcagatctggtccatgaatgcccattcgaggcccatcacagcccaaacccccactggtcctaaacctctcgccgtcacgcagctttaagttccgatacccacaagcacttggcatcaaccctaaaccacccactatacccacccgcccggctagggttttgccaccatggccgccgccgcggccgccgcccggaggctcctctcccgccgcgcctcctcgaactcgctctccgcgttcctccgccgcggcgctgccccggagcagtcgctgctgcgcccggccgtcgtcgcggcggcctcccgcctcggcttcccgcgcgggatggcgcggcggcctggcggggacggctacggcgcgggccgggaccgcgcgcccacggagatggcgccgctgttccccggctgcgactacgagcactggctcatcgtgatggacaagcccggcggggagggcgccaccaagcagcagatgatcgactgctacatccagaccctcgccaaggtcctcggaaggtagccgaggcaccaatcgtccccttctacgattgccgtagttcctgaggagtggggtggtttcttttggaaaaaggaaatctcacggtattttttttctgcggtgcagtgaggaggaggcgaagaagaagatctacaacgtctcgtgcgagcgctatttcgggttcgggtgcgagatcgatgaggagacatctaacaagctcgagggttcgttcaacctatgctccatgataccattattacgttgttctctctgctaaatttgacctgacaagtatctggtgccgttttgtttatgttgtactgcag

SEQ ID NO: 2914 - DNA, 3947 bp, Zea mays
agcctcaagtgtgaggtggcatgacaatgtaggtggacgaactgagcagatatctgaggagagggaccggcgatgttcagctggttggtcaaatgatgagagagagagatatgattacgatgatgcgcagtttgtgagagtaagaaattctaggataggaagacaagatgacaagtttataactgaggatgaaactagggttacatccagttcaaagaacacatccattttaaaacacggtagcaatgctgatcagcaggctgcagtacataaggatggttcaacgaagagctcacagaagataacggagatatcagaagtccacgataattccactgaacaagattcaagagcacagcgctatcatcaggaagatagagaaaactacactaagaatacgccatcttctgttcaaaattctgtgaagatggctagtgacagtagaagacaagttgatcagcataatgaggtgaatcagaacttggtctcagtcactgattcaaggaaaaactcagggaacctcaatgtaacaactgatagcagtcacaatgtcagcagggtctcacactcaatgagaaatcataatgaaataaaccagatggatattgatgacagttctacttccttacagaatataactcatgttataagagataagaagagcattgtaaaccaacaagtgatacatgaaacggatatagacgcgcagaatattacacatgtcgatatttcaaagatccatgctagtgatacttccacgtctaggagttcacaaagtcatttggaaactagatcagacatgaactcatcttccagtatgggtttcatcaatagaacaagaagccaggaaaaagaagggtatggaaatatgatctctgctaatgatagtggcatggttaggggttcacaaagtcatcttgagactggattgtatgatccatttcactcaaagccattggctaatattactgacaacaaaacggaaagtcatgaacaagctgaacttaatattgccaatgctagtaatgctgctgtagccaacacttcaggcagtcatctccaaaccataacagattaccaatttcaatcgccttcagctgtagcaattgacagtatgaatgaacaaattgattttgctaagatccatgctattgatgctacagttagcagttcacaaggtcctgtgattagaaatgacaatcaagttcataaggcatcaactgtacattggtcaagtgagagacaaggcatgaatggtcggcaaattacacaagtttccaatacagaacgagatgatgaagcaagaagtatttttcctgaatcctctcaggatacacatcataacatggatttgatctggcagcaggcagacaccagtgggatctctgatgacaaaaatattactggtttgctcgtggagagcaccaaaaagggatttatgactaatgtggatatgggacaacaagaagcaacaatgggtagctatgaccaagaagtaaggagtgaaattactgcaggaagtagtttaccaagtggttcaagtgccagacagtctgtcaaggaaagcatgctagaatcagctgctcgattagagaaatcatctacctttcttgttggacggtttgttgatgagctccaacagggagtctcagatccagatgctactttaacaaagaaaaatgggaaatccatagtggaaggtataacaagttcttcatcaaggtctagaacaaaaggaccagcagatgaaatgtgggatgtccagagtactacttctgaagagaccttcaagacggccgacaaggaggaaggttcctcagctgatggagctactaattctgcctctcagacaccaaaaaatgaatctgctgttgctaggaaagttcacaagtcactctgggcttatgttgctgatataatccgtcttggatttattcaacatggtgactcccatgattctagtcacaaatcagttaagaaaagttcatctaataattctcagagcacagagggttggctttctagtcaggaacgtgataatgatggccccgcgtccggcacaaagaagaaaaatggaagtaccaacactctgggtggtggtgaacaagaatctggagtggcttcaatgtcaaatgaggaatatttgcacactgatacccatggtttgcagatatcagaaactgttgttgaacctcaagtaggtagatctgagggagacttgttgcctacaagttctacagatgatctacatatatcaggggggagaacaaagcaatctgatgcaggtgaattacgcaaaggaaatagcatagatgatagcactccaacttatctagatatcacgataggacatttacctgaacgcaaaactgcatccaggatcacaacagagggttctggtgagtttattactgggaaaggaatgttagctggcacatcttctgtgaccatcagtgcaatggaagctggtcgcagtgaagatggagctgattcgatatatgatccttcaggtgctataactccttatcatgattctcaaacgcaaacagtaatgccacatgagaatacctcaactggtatccttggaccaccagcgttacctgtgggagtttctacaaggtttgaagaaaagaatatcatgcaagaggccccagaaattattaaaacaggagggaaggatacagaattgaaaaggagaaattttcaaagaaataaacaagtattgaaggatacatttgatgaatgggaggaagcataccagcgggatgctgagcagagaaaagctgatgagttattcatgagagaagctttacttgaggcccagagagctgcagatatttgggaggtacccgttggtgcagtgttagtacagaatggcgaaattattgctcgtggttgtaatcttgtcgaagatcatagggattcaactgcgcatgctgaaattgtttgtataagagaagcttctaacaaactcaagacatggcgcctagcggacacaacgctttatgtgacattggaaccttgtgccatgtgtgctggtgctattcttcaagctagaatcgatactgtggtatggggtgccccaaacaagcttctgggagccgatggcagctgggttaggctgttccctggggatggacaaacaagcactcttgattcaacaaaccagagccaggccgcagggcctgtccaccctttccatccgaagatagccatcaggcgtggtgtgctgtcggccgagtgctcagagataatgcagcagttcttccagctgaggaggaagaagaaaccacagtcaccaccgcaggcccaccgccatgggcaccatcatcctgtcaagttcttcagcaagatgcaccacatgttcggcacgatattctgtttataacttcgcctctctgttttcttttagcttcctaaatttcgtattatggaagtgtgaaaaatgcatttctttctgtgcatctagtgtttttatacaggtaccagtttgtattgtgagatgtcatcgataattgcttagttccaatgtcgaaacttagcggcaccaacagccattgctgaagcaccattcacaatgacatgccgcaaaacatagaaaaattgcattatccaatgctgtaggaaccttttaggatgcatctaacacattgaaacagcatagtccgcattgctgtcgcagatgatcaatggaccatcaatctagtaccactagtactagtcatgttgaaattggagatccagatgactttctggacatagtgagattggaatcaagtgagaccgtgacgcgtgattcaaacaacgaacatgaacttccccatcgattgcatcacaacgaggaacctgaacttcatcgattgaatcaaccttgcaagaacaaaaaccataaagagtgtttggtgtgaaggctgtctgttcccctcgatcagttttctttaacatca

SEQ ID NO: 2915 - DNA, 2310 bp, Zea mays
  misc_feature (775)..(775): n is a, c, g, or t
  misc_feature (808)..(808): n is a, c, g, or t
gctgatgctgcgggatatgatcctgatcagcctctttggaacaatgagcaccgagaagcatcatctactggctttataaataaagatgttggaccgtggaatgctgaatcatccggctatgaaatggggcaggagcattcaaaccaggttttggcttctgatggttctcagagtttgaagtcttctgtttgggggcgaataacatcaaaaagaaaaccaggaggtaataacacagctaaaagtacaccaacgagtatcactggaaaccaaaaaagtgattatgatgacatggctatcagcacgggccaagtaaaatctgctgctaaggataccaatggtcaacccaattcaagaatatatggagatgtgggctggcaaagtaatcgagctgctcagaaagcatcccgtacattatatgtaaatggaattccccaagaaagcaacagatgggagacccttctatcgcattttcagaagtttggtcaagtaatagatatttatattccatctaacagtgaaaaagcttttgtccagttctcgagaagggaagaagctgaagctgccctaaaagctccagatgctgttatgggaaaccgctttataaagctatggtgggccaacagagatagagttcttgatgtgggagagggcagaatctctcaaaagccttcccagttgtctactacgccggctaattcttaccccaacagagtcaagggaaagtgttcaaccaacagctccagggcccagcttctggatcttctgctgaactgtntgagtttctggtacaccaagttctagaatgctngccagcaagtagtgcgaaagcagtaccaccccatgctccaaaaaggcaagaaggcctagaactattggaagaactacgtaaaaaaccggccggcttagctctgaagcgtgatgagttccgccggcagttagagaaacttacaaaacaaaaaggttcagcaaattcagttaagcatgcagagactggtggaaaagaaattgcttctaatgatgcatcacaagtaaaggatgcagcgtccacgagggttgaagggtcacaggagacagctggttcattggaaaagagaagttctggagagtttgccttgttgtctcaaaagtctgctgcgatatccacgcagaaaccagtggtggttacaaaacagactactctgccagcacctcctcagaataggtttaagcttgacaatcggaccacatcattcagaattcttccacctttgccacctgaaattgcaaatgaatctgtcttggcagaccatttctcatcatttggggatctttcgtcggttgtcctggaagatactgaagcccataaccttgatgcaaccctaaaaccttcgctgagttgctcagcttgtgtgacttacacaacacgacaatcagctgagaaagcatttattggtggtaaatcttgcaaaggacacacactacgatttatgtggttgacagcatctcctggctcaaataaccattataggcatcagaatacctcagttcatgtgaggccctctactatccctggccatactcaaagcatatcatctgagtcccccagccctgttgggaaagtatcatctcttgctacatctgttatggtagccattcctcataataaatccatctcaactgtggaaaatacaaagacttctccagcgggagtttccaaagtttcatgtggtagctcctctctatcatcaaatgataagtgtccttctgaatgtggttccacaaggaatgttatctcagattctgacgttccacaatgaggcttaatgctatctggacgaggtggtgttatgaatcttgatttggtggctcggctatttcataggtctacacctagtcaaaatcccatcacatttgaagttattggaagaccttttgaaaactttggtgtttaatcgtagggcagcgcggttaaggctgtaaaaagaaaaaaaagagaatgtttaaagaaatatgggttcaaaagcatactggaagtggaggctttctcggtaaccaccgtctaatcatctcattgttcacggagactgagtggtgctaggttatttgtacacttcattttgggggcgcatcgtgctgaaagcagttggtaatatgctaattctgtagtttgtagctcctgctgaaatcagctttgtggattatgttgtgagcacgatgaacatcaaactctcgcaagtcccatcgaggcatcttgtcgaaaaacttctgctgtgcatactgtactaaaaaaaaaaacgaagagcgggcggccgggatttaggtacactatag

SEQ ID NO: 2916 - DNA, 1128 bp, Zea mays
aaacgtttttatggtagttcgtgttcatgtccgatctgaaatggcttcagcgacttcgcgtgcttgattgaaacgcacccagtccccgctcctgtttcgatctcccgaatcccgatcccgctaccggaggcggaggcgatggcggcggcgccggcggtaaggttcccggtcttcgggctcgtgcggctgctgggcttggccgccgcggcggcgatcctcttctgggccgtccacttccgaggcggcatggcgctctccaccgaagaggagagcaagctccccctcttcaacgttcacccagtgttaatgctgattggtttggtggccttgaatggcgaagctcttttggcttataaaactgtgccaggaaccaagaaactgaaaaagctagtgcaccttgccgtgcagttccttgccatgtttctgagtctaattggtctgtgggctgtatggaagttccatgatgaaagaaaaatcgatcatttatatacacttcactcgtggttgggccttacttgcttcatcttcttcagcttgcagtgggctgctgggttttggaccttttggtaccccggtggatcaagaagtggccgtgcatttttgcttccctggcatgtcttctttggtatattcatctatgttcttgctatcgccacaagtgtgactggactcctggagaagtcaatctttatgcagagcgccaaaatgattgagcgcttctccacagaagccatgtttatgaactccctgggaatgctgctggtgttgttgagcagccttgttattcttgcactcgttagtcctggacccagcatgatcgacacatacagaggctcttctgagtgagaggaaatgattacagcctagtttcttaagctacatttttaatcagtagctgagcaatttttgtgtacatgtacccagaattatgcttttcttcttttgacatggagttagtcagtgttgaggataatttcatccctgttagagtggcttcattcaagtcgcagtaataaaattgtggatgaggctgacaatgaaattacagctgagaacaaaaaaaaaaaaaaaattcctggttaatcagaagttaaccaattcccgaaaaaaaaaaaaaaaaaagcggcc

SEQ ID NO: 2917 - DNA, 3641 bp, Zea mays
gcctggctctggcttctgccatcccactcagcagtgccaaggcccagcgccgaccgagccttcccctcgcctgatctgcgcgtccctgtcctcggctcctgagcactcgcgtactcgctcgtcgcatctgcccacactaccactggccacaccgaaaccctagctgcgcacccaaatcgatcgatccagggacggcagcggcacgacgcgccaaaataggttcagaactagcgtcgcgacaaaatcggttcacgaccgccacggttggaccagctgcgccgtggccgtgcggctgtgcggccggcattggcgcgctgcgcgctgctgcaggccggtgtgccgcgcggctgggcgacgtgaaacggatccacatcgtaggagcagaacttgctggtcgaggtggaggcttgctgcgtgcagcaggacagggagtcagggacaacagattttagcaaagtatgagctgtgaactagtgttagaggaaagcacgaaggaaatagtggcataaaacttgatttgtctaaagataaattggtttcttaaaatggctcagcaaatggcttcagttcatttgaatgatacaacagttgttgatgccaagcccttgcgtacattaactcccatgttccctgcaccactagggcttcacacgttcactcctcagaactcaccttcagttgtttgtgtgaccccatttggaccatatgctggagggactgaattggggatgcctgctgttccaccaatgtttgcagcgcctgtacctgctgcaggagcagaacccagccagagacagccgcatacagctaatatgaacggaggagacactgaattggggatgcctgctgttccaccaatgtttgcagcgcctgcacctgctgcaggagcagaacccaaccagggacagccgcatacagctaatatgaacggaactgcagtcaacagttcggtcacatctttgcaaactcctccttcagctgccacacaggaatctggtaagaggaagaggggcaggccaaagcgtgtgcctgatactactgtttcttcggctccttcagctcctctggctcctactatttctccagttccttcacttcctgtggttactccagttccttcagctcctcaggaattgaacactattgtttccctgacgccttcttcagacgccccacaagaatctggcaagaggaagaggggacggcccaaacgtatacaagacgttcctgtaatggttcctctgacctcgcaaggagatagcacatctgttattcagacacttccagggtccagtgtacatgaatctggtacgagaaggggacgtcccaaacgtttgcaggatagttcagatattgtcactccaattgactcaaaagatagtgagtcctctccccagccacctattgccgcacctgccgaaagtggtaagaggaagaggggacgtccaaagcgcattgatggttccgtgactccttcaagtcattctgttttttcaatagatgatgatgctgttgacacgatgaaacgtggacgacctaggaaaattgataccaaactgttacagtttccatctttattttcagatgatcctagacaaactgcagataatgtactcatgatgtttgacgccctgcgacgcagacttatgcagatggatgatgtgaaacaagctgcaaagcagcagcctaacttgaaagctgggagcatcatgaacaatgctgaacttcgtgtcaataaggacaagaggataggagaggttccaggtgttgaggttggtgatatgttctacttcagaattgagatgtgcttagtggggttgaatagtcagagcatggcagggatagattacatgtctgccaagttcggtaatgaggaggaccctgtagctattagtgttgtgtcagctggtgtatatgataacactggagatgatccagatgttctagtttatactggacatggcatgtcgggtaaggatgaccaaaaacttgagaggggtaatcttgcactagagaggagtttgcatagaggtaatccaatcagagtcattcgtagcgtaaaagacttgacttgtccaactggcaagatttacatatatgatggtctttacaagatcaaagaagcctgggtagagaaagggaaatctggtttcaacgtgtttaaacacaagttgcttagggaacctggccaacctgatggcattgcagtgtggaagaagactgaaaaatggagggaaaatccatcatctagagaccatgttatattacttgacatatcatatggtgtggaaaataaccctgtctgccttgtaaatgaggttgacgatgaaaagggccctagccgcttcacttatacaactaatttgacatatgggaattctctcagctcgatgagaaagatgcaaggttgcaaatgcataagtgtatgcctccctggtgataacaactgctcctgtacgcatcgaaatgctggtgaccttccttacagtgcttcaggcatacttgttagccgaatgcccgttttatacgagtgtggtgattcctgcacatgttcacaaaattgccggaaccgagttgtacagaaaggtacgcagatccgttttgaagtttttaagacaggagatcgtggttggggcctccgtagttgggatccaattcgagcaggcacatttatctgtgaatatgcaggtgaaatcattgacataaatagagtgaatggtgaagatgactacatatttgagacttctcctttagagcagaatttaagatggaactatgcaccggaattgctgggtgagcctagtctttctgactcaaatgaaacaccaaagcagctgcctatagtcatcagtgcaaaacgaaccggcaacatagctcgctttatgaaccacagctgctcacctaatgtgttttggcaaccagttctctatgatcatggtgatgagggatatccacatattgcattctttgcaattaagcatattcctccaatgacagagcttacctatgattatggtcagaaccagcgtaatagtattcaaatgggaacccattctggttttcggaagtctaaaagttgcttatgttggtccccgaagtgtagaggttcctttggctaataaccagccctataaggaatatattggatcataatactccatttcaaagttacacctaagatatctgctggtcgacttttatattcagctcccaaaaatctgtcacaagtttgtgagagcaactgaattgtctttaccagcagaagcagcccgtcatggtggcctgtatgaagcagcaggggtctcctatgtcctaggtgttccatgcaccatcgaataaatccacccctcttcatgttagaatgggaaacggggatgtgttttgcacaaattatctgtcatgcagtcgtcgtattaagttttcttgaactagtttgtagtcatcctcagagaatgcatgatgtgcactttgtagtaatatatgcaggttgttatcccacctactatataaccatcaaaatttcagtgtttgtacaggacgccctatgtagtggcgctgcttgcaaatgttagttagtacactgatattccataattttactcctttccaaattaattcaacttataaaattattctaagtc

SEQ ID NO: 2918 - DNA, 990 bp, Zea mays
ttgggtccctcgaggccggccggggaacggtactttttcagcctcaaagcaggctctgaactagccgcacgtacgccggcgcgtggcgcggcgcgttccacacttcctggtctgctgcccgaagcatgcacatcggcggccaggcccaaatcatccgcgccgccgaccgcggccccgaccggcagcacagaatcaaaaatatctgcctgcctacctaccgatggccgccgcgttgtagttgtagtgtaacctagccacacgacgcatccgcggttcatcggcctcgcaggaaacgagcgtcgagcaaaaggtcgaattctcaactctcaagcaccagcaggaatcgagcgagcgagcgagcagtgtccgccccccatggccatggtcgcgtccacctccttcgcgtaccacaagccgcgtttcgcggtggtgtgcaggaagaacagggacggccgggacagggagcgggacggcaaggagcacaagcaccccttcaaggtcgtcgagatcacgccgcctccgcggtgcctcggcgtccgctgcttccccaccaacatccactgcggcgagagcgtgacgatcgaggggcaggcgtacacggtgtcggcggtgacgcaccggtaccagctgcgcaaggggcggtacgagccgagcgagaagcgcctcgacgtcctctccaccggcagatacatcctcaacctctacctccagaacctgctcgaccagtcctagctaccatatctgtatctgtactgtacatcagcatcgcttcactctgtatagatatacatacatatatatgttagctagtagcatcgaacacttgtcccggtgggtggcggacggagatagtgtttccctgcgtgctgctctgtgtaaactgaaaaatgcgagatgaggcataaagttcagtgaaaggttgcatacattttcttgaagaaaaaaaaagttcagtaaaaaaacaaaaaaaaaaaaaaaaaagcggcggcc

SEQ ID NO: 2919 - DNA, 1708 bp, Zea mays
  misc_feature (1184)..(1184): n is a, c, g, or t
tataggaactaaacattagtccctagaaaccaaacacccacttagaaatccacaactccagactgggaacagcacataaataccagcttcccgccggggtcgtcgatcaaacaaaaccaagcggtcgagctagataagacaaccatgaagatgcacgaggtcgaggagcctccagcggagatcacccgcgacgcccacccggcgcacgcgctgaggctggtggccaccgacgacggcgcgccgttccggtgcgacgggtgcaaggagcccggcagcggccaggggcggcggtacaggtgcggccacggctgcgacttcgacctgcacgtggcctgcgcgctggcggggccgactctgaggcaccccctcttcggcgagggcctcgagttccagctcctcccggaggcgccgccgcccgtcgacaagacgttctgcgacgcctgcggcctgcgggcgcccggcctcgtctaccactgcttcgacagggacctggacctccacccgacctgcgccgcgctgaagccggagagcgccttcccgggcggccacctggcccagctcggctgggaggccgccgagcaccgctgcgtcgcctgcgacgccgccgccgccgccgccggcaagaggttctgggcgtaccgctgggcctacggcggcacgcacgggtacctgcacgtggcgtgcatgaagaagatcgcctttcagagctgggaacaggcctaccaggccagcgtcgtcggcggcggcctcgtggaggcgagcgtgccgacgatgacagccgtgctgcacaggaagcgcaccgacgaaattacgggcggcgttaagattatcgacaccggcatacgcgggcagtacctttccagttcaacttggggtacttaaataattggtactatcgctctagtttattacacccaaaatactgctggcacataagagggctagctgcctagctatagtgccggcctgtgaatcaagccaacgactttgtgtaccgttgccacctcagctgtgtttaataattgggttttttaagctggtgccaaaagattaagccttttttttacccggtgttcataactgtttggagctatatatcgttactaggtaggtgcccgtgcgatgccacggtatacaaaatatccagcaaaatgttattgcacaacaattacataaaaaatacnacatatattatcgatctcaatatctcataaattctttggcaacaatcaatacataactaaattgatacagatcaaattatattacaatacgacaataatgtcatcttaaaaaatgcagagttcaaaaagggttccattcaggtgctacaagtccataaagaaataagaaatcattgatgtagtacttgaaaggcacactgcttcaccagctctctgtagaatgtccatgtacaacctcacacatcagaaaagagaagcaataattttctctccttcatataagcaatgactcatgactactgcagaagtacctgttggagaaatatttactcctaaaagttggcttagctcaagggcctttcatgctctggaacacctacctaaaaagttggcaaacctttataacctcaataagaacttcggcaacacaattagaagggccacactacatagtgcctttatccaacccttaactgtgattactgatggccatgtaaaaggtgtaacaaaaattataataggat

SEQ ID NO: 2920 - DNA, 1873 bp, Zea mays
  misc_feature (868)..(868): n is a, c, g, or t
gtctggatccgcttcgaactgatttccgagtcaatcccacagttttaggtaacaaataccgcgagaaactaggaatcctaactgactctgcgcatgcgcggaccgtccgcgccaccaccgcggacagtccggaccgcggaccgtacggcctcagggccgtacggtccgcgcagctccttttgacttccaacaccgttcatttcagcaattgcaagcaatacacgcacttgtcagagtaataatggatgcaaaagcatgataagtggcagcaaggcgttcatgcgacgtcggtaggtcgggcagagatatctggatctggatcctacgtggcccaatggtgcgcgggcacgcggatattgcggccaatggagggcggtttttggatacccccatcccagctccgtcgtgcttcttattaatagcagcctcagattctgctcagctctcactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccagggtaagcaagctactagcctagccagtgacgacgcataacgtacaatcgtacatgtctttttctactgtgcatgcaatgatatatatatatatatacaaacacacacagtgacttcggcttcgaccccctgggcctggccccggtgccggnagaacttcgagcggttcaaggagtcggaggtgtaccactgccggtgggccatgctggccgtgccgggggtgctggtgccggaggcgctggggctgggcaactgggtgaaggcgcaggagtgggcggccgtccccggcgggcaggccacgtacctgggcgccccggtgccgtggggcacgctgccgaccatcctggcggtcgagttcgtggccatcgccttcgccgagcaccagcgcaccatggagaaggaccccgagaagaagaagtaccccggcggcgccttcgacccgctcggcttctccagggaccccgccaagctcgaggagtacaagctcaaggagatcaagaacggccgcctcgccatgctggccttcgtcggcttctgcgtccagcagtcggcgtacccgggcaccggtccgctcgagaaccttgccgcccacctcgccgacccctggcacaacaacatcggagacatcatcatccctagatcgatctccccttgacaattatattggttgattattacgactaggcactaggcactgcctgcctgcgtgcaggagcagtacaacgacgacgacggcgagtcggcgacttccctcccgcccggaaagctctcgtaatctaaaggaaaaggaaattggtaccatgttgtgcacttctagcatgcatgacagcaatcgcaagcttcttcctcagccactaacctctatgtacattttcagcgcaagatcattgtcgacagtagtatacataaaagtgtacacaatatactgaacaaacaaccaagacacaagtgaatgtaatttggcgaaaaaaaaaaaaaaaaatgcataaacaaacaccatatggcatgtcttaccttgacaagatctcccagttcaagctacactcgagcttatcttaggattagtaccgtcattctcatccggtactgagctacacttatcatttatcgtcactcttaggattattagttttaaaattaagaaatattattaattc

SEQ ID NO: 2921 - DNA, 1327 bp, Zea mays
cattgggacctcgagccggccggggaaagggctggttggaatctaaagtgtggtagaaagaactacatattggctgcctcaccgcccgctcggctctaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgccggaggcgctggggctgggcaactgggtgaaggcgcaggagtgggcggccgtccccggcgggcaggccacgtacctgggcgccccggtgccgtggggcacgctgccgaccatcctggcggtcgagttcgtggccatcgccttcgccgagcaccagcgcaccatggagaaggaccccgagaagaagaagtaccccggcggcgccttcgacccgctcggcttctccagggaccccgccaagctcgaggagtacaagctcaaggagatcaagaacggccgcctcgccatgctggccttcgtcggcttctgcgtccagcagtcggcgtacccgggcaccggtccgctcgagaaccttgccgcccacctcgccgacccctggcacaacaacatcggagacatcatcatccctagatcgatctccccttgacaattatattggttgattattacgactaggcactaggcactgcctgcctgcgtgcaggagcagtacaacgacgacgacggcgagtcggcgacttccctcccgcccggaaagctctcgtaatctaaaggaaaaggaaattggtaccatgttgtgcacttctagcatgcatgacagcaatcgcaagcttcttcctcagccactaacctctatgtacattttcagcgcaagatcattgtcgacagtagtatacataaaagtgtacacaatatactgaacaaacaaccaagacacaagtgaatgtaatttggcgaagtacagtaagatccatgcataaacaaacaccatatggcatgtcttaaaaaaaaaaaaaaaaaaaaaaaaaaaaaaagtaaaaaaaaaaaaaaaataatggtt

SEQ ID NO: 2922 - DNA, 2097 bp, Zea mays
actcctatgggcgattggggcccccgcccggaaacgaaccacagaactacagaagaggcggccaagcattagcaaagcataccccaaaatccccaaaccctagcgaactcggcacggcggcgatggcagcggcgggcctgcggaaggggaacgcgcgcctcccacccgaagtgaaccgggtgctgtacgtgcggaatctgccgttcaacatctcgagcgaggagatgtacgacatcttcggcaagtacggcgcgattcggcagatccggctgggcaacgccaaggacacgcgcggcaccgcctacgtcgtctacgaggacatatacgacgccaagaacgccgtcgaccacctctccggcttcaacgtcgccaaccgctatctcatcgtgctctactaccagcccgccaagatgtccaagaagtcggatgtcaagaagaaggaggacgagatcactaggctccaggagaagtacggaatagggtccaagacgcccggccctggctccaccgactgagcggccagagtattgcctctgaagcctttttgtatgatgaagagtaatcagagggaacaaactggtagcactgtgctgtgtttcatccagtgttgctaattactctgtgttgttattcggtcaattgaatatatatgtgcttaatgtgctacaatgcttgttcctttcgtgcttttgtaatcgcccatataatgttaatcttttctactagaaacaagatgaatgggttagtatacgcctgttgctaggtttgcacggctcgagtcttttctgtagtgagactgggagtagcatggttagctccactgaaaacaagatgaatgagttagtatcacctgtcgctaggtttgcattggtgatctgtattctgtaatgagactgggagtagcatggttaggctgttaaatttgggctcagtgtctggttagttagtatcttttttggggagctggtatgtgttagtgttaccatatactaaaagttcaagtagaatgatgttggtgtgctctatgccaaattaaaatgaattttcagggactcatacttgggtttcactttgtgaagttcatttgtgcctattagtttgggtttggactgatattccttagatagttcattatattgttgtccaattgaatgtttatgtgtgccttattgaagttgacaggtatgctttccatagcaaaaccatgttcttaaaacatacatttctggacgagtgactggatgatgttcagatgcctttgcaacttcaagatgttcagatgccttgcaagttaagtgtttctgtgcacttaatcaacttcatcgtttgagggttagtcagaatctgtggatttcatcattccagtgcaaaaatgattgtgttgatggtggtcatggtgacgggctttagttagcgaagtggattgtatggtactagggtgtattgttagtattgctcagaccactcgatcctctgatttcagaatttgttttttttagttcgcaattattagagatgatataacacagcaaaaatgcacaatttttacatcttaggccaccagttgcgtcagatgggccatgcgtgctcagcagaggtggcactgttcaacatctgcttaaaaatgtcagcgtatggaggacctgatgcattatttttctccattcttgagcaaggcaggtaaccccagcagccaattgaacttcatagacatgtatcgcctcgccacctttgaagccctgaaaaacatagatcagagtcaatgtcgactttggcaatgtcttcaaacagaaacgtgccccaagccaaatacaccaagctatcgtgtcatcttaccgctagttcatttttaaactaaacggcgacaaatgaagacaaataaaaaagcacggagggagtactacttagaacagttcagagcttaaggcacttaagggcaggtacatagtcaagatcctcgtggctccaaagaacaagcataacgtggaattgattatccaagaaagtaggtatatgtccaattaattctgtttccaacgcgaaattagagtcatgcaagatgcgtagaaaagaaaaacgaatgccccatcccatgcc

SEQ ID NO: 2923 - DNA, 1196 bp, Zea mays
  misc_feature (26)..(26): n is a, c, g, or t
  misc_feature (31)..(31): n is a, c, g, or t
  misc_feature (1163)..(1163): n is a, c, g, or t
  misc_feature (1165)..(1165): n is a, c, g, or t
  misc_feature (1169)..(1169): n is a, c, g, or t
  misc_feature (1173)..(1173): n is a, c, g, or t
  misc_feature (1176)..(1176): n is a, c, g, or t
gcacgagaccattacctagaacatcntaatngaaaagacgccgacatatgggccccgcttgagaagtaagggccacatgtcggtgggaactctcccggagtcggcaactaatcgaccccgtgcgccggctccacccgaagcgcaagaggaagaggtggccatacgcgaggtggccatacgcaacaagcaaagcatacccccaaatccccaatccccaatccccaatccccaaaccctaggttatctcggcgcggcagcgatggcggcggcgggcctgaggaaggggaatgcgcgcctcccgccggaggtgaaccgggtgctctacgtgcggaacctgccgttcaacatctcgagcgaggagatgtacgacatcttcggcaagtacggcgcgatccggcagatccgtctgggcaacgccaaggacacgcgcgggaccgcttacgttgtctacgaggacatctacgacgccaagaacgccgtcgaccacctctccggcttcaacgtcgccaaccgctaccttatcgtgctctactaccagcccgccaagatgtccaagaagtcggatatcaagaagaaggaggacgagatcaccaggctccaggagaagtacggaatcgggtccaagacgcccggcccgggctccagcgactgagcggccagggtattgcctctgcagcctcttgtatgatgaagagcaatcaaaaggaacaaattggttgcgctgtgctgtgttacatccagcgtcgctaattactctgttgttattcaggctccataacaattgaatagatatgtgcttgtctaatcgccagcgataatgtttagtttctaccaaaaacaagaggaatgagtagtgtacacctcacacctgtggctatgcttgaattgttgatctatattctgttgtgagactgagagtagcatggttaggctgttaaatttgtgcttctattattggttagtatgtatctttgttttggtagctggtatgtgttatcgtaagctaaaagttcaagcagaatgaagtgggtgtgcttcttgccaaattaaatggattttcagaggctccaaaaaaaaaaaaaaaaaaggaacctagcccgtactccgcggtgtcgccgcgcctttgtgcatattagtttgggattggactggtaaaaaaaaananaagnaaanaanaaaaaaagggcggccgctct

SEQ ID NO: 2924 - DNA, 1015 bp, Zea mays
  misc_feature (997)..(997): n is a, c, g, or t
ggggagggaggttgtcgggattcgaagccgagagcccgagagcggctcgaggcggctcaggactcaggtcaccttattgcgccaaaacgaagcttcgagactcgacgccgacatatgggccccgcttgagaagtaagggccacatgtcggtgggaactctcccggagtcggcaactaatcgaccccgtgcgccggctccacccgaagcgcgagaggaagaggtggccatacgcaacaagcaaagcatatacccctcaaatccccaaaccctaggttatctcggcgcggcagcgatggcggcggcgggcctgaggaaggggaatgcgcgcctcccgccggaggtgaaccgggtgctctacgtgcggaacctgccgttcaacatctcgagcgaggagatgtacgacatcttcggcaagtacggcgcgatccggcagatccgtctgggcaacgccaaggacacgcgcgggaccgcttacgttgtctacgaggacatctacgacgccaagaacgccgtcgaccacctctccggcttcaacgtcgccaaccgctacctcatcgtgctctactaccagcccgccaagatgtccaagaagtcggatatcaagaagaaggaggacgagatcaccaggctccaggagaagtacggaattgggtccaagacgcctggcccgggctccagcgactgagcggccagggtattgcctctgcagcctcttgtatgatgaagagcaatcaaaaggaacaaattggttgtgctgtgctgtgttacatccagcgtcgctaattactctgttgttattctgggtccataacaattgaatagatatgtgcttgtctaatcgccagcggtaatgtttagcttctaccaaaaacaagaggaatgagtagtgtacacctcacacctgtggctatgcttgaattgttgatctatattctggtgtgagactgagagtagcatggttaggctgttaaatttgtgcttccatttatggttagnatgtatctttgttttgcc

SEQ ID NO: 2925 - DNA, 873 bp, Zea mays
gacgccgacatatgggccccgcttgagaagtaagggccacatgtcggtgggaactctcccggagtcggcaactaatcgaccccgtgcgccggctccacccgaagcgcaagaggaagaggtggccatacgcaacaagcaaagcatacccccaaatccccaatccccaatccccaatccccaaaccctaggttatctcggcgcggcagcgatggcggcggcgggcctgaggaaggggaatgcgcgcctcccgccggaggtgaaccgggtgctctacgtgcggaacctgccgttcaacatctcgagcgaggagatgtacgacatcttcggcaagtacggcgcgatccggcagatccgtctgggcaacgccaaggacacgcgcgggaccgcttacgttgtctacgaggacatctacgacgccaagaacgccgtcgaccacctctccggcttcaacgtcgccaaccgctaccttatcgtgctctactaccagcccgccaagatgtccaagaagtcggatatcaagaagaaggaggacgagatcaccaggctccaggagaagtacggaatcgggtccaagacgcccggcccgggctccagcgactgagcggccagggtattgcctctgcagcctcttgtatgatgaagagcaatcaaaaggaacaaattggttgcgcttcgagagggtaaataaggacgagcgggcgcgagctagaagagcagctgcaggtactaccatcatcgtcgtcgtcgtcgccaggatgaccgtcgtcgacgccgtcgtctactccaccgatgccggcgcccctgctgccgacgccaccgcggtaccggcggtgaacgggcggaccgtgtgcgtgaccggcgcggacgggtaca

SEQ ID NO: 2926 - DNA, 1336 bp, Zea mays
tgggcaccgcgtgcctggccgccccccgcgaccccagtccccattccaagctctcttcattggttcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaactccagctgggagcccaaggtgccgctgctctacggcggcaccttcagcccatggggcgacgtcatggtgtctcgggagatgaggcgggaggacgatgacaaggtcagtgaccatgacgtcgaaggaggcgaggaggacttggactgcagtgagccggggagcctgcgtaggtgcagctggatcaccaagaacagtgacgaggcgtacgtccagttccacgacgagtgctggggcgtccctgtgtacagcgacaaccggctgttcgagcttctgtcgctgtcagggatgctgatcgaccacaactggacggagatactgaagcggcgggacatgtacagggaggcgttcgccgacttcgaccccagcgcggtggcgcggatggaggaggaggacgtggcggagatcagcggcgacagggagctgaggatcgccgagtgcagggtccggtgcatcgtggagaacgccaggtgcatccagagggtggccagggagttcggctccttcagcggctacatgtggggccacgtgaaccaccggccggtggtgggcaagtaccgccaccacaagtacatcccgttccggacgcccaagtcggaggcggtgagcaaggacctcgtccgccggggcttccgcctcgtcggccccgtcatcgtctactctttcatgcaggccgccggcatggccatcgaccacctcgtcgactgcttccgcttccacgactgcgtccgcctcgccgagcgctcctggggcatcaccaacgtcgccgcgtagccagccggcccctcaatatctgtgcatgcattcctctccaactttttcacaccttcttcttggtgttgttattttttttttgtttggagatcgaaattgtgtgtgtaattacgtagagtatgtagtactctactaagttatgatgtaatacttctattaactctttgccaatgaaaagtagtactgaaccaaaaaaaaaaaaaaaa

SEQ ID NO: 2927 - DNA, 1410 bp, Zea mays
cctcgaggccggccgggaaaacctcattccatgctctcttcattggttcatacttcatagctagtttgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaactccagctgggagcccaaggtgccgctgctctacggcggcaccttcagcccctggggcgacgtcatggtgtctcgggagatgaggcgggaggacgatgacaaggtcagtgaccatgacgtcgaaggaggcgaggaggacttggactgcagtgagccggggagcctgcgtaggtgcagctggatcaccaagaacagtgacgaggcgtacgtccagttccacgacgagtgctggggcgtccctgtgtacagcgacaagtatttgatttcgccaccacatttgcttctccctgatgaatgaatttgtgaactaataaccggaagcgtgggttcatgctgtacgcacgcagccggctgttcgagcttctgtcgctgtcagggatgctgatcgaccacaactggacggagatactgaagcggcgggacatgtacagggaggcgttcgccgacttcgaccccagcgcggtggcgcggatggaggaggaggacgtggcggagatcagcggcgacagggagctgaggatcgccgagtgcagggtccggtgcatcgtggagaacgccaggtgcatccagagggtggccagggagttcggctccttcagcggctacatgtggggccacgtgaaccaccggccggtggtgggcaagtaccgccaccacaagtacatcccgttccggacgcccaagtcggaggcggtgagcaaggacctcgtccgccggggcttccgcctcgtcggccccgtcatcgtctactctttcatgcaggccgccggcatggccatcgaccacctcgtcgactgcttccgcttccacgactgcgtccgcctcgccgagcgctcctggggcatcaccaacgtcgccgcgtaggcgtagccagccgggccctcaatatctgtgcatgcatgcctctccaactttttccttttcacaccttcttcttggtgttgttattttttttttgtttggagatcgaaattgtgtgtgaaattacgtagagtatgtagtactctactaagttatgatgtaatacttctattaactctttgccaatgaaaagtagtactgaact

SEQ ID NO: 2928 - DNA, 1614 bp, Zea mays
ttcttcgccaatccaactcccgtcttgcttcttcctcttccttgttcgaatccaagtaacctacccaaaccgccaaccccccaccccaaggaaggaaccctacccacccgtgagaaccgccgccgcacaaccccggacgtggtggcaggcgaccgatccggatccatcatcccaagcttcctttctgtctcctcttcatccatctccacaaggataatcaaggaaggaaggccatggttttgttcgaacttgacccggacatcatccgatggggtcttcaccatctcctccccgctccggctggatactctcctcattgtcgcacccaaaccacccctaccacaccttgtacagcttttgctcgccctcctcatcagcccatcggagacatgggtacctcaagctccgttgagatcaaggtcgagcatgtcgatggggttgacaacgacgcgatcatcgcacaagccctccaggaggaattgtccaatgtcgccttcgccgaagcgtccgggccaacctccgccgctgacaatcaacaacattctgctgttctcacgcagcaatggcttcgcccacgcgccgtccatgtagaaccagcttctcaagaggcagggaccagggaggaacctttcagcacctgctcaagccctggagatgacaataacgtccaggacagccagcaatgcttgatagagctcatggataacttctctgtcattgacggtgaagtgggcaaaagattgaacaacatggttcctgttcctcatgttcctaaaactaatggagagattccttctgttgacgaagccatttcagatcatcaaagacttcttgacaggttggtggtgtacggtttggttgatctcaaggttaaaggagatggcaactgccagtttcgagcgctgtcagatcaattttaccgaactcctgaacatcacagatttgtccggcagcaagtggtgaagcagcttgaatcgcatcctgagatttatgcaggatatgtccctatggactacagggaatatctcaaaaagatgtcaaagagtggagaatggggtgaccacgttacattgcaggctgctgcagactcgtacggtgtaaagatcttcatcctgacatcattcagagatacatgttatattgagattcttcctgttgttgagaaatccagaagagttatatgcttgagtttttgggctgaggtgcactacaactccatatatcctgaaggagagttgccggttttggagtttgacaacaaaaggaaaaggtggtggcccttctagctaggattcccaggacagagtagatagagcagctttaacagactgaggcctttctgttgggctgtgacactgactgatgacgaaaacgagcccatgggtggtggacggaactgcattggccttgccctccttgcccacacgatagacatgtacagtgcgtagtagatggtactatttgcctacttggtaacccattctcagatatatcttttatctctattactataataaagctccaacatgtaatgggccgataacggacgatacaatcggtctgaatgggccgatacaattggtttgagtatccaaaacaaaaaaaaaaaaaaaa

SEQ ID NO: 2929 - DNA, 1735 bp, Zea mays
ccgggttcttcgccaatccaactcccgtcttccttcttcctcttccttgttcgaatccaagtaacctacccaaaccgccaacccccaccccaaggaaggaaccctacccgtgagaaccgccgccgcacaaccccggacgtggtggcaggcgaccgatccggatccatcatcccaagcttcctttctgtctcctcttcatccatctccacaagtaagatgcaatttctcccttttcttcctgtcgggcggagatagtagtatattcttcgaggaaacctaggtgattgcaatgtcgttttgatgatgatgattcccgaccattttatctgcacagggataatcaaggaaggaaggccatggttttgttcgaacttgacccggacatcatccgatggggtcttcaccatctcctccccgctccggctggatactctcctcattgtcgcacccaaaccacccctaccacaccttgtacagcttttgctcgccctcctcatcagcccatcggagacatgggtacctcaagctccgttgagatcaaggtcgagcatgtcgatggggttgacaacgacgcgatcatcgcacaagccctccaggaggaattgtccaatgtcgccttcgccgaagcgtccgggccaacctccgccgctgacaatcaacaacattctgctgttctcacgcagcaatggcttcgcccacgcgccgtccatgtagaaccagcttctcaagaggcagggacccagggaggaacctttcagcacctgctcaagccctggagatgacaataacgtccaggacagccagcaatgcttgatagagctcatggataacttctctgtcattgacggtgaagtgggcaaaagattgaacaacatggttcctgttcctcatgttcctaaaactaatggagagattccttctgttgacgaagccatttcagatcatcaaagacttcttgacaggttggtggtgtacggtttggttgatctcaaggttaaaggagatggcaactgccagtttcgagcgctgtcagatcaattttaccgaactccagaacatcacagatttgtccggcagcaagtggtgaagcagcttgaatcgcatcctgagatttatgcaggatatgtccctatggactacagggaatatctaaaaaagatgtcaaagagtggagaatggggtgaccacgttacattgcaggctgctgcagactcgtacggtgtaaagatcttcatcctgacatcattcagagatacatgttatattgagattcttcctgttgttgagaaatccagaagagttatatgcttgagtttttgggctgaggtgcactacaactccatatatcctgaaggagagttgccggttttggagtttgtcaacaaaaggaaaaggtggtggcccttctagctaggattcccagggcagactagatagagcagctttaacagactgaggcctttctgttgggctatgtgacactgactgatgacgaaaacgagcccatgggtggtggacggaactgcattggccttgccctccttgcccacgcgatagacatgtacagtgcgtaagtagatggtactatttgcctacttggtaacccattctcagatatatcttttatctctattactataataaagctccacacatgtaatgggccgataacgggcgatgcaaaaaaaaaaaaaaaaaaaaaaaaaaaaaaaactagagggggggcccggtaccc

SEQ ID NO: 2930 - DNA, 813 bp, Zea mays
aggcaattgaggcccgggacagagattatatctgtacagagtactggcgatcaaggccccatgcaacaattgagaatcgcgcccgtccgcccacgcctccgcaggatccaccccttgttgcactgagggggctcttccagcgggctaattgtgatgaactgcgagcactacgcagtttgctgatgagcaatagaattctgggcgacaattctaggcagcaggcttgccaaatccttgatgaggagattgcgaagcaatggcactgaccagcgtaaatacaggatgttgtactaaccaattgtttggcatgattttgttttgacgggataaatcagttttaaggcttgcttcttccgttgcccttgtgcccattcttttcattcttgtgaccatacccaattctttattgcaagtggtgtcaacaagcatgaggctacagctgcatcacctgcaaggaagtcaaaagtaagaggcacatgcatttgtaatggcatcataatgttctttattcccatttcattatggttcctcactatttctgaatagttgtggctgattgttatgttacccaatgacaagggtgagtaacttattataagatgtagctggggcatcatattcctttgttcttgaaatctgttaaccatgcatgcttgtctgatgtaaaccacccttagattccgggtactcggtcattattgggattattctagtagttgtattctttgtggagcaaataacgatttatatgtattgtatgcatggtgtaactataactaactctttcatataaactgtatcagcattccatgc

SEQ ID NO: 2931 - DNA, 1147 bp, Zea mays
aaccccgggtttcccccgcgtccaagcgactttgtacaacgccctttgatagatatttgttcttgagcttcttcgtttttgcaccaaaagacaagcaggatgtcttgcagctgcggatcaagctgcaactgcggctcaagctgcaagtgcggcaagaagtaccccgacctggaggagaagagcaccgcggcgcaggccaccgtcgtcctgggtgtcgccccggagaagacagctgctgccgagttcgaggccgcggcggagtccggcgccgagacctcccacggctgcagctgcggtgacagctgcaagtgcaacccctgcaactgctgatcgaccgacgaccacacatggggaacgaagaccgacgatatgcatgctgctgcttatttgatggtgatatcgatcttgtgccggcgacgtacggtactactagctactacactacatgtagtgctctgcaattgtgttattgtgtgtgacgtatgtaactgatggttgaacaataaggacgagctagctatctgctatgtatttcgatctggctcgccagcatgcatatatatgcgatctatatatctgcccttgtgtgcctgatcgagagagagagtatacctcttttgcttattggccttggcgtcagtcttgtgctcttgcatttaattatgtgcatgtgtgtgtactgtgtatccatcttgtgctcatacatcgatctctatgtgtctctgtacgtaatgacgatatgatttcgtccagggtgatttatatataaaactggtatggtttatttgcctgagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaataaaaaaaaaaaaaaaaaaaaaaaaaaaaaactaaacaaaaaaaaaaaaacattaaaaaatgaaaaaaaaattggagtcccctggctgaatttcaaaaaagcacatccgggtaaaaccaggtggttccatatttaagaggccctaaaaaaaatccctttccaacagtttcacaaactgaataagagaaaaacacgcgccctctctcacaaaattaacccacccaaattcgctatttacacgcaccttgaa

SEQ ID NO: 2932 - DNA, 1474 bp, Zea mays
ccccctgctttacggggcgttggtaacatgcatcggcaaatatgccgacaagaatatagttactcagacatggagaaggtgtacgcttctgcatgcttgcaatcaaagatatcggcagcgaacttggctcccatcccatgtcccacgacgcgggctaatcgcttgtgacccgcagtacccgcgcggccggcaggaccgctctgaccgccgcttgctagcttttcacttccattattatccctcctagtcctaggccggcccgcacgaagccgctcgacgtgacgcttaccggtccccgcatgacggcgatcgagccaaaagctagcacaagagagaacgccgagagaggcagtatagcggtgcacgagcattagagcagtcccaacacaccagatcatccagtttctagagaattaattatactgccatgtcaccaatttgatgatgtggcaaggagtttaatgaagaaagagagaagtggtttctcagaaacgaaaccaagtcgacactcgctccaatgaccgtagaaatcacgaacactgggtacctcgaggccggccggggatcgtttctatcctcgttttcctccctctcctccagatccggtgctcctctccgccgcctccctcccgcagctcccatatttttccgtcgctcgcgcgcccgacgcctccctcccgcgctcccggtgcttatgcgcgccaaatctcccgccagcatctccttctcccgcgcacgcctctggctttcgttccagaccaggctccggccagatgagaacgctccaccagtagctaggcttcattttcctttttaatggctcatttccatcccctgatctagcgctaaaatttagtccccaattcatctctaaggaaaatcgagtttcagatggatttgttagggaagggtggtgcgcaacaaaagaaatcaaagaagtcttctccaacctccagaaaatcaactgttgttccggccatggcatctgcaggcagtgcaggcgttgcagctccaagcacgggtggtcgaagtagttctcatccattttctgtggtttgggatgggatggcacttggaggctcattcgcgtctgaatcatctcccaccagctctgaatggctatatccaccaggcgggtttgtaaattctctaaggatgccatttccttatgctacctatccgaatggcagccaacttccagaaaactcccattttgttggttgtacaagcaacaaagggactccatcaccaactaatgataaagggactcctattgcagaagtacatgattcaattgacattgacgccgatgacaccctagagcctgctagaactgacaaacgattgaattggtcacatgaagaagatgttagattggttagttcttggctacaaaattcactagacccggtcgatggaaatgataagaagtcagattattactggacagatgttactaatacgtacaacagca

SEQ ID NO: 2933 - DNA, 1720 bp, Zea mays
cttttgtcagagaaatgctacataatgcgaaagctgacattgcaactttacgagttgacaagaacagtagccttgttttacagactgcactgaagctatcgtctggtgatgataatgaattgcatcatataatatcaatacttcttggttatgatgaatataaaactgtacagacgagagattacagtgaaaaaatggacgagattgttactttacttgaagaaagtgcttatagtcatctcttggaggtgattgtggaggttgccccagacgaattgcgcaatggtatgcttgcacgtagtctgaagggtgcattatttgcaatctcatctcaccactgtggtaactatgtggtcccacgcgtccgatcatctactaaaacctcagatcagatgaatcaaatatgggaggaacttggtccaaacatgaaggaattgcttgaactaggtaaaacaggggttgtagcttccatcttagcggcatgtcagcggcttgaaacttatcgccttgagagttctcaagctcttgctgcagcgttaagttcagattctgagtctactgagagcattgttgcacgtatactttttcttgagaactacctacatgagagatctaattggaaatggattcttggtgcaaaaatgagcattctgggttgcttgatgctgcaatctattttccagtacccgcatcaatatattcgcccatatgtcgcaagcttgctggccatgggggatgatcagatcctccaaatttccaaggattcaggaggttgccgtgttcttgagtcttttctaggttcaagtgccactgcaaagcgtaaatttaatgtttttggaaagttgcaaggtcattatggagatattgctatgaatccttctggctcattcttagaagagaagtgctttactgccagtaacttttctcataaagaggctatagtggcagagctgttggctgtgcaatctgatctatctaaaacaagacacgggttccacttgctaaagaagctggatgtcgatagatatgctaggcgacctgagcagtggagggctagtcgaacttcaaaagaaacaacccaaaaaaagtttgaggcagaatttggctcaaacagtcaatctactgggcagattgttaaagaaaagttctctcaaagtcgcacgaagaagcgtaagcagaaagagaaggttgacaaaattactgaggatgccaggagcaaccaaccagacttctctcagaaaggaaacagtaagaggccaaaatctggcagcgcaacttctgagaaagagccccctgagtgaaggtgctagtgctagcatggtgttcttgaagggctctgtcaagaggaagtccccaggtttcctttcagataaactgagcttcaagaaacaaaaacctcacaaacccgattctggtagaccagacggcaaacgttttgttcgagatagtgatactagcgcaccgttcgtcaagaatgccggcaaacagaaacagtccattgctgagctcgcggacccggctggtaaggagaagctgactgcgtctgaagttcgcaaattgctgaagcctgaaatgtcaggcaagagctaatgagtttagggtgagcgttggtcgtttttcctcgtatgttgcggaaagaaactgtggcacgtgatatgggtttgtttcagtagaaacgtattcgtgatacctgtcctgataccggtttctcttgctcgag

SEQ ID NO: 2934 - DNA, 2133 bp, Zea mays
cctggccgggagtgtcgtcgtcgggatgtcttagaggctccagaatagaggagaggagagagagagagagagagagagagaggaggaggaggacgaggagtttgtttggacgctgctccaaactccgagaaaggcaggcacagccagtgataactgtcaacagtcagtctatttacagcgtctgctgcctgctggctgctgcctcgccccgcgtgaatcaataatcattgaatccattctaccgctgctcctcctccttgctctgccgagaagccggcgatgaggggccgcaagaggcagcaggtgagcgccagctcggccgccgcgctggtgaaggggagggagagcaccaagcagaaggagaaagaagctaggaaggagaaggaggcgagggagaccggcagggagccggcggcgaaggagaggcagatgaggcgcaaggccgggaaggagaaggagacggagacgggcggagaggggaaggagccagccaaggagaaggaggtcagggaagagggcaaggagaacgacaagcacaaggagaaggcgaagacgaaggccaacgtctgcccgcagttcttcaaggtcttcttccccgagcagtccacggagcggctgagaatcccaaccatgttcaaccagcacctcaaggagcagcagccaaccggagcagtttccctgagaggcccgagcggcaacagatggcaggcagcgctcgcttcagagtccgagtcggaggccgcgtggtgcttcgagcagggctggaaggagttcgtcacggaccactccctcaggctaggccacttcctggtcttcacgcgcgacgggcccgcccagttctccgtggcggtgttctcgtcgtcaggcgtcatcgacccggcagccctggacgcgaggcccgtcaagctcgaagagggcgaaggcgtcggcgtcggcgtccgaggtgacgtggacgcaggcggcgacaccagctctgaggtgtcgcttctgcccgcggaagagggcgatggaggagcgacagggaggagaacaggagcgacgagtggtggcgctggcggcgcctctgagatgccacttgttcttagagaagagggccgtggagtgacagggaagagagcgagagcgacgacgagtgatctcccggcagatgccagtgcgccaaagaagcactctgccctcgcgaagaaagctggtaaaaggaggcctcaagctgccacttcaaaggatgtgtcgatgattgttcacaatgccaccttcagtttgttagacgaatccaagactttcaacaagactcagatcagagacaagaacgtgcctaggagcggtaaattccttctgaggaccaccaaagcaccagttgtaatatcccaaaggcgccgagtaaccgaagaagagaagtgccttgctctcagaaaggcaatggagttcaagtcgaagcaccctttcaccatgcagataatgatcgagtcttatgtctacgtgggatttttcatgaacatcgcctgcgagttcgtcagggagtcgctcccccgcacgagcaagaagatgacgctctgggacccgctggggaagccgtgggacgtcagctacgtctactacggcgaccgcgccgccggctccttcggtggcggctggggtaggttcgctctggggaacaacctggagaagtccgacgtctgcgtcttcgagctcttcgaggaggacaacatgcgggtgcacatatacagggtcgtcccggagattaccccgctcctgcgcgccagcaacaaggactaggcttgcggctttcctgtcgatctgcggctagtggagaataacaagaagaccggttggtcattcacaatgctggaatggaattcggtgctcgttcaagagagagagatgctaataatttcccggaataaataactgactatgaacagaggagtctattagtctatgttcgcttagatttaattcgtaccggtttctactgtttatacaatgtttataaattacagttgcagcagtccaattagctggctttaatcgtgcccatattttggttggaagttggaaccctggtgactggtgtgtttgcttaactgatatcgctgtgaacttgcagacaaaaaaaaaaaaaaaaaagcggcc

SEQ ID NO: 2935 - DNA, 4330 bp, Zea mays
acgtaggggggcccttatccgtatcttgggtcctattggacctttttctccttcttaatatatattcgcgcagttctcttgcgctttcaagaaaagcccttatcttgacttatcattgagcaaaccttgtgtccaatacagaggtgaaaaatcatgttttatcgatatgatgaagaaaaataaaatatgcaaatgtttagatgtaaccctagcaaaaaaaacatatatcctggtatgtacattcaacaatggacttgaagtcttctgctaatctacttgggtgcgcttagcaaacaggttaaaatctaatttttctctactaccaattatagatggccaataagcatgaggcccgcgagcccaacacaaagcccgctgtttgggcccggtccgagcccggcacggcccggttctatgcgggcccagaccggcccggcacgaataagtgggtcgggctcagataggaaactaggcacggtgagctagcctggcacggcccgtttacctctaagcccgttaagcctacttttttacactaaaacgtgcttaccggctcgtttagcccattttttcgtactaaacgggctggctcggaccgtttagtcccgctgcgggccgggctcggacaggaaattgagcccgcgtgcttagacggtccggcccggttttctaaccgtgtctggcgggccgggccgggccgggccgggacggcccgtttggccatctctactaccaatcaacaacaggaagtcaataaaaacttgattgcatcatcgatctacgtgcacttgatgcttgccagagaacgcagcaacataaggctcatggcttctgccgatagggacaacaatgataggagctctccctcctttttttcgatggatcagagtaaaattcattgacccggaatcaactttctctcgacagcaacgattgcaaatgaatcggcaccactaccgaaaaatagatccaaacgtacgtggtggcgcgacaaacttttgtgagatagcaacgcaggcattctagaatcctgcatagcacaagatcagatgcaatgcatagtcttttctgtttctacccgtgtgattgatgactatgtctgtgtaggtgtgctcgtatgagtctgcccaacagacacgtgacttttacccgtacccgcgcatgcagctaaaaagctaccgcaaaatacgtgagttgcatctgcacatacatgtctaaccgagtgcatataggtaacgaacatgctctcggagctagtcaacgcatgcagagagccatgctagcgaggtacatccaaccaatcatgcagtatatgactccagcatgatattttcatgcaaaatgagaatttttgttgcagcggcgaacctggcaggcacaaaacttgtacaaccaattgctgctgtcagaggacaacttactccatgttggttgctgcatccatgtcaaaagatgtctggctatgctcttggctctcctccttgttgcttcactctgttttctgttggttgatggcttgctgcagacgggtacaaggccacgtgttgaggtctcagtcaggctcggcagctcagcccatgctccctttaattcctttctactcaattcagtgtttcagcaaatggggaaagatcactcatcagcaggcccattatgcaggacgtactagtgatcagtgaggcacgagctacagctaagctgaacatgtggcatctgaagtaggttagctgagatctaatctaataattgcccaatgattgaacctgcaggttaaggacattagaatgacaaacatgtgaaagcaaaatagccttttgatgttacagttagttagagtcatcttgtgattgttcttggtgatcaagcatttttacagtccccggagaaataaggaaaggtactagcaccggtttagctagaactgattttggtatctcctcatagaaatataaaattagttacaagtcagttgtccgtgccttactacggtttctatattcaacccatctataatatctattctttattgaatacaaatgattgtgagctccaatagtttataaccaagacgtgggagggaggaggacgaccaagagcgggcccagaattttcaacttggtattccgaatataaacatactagaattttttttggattgcctaattaaatctactatttagcatctataatatataacagtgctaatcacataatagatactagtagcaaatatttcacctaattgaacatagttcaatattcatacaattaatcacaatttttggacctgggccgttgggcgctgggccttgccactggctggctgcaccttgctgcgctatcgcactggagcttgcggctggtgtgccacacactctcaactcacagtcacagatacagcgtgaggccaacgctgcccgtaggatgactgccgatgtgtagttcccccaccgccgatatagggttctggtttcattggatagaggcagattgacagaagcagatgtcggaaagaagtttcagtgcacttagatcactaatgctgatagataattgcggctccttgttggctgcaacgtttcagtacactgttcatgaggttggggggacttggatggcttcagatttcgcgccacggagatgttggtgcaaccaccagaaaactttggctcatctgcagttaatggcctcttcatttcggtaggttcttgatggcaaagtcacatatatctacggggtcgttgccagctgatgacattgtactcaaggaatcgtacggatagaaccgtttcgcaactcagaacaaacgaaatggttaggaacttaggatccaaatgtatattgtcatcttgatggcaaagtcacatactgctgcatttggatcattaaaagaacaaacgtatgtgcgatttaaacgctgacaaataaacaatgtatcgaattcagagtcaaatcacaggtagttaggatagtagtagtactatcgatagccaggaaaacactactttgaggaggaaaaacatcctgatgacagagaaacatcaagtagacatactactctgttctgtatcactcatctcatccgccattgatttcttggaggtgggtagcaacctaagcccatgtgacgaggacgagatcagatgggtgcagttctcgggttcctgtacttcttgaccattaacagcttcttgacgagcctgagcatcagcatcaggctccacttccggcgccggaccaccctgccgtcctgtgggtgcatatgcttgccgtgcttctccaggtcaaggacgatcatctcgtcgtcgtcgagccagccggccgcctccttcatcgccagccctcccttgttgatcacagggctcagcgggcacagcggcggcacgctcgcgagctcctcgttgaagtcctcccacagcatgtccatcttctcctcctcctcttcctcctcctcggcagcagcggcgaggaaccacggcgaaggggagccaccaaggccgagctggtgcgggaatgctgatggaagaagctgcactcctgcatggagagtggggaaagtgaagtcatccatccttgatgcgagcctgcaaatctttgaagtgtataggagtatgtggggtgttgatgtatgtatgctactcccccgctagcccctttgtatctctatatataattcttttatatatgtggaacacttggtctgcactactggcagctacagtacgagagtgggcatagcatggatggtgcaacatcctcatctacctaccagaaattggtttgtctgttgaattgaagatatagtttcaggcatagagtttcaactttgaagacatggatgacaaagcaataattgttcagtgattaatgcacactattgagccaaatgaaaggccttgatgcttccagtgatcacctgttatgttatgcaggatatatgcactcagaagttctggggcacgcaaaaggctgtgcatgttgtagaaatgtagagtgtaccttaaagaatgttcaggcctgctgtctaacagaaactgtgaataaaggatgctgctggttggactaaataaccagtagtacattttgaggaaaagggatactggtgctgcatatggctggggtgattggaaagcaaagggatggctgcctggaatccatgaacatgcatgcagatccgcagtatttgagtggttctggtcttttttagagactgagagcaacagcccagatggctttctgctgaagatatgatgttgcttggaaacaaggaatctggtctgcctgctcccttatgttcctaaaggtttttggactaagttacttttttttc

SEQ ID NO: 2936 - DNA, 1152 bp, Zea mays
ctgctgcctgctggctgctgcctcgccccgcgtgaatcaataatcattgaatccattctaccgctgctcctcctccttgctctgccgagaagccggcgatgaggggccgcaagaggcagcaggtgagcgccagctcggccgccgcgctggtgaaggggagggagagcaccaagcagaaggagaaagaagctaggaaggagaaggaggcgagggaggccggcagggagccggcggcgaaggagaggcagatgaggcgcaaggccgggaaggagaaggagacggagacgggcggagaggggaaggagccagccaaggagaaggaggtcagggaagagggcaaggagaacgacaagcacaaggagaaggcgaagacgaaggccaacgtctgcccgcagttcttcaaggtcttcttccccgagcagtccacggagcggctgagaatcccacccatgttcaaccagcacctcaaggagcagcagccaaccggagcagtttccctgagaggcccgagcggcaacagatggcaggcagcgctcgcttcagagtccgagtcggaggccgcgtggtgcttcgaccagggctggaaggagttcgtcacggaccactccctcaggctaggccacttcctggtcttcacgcgcgacgggcccgcccagttctccgtggcggtgttctcgtcgtcaggcgtcatcgacccggcagccctggacgcgaggcctaccgcgaacggcggcgcggccgtcaagctcgaagagggcgaaggcgtcggcgtccgaggggacgtggacgcaggcggcgacaccagctccgaggtgtcgcttctgcccgcggaagagggcgatggaggagcgacagggaggagaacaggagcgacgagtggtggcgctggcggcgcctctgagatgtcacttgttcttagagaagagggccgtggagtgacagggaagagagcgagagcgacgacgagtgatctcccggcagatgccagtgcgccaaagaagcactctgccctcgcgaagaaagctggtaaaaggaggcctcaagctgccacttcaaaggatgtgtcgatgattgttcacagtaagaatgatacaagacaagagccttgatttattgaaagaatgaaaaataatctgttttttttttgtttct

SEQ ID NO: 2937 - DNA, 8702 bp, Zea mays
  misc_feature (2362)..(2362): n is a, c, g, or t
caaaacaagacagaaggaaggcttattgatcttatttttccaagaataatctatgttagacttttggtgatgcaaaaatggagctaaaaatattgtattctgaaatttcattttgtaaattttgagttgaaactcttagttctattttttgtgaaccagctatagttctaaggagaggatgtttagatggaaccacgaacattgccatgcgaagaagaaagtggaaaagatgtccaactcttgtttgcacctgggtgttgattagccacctctccaaattttgtgccttcatactaaataacgataagattgtggtgatcaaaagaattttctctcagtccataaaaggtgattctaacaactaattttattgtggcatttaaatcttacccaaacatagaagagcaagaacatactgaacccaatactatggttcatctattctatctaacatctttggttgatcattgtaatttacaaataacacctttcaccaccacaccatgtcagagggtgttcttaacaaaatataccaagcaactagatacattagatctaagatgagtggtgatgatttaatatgtgaactaaactttcatgtaccgcatcatttggccaagtgtttggtccctacccttcactcctttgattgtgcacacttaatactctagagcagtaaaaacatcccatttcatagcatcgtcaatacagtttgcttcacagagctatgttggcatgtttatcagatatttatttgtgatatttcattgacttgcatccataggatttaaatacgtaaataatatcctggcacatatttttagtctacagatacctcacaagatggagagggaatgtatcaacttttgtgaaaaaaaattaaaattttttgttggcctacattccttcatttggaaagaaatcttgaggtaacttaaactccatgcgcaagaaccaatgctagacatagaaaatagagtatgtatgtcgattttagtgttggctactcttagcgtactccgagtgaactcataagagcaactcttgtagacatctacttgaaccttcaaaattaaaatttaaggcttaagataaaaaaaaaacaaaatctgtcaaagtctatactagagcccttgaattttaggagaccacaaaacttcctccggcactcattcctgatggctccaaagagaaagaaggaagaaaaaaaaaactagctggtctcggctgattgttcctatagaaagaaggaagaaaaaactagcgcgctgatgcaccctaaaatctaactgaaggcatctcctgctgatggatccttacataactccaacactccagcagcccactgtccaacagacccaaagcgggggttcagaccatcgcctttccatccattctcccctgttttcgtgaaaaaaggctggcccctctagcctccagcaaccattccttaaacccacggagggtccaggtccagccgtccaggctccagaaagaggagaggagagagagagagagagaggaggacgaggagtttgtttggacgctgctccaaactccgagaaaggcaggcacagccagtgataactgtcaacagtcagtctatttaccgcgtctgctgcctgctggctgctgcctcgccccgcgtgaatcaataatcattgaatccattctaccgctgctcctcctccttgctctgccgagaagccggcgatgaggggccgcaagaggcagcaggtgagcgccagctcggccgccgcgctggtgaaggggagggagagcaccaagcagaaggagaaagaagctaggaaggagaaggaggcgagggaggccggcagggagccggcggcgaaggagaggcagatgaggcgcaaggccgggaaggagaaggagacggagacgggcggagaggggaaggagccagccaaggagaaggaggtcagggaagagggcaaggagaacgacaagcacaaggagaaggcgaagacgaaggccaacgtctgcccgcagttcttcaaggtcttcttccccgagcagtccacggagcggctggtgcgcatcttcacgcccacccatcccccctgttttggtttaattaatccgcgaatcaatgcgtggactactgtgatatcgcttccggtagcagtttattttcccccacaaacaaatagtgtgtctggttgttagaaatctggatcctgtttcttgcgattgtgatgctcagcaaagaaaatgtgaatttcaatccccccccccccccccccccttttcctcccctgccgagttaccttttgttttcctactaatgatctatccgccgactgcttgtcatgtgccggtgtctgatttggcaagcacgcancaaatgccacatggaattggacacttgcgtgtagcattttttcactatcgtttcatctcatggcttactggctaagatttgcatacattccatacatcactgccttttttttatgaaatctcatcacgcatgtagcgctcgcctcattgtctgtcagttcatctgtgcattctggaggcaaagtaaactatcagcttcagaaatacgtttgttgatccctgcgcagagaatcccacccatgttcaaccagcacctcaaggagcagcagccaaccggagcagtttccctgagaggcccgagcggcaacagatggcaggcagcgctcgcttcagagtccgagtcggaggccgcgtggtgcttcgaccagggctggaaggagttcgtcacggaccactccctcaggctaggccacttcctggtcttcacgcgcgacgggcccgcccagttctccgtggcggtgttctcgtcgtcaggcgtcatcgacccggcagccctggacgcgaggcctactgcgaacggcggcgcggccgtcaagctcgaagatggcgaaggcgtcggcgtccgaggggacgtggacgcaggcggcgacaccagctccgaggtgtcgcttctgcccgcggaagagggcgatggaggagcgacagggaggagaacaggagcgacgagtggtggcgctggcggcgcctctgagatgtcacttgttcttagagaagagggccgtggagtgacagggaagagagcgagagcgacgacgagtgatctcccggcagatgccagtgcgccaaagaagcactctgccctcgcgaagaaagctggtaaaaggaggcctcaagctgccacttcaaaggatgtgtcgatgattgttcacagtaagaatgatacaagacaagagccttgatttattgaaagaatgaaaaataatctgttttttttttgtttctcgctgttttgttggttcactgttgagtgttgacatctttgcaaatgactgatagttaatagtggagttattctatagcgtgtttcattgacaaaatcttagctctttgtcggctaagattttgccgactcctgtcatttttttggcataaataaaaataactgctctattatgttaggaacacgattgcagtcccagctgagcactcttgagaaaccagcactactttttctagctatgattcattcagaaaccgtaaccattaccgtccatgtactttctcatcaagtcaaccttttgcattcatgccacagatcccaccttcagtttgttagacgaatccaagactttcaacaagactcagatcagagacaagaacgtgcctaggagcggtaaatgtaagtttttttttttgcttcgtcttcactgaacaattctattgcagtgaaactgtcatcattatcgttaatctcgactcagttcctttggattgtattgtatgacaactgtgaataaattggtgctatttccagtccttctgaggaccaccaaagcaccagttgtaatatcccaaaggcgccgagtaaccgaagaagagaagtgccttgctctcagaaaggcaatggagttcaagtcgaagcaccctttcaccatgcagataatgatcgagtcttatgtctacgtgggatttttcatggtataacaacgtcaactatttcccacacttccattccattggcctgctcaacaaacacatctcctccattgcttctctggccgctactgtgtttcagaacatcgcctgcgagttcgtcagggagtcgctcccccgcacgagcaagaagatgacgctctgggacccgctggggaagccgtgggacgtcagctacgtctactacggcgaccgcgccgccggctccttcggtggcggctggggtaggttcgctctggggaacaacctggagaagtccgacgtctgcgtcttcgagctcttcgaggaggacaacatgcgggtgcacatatacagggtcgtcccggagattaccccgctcctgcgcgccagcaacaaggactaggcttgcggctttcctgtcgatctgcggctactggagaataacaagaagaccggttggtcattcacaatgctggaatggaattcggtgctcgttcaagagagagagatgctaataatttcccggaataaataactgactatgaacagaggagtctattagtctatgttcgcttagatttaattcgtaccggtttctactgtttatacaatgtttataaattacagttgcagcagtccaattagcaaacaaaaaaaaaaccaatattttggttggaagttggaaccctggtgactggtgtgtttgcttaactgatatcgctgtgaacttgcagccgtcggcgtgatgattcgctacatgaacattattgttgtccccattgattttttttcttcttcttcttgcggtttatggcagaaactttacttaggggtacaaaaacaggagagctgtcgcgatttatctgatcagtttcgcttttgccttggctggtggagcggtagttgcgaacatctgggtcttggggtgaaacagaagcctcgaccaaaaagaaaacctggttgctttatgaatgaaattgtctagccatcgcttggttgctttctggcaactgttgctaaactgtttctatcgtgaggccatgcttttctcaatcgctggtgttttcttgtatcatctgtgagatagcagcccaggcatcctagaatcctaaatagcacagcagcaataacactgtttctattagaaatatgtccctatattactaggatttctatatattacatgaatagattttattttaataggtgggtgccagtggagccaacagccagagttccaacctccactcatgcgtaatgttactttatttcgtataaaatgggaagaacagaggcgggcccatggggttttataggtattcattaaatactcaagttttaggtagtctatagtaatttgtcaataatgtattacataaaatagtgttagagcactaatttctttaatcttttgaatttttaatacccaatatcaaatggctggaaccgcttatgaaggacaaggatgacgttcgccgaccgtggaaccgtgatttatataatagagatttgatttcagcgcaatatttttttcatgtgaaataagattttttttgttggttacaacagcgaagctgacaggcacaaaacatgcacaaccagttgctgctgtcgagaccaacctgctctccatgtcggttgctgcatccatgtcaaatgcatgctcttgtcttggccctccactccacctccgtgttgcttcactcgtgttgcttcactctgttttctgttggtcgatggctcgctgcagatgggcacaagaacaagaccacgcgctgaggtctctcagtcaggctcggcagctcagctccgctgatgaggcctccctttaattcctttctactcaattcatcaccccccccccccccccccccttttgcagtacgtactggcgataagtacgagtgtgagacacgagcaacagctaagctgatcgtgtggcatctgatgaagctggttagctgggatctaatccaatcattgcccaatgattcagtctgccggttaacaacatgagaatggccttttgatgttaccgttaatagagtcatcttatggttgttcttggcgaccaagcgtttttacggtacgtaaagaaatcagcaaaggtactagcaccaattttgccagagttggtcagggtgtctcctcgtagaaatgtagaatcatttacaagccagtgcggcggattctagcagtacttcccaaggacgaggaagaagctccctgtcagtgtcactgtcacccggagaaccgacttcaacaaaattaaggggcagagaggtgtacactgtactgctcctacagctgttcatcgatcatgtgggggcgattaggcaagccggattaagattaatgatggatgaggcagggcatttagaccactaatggccggagatatggtactctctactctgatcgcggcttcctgttggttgcgatgtgtcagtgacactgttcgttgatcatggtgtggttaggcgagccggattaagattagtgatagatgaggtagatcactaataataataatgctgagagagagagagagatggtactctgatcgcggcctcttgtcggctgcaatttttttcagcgtgctgttctgttcatgaggctgggggacttggattggcatcccattttgcgccacggagatggtgttggtgcaaccaccagaaaagctttggcctcattctgcagttaatggccccttcatttcggtaggttcttgatggcaaaggcacatatctcgttgccagctgattggcattgcactcaaggaatcgtacggacagagccatttcgccacggctgagttgagctcaggatggtatccagtgtatgtggcatccaattcctggcagtaactggagttgaccagtatacatatcaagttccaacagttcaaactgacaaacgtttcagacttcttccatgcagaatttggttctgcatgctcttgttgatgaacaatgctgctgcacttggatcatcaaaagaacaacaaacaatgtatcggtttcagacttttttttttttttttgaggatagtgttatcgatagcaagaaaaacgcaactttgaagagggacatcaagtaaactctgacagagaaacatcaagtgaacttaaaacttgtatagagcattgtacgctcacacagacacacacacacactactatgttttgtttcactcatctcatccgccactgatttcttgggaggatcagatcagatgagatcagatgggcgcagtcctcgggttcctggacttgttgacgaggaacagcttcttgaggagcctgagcatcagcatgaggctccacttccggcgccggaccaccctgccgtcctgtgggtggtgtggatgcttgcccttgcagtgcttctccagatcgacgacgaccatcttgtcgtagtcgtcgaggtcgagccagctcatcgccaaccgttccttgttgatcacagggctcagcgggcacagcggcggcacgctggcgagctcctcgttgaagtcctcccacagcatgtccatcttctcctcttcctcctcctcctcttcttcctcctccccagcaacggtggcgaggaaccaccgcgagggggagccgccgaggccgagctggtgcggggggaacgctgatggaacaagctggcctcctgcgtgaagagtggggaaagtgaagtcatcatccatgcctgatgcgagcctgcaaatgtttcaggtgtaggaggagcatgtgtgtgtgtggtgtgttgatgtatgtctctactaccgctactcctttagccccttagtatctctctatatatgtctgtaattctacatatgtggaacacttggtctgtactgctgccatggatggtgcaacatcctcatctacctacctggaattggcttgtccgttgaattgaagacgtagcttcagtcatggagttccaactttgaagaaaaaaaaaaaacaaaaaaaaaaaaaaaaggattaatgcacactgttgatcagcgaaatgacaggcactcatgctgcaaatgattcacttgttctgcaggatttatatgtgcacccacaagttcaggggcatgcaggaggctcttgggtctggccaacctaacagaagctgtgaataaaggatgctgctggttggaccaaactgccagtacattttgaggaaaagggtgactgctgtccaatatggatggggatggggtgattggaaagcaaagggtggctgcctggaatccatgaacatgtagatcagcagtgtttgagtggttctggtcttttggagggagagcaacagcccacatggaattgcattctgatggctttctgctgaagatgcggtgttgcttgggagttgggaacaagggatctgatctgcctgctgctccctgtctggtgtctgtgttcccaaatagaatgtgtgtttggactatatttttttactagatttatagaaaatattgtgaatatttatatgtctgatttctgaataagtttatcataaaaatacatttcataattcatctcaagatagttattaagcatttaatactttattttatatatttaatcaaatgttgagatccatttactctttgaaaaactagaatcttcgttgcgcatagagagtcattgtatactcactcagtcctaatttatataatttgtttgactttctgaaccaaatttactcggctcatcttatttatttctgttgga

SEQ ID NO: 2938 - DNA, 1617 bp, Zea mays
aaagcctgaagctgaagaaaagcaaaagcaacgagcagatcgcgatcaggggaggaaaagaaaaaaaaaaaagaggcgccgcagcgaggtcgaggtgattattatttaggctcagtggggccctcggggccggccccaaatcgacctgggctggacccagccgcgccccgtctgcctcctgcttctctctccgcttccgcttcctgcgcctccaggctccacttctccgctcggcagtctgcactggaaggacagcatgtcggcctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgctttccgcagttctccaactttgggaatctggaaccacatggatttgcaaggaataggacatggagtgttgatgatgatcctccgccatttccagtgccaacctccaatagcgcttatattgacttgatcctcaaacctactgaagatgatttgaagatctggcctcatagttttgaataccgcctgagggttgcacttagtcctggtggtgatttgatgctaacttcacgtataagaaacactaatgcagacgggaagccattctctttcacttttgcataccacacatacttcaagatttctgatatcagtgaggtgcgagtagaaggattggaaactctggattacctagacaacttacaagatagagctcgttccactgaacaaggcgatgcaattgtttttgaatccgaactggacagaatatatctgggcacaccatcgaaaattgccattattgatcatgagaagaaaagaacatttgttgtgaggaaaggaggccttcctgatgctgttgtttggaacccctgggataaaaaagcaaaggctatgtcagattttggggatgatgaatataaacgaatggtatgcgtggaggcggctgctattgaaaagactgtcactctgaagcctggtgaagagtggactggaaagttggaactttctgctgtgccatctagctattacagtggtcagctagaccctgaccgtgtgattcaggattccactgtcccggaggactccatcagctagtccttattctatttttgcaggtagagcattgtatcattatgcataagagatgctggcaacaagggctgtccacatgtttcttccattctgttcaaatcttcggtgtttttttattccgaatgcatatccgaaccaaggaatgtgaaattggtttccgctttttgaggatctatgtagcataatggataagtcggtgtttcgtaccctatttagggatgcttgaagcaagaaacatcttcatgggttgtaaaataaaagaaaaattctctttattatatttgatcaattcttttgccttaaaaaaaaaaaaaaaaaaagaaaagaagcccccgcgggggggcccggtaccc

SEQ ID NO: 2939 - DNA, 2020 bp, Zea mays
ttgggtacctcgaggccggccggggggtgatgaaagcgagcgaagcacgtcagaacgtaccagcaaagaaaggcatatccatggggagctgctgatccagcgatccgcccgagctcaaaagcctgaagctgaagcaaagcaaaagcaacgagcagatcgcgatcaggggaggaaaagaaaaaaaaaagaggcgccgcagcgaggtcgaggtgattatttaggcacaaggggcgctgtccggaaattccccaaatcgacctgggctggacccagccgcgccccgtctgcctcctgcttctctctccgcttcctgcgccccccgcctccaccctcctctgctccgctcggcagtcggcactggaaggacagcatgtcggtctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgctttccgcagttctccaactttgggaatctggaaccacatggatttgcaaggaataggacatggagtgttgatgatgatcctccgccatttccagtgccaacctccaatagcgcttatgttgacttgatcctcaaacctactgaagatgatttgaagatctggcctcatagttttgaataccgcctgagggttgcacttagtcctggtggtgatttgatgctaacttcacgtataagaaacactaatgcagacgggaagccattctctttcacttttgcataccacacctacttcaagatttctgatatcaggtatgttgtttcaagttatggtcatcatctttgaaatattcaatttgccagcatagtttttgaagtaatcttgtggcagcatgtttatccccagtcccaattcgtttgaccaaactctggtattaaaccataattatctttgattttgtaattagcgttcttaagtacagaattgtttacgtgattccatgctaatacagtgaggtgcgagtagaaggattggaaactctggattacctagacaacttacaagatagagctcgttccactgaacaaggcgatgcaattgtttttgaatccgaactggacagaatatatctgggcacaccatcgaaaattgccattattgatcatgagaagaaaagaacatttgttgtgaggacaggaggccttcctgatgctgttgtttggaacccctgggacaaaaaagcaaaggctatgtcagattttggggatgatgaatataaacgaatggtatgcgtggacccggctgctattgaaaagactgtcactctgaagcctggtgaagagtggactggaaagttggaactttctgctgtgccatctagctatttcggggggcggctagaccctgaccgtgtgattcaggattccactgtcccggaggactccatcagctagtccttattctatttttgcaggtttatgtttccaacgatgcaggtagagcattgtatcattatgcataagagatgctggcaacaagggctgtccacatgtttcttccattctgttcaaatcttcggtgtttttttattccgaatgcatatccgaaccaaggaatgtgaaattggtttccgctttttgaggatctatgtagcataatggataagtcggtgtttcgtaccctatttagggatgcttgaagcacgaaacatcttcatgggttgtaaaataaaagaaaaattctctttatatttgatcaattcttttgccttcacggacacggagaagatcaagaatcacaaactgagggccagaaccaaaagatctcggacctgtgaaaaaaaacaaaatataagggcgctcgccgtctagtgagccttgccccccgggaatt

SEQ ID NO: 2940 - DNA, 1642 bp, Zea mays
atcgcattcacgtccaaccgttcgcttgcgccctccgcaacaacgcaacgcatcgtgacgccgccgctttttgcttttccgactgctgtttccgccttttgagtaggcgttgggcgagcttcggtttcgacggacgtagccgtcaccgcctcaccggcccggccatgggcgccgccgccgcctgttctcttcgcctctgccacacgtcaccatccgctgcgacggtagggccgcgatgactccggcggttcgggtggggaaccctcgcgatcccggtccgggcgccgcggtggtggaggacgaggaggaggcggcggtcgcgtggcgggagctgcgcggcaaggccgcggaggtcgcggctgcgggcgaggaaagggcggtcctggcccgccgcatcgaggccgcgctccaggtaaggagggaggcgctgcggcaggcggaggagctggacgagttgacgcggatggtggacctccagcaagcgcgtttggaggcggccgtcgtcggcaggaggcgggcgctcgaggccgtggagcgggggaagaagcggctgcaggagcagatcgaccgggtgctgccgctgtcgaggtccctcaccgccgcgcaccatcgagtgcaggaagcgaaggaggcgttatccggagacaaattcagactcaaggatctgcagaggctgcttcggacgaggcagcagcgcatggttagccaggttgctggtttgtaccctgtgagagtcttccatgatcttccaagacatgcagaaaacccctgtgccgatactaatggggagcatgtgacacttccagaggaaaacagaacattttcaggtggagatggaacacatttacccaccattatcaaatctccagaagcacgtggctggacattttttggttgggacattatgaagcataaaatgaagcaaaaaagttacaggaacaaggtgctacagaggtccgcagctgttctgggatatgcagcacatgcagtcttgctcatagcttgctatctagatgttcccctccgatatcccttgcgctttggagggtcccgatcttatgtgagtgatcgcttgccttcagctgatacagcatcatcggctgctttagcaagtaccaggaacaccgaatcagaactaacagaataccctcttttcctggaatgccaagacgatgactccactagtgcctcctatgccatttatttattgcacaaggatacggagcagcttctgaactatgttggagctgagagctgtggaaggcacgtgtttggtaacctacgagaacttcttaggatcgtgcagtctgataagtttgtgtacagatgatggttccaatccatgtggttttggagtgcttatgctgtagatgtattatagagatgtaagtaggtgtttttcttttctcttcctattctttcgtgtgattcattccctctttccctgcgctaggttttttatatgtgcaggaaataggcaattgtgtttttctagagaaatgaaatgtactcacacgtatggcttttttcgagaaaaaaaaaaaaaaaaagatggtccaatcgaaagtcctacaaccactgggtctgtctccttgacaagcaagtgtttgatatttagattatccaataagtcacattttgc

SEQ ID NO: 2941 - DNA, 1081 bp, Zea mays
ccgccaacctgagtgccgccggccacctcaccaactcccctacaagccgccgggcaagtgccgccgggccggacgaccgaagcatccacttccaaagtgttttgtttgttgtccgcctggcgcctgcccccctaactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcgacctggtgtatcattgaggccaggtactccagtggaggaagtttttcccctggtggaagcagaaaatccggtagaattggttcttgtgatgacagtcgagcctggttttggtggtcagaaatttatgccagaaatgatggataaggtacgcacactgagaaagaagtacccttcccttgacatagaggttgatggtggtctaggtccttcaaccatagacgtggccgcatctgctggggccaattgcatcgtcgctgggagctctatatttggcgctgcggacccaggagccgtcatatctgtgctgaggaagagcgtcgagggctctcagaacaaaaactgattttggtgtttctgctgtaaactactccctccgtttttttatttgtcgcgatttagttcaaacataaactaacggacgacagatactcgagaacggagggagtacttcgaccttgcacgtcagatgagctgatcctcacattgcaggcgagaataaaatttgatgttagaccttgaacgtcttttgcaatatgcttttttgtctgcgctgattatattct

SEQ ID NO: 2942 - DNA, 2047 bp, Zea mays
accggccacctcaccaacgcaacctcaccaactcccctacaagccgccgggccgaacgaccgaagcatccacttccaaagtgttttgtttgttgtccgcctggcgcctgcccccataactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcggcctggtgtatcattgaggccaggtactccagtggaggaagtttttcccctggtggaagcagaaaatccggtagaattggttcttgtgatgacagtcgagcctggttttggtggtcagaaatttatgccagaaatgatggataaggtgcgcacactgagaaagaagtacccttcccttgacatagaggttgatggtggtctaggtccttcaaccatagacgtggccgcatctgctggggccaattgcatcgtcgctggaagctctatatttggcgctgcggacccaggagccatcatatctgtgctgaggaagagcgtcgagggctctcagaacaaaaactgattttggtgtttctgctgtaaagtactccctccgtttttttttattcgtcgcgttttagttcaaacatgaactagcggacgactgatattcgagaatggagggagtacttcgaccctgcacgtcagatgagctgatcctcacattgcaccggaactgttcggcgagaataaaatttgatgttagaccttgaacgtcttttgcaatatgcttttttgtctgccctgattatattctaccccttcatataacgcttgatgtgccgtcaagaaatggcgaaacattggcatgactgtaaacaagaaactaaatacgggtataaaaatcgtgtcatgtcatgtccatatacttgtggatatctcgtcattatgcattctctcgttgaacctctctagcaacttacacatagtcgtacccatatttaaactatattctacaaacagtacaattaatggtgcaaaacggtgttttggtgatcatatggatgaactattgtatattgcacttatatggtcactgaaaacattgtttttttattgttttgtattataaattgcacggagtgtaatttgaatatatgtatgaataagctgttgaagataccgtctgggttgagccctccaacctccattactagcgacgatacaatttagcgaacacactgacacacctcggtgcattgggaaccatttttagtttcctaggacgggcaccaaccatttgactagttcgcttgacctgtatattgtacaattacggacaaatcctacagaatcgttaacaaacacattcgccctcgacggtgcatgatgacaatgcttgcctttccggtctgcaagtgaactgccaagcgcatagctgcagacaggcgaagcgaaccacaaagtatccgatctgccggtctgccacccagctcctgttccgtagtatgcggtgtgcgccttgcgaagcgagccaaaagcatcggtctgccactcttcccctgttccatttccatagattaaaatttagtacatattatatcggatgttcgattggttactacaagtattaaatataatctaattataaaaataattacttagcagatgactaaacaacaagaaaaatttattaaatataattaatatataattagtaaatgtttattgtagcatcacacgatcaaatcgtgaactaattaagtttaatatatcagtctataaa

SEQ ID NO: 2943 - DNA, 1229 bp, Zea mays
  misc_feature (1148)..(1148): n is a, c, g, or t
  misc_feature (1205)..(1205): n is a, c, g, or t
aagttttgagagcggcaaagcgttaggcgttagggcatccacctcgtcgtaggcggcggtctccatgtcgaccgcatccggcaacggcggctcctcctcttccatgttatacgacttgtacggccctaatgcaaagcctgatgtggtttttaaggaggctgctttaaactctatgttaaatctgcaggatgttcagggtctagttacttgggttattggtgatggcatgctgccttcttgggtgtttgttaagaacaaacctcttataccaaaagttgtcctactatatgttcctggccttgatgcaactttatatatgtcacacactcgacttctttcttctctgaaagaattatgtggcaatccaaaacctgttttagcttcaagccgtatgccagatgagaggcacaccattgatgcgctcctaacctgcagagtaaagagaaagcgtgatgtaaaaacatcaaatgagtcatctaaacctgacatagatggaaaactatcaagtctggatgatcttggggacataccattccctgttacatattacacactctcagagaaagacttggaagataatggctactctttcaatttaccaggttttgtccctactgtttcagctccttcaggttcctcaccacataaagttcttgcacttgattgtgaaatgtgtgtgacaaaagctggatttgagctcacaagagtgacattagttgatattaaaggattggtggtgctagatagactagttaagcctactaatccaatcattgattacaatacaaggttcagtggaatcactgctgagatgttggctgacgtgtccacaaccctgcaggaaattcaggaagagtttgttggacttgtatataaagaaacaattcttgttgggcattccttggaaaatgaccttatggcattacagatatcccatggtttaatcatcgatacagctgttttgtacaagtataagcgagggtctcgctgtaagattgctttgcgtgtcttgacgagaaagtttctcgaccgggagatccagaacacaggatctggacatgacagtgtggaagatgctaaagctgctctagaacttgctatattgaaaatcaaacatggtcctgattttggttttcaaccatcgttgncaaggcagaaattgacatctatactgcatgagagtgggaaaaaaatgctccctttgntgatgatgtatctgttctcgagcg

SEQ ID NO: 2944 - DNA, 2421 bp, Zea mays
cagtccttcagatctcccctcccttcctgtccttctctattatagcaagcaaagcgccactcgcaatcgcaacccaccaccctcaggtcaggcctcgctcagatctctccgccctcgtcccccctcacaccccaaaccctcggcccgcctctctcgtcaacgccgcccgacgagagcgatggcggcctcgccggccgcggccgcggcactcctcatcctcttcgccctcggggcggccggcggagtggcggccgacggctccgaccaccggtacaagatgtacgagcccgtcccgctctacgccaacaaggtcggccccttccacaatcccagtgagacatatcgttacttcgacctgcccttctgctctcctgagaaagtgaaggagaagagcgaggcccttggcgaggtcctcaatggggatcggctagttgatgcgccttacaagcttgatttccgttcggaagttgagtccaaggcggtttgctcaaagaagcttaccaaagaggatgtagtgaagttccggaatgcagtagcgaaggactactacttccagatgtactatgatgatctcccactgtggggcttcattggtaaagttgagaagggaggcaaggccgatccgagcgagtggaagtactacctgtacaggcacatcatcttcgatatcctgtacaacaacgaccgggtgattgaaatcaatgtgcacactgatcagagtgcattggttgacctgacggaggataaggagacaaatgtggatttcctgtactcagtcaagtggaaggagacaccaacaccatttgagaagaggatggagaagtactccagctcctccaacatgccgcaccacctggaggttcattggttctcaattataaactcttgtgttactgtcctcctcctcacagggttccttgcaacaatcctcatgcgagtattgaagaatgattttgtcaagtatgcccatgatgaggaagcagctgatgaccaggaagagtctggatggaagtatattcatggtgacgtcttccggttcccaaagaataagtcgctattttccgctgctcttggcacaggaactcaattatttgcactcacaacctttatatttcttcttgcacttgttggagtattctacccttacaaccgtggtgcactatttactgcattggttgtcatctatgcactcacttcaggaattgctggatacgttgctacctctttttattctcagctggaggggacaaactgggtgaggaacttgctattgacaggatgcctgttctgtggacctctcttactgacattttgcttcttgaacactgttgctattgcttatagtgcaacagcagcactgccctttggcactatctgtgtcattgtgctcatctggaccttggtcacgtttcctttgcttgttttgggtggtattgctggtaaaaacagcaaaagtgagttccaagctccttgccgtaccacaaaataccccagggagattcctccacttccctggtaccggagaaccattccacagatggctatggctgggttcttgcctttcagcgccatatacattgagctatactacatctttgctagtgtttggggccacaggatctacacaatctacagcattctgtttattgtcttcatcatcctccttattgtcaccgcgttcatcactgttgcactgacatacttccagcttgctgctgaagaccatgagtggtggtggaggtcattcctttgcggaggatcaactgggtttttcgtgtacggctactgcctgtactactactatgcgcgatccgacatgtctggcttcatgcagacatctttcttctttggctacatggcctgcatctgctatgcattcttcttgatgctcgggatggtgggcttccgcgccgccctgttctttgtccgccacatatacaaatcaatcaagtgtgaatgagctgttgctggggagacgaagagcagcagagttgtacccgtttttggtgccccaccgagaggtcccagatatagaaaaggttagctctcgcatgcgacaggagcagctagagattgccatgtttcagagtaggccaattatttataggaacaggtaatgaacctataaatttgttctgtttttgtgactgctgtgataaaaagaccgtctgttccttcgtcctatgtatcatctcctagtgacgtcagacagcactataactttgttggaaccgtgacatgcctgaatatctgtggaaaaagaaacccgtgttatgttgttatatatgttctctaaagcatagaataatagaagtgtagacctctagtgtggcaggttcatctgtacgtgtatcctcttcgttcttgttcactgcggagcgttggactctatacatacccccagacttttggtactgttgt

SEQ ID NO: 2945 - DNA, 2383 bp, Zea mays
gccggccccctcccggccggcactccgtcgccccttcaccaccgaacctgagaacgccattcgaggagttcaggtctccaagccaaacccgacccagaccttcagatctcccttcccttccgttcctgttcctctctattaagcagcaagcaaagcgccactctcaatccacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccttggggaggttctcaatggggatcggttagttgatgcgccttacaagcttgatttccgtgacgaagttgagtccaaggcagtttgctcaaagaagcttactacagaggatgtagtgaagttccggaatgcagtggctaaggactactacttccagatgtactatgatgatctcccactgtggggcttcatcggtaaagttgagaagggcggcaaggatgatccgagcgagtggaaatactatctgtacaggcacatcatcttcgacatcctatacaacaacgaccgggtgatcgaaatcaatgtgcacactgatcagagtgcattggttgacctgacagaggataaggagaccaatgtggaattcctgtactcagccaagtggaaggagacaccaacaccattcgagaagaggatggagaagtactccagctcctccaacatgccacaccacctggaggttcattggttctcaattataaactcttgtgttactgtcctcctcctcacagggttccttgcaactatcctcatgcgagtattgaagaatgattttgtcaagtatgcccatgatgaggaagcagccgatgaccaggaagagtctggatggaagtatatccatggtgatgtcttcaggttcccaaagaataagtcgctattttccgctgctcttggcacaggaactcaactatttgctctcacaacctttatattccttcttgcacttgtcggagtattctatccttacaaccgtggtgcactatttactgcattggttgtcatttatgcactcacttcaggaattgctggatacattgctacctctttctattgtcagttggaggggacaaactgggtgaggaacttgctattgacaggatgcctattctgtggacctctcttcctgacaattgggtacctcgaggccggccgggttgcttatagtgccacagcagcactgccctttggcactatctgtgtcattgtgctcatctggaccttggtcacatttcctttgcttgttttgggaggtattgctggcaaaaacagcaaaagtgaattccaagctccttgccgtaccacaaaataccccagggagattcctccacttccgtggtaccggagaactattccacagatggctatggccgggtttttgcctttcagtgccatatacatcgagctgtactacatctttgctagtgtttggggccacaggatttacacaatctacagcattctgtttactgtctttatcatcctccttatcgtcactgcattcatcacagttgcactgacatacttccagcttgctgctgaggaccatgagtggtggtggaggtcattcctatgcggaggatcaactggatttttcgtatacggctactgcctgtactactactatgcgcgatcggatatgtctggcttcatgcagacatctttcttctttggctacatggcctgcatctgctatgcattcttcttgatgcttgggatggtgggcttccgtgcctccttgttctttgtccgccacatatacaaatctatcaagtgtgagtgagctgttgttggaagatcaagagcagcagagctgtacccgtttttggtgccaccgagaagtcccaaatatagaaaaaaaatggtttgctctcgcgtgcaacaggagcagctagtgattgccatgtttcagattaggccattatttatagtaacagctaatgaacctataaatttgttccgttcatgggactgctatgataaaatcgtctttttttgtccgaaaaaaaaaaaaaaaaaagccgccggcggccccggactttgttggaaccgtggcatgccagcggtaattgctgaatatctctaagtcgttacaggaaaaaaaaaaaaaaaaaagcggcc

SEQ ID NO: 2946 - DNA, 4830 bp, Zea mays
cccctggtctggattgaatataattcctcgagctgtgaatctgttacttttaggcgttggatctgtggtgaaggagaacaattatggtacaagctaacataggttatacaattatggtgattgctattctaacatcgttccattttcattgcagtgaaacatatcgatatttcgacctgcctttctgctctcctggttagtttgtgttaatttgaagtcttttgctcaccgagctagaatagcaatgattagtttctcaaaacatgtagtgtgctaatcaactgtatccacggcagagaaagtgaaggagaagagcgaggcccttggcgaggtcctcaatggggatcggctagttgatgcgccttacaagcttgatttccgttcggaagttgagtccaaggcggtttgctcaaagaagcttaccaaagaggatgtagtgaagttccggaatgcagtagcgaaggactactacttccagatgtactatgatgatctcccactgtggggcttcattggtaaagttgagaagggaggcaaggccgatccgagcgagtggaagtactacctgtacaggcacatcatcttcgatatcctgtacaacaacgaccgggtgattgaaatcaatgtgcacactgatcagagtgctttggttgacctgacggaggataaggagacaaatgtggatttcctgtactcagtcaagtggaaggagacaccaacaccatttgagaagaggatggagaagtactccagctcctccaacatgccgcaccacctggaggttcattggttctcaattataaactcttgtgttactgtcctcctcctcacagggttccttgcaacaatcctcatgcgagtattgaagaatgattttgtcaagtaaggacctcccatcttcatttgtatttgcattcttgttgatgataaccatttctatcataaacagtaacacactataaaaaattctatttctgttcaatcgctgccataaatagaaaaaaaacacaattgtcctatgatttgttttcttactagaagacaggtccaaggggtttgtgttttttgtgatatatatttcaattactacaggatattttgacatctgtttgtttcaatatattctgctaccacatccaacgaaatactatttcatctctatttgttttggactggagaatctgttttccatatattatagtataggcagtaaaaaaatccttaatgcctgtactcatgtgcttgtactcaagggcctctagctgagttggctaggtggtctgtttagcactcctcaagtcctgggttcgactcctcgtgggaccgaatttcaggctgtggttaaaagaattccctcgtctgtcccacgccaaagcacaggtctaaggctgagcccggtcgtggtcgttctcacattggcttcggagccactgtgtatgggtggggcaggggttcgcgggttttctctacctgtgtgagaaggtcttcttaaaaaatacccggggctgtcttaccccccgcaggtcgagttttttagtatgcataatttaattgacattattttgggtggaactgaattcatcttagttgaacattcttcaacgaactggtatctccatttatcaaaatgaatcattggtctaatttaaattactcttaggtcttttgaatgatgtcctctgatcatgttgattcgtattacaatttacaataagaaaatgcttggtttgcaacaaatgatgatccaccaagacagtatgttggacctatctcttcatgtatctatttctcttgtgtcctgtttaaatcacgtttttcagcgacagtgcgcaaaatatgttagcaacttagcatggtataattcagttgcatatgcatctgtctgtttatttatttcagttgcatataattttgtatgttaactttaaactgtacattttcacttgaaggtatgcccatgatgaggaagcagctgatgaccaggaagagtctggatggaagtatattcatggtgacgtcttccggttcccaaagaataagtcgctattttccgctgctcttggcacaggaactcaattatttgcactgtaagttcctgtggctattttctctctgtttataatgttttgcagggctgtaattattcctccagctcattgttttgacaaaaagatacttaacaatcttgtctttggcacctctgcagcacaacctttatatttcttcttgcacttgttggagtattctacccttacaaccgtggtgcactatttactgcattggttgtcatctatgcactcacttcaggaattgctggatacgttgctacctctttttattctcagctggaggggacaaactgggtatgtactgcctttaccttatttagttatatatgtacatgaccaaattgaaatactatcttttcttcaatggtagtgttgttgcattttgcatcaatcttcaggtgaggaacttgctattgacaggatgcctgttctgtggacctctcttactgacattttgcttcttgaacactgttgctattgcttatagtgcaacagcagcactgccctttggcactatctgtgtcattgtgctcatctggaccttggtcacgtttcctttgcttgttttgggtggtattgctggtaaaaacagcaaaagtgagttccaagctccttgccgtaccacaaaataccccagggagattcctccacttccctggtaccggagaaccattccacagatggctatggctgggttcttgcctttcagcgccatatacatcgagctatactacatctttgctagtgtctggggccacaggatctacacaatctacagcattctgtttattgtcttcatcatcctccttattgtcaccgcgttcatcactgttgcactgacatacttccagcttgctgctgaagaccatgagtggtggtggaggtatgctgttttcctctaaatcttgcttttgaatgtatacttatgtaagtgtgctgacacttaaaaaaagagtaagatggaaaggaaatgtatcaattgagtagcagattgtattttattaagtctattatgtcactataacctatttcaacttgttgagagcctagcagcaattcttgtggtcggtttatctttttgccacactactaggcttcctgattagtccccccttcaaccaatatatgtcactggaggtagttaagcaaaatgtcacgcagagcatctattatctgaatggcataagtcagctgctgaaatgtattgtagcattgaattcaattgtgtgatcctacgtgtgtagagtgtagactgctttcaaaacacaacccttggtcgaacaagtataactgccccttcaacattttgggtcaactgcagtgctgatctgtttatcctgcaggtcattcctttgcggaggatcaactgggtttttcgtgtacggctactgcctgtactactactatgcgcgatccgacatgtctggcttcatgcagacatctttcttctttggctacatggcctgcatctgctatgcattcttcttgatgctcgggatggtgggcttccgcgccgccctgttctttgtccgccacatatacaaatcaatcaagtgtgaatgagctgttgctggggagacgaagagcagcagagttgtacccgtttttggtgccccaccgagaggtcccagatatagaaaaggttagctctcgcatgcgacaggagcagctagagattgccatgtttcagagtaggccaattatttataggaacaggtaatgaacctataaatttgttctgtttttgtgactgctgtgataaaaagaccgtctgttccttcgtcctatgtatcatctcctagtgacgtcagacagcactataactttgttggaaccgtgacatgcctgaatatctgtggaaaaagaaacccgtgttatgttgttatatatgttctctaaagcatagaataatagaagtgtagacctctagtgtggcaggttcatctgtacgtgtatcctcttcgttcttgttcactgcggagtgttggaatttatacatatccccagacttttggtactgttgtatttgcattacttccagcgatgctttcttaggattgtggacctattggttctttaaacgtggtggctgattcgcttccttcgactgagctcgcatcttcggtacgttgttttcttctgacctcgatggttcccaatttggtttcagcttacacgcgtcgaagacccgggtaactgtcaggaaaacgagtaggatgaaagcgaagctcgcggtgcttgggcgcgagccgcccggcgttacaagttgcaatgcaactctggtggaggctatcgcaagtcactacccatatgaggccacgttcgtttgatcccaaaaccatagggattaagggggattggaaaggattagagaggattttgactcgtagagaatttgatcccccttcaatccctatggatcagcacaaaacgaacggggcctgacggaggacgggaggaggcttgtttgtcctataacggcgtcgcggagcctcagccagcatatgttcttgttggatgccggagtagcggagtgggcgaatggactgcacgctctcatgccatgcggcacgcctacgactacgagatgcacggcgacgctgacgcagcgcggggcccgcggggacggacggcatgaacccgtccagtgtctcgggtctcagagctacaaacaaagccgcatggtggcatgatctgtgcctgtcccggtggtgagtagtgacgatcgctgccgcttttcccccatcggccgccgcagcat

SEQ ID NO: 2947 - DNA, 1371 bp, Zea mays
tgattttgtcaagtatgcccatgatgaggaagcagccgatgaccaggaagagtctggatggaagtatatccatggtgatgtcttcaggttcccaaagaataagtcgctattttccgctgctcttggcacaggaactcggctcctcgagcccgcccgctttatattccttcttgcacttgtcggagtattctatccttacaaccgtggtgcactatttactgcattggttgtcatttatgcactcacttcaggaattgctggatacattgctacctctttctattgtcagttggaggggacaaactgggtgaggaacttgctattgacaggatgcctattctgtggacctctcttcctgacattttgcttcttgaacaccgttgctattgcttatagtgccacagcagcactgccctttggcactatctgtgtcattgtgctcatctggaccttggtcacatttcctttgcttgttttgggaggtattgctggcaaaaacagcaaaagtgaattccaagctccttgccgtaccacaaaataccccagggagattcctccacttccgtggtaccggagaactattccacagatggctatggccgggtttttgcctttcagtgccatatacatcgagctgtactacatctttgctagtgtttggggccacaggatttacacaatctacagcattctgtttattgtctttatcatcctccttatcgtcactgcattcatcacagttgcactgacatacttccagcttgctgctgaggaccatgagtggtggtggaggtcattcctatgcggaggatcaactggatttttcgtatacggctactgcctgtactactactatgcgcgatcggatatgtctggcttcatgcagacatctttcttctttggctacatggcctgcatctgctatgcattcttcttgatgcttgggatggtgggcttccgtgcctccttgttctttgtccgccacatatacaaatctatcaagtgtgagtgagctgttgttggaagatcaagagcagcagagctgtacccgtttttggtgccaccgagaagtcccaaatatagaaaaaaaatggtttgctctcgcgtgcaacaggagcagctagtgattgccatgtttcagattaggccattatttatagtaacagctaatgaacctataaatttgttccgttcatgggactgctatgataaaatcgtctttttttgtccgatgtattatctcccagtgacgtcagacggcatataactttgttggaaccgtggcatgccagcggtaattgctgaatatctctaagtcgttacaggaaaaaaaaaaaaaaaaaagcggcctattcagtcattaccggggcc

SEQ ID NO: 2948 - DNA, 3008 bp, Zea mays
  misc_feature (2998)..(2998): n is a, c, g, or t
attgggtacctcgaggcatcccgggacccgcactcgcgcgcgtcgggcggaaacgaaagatcctcctccctcccaaaggtgaggccgttagccaggaattccggcaacaatgacttccctctcctccgccgtggcactgccgtcctcgtgccgggcccggccggcggggggcagccggagggcgcggatggtggtgacgcgcgcggcggcgtcgagcccgaagctgccgaacgggcggcggctgcgggtggcggtggtgggaggcggccccgccggtggcgccgcggcggaggcgctggccaagggcggcgtggagacggtgctaatcgagcggaagatggacaactgcaagccctgcggcggcgccatcccgctgtgcatggtgtcggagttcgacctgccgctcgacctcgtggaccgcaaggtgaggaagatgaagatgatttcgccgtccaacgtcgccgtcgacatcggccgcacgctcgcgccccacgagtacatcgggatggtcaggcgcgaggtgctcgacgcctacctccgctcacgggcacagtccgtcggcgcggaggtcgtcaacggcctcttcctaaggtacgaggcgcccaaagagccgaacggctcgtacgtggtgcactacaaccactacgacggcagcaacggcaaggtcggcggcgagaagcggtcgttcgaggtggacgcgatcgtgggcgcggacggcgccaactctcgcgtggccaaggacatgggcgcgggcgactacgagtacgccatcgcgttccaggagcgcgtcaagatccccgacgacaagatggtgtactacgaggagcgcgcggagatgtacgtcggcgacgacgtctctcccgacttctacggctgggtgttccccaagtgcgaccacgtcgccgtcggcaccggcaccgtcacgcacaaggccgacatcaagaagtttcaggccgccacgcgcctccgcgccaaggacaagattgagggcggcaagatcatccgcgtcgaggcgcaccccatccccgagcaccccaggcctaagagggtgtccgggcgggtgacgctggtgggcgatgccgcggggtacgtgaccaagtgctctggcgagggcatctacttcgcggcgaagagcgggcggatgtgcgccgaggccatcgtggcgggctccgccaacgggacgcggatggtggaggagagcgacctgcgcaagtacctggccgagttcgaccgcctctactggcccacttacaaggtgctggacatcctgcagaaggtgttctaccgctccaacgcggcgcgcgaggccttcgtggagatgtgcgccgacgactacgtgcagaagatgaccttcgacagctacctctacaagcgcgtcgtgccgggcaacccgctcgacgacatcaagctcgccgtcaacaccatcggcagcctcgtcagggccaccgcactgcgccgggagatggagaaggtcaccttgtgagccgccgcccgcgacgtcattgccgtcgaaatggtgtcgcagctgatcggccggtgtattagtagagatttgcggctgatcgggttaatttaggccaacatgcgtgggcagtgggcgcggagaggaagagaaacaagttgtgcaagtgcagcaagtagatcaaaagtgctgcctgtttgtatcgatggatcctgcaacatatagcatctggtgatgttgagaattcggagcagttcatcgactggattctgacgccggcaagcatcgacgtcaatgaatgtctaatacttagtacatcaagacatgtaataaaactgaaactcccccgttctggttctgattactgtaaccctaatccatgtatcttcagtttctgaactctggcgagaaagcaaatgtacagagactattggactgctcgtccaccaggcaccagctctcatacggtaccctcggccaaaactgtgataaaatccgaagtgggaggatggcgagaagagagaaacgaaacaaaatgattcaactgatgtccagttaaacttactgcccaatggcaagccagccaagcctgatgtcaagttcatcacactacagcgtacgctactgctaagtgcactacgagaggctgactgctgccctaattaacttgctgaccaatggcaagcctgatctgaaggtcaacacactatggctaacatttactgctaattacactgaaagactgacgcgttgccatcagacaaaattcctatgtgatcagggggactcagactcagacctgcacctgcacaaaatccagggaccataccagcacgcagaaggcatccttcaccaggcgccatggcctatgagtcgcttcctcctgaagctctccttgaagcacgcctgcctgggatccttggtcctctgatccagaatcgcatcgggcctctcctcgatcatcttctttgtcagctgcaggtcgtccaccacgctcctggtcagattctcgtcctcttgtacgttttccttgaagcacaccagcctgagcccctccatcctctgatcaagcatcgcatcgggcctctcctcgatcggcttcatggtctgatccaggaattccaccaggctcctggtcagatgcccgttctcctgtgcattctgcttccctatcccctggacgttgtcgatgagtttctccagactcttcagcttccggtatggccagcgcgtgatgccaagcttcctgcattgcctcttcaggacggtgacccccacgttgagctcccgcgccgcctgcttgatcggcacggagaagtgccgagacaactgctcaaaagttagttccttcttcttcgtccctgacgacgacccaccgccccgacgtcctggtatctctgcgaccgtctgcacattgccatacacgatcagggccttctcgcagtcgccttcttcgctcttgcgacgcgcctcgtcctcctccatctgagcccagaaacttggaaagtcaacatcaaacaggccgccaagctcatnttgagagaag

SEQ ID NO: 2949 - DNA, 4681 bp, Zea mays
  misc_feature (4490)..(4490): n is a, c, g, or t
  misc_feature (4609)..(4609): n is a, c, g, or t
  misc_feature (4644)..(4644): n is a, c, g, or t
ctctactattatatggctctctttcttctttttttttaaaaaatatacaaactctactgtggactctcttttttaaaaataaaaaaataccatggtcttaaaaccacaaccttcaaacaggttaacagggcctagtcgaaagagaagaaactgagtccaaaaccagagtgagcatcgctctctgtcagtacacccttcttttcttgaagaaaagaaatgcatgccttgggtcgttcagtagtcttacacagacattccaagatgtttcttgattctgaaattcgctaacactagcatgttttatgtgtgtattgttgttatatgaaaagtgaagtatgatcatctccagtgtccactacatgagtacaacaaaccgtctggtgtttttttttcctgtacacacacaaacacaaacacacacatgatgacgacgacgacgacgctacttgcactgcctgttggggaaggcctctgacctgacgatcctgtcgatgagcctccggaagcgctgggctccgggcccaggcctgagcacccagtcgttatcgacggcgcggcactcggcgtcggcgccgcaccagccgccgggcacgaaggccgcggtggcgttggcggggcgcgggcgcgcgaggaggccgtcgtcgatggcgtcgagcacggggtcgtcccgcgggaacttgcgcgcgaagggcgcgccgctggcgagcatggcgggcatgtcggcgagcgcgagcgggtgcgggtgctggcgcggcggcacgtcccactggatgtggtgcaggtcgtggttggcgacggtgggcacgaagcggggcgcgttgcagagcagcgtctggaagtagccctccggggaggagacgaagttggcgtagtacatgagcagggtgcgcggcaggttatcccacccccacaccgtgtactccacgaagtcccgcgtcagcgccacccaggcggagcccgtgaagagcttgaacgccgtcggcagctcccgcttctgcgacacccagaagatgtcctgcttcttggagccgtacagccccgggtccacgatcagaggccgagcacgctgccccctgcgggagaaaaaaaagggaaaggaaaggaattcccatggcagtcagcttcttccgcctttgggcttgctttgctctgcatttcatcaaacggcttgagctactcactccttccagcctaggtagccggtgtgctcgatgaagttgacgttcctgggcaccgtggagaatacgtgcaggatgtctgccaaccaaaccagtcaattcagcattcaatccgttgataaagaaatcgtcaacacagaatgcacagcgtagtgtactcctagcctaggtgaacccgtttgaccgtgtgtccgcgtgcgtgcgtgtactcgatcacgcggcgcgggcacggacgagacgaggcgtggttacattattaaataaaaaaaacagagagaaacgatgtgcacacgtaccgtcctgcgtcatgagcgggtagtcggaggcggagaggttgataaaccagtcccaggctccgccgcggcggaggaggacggcgcaggcgtgcagcgtgttggacaccatggtggggccgcggtaggtgaccatgttggcgcggcggatgacgtggacgttgccggcgcggcggaagacggtggcgttggcgacgcgggccgccagctccaggcgctccgccacgggggcctcgcggtccaggtgcaccacgtactggttgcgcgggtggtacagcgcgtgcagcgcgcgccacaggcggtccaggtcgcccttggagccggagatgaggtaggccagccgcggcacgccggcgccggggggaggaggcggcgactgggactgggagtggttggcggcggcggcgcggctggcggggacggggacggggagggaggagaagaaggacgacggggagacgatgtagggcgacgaggaggaggagaaggacgtgacggcgagcgcgacggccaggaacagcagcaggctcagcgcggccgacagcgcccagcggctgtccaccagccaggccgccgcgctgctcgggagcttcgccgctccgccgccgccgcccccgccgcgcggggacgccgacgacttgggcgacctcggcgagtgctgctcgccgctgccgttgttgccgtgcatgctggcgcccagccgcgcgcgatctctgcctgccgccggtgcaacgtgcaagtgcaaggccaccaccaccagcagctagcgatcggccgtcggcgtcagcggatcgaccgcgcgggatcgatctgtggggtcgacgcgacggacggacggacggacggtacagcgcttgcccgcgcgccctggacgatggaagctatctactagcttgcaatcgaggaactggtcgtagggacgggaggcgggacaggcggacggccaatggcaacaaggggattctttggatgggccgatgggggctggtcactaacgtacatgcaggcaatggcaacaaaagagattgggatgatagatcggacgaagacgccgacgccgccgccgccgccgatgcaggcggaagcgagaagaccggccgcgcgcgcgtatataaacacacgacacggcggaaactgttgcccgcctgctgtacgttgaccaggtagctgggagctagcgaccgatcgatcgcgaggacccgttaaacaagctggagggaggaaggaaaagctgaggcagagatcgagagatagatccaagagaccacttcaacggatgaacagatagcccggacaccccccaccaactgagacagacgatgcagatcgagcgagccagggagggagaggacgacgacgataggcgtgtggagaggcgaggcgagcaggtttctcggaaaaacggttggcggttgcagggatacagatgtggtcggggcaagcaaagcacgcgatatatagggaggccccccttgccttgttgtatggggcacgaggaagaagataaagaaatgaaatggcgcaacggccccggcaacgcggccagccagcgtcacgtttaccctcctcccctccgggcggcacgcgcccgtccctctcctctcctctcctgctccgatccgtacgcaaacgcaacgccgcccgcttcgccttgcatgcaatgcaccgccgttaacgcaggaacactttttttttttttttgcatcgacgacgacctgctgtcagcatcgccatgggctcgctcgatcatgcgtagtatgcaagcataaacatgttttgcttttgccctgtgccgcctgagatgcatggacgatgatttggcatgtatttgttagccgtcgtttctagggcaccgtctatattattatgtgcctgccaaagaggaagatctgagagtggcagctgctagaaggggggatggaggggggcggacgggacgtgtctgccacgctactggtcacctgtgcgtgtctagctatgcggcggcggattattggcacgctcaaagtgtgcacgccagtccaatggagtttctgctactgctggcgacacacgcgaatcatcagctatcacaaccggagactgagatttcgtcattccggtcgttgtttcaaaatccatagttatacaagcgtcggtaatgcatggtttcaaataaatattgagtccgtgaagagaacatggttaccgcagttattgctgtctctaatcaatactaatatatcaggtctttcataccggcagaagacaccaaaatgatactaaaagatatctttagtaccggaaacaataaccggtacggtactaaaatatttccaacttggcgcaagaaataattagcctgctgtaccgactcttacaaagaactagtactttgaggctattttccatcgtccccgcaacaagttttaggttcacgtctaaactactttagtatcaattattaaaaagaaccgctactaaaagtgaagtgattagcaccggttttcgtactaaagatattcctattcccgccacagctttcgctcccctataactataaattcatctttccccaagcctacctctccagcgaggacatccgaaactcatgcattatttttttatgtttcttcaccatagagtttgcatttttcacacactcgcaaaatgatgtttctccatttttttcctatttgtttattgtccataatgcttatattgtttgttttaaactctacctttttccttttaatatgtttttatagaaatcctgctaatattgatcccatgaactaatccttagacagaaaataagaaaatacattcaactaccaacaagccgtcgcgctaagggctagttgtcggctaagagcatcttcatctctcgccatagacctctagccagagacaaagaaggaactgcgacgaaaaaggaagtagggttagggatgtgatcagatcagatatggacggatattattcgtctcatatttatttttatattttctcttcagatcaaatcggatacggatattancgagttgtgtcggataatttttgaatgctttaccatcttaaatatccaactttgaatatatggatacaaatataaattggatagtatatggatcagatctcgatcctcttagaccaatngaattcgaatacggatggatattatccgtaccatnacatctccaagtagggatgaagaagaacggagatgag

SEQ ID NO: 2950 - DNA, 2067 bp, Zea mays
  misc_feature (12)..(12): n is a, c, g, or t
  misc_feature (16)..(17): n is a, c, g, or t
  misc_feature (29)..(29): n is a, c, g, or t
ggtcatggtcgnattnngctggtgggggnaagaacgttgaggctcacaagccgcaggagtacaactggactggctacaggcgcctcttccagatgatcagggaactcaagctcaagttgcaggtcgttatgtcatttcatgaatgtggtggcaatgttggagacgatatatccattcccctcccacattgggtaatagagattggaaggagcaatccagatatctactttactgacagggcaggaagacgtaatacagagtgcttatcatggggagttgataaagaaagggttttgcaaggcagaacagcagtggaggtatattttgatttcatgagaagcttccgagtagaattcgatgagtattttgaggatgggatcatctcagaaattgagattggactaggggcttgtggagagctgcgatatccatcttatccagcaaaacatggctggaaataccctggcattggagaatttcagtgctatgacaggtacttacagaaaagtttgagaaaggctgcagaagcacgagggcataccatatgggcaagaggacctgacaatgctggccattataattctgaaccaaatctcactggatttttttgtgatggaggagattatgatagctactatggccgttttttcctcagctggtactcccaggcattggtggatcacgcggaccgtgtactgatgttagcaaggctggcttttgagggtacaaacattgctgttaaggtctccggggtgcactggtggtataaaactgccagtcatgctgctgaattgactgccggattttacaacccgtgtaaccgtgatggctatgctccaattgctgcagtattaaagaaatacgatgctgctttgaactttacatgtgttgaattgcgcaccatggaccagcatgaggtataccctgaggcatttgcagatccagagggcctagtatggcaggtgctaaatgctgcgtgggatgctggtatacaagtggctagtgagaacgctctaccttgctatgatagggatggattcaacaagattttggagaatgccaaacctctgaatgacccagacggacggcatttgttaggtttcacctacctaaggcttggcaaagatctgtttgagagacccaacttttttgaatttgagcgcttcatcaagagaatgcatggtgaggcggttcttgatctgcaagtataagattggtagcatattgcatacacgtatacaagtgactgattggctcaggccttatggcttacatttttttcttcttttgctttgtgtttttaggcggtaatatcagctgatttttgagctgttaaatagagaactcgctgctcaatttttaactctagtcttcaagaaggaagacgagttgagttccgtataatcggtgaattcacatccttttgtcgccggcggctccacatgtgccatcatctcatggccatggcgcaatgttatgcagatgtagtgtgaaatccgaagaacctaggcattctgctcatctccatctccatatcagcgtcaaatgctcaaattttttagttcaagtgactgctgatacgcatggaacaaaacgggaataagtgtctcgatcctactgtcttgcgtgtaatgatgttcaacaatgcagattgtgagtttggatctgttgagcacagaaaaggtgttgagcacagaaaaggtcctcgcggaccctgctgatttttttgtttttagccaattttgtgacaaaaaattacaattagacccttgaaaaacttatttcccgttttggacctgaagctcggcgccacaggctgtggcgccgagttctgacgtggcgctaacggcactcggcggttaggactgacgtggcgccgacgcagtctcgtagctcggcgccatagatcttggcaccggcgagacctataaaacggtcgtgttgctgaccgagaagagctcatctccccttaattcaaaaattcgtcaaagttgctgttggggacttgttctcaaatgctatgagttaagaacaaggcaacacagagaatgtaaacgataaagtcct

SEQ ID NO: 2951 - DNA, 836 bp, Zea mays
  misc_feature (13)..(13): n is a, c, g, or t
gcgattcccgggnaaaacctccaagaaaatggaaataataggaatgggggattcttcttatcaaagaagaaaagcctccaagaaaatggaggtggaactagcagaaagttcatgatatagaaagcactgctgatggatgatgtgaacatggcacaagcagataacattcaggacactgtaagaaggcttcaatcaaaccatcttgcttagaaaggagaagctgaggtgttgtccaaggataggtatcgatcttccatggaggtccaaccggccgccgctggaccttcatctaatctggatagtgaaagtcatctagtgcaacggaggaggcaataagcaaccaaagaagacatcaaggtttctaagagctcgttcaggtgacaactcgttagccatgcttggtttcagacagccaagtgcaagccctgaatgtccacaaagggaattacaaggtccagagacgtggttgccagcgcgaggtgcttggaagacgaagaatggtgggggatagaaactctttttgatcaatggacggaagagtcattgcaactgcatttagacgtgtccatatactttagtattttttgaattttgagataaagtcgtggtattgaaaaatattatagtttttcccaagtgtttggctaccttgtaaaagctctcttttgaatactataatttagtagttctatggtttagtagataccatggtatttatttttggagtatttaaaactccactccaatctaaaatttttttatctatgactggcttttggtatatatacattaaatatcatggtttaaaaaaaaactgctacctcaaaaggctacaa

SEQ ID NO: 2952 - DNA, 2360 bp, Zea mays
gcactgggcaggcactccggcactggctccttccttccctttcccctgatccctcgtccagtcgtcctcctctgcccggtacagctgcgaagccggcactggctctgctctgctcgccagcagcaccgacctccactctacgtctccaccagcaaggcgagctcgcttttcactcccccaaatctctgaataaaaaatcgcgcaagcaacctcgctccaccggcctcccgcaagttcgttcgttcagtcaggtcaggtcccagcctacgcagcatttgacagcgcgaggcggttgcccagtcagtctggggtggacggctttgatttgcttcgaagggagtgagattggttgaagccttcgaccaaggttgtcaatggattctgggatttgggcatctgtttggagcttcatcaagttcctgcctttcttctttgcgcttctcctcctgggcatcatcaaaggtgctttgtttggcccatgggcatggcttgtcatgacaattggaatttccgcacttattctaggcttatggcctatgcatgtgatttggacatattactgcatcatcagaaccaagatggtaggaccggtcgtaaagttgctgcttcttattgttgcaactgcggttttggttatatggctaataattggcgtcgtgggaagcatccttgctggtttggcctatggctttctcgcaccagtaatggctacatttgatgcgattggggaaggaaaagaaaatccacttgttcactgttttttggatggaacatggagcactatcacaggaagctgtacagttgtcagggacatgaaagacatgttggtacactcatatttttcaatcatggatgaagttcgtcttcatgcacctcccgacggcaagccatatgagataagattgctacaaattcctggtgcaatatttgctgctgcttgtgggcttgtagtggatgcaataatgttcacactaattgccttgtacaaattccccgttatgctattcaaaggatggaagcggttgattgaagatcttattggcagagaaggaccttttcttgagacagcttgcatgccatttgctggtcttgcaattcttctctggccatttgcagttataggagcttttatagcctctgttatctgcagtgttccttttggtgtatatgctgctgtggtggtttatcaggaatcctcacttttcttgggactgtcttatgcaatatcatcagtatccatctttgatgaatatacaaatgacgtacttgacatggcaccaggatcttgctttcctaggtttaaatataggacaaatgaagcttcctcacatggtggctctctctcgagacccgcttcattcaaggacaagcatgatggaaagaaagcccctcagcgtgtaacatcatttaaaagtagctttgatgagttcaatccattcaagttgctagatcaccttttcatagagtgtaagcaccatggcaaggatctggtcgctgaaggagtgataacctcaaaagatatagaaggaacaaaggcaggcaaagccagcactggggtacttaatgttgggttaccagcatatgttatccttaaggctctcctccgatctgctaaagccaattctgatggtctcgttctaagtaatggatctgagataacatccgacaataggcctacgagtaaaatctttgagtggttttttgaccctctgatggtcatcaaagatcaaatcaaagctgaaaacttcacagaagaagaggaagcataccttgagaagcaagtgctcttgattagtgatccaaagcgcatcaaggagaatctcattcggcttccaccattgagtgagcgaaaacaagcagaaatagaagcatttgctcgaaggttgcaagggatcacaaagtcgatatcaaggtaccccacatccaagcgccgcttcgacgcccttgtgaaggctctttcagaagagcttgcgaggacaatgggtggtaatcaatctgctaatgggtctcaggtccggaagatgagaagtggtatcgtccgaatgcttagtcagagatcacttgggaaagcaacaggcatcccgggcgatgatcatgaggctcagctaacaagcgatggtttcacttcatgatgttctggaggtgttcaactgtaacctcagtttgaaaaggagatgctactttactgtgttattttgctaactggatacaaagaactgacacttctgtatgaagagtttagcctcaaccatctcgaggatgagttgtttgttttgaggactgtatctggacaacactgtagtaatactttgtaacagaaagcaaaagatatgtccttgttcagtgccaccttctagctg

SEQ ID NO: 2953 - DNA, 1425 bp, Zea mays
accttcccagttcccacgtcccaacaacaaccaccccaggatatgagaatactatgatccccatccctcccctcccctcccctgactctactactcctcccccactgccttgccttcgtcgtcacatgcgcacaagaaagaacccgcgccgcccctgaccctggcccctcctctcctccagcgcgcagccaagacgtcgccgcgcccgcttccatgaccctcgtccccacctcgcgatgagcgacattgcgccgtggtggcgcctgccttttcgttcttgaccgcccgtcgagctgctacgagaaagggagggaggccgggcgatggccgccgcgaggaggctctcggagctgctgcaggagcagcaggagccgttcctcgtcgaggccgccagggcgaggcggccccgacgcgtccgtggcgcgagcggggcggcggcggaggaagcgggaggaggaggtgggctgggctgctgccccaccgcggcgtgccggcggctgctcaggctctgcagccacgggttcaagaagaggagcgccggcgccctcaggtcggcgctgaccaaggtgctgtgcagcagggccatgcgccgggtgctgcgctgggacggcctcggcggagactgcctctcgggcgccggcgcatgcggcgccagcgagttccgccgcctgcgccgctcactgggggacagcggcgagtgtgaccctcgcgccatggtgtttcccggcgatggtggggacgaggagcgggtggggtggaaggccgacatggacgtcgactcgtcgcggcagctcagcccggtctccgtcctggacctgcactccgacgatgacgacgacgagtcgctggcgcattcttactggggcgacgagaagccgtccacctccgggagctcacctccgtccgagcctttcctcgggccgacctctccgtgcttcagctactacagccacagccacatcctgcacgacaagttccgcgagatggaggtggacgagggcgaggaggagacggcccggaccggcaggtccgtcgaggagcagatctcgtcgtgggagaagatcgcgggtgacatctccaggatccccgcgatggtggagctggacctggcgcggtccgcgcggcagtggcgggagccgaggctggaggccagggaggtcggcgccaggatagagaccctcatcttcgatgacatcaggagggagaccgtgtgcgacatgctcgcctcgcattgtagatcggcggcggcggcggcggcagcagcaacgtcttgttgatcgaggtagtaggaggaggaggggttgttgtgttggtcagaagctatgcagcggatacgggtacatttatcgacagttttcaaaaataaaatggagaataaatagcgtatatatgttgaaaaggttaacaaaaaaaaaaaaaaaagtt

SEQ ID NO: 2954 - DNA, 795 bp, Zea mays
tggtactctatctattgatcctgcaagctagttatcatttcaagattctctctgttttttttactttattgtctaaatgttcctcaagtaatggcagaagctgaactgaataatccacgcaagcatgtaaaaagaccctgctaatttgtttcctctgctgttacttccgacagggggcgacgagaagccatccacctccgggaccgggagctcacctccgtccgagtctttcctcggtccgactccgacctccccatgcttcagctacgacctccaggacaagttctgcgagatggaggtggacgaggccgaggaggaggagacggtccgaaccggcaggtccatcgaggagcaggtctcgtcgtgggagaagatcgcgggggacatctcgaggatccccgcgatgatggagctggacctgtcgcgttccacgcggcagtggcgggagccggagcccgaggtcagggaggtcggcgccaggatagaggtcctcatcttcgacgacatcaggagggagaccgtgtgcgacatgctcgcctcgcattgtagattggcggcagcagcagcaacatcttgttgatcgagggaggactggactggaggagtggtgttgtgttcgtcagaagtaaggggaaaaaaaagagagagagtagaaacagtagaggaggaggatgtgtacaatctgaggcttgcttgatgtgaaattctttttgcccaaacgacgaagccttggactctttgccgcatcgagttccacgctgtttatgtgtttgcaaatatgatattggtggcaat

SEQ ID NO: 2955 - DNA, 2209 bp, Zea mays
  misc_feature (37)..(37): n is a, c, g, or t
  misc_feature (40)..(40): n is a, c, g, or t
  misc_feature (2199)..(2209): n is a, c, g, or t
aaaaggtacttccatttggagaagcctgattcatatnggngcgacactgtcactgaatcctgtcaaacttccagtaaactacaaaaactaggcaactggaagtcaggtaatgacttttttgagctaacccgagatgatcagaaatgcaaaaatgatgaagccacagagggaggtgataaatgtgagcaaatgacccctattactagtgtcatcaatgatcacaatgaaattgaattcaatgcagcaggctctgacttggacaggtatgaaaaactatgggaggttaatgacaaaggtagtgtgggggtgaaacctgtaaatctgagagagaacaagacagctcccgtggacaaagatagtgtgtctgtgattttagaatcttctacagaaaataaggcacaccaaaagactcacaactcaattggtgagggacttgtaacactgaaaaatgctaaggaaagccatggtactgataagtgccttgagcttccttctatgagtggagcctccacaaagctggatgtcttcaaggatgtgtcaggttcatttccggaggctcgctcatcagtaaatgccagcgatcttggagaccatggtaatattagtccaaactttagtccattagcaggaacatcacaagaggacacaaccagtaaactggtatcagaagtatcttgcgatggtgggatgcaacacacttctcgtagtaatgaaaagctacaggaatcctcagatgtatctgatgttgctatttcccagggaagtaacattaaatcattcattttagaagaacttaaagaatctgatgtatgtgatgctttcatgaggggacctaatggaaaagggcaggaagctgaaaattatggaagagaaaaaatcagctttattgatggatcactcttgctgcgaccacacttccataacaaaggtgctaagatgaatgtaatctctgaggaagtacagaaagtcaaaaatgaggagaaacttggtccgtgtacacaccccgaagtaacaattgtggatctggtcggcgacggtccccccccccccccccccgttattctacaaaatgatgactttgcagacccagaagaatcaaacatgcctaatgtatttgaggtagctagcaagttgattaaaagagatctggatcaagaaatgcatgggtcattaggacatggtgaagaggagaatatggaagaaggaacagatgtacatctttgtgatattaatggcaaagaagtagatgaaaccttgttagaaaatagtgtgtgtacagatactgaagaaggatgtgctcattgtaaccaggaagaccagaattcatctgacagcaccaacagaggaaaaagtgatgtagataacatgtgttatacatcttgtgacgaggttaggtctgaatcattttcaggcgatgaagttgttatcaaaactacaattgatagcactgccagaacatttgttaatttgaaagatgagcaggttttgtcttcagaaatgtatacccgcatgcagcactcaatgcaaaaagatggtactgctgcttttcagacatctgggggtgttcctggtcttgaagaaatcggggatgtttccaacagaggaggaagagaattatcaacagaaaggtctacatgtgaagatcatggcaacacaatcataatggaagaaaaagacactacagcaaggatatcaaaggcagagcatgcatcatctcccttggagacgatgtgtggtgtaactaaatctgctgaagctcccacaacagttcctactgtgacacggaaaaaagaggtacatggagttcagaggaccaaagagagggagaacatgacaacagcagatagtgcatgtgaaaaggacaaagggtcttctcaaagagtacaggaggaaaacgaaagtgaaaggagattggagaaagaaagagaagttgaagagaaggaaagaaggaaattggagaaagaaagagaacttgccgaagagaaggaaagaaggaaatttgagaaagaaagagaacttgccgaagagaaggaaagaagaaaaatggagaaagaaaaagaacatgccgaagagaaggaaagaagtaaattggagaaagaaaaagaacttgctgaagagaaggaaagacataaattgaagaaagagagagaacttgctgaagagaaggaaggaagaagattagaagaggcggaaaggggnnnnnnnnnnn

SEQ ID NO: 2956 - DNA, 978 bp, Zea mays
actccttcaatactaaggaaaagaaaacgtgataaagcaacacctgcttcgggtaatgagttaaagacaggtggagtaaccaatgatagcttttacactcctaatcgaacgaatgggaaggatactacttctccaaggtcgtttaaaactgctgcatcttttttgtcgctgggttctgttaatgggttattgacttctgcaaggagctttgattcttcaccaccctatcagaagaaaaggtcaaaaagaatggccatcatcaaatcagttgagaaacagctagatttttcagcagatggactggatacttctggttctgagattatgaactctccttgccataattcccaaggtgcaaattctaacaggatgtagcaactgatttgattgcaatctaattccacaatgtgcaggaattgatctcaatcttatgaagccatacaggacttagaatcccgtcctaactaaccagcctcatgcaaatgtcctggttcatgccaaaatccaaatcaaacaccttcagtggggacaagaccttaccgacagttaccctgtcatctcatgtaatcaggggtgtacaaaatactgtctaaattgaaagcacattccatagaagattacattgtttgctgcattttgtgaacttatagctagaagttcagattatagaaacccacagctgtgtacaaagaagagaaacatagctttagaaacatatagagcttcccagtggaatgtcaaattgttcttagtttcttttattgcgcgcgtcccacatgttgcgaaacagcaagggtctgctcattttgtaacaataaagcctgatttgtgggctaaattcttgctaggcattgtcaagaaactggttatcacaggcttggcttcatggttggctgaatcttttgtgcttctattgttactagtttaatacccgtgtgttgctacggcatataatcatatttaatggccgcttaatcc

SEQ ID NO: 2957 - DNA, 766 bp, Zea mays
tgttgattcaattttgagaatggctgctgatagctttccatgtacctccttcaatactaaggaaaagaaaacgtaataaagcaacacctggttcaggtaatgagttgaagacgggtggagtaaacaatgatagcttttacactcctaatggaactaatgggaaggacactactccacggtcatttaaaactgctgcatccttctcatcgctgggttctgttgatgggctattgacttctgtaaggagttttgattcttcaccaccctatcagaaaaggtcaaaaagaatggctatcatcaaatcagttgagaaacagctagatttttcagcagatggactggatacttctggttctgagattatgaactctccttgtcataattcccaaggcgtagattctaaaaggatgtagcgcatacaagtgatttgaatgtaatttaattccataatgtgcaggaattaatggcaatcttatgaaaccggacaggactttatggaatcccttccgaactaaccagcctcatgcaagtgtcctggttcaagccaaatccaaatcaatcaccttcagcggagataaagagcttcctgcaatggaaatgacgtacggaacacaggccaacagtttaccctgtcatctcatgtaatcagagtgtacaaaatactgtctaaattgaaagcacattccatagaagattacattgtttcctacattttcgtgaacttacagcttaggagttgagattgtagaagcccacagatgtgtac

SEQ ID NO: 2958 - DNA, 1120 bp, Zea mays
aactcaacattttttaaaaaaacctataaaaagcccggtaggctcagccagtcaggcttattacagctacacctccactcgacgcaagaaagcaggtacctcacggttgcggcctcggatctgtgatggaagaaagcaagaccggccccggcggactgacggcccgtggcaaggggaaggcgccggccccgccgccgcctccgccgagccgtgaggaggagaacggcggtgggcaccgtcgcgggcagaggaggaaagtctggccgcgtggccgccgcgcggtcgtagctctcgtggcgatggtcgcggcggccctgtaccttctactcgctgacgccgtcgcggagccgccgccgggcgcctgggtgctcgtggcctaccttctctggatcgtcgggctgattatgcttttttcagttatgaagtgagattgatggtcggtgctggttggtgtggggactgagggccacgggatcgtttctttcagcctttctttttcttattatgtcttttccttttccttctccttttgtacatgcacttgcgccgtcttgatatgatcctgccatgcatgatgcatgcgctagattattacttgatcgagctaatttaaattgtctcttttaatttcgttactcagctcttcaaatataataaaaaaatatcaatcatagatgtgctgggcatcaaataacacacgatcgatagagaagcacacaaggacattttttttgtttttttttttggctctagcgactccatctcctttgacttcagtttaaggaatctgtttcggttatctctgccggccggctgctgctcatccgcttggctccgagtcaggcggccctaccactccaaagcttcggcacgaaggaccgcgtggtgaccgcggggcagcattggccagtttgttgcgcatgtacatacacacagtcgcacgccaccgccacgtggattctgctgagatatcgacggacccgcggcgtactgcttccgacaccatatcagcatctcgcaccactacaccaaaatcatacactgcctacggttttttaacttcctacagcttttataacaaactgtaggaaataaataactttcgagaggcaactggtag

SEQ ID NO: 2959 - DNA, 1549 bp, Zea mays
ttcttaagcagtggtaacaacgcagagtacgcgggagcagtggtaacaacgcagactacgcgggcaaagtaatatttcaaagcacaaacaagagcttaaactgtcacagtacaaggatatcgagaagcgatatactaatcaatttctccagcttaagacaactgaaatggcaaacaaggacttggacagatattatactgctttagacaaggctcttatgcggttccacagcatgaagatggaggagataaataaaataatcaaggaactgtggcaacagacatacagaggccaggatattgattacataagcataaattctgattctgagggtgctggcactcgatcatacagctaccgcgttgttatgcaaactggtgatgctgagctggaaatgcgagggcgctgcagtgctggtcagaaggttcttgcttctcttataatcagactagcacttgcggaaactttctgcctgaactgcggtatattggctttggatgagccaactacgaatctagatgggccaaatgcagagagtcttgctgctgcgctgttgagaataatggaagccaggaaagggcaggagaacttccagttgattgtaatcactcatgatgagagatttgcccatcttatcggtcaaaggcagcttgctgagaagtactatcgagtctccaaggatgagaaccagcacagcataattgaatcccaagagatatttgactaagggtgttctaggaggctgtagcacgcactcgtttgctagtcgaatccagttaatttatgccaagtactggtgccagagcaatgttaacaagctttaggaggctctgttacgccgttacgtcagttgcgtgaaacctatccttcgttgttgtatacttatttaatctggccagaggatggaatgtgtgcactgggtgatggatgtttcacgacatcaatgaatgtttcacaatctagcatccgttttttttgcttcacatgatgtcatacaaaatcgctacggtttcatttggttttggaggtacctacgagtacgatggaacacaacggcatgtttctgcgtcgttggagccgttggattcgcttcaacatttgtaaggttgtctcttaacgtatgatgcttgtgcaatgacgaccatatttgagaaagatatttgttaaaaaggagacttgtcacttaatatctagcttggctgtttgttctagtgaggtggtactatctaggagcgctgtgctatatgtggttgtgtcgtgttttagtttgggtgttttcttaccatctatctaagaggtaacgacctataccatttgacgatgtgaaccgttatacatctctatatttcttctctatgtatcccctaaagatttctctataagatatgttataaacttatattacagatgtattgttggcccttgctctcagatgttatactcaggaacaaagcagcacaattgttattgattagtgaccttcgtccttcgaaacattatctcccttaggtataatgatatctagttgaaggtcaagaagggcatacct

SEQ ID NO: 2960 - DNA, 3689 bp, Zea mays
  misc_feature (2777)..(2777): n is a, c, g, or t
  misc_feature (2815)..(2815): n is a, c, g, or t
  misc_feature (2824)..(2824): n is a, c, g, or t
  misc_feature (2854)..(2854): n is a, c, g, or t
  misc_feature (3337)..(3337): n is a, c, g, or t
attaattttagttaagggatgttagtttcttgttttttaagaaactgataatctagtttctataaagtgagacataaattattatgtttgaaaccacctcagtttttataaactagtttcttaaaagaagagtgcttccaaacaagcccttagttacaaatatgtactcttatgtagttctagttttattgtgagttaaattatcataaatttggtcaggtttacaaagaagattggtaaattatgtcatcaaccaagtatattcgaaaatatacccatgatggatcatataatatttactagacatgtacccatgtattgtctcagcagtttaaaattattatataaaacatagatacatagccagtaggatggtttgccagaaaattgtgtagaattgggtggacaaaatgaccagccttgtaccataaaagattgaattttctatagaactgaggctgctatccagatcaccttcttgggtccggccggtcgggatcaatagttgttgtgaactctacgatgttgtgcagtattttatctactgcttaagcgggacaatttagcacgaatgttggggtattttggcaagagacccgaaaaaagcaaatgtccgtacattccattctttcaagttaagttcagaaagcctttcatgccactgtatattacagctttcacatttagattatgctagtaataacaatattgttcctggagctctagacctcgttctcatttcggaaaacagattgttagagcattcggcatatagagtttagaagtgcatccactcttttcccatttcagaaaacagattgttagactcttctagcaacccttgttttatgagaaacaaaacgaaaaacaggctcaggttaacaatagcaacagatatatggcacaatatgatttcattactgcatttgcccaattaggtggcatacaatctgacaacttccaatatcatccaagctttaaattgctaagcgagtcctgtgatggcaccataggaaaaaaacctgctcatttgtaaagctataggattatacatagccaacaaattcgggcctagtaaaaaatcggcaaaatatgccctagtcatccagctcaataatcttcacaaccgatgaatctcccactttcgggcaaacgacgtgatgtggattgggggaggaaaccaggaaattgacaccacaaagttgaacctgagtgaaatggactcaatggactatggggaaggtggaaccagaggaggtcgatttccagtcgaggtgaccgaaggagatcgccctctctgggagatctattattcttcaatgtctcctattacaaactatggtgctttatatagctagcacctctttctcttaaggaaaccttacttaaggaaatatactaacaggaaaataaactagatcatatctcttaattgagggaaactctcctcatttattcttaagcaatctactagtataggaacaaactaaatcatatctcctgattccttttgtttctgcggctcctttccttttctgtgcctaaatcatatctcctctcctgattccttttgctactgctgatgctcctttccttttctgcgcctttggtactgctgaccatagaaggagtctataacatttccccctcctcaacaaacagctcgtccgcgagctgtactgcaggaaactgacgcttgaagtcatccagctgctcccatgaggcgtcagtagcaggccgaccaacccaatgcactaggacttcccagactccacggttcagcctggctttagtaaccttgttaggtgtagggacaattctgccatgaagaatatctggtaaaggaacaacagccgctggcgggggtccttcaaacttcttaagcagtgaaacatgaaacacatcatgaatcttggcacgtggaggaagttggagctgataagacacattgccaatgcgccgcagcacttgatacggaccatagaacttgggccctaatttggacggggaagctgcagtgacaccaacaacagtcctgtgctgtaaacggagccagacccaatcacccacaatgaactggacaccccgacggctcttgtcttgatacattttcattgtcacttgagcttgaagcagtctttcccgaatttctgccaaaaaaggtcacggtcctgcatctgtcggtccacaaccaccacccgtgctgtccttggtgaataagagaccatggtcggggggtctctcccataaaccatcttgaatggagaacattacagggcagtttgataagaagaattatagcaaaattcagcccaaggaagccacttgagccaacttttaggctggtcactggcgagacagcgaagatacataacaatcactcggttgaccacctcggactgcccatcagactgaggatgaaaagctgagctcatctgcagtttaacaccagccaatcgaaatagttctgtctagaaagaactagtaaagatagtgtccctatcgctcacaatggaggatggaataccatgaaggcacacgatatcatcgaagaatgctttagcaacatatgcggcagtgtatggatgaccgagggaaataaaatgagcaaatttagagaaccgatctaccactgtcaggatcacagacttgcccccaaccttcggaaagccttcgacaaaatccatcaagatatcactccagatttcggagggaacaggtagcagctgcagcaacccagcggggtgtagatgttcagttttattcctctggcatancgaacagccttgtacaaactctcgcacccttcgggcanctaaagggntgtagaaagaagaccgccatctgtgcaatntcttctgaataccttcatgtccactttcatgtgcttcagctagcaaggaagaccacacagaagaggaagcaggaacaaacactttcccattatacaataataacccatcagactcagtccaaccaggaggagccgtcccattctgcagccctgctcgcagttctataccttggaaatcattagccaagtctgcccgaagtgtgtcaaaaagctgaaaaatcggggccgagatgctgtgaagggctgcaacatcttcatcacggcgggataaagcgtctgctgccccgttaagtttcccagggcggtattccaccgtgaggtcatacccaaataatttactgacccatgtgtgttgcggaatggtagaaagacgctggtccaatataaacttgaggctatagtgatcagtccgtaccgtgaatggacgcccccacaagtacggacgccaatgtcggactgctttgacaagaccaattaactccngctcgtaggccggcagcttctggtggtgaggcgccaccactcgactgaagaatgcaatggcgccatccccttggtgcagtacggcaccaaaacccgtgccggaagcgtcacagtcgacgatgaagcgctcggagaagtccggaagctggagtagtggcgccatgatcaaggcttgcttaaggcggttaaaggcagttgtcgcctcttctgtccaagtgaatgcctcgcgcttcaagagagacgtcaggggggcggccacagcaccgtatccagcgatgaacttacggtagtagcccgtaagaccaaggaagcctcggagtgcccgcagagaccgcggtgcggccaagccacc

SEQ ID NO: 2961 - DNA, 2769 bp, Zea mays
  misc_feature (8)..(8): n is a, c, g, or t
  misc_feature (11)..(11): n is a, c, g, or t
  misc_feature (14)..(14): n is a, c, g, or t
  misc_feature (17)..(17): n is a, c, g, or t
  misc_feature (29)..(29): n is a, c, g, or t
  misc_feature (42)..(42): n is a, c, g, or t
cccgcggnggnggncgntttttccctaanggatcccccgggnggcggggtagcacgagcccccccggtccccccccccccccccccccgaactggtagctggtgtttcgacgagaaagttctgattcagtcactctacaaggttatggtttctgtatctgaaaacggtccgattattctttacataagggatgtggaccatttcctctggaaatcgcaaaaaattcacttgatgttccagaaaatgttggccaagctatccggtcaagtgttgatacttggttctcgactactcaatcctgacgctgataacagggatgccgatgagaggattagtaccctgtttccttaccatgttgacatcaaagctcccgaggaggagacccatctagactgctggaaaagccagattgaggaagacaagagaaaaatccagatgcaagataacagaaaccacatcatagaggtactctcggcaaatgatctagactgtgacgatctgagctcaatctgtgaagcagacactatggttctcagcaattacatagaggagatcatcgtatcagctgtctcctaccacttgattcacaacaaggaccctgaatacaggaatggaaagctcatgctatcttctaaaagtttgtcccatggtctaagcattttccaaggtagccatggtgggaaagacactctgaagttggaagaaacgaaggatggtttgaaaggagctcttgggtctaagaaaactgagacacttccggttggcgaaggtccagtaccgctgccaaaaccagaagttccagacaatgagtttgaaaagcgtatcagaccagaggtcattccggcaagtgagataggagtgacattcgatgacatcggagccctggcagatatcaaagagtctctccaggagctggtcatgcttcctcttcgacggcccgatctcttcaaaggagggctcctgaagccgtgcagagggattctgctgtttgggccacctggaaccgggaagaccatgcttgccaaggctatagcgaacgacgccggcgccagcttcatcaacgtatccatgtccaccatcacatcgaaatggttcggggaggacgagaaaaatgtccgggcgctgttcagtttggccgccaaggtagctcccaccattatttttgtggacgaggtagacagcatgctggggcagcgcgctcgctacggcgagcatgaggcgatgcggaagatcaagaacgagttcatgagccactgggacggtctcttgtcaaaaacaggcgaaaaaatcctcgttctcgccgcgacgaataggcctttcgaccttgatgaagccatcatcaggagattcgagcgcaggatcatggttgggcttccaactctggagagcagagagctgatcttgaggacgctgctttcaaaggagaaagttgatgaagatattgatttcaaggaacttgcggccatgacggaaggatacagcggcagtgatctcaagaatctctgtgtgactgctgcttaccgccctgttagggagctcctgaagatagaaagagagagggaactggagcgaagggaaaaggagtcaaaagacaaggcggcggcggcggagaattcagaagccccggagactgagaagaaggagagctcagaaaccaaagaagctcggaagagcacgcagagtccagaaggcggcggcaaaggcgacgagggtccagacagcaaggcggagggcgagaaggaagcggccgttgttgaccttaggccactgacgatggaagacctgaggcaggcaaagaaccaggttgcagcgagcttcgccgccgagggtgccgtgatgaacgagctcaggcagtggaacgacctgtacggcgaaggggggtccaggaagaaacagcagctgacctacttcttgtagaggtgaagcatttggcaggtggtggagaggaacagagctgggcagacggtggacccatacttgatgaaccgagcatggtttcttcaagacgtgacgtgggcatgacgcatagtactagtctttgaggttccaggatccatgagatgagatgaggtcgatggtcaatttgtaggatcatgaactattattcttttacatgcatttgtacatgagcgctagactggttatgtatatctggattgattgaacagctcttgtgtttgagggtcattttagcttctcgtagactgctgtaattatatcatatatagtgagtatatatattcacaaaaaaaaaaaaaaaaaaactcgagggggggcccggtacccaattccccctaaagtggagcctaattccaattccccgggcccgtcgttttacaaccgccggtgactgggaaaaacccgcgggggttacccaactttaaatcgcctttggggaccaaatccccccctttcccccccctggggcgtaaatacccaaaaaaggcccccacaccgaaatccccccttttcccaaacaattttgggcaaccccccttaaagggccgaaagtgggaaaaattcggaaagcgcttaatattattttttgtcaaaaaaccccccggcggaaaaattttttgggaaaaacccccgcccctttttttttaaccccaaaagaggcgccaaaactcgggaaaaacaccctcttttaaacaccaacagaaaaaaaacaccccgaaaacacggggtcgggaggtgttcttccaccggtggggaaaaaagagactcccccctctaataaaaaagcgggggcacccccccagctagaag

SEQ ID NO: 2962 - DNA, 1346 bp, Zea mays
  misc_feature (1257)..(1257): n is a, c, g, or t
  misc_feature (1309)..(1309): n is a, c, g, or t
  misc_feature (1318)..(1319): n is a, c, g, or t
  misc_feature (1325)..(1326): n is a, c, g, or t
  misc_feature (1331)..(1332): n is a, c, g, or t
  misc_feature (1340)..(1340): n is a, c, g, or t
  misc_feature (1343)..(1343): n is a, c, g, or t
  misc_feature (1345)..(1345): n is a, c, g, or t
attggggcccgccgggccggccgttttccccacccgcacaaacgcgcacaccccacttggcgctccacctcttcgctctccgacgacagccagcgagcgtgcgacgggcgatcgatcggggcaggcattcgaattccgacgacggccatggagcagaggagcctgctggtgtcggccctgggcgtcggcgtcggcgtggggctggggctcgcgtcggccaagtgggcagtacagccggcgccgaacggtggcgacggtctcggagccggcgccgcggagttggaggccgagctgcggcggctggtcctggacggccccgagagcgacgtcaccttcgacgagttcccctactacctcagcgatcagacgagggaggtgctcatcagcgcggctttcgtccacctcaagaacgcggagctactgaagcacgtccggaacctctccgccgccagccacgccatcctgctctccggccccacagaggcctacctgcagtcgctcgcgaaagctctgtcccactacttcaaggcgcgcttactaattctggacgccaccgacttctctcttcggatccagagcaaatacgggggctccacaaaagccacggcccgcaatcaatctgtggctgagaccacgttcgggaggatgtctgatctcattggatcctttatggcatatcctaagaaggatgggcctatagaaaaatcgctgcgtcgccagacaagcagcacggatttaaggacaagaggctctgacggttctagcagtacgccttcgctgaagaaaaacgcctcggtatcatccgacatgagcgaccttgcctcacaaggttcgggaaatccagtgaggcgaactggtagctggtgtttcgacgagaaagttctgattcagtcactctacaaggttatggtttctgtatctgaaaacggtccgattattctttacataagggatgtggaccatttcctctggaaatcgcaaaaaattcactcgatgttccagaaaatgttggccaagctatccggtcaagtgttgatacttggttctcgactactcaatcctgacgctgataacagggatgccgatgagagggattagtacccctggtttccttaccatgttgacctcaaggctcccgaggaggagacccatctagactgctggaaaagccagatttgaggaagacaagagaaaaatccagatgccagataacagaaaccccattcatagaggtactctccgggcaaatgatctagnactgtggacgatctggagctcaattctgtgaagcagacactctatgggttcncaccaattnncttaannggganntcattcgnatncnc

SEQ ID NO: 2963 - DNA, 613 bp, Zea mays
cttcttcttttttccctacccctccgccgttgctctgcaaggcacgcgtcctgcacgcgccaaagctaggcgataaactggaaaggagcgcgcagcgcaggcttcgggctcctgtctccgccgcggcgtcctctcgctttttcaggactttcaggacttgcaggctctgcgcagcgcgatctgacatctgaccgggtcagacgatacagcccatatactacgttacgtcgagtcctcaaagttcaattctacctggaccattgcacccatcttggcccaaagtacttgcgcgccgcgctacgaacgaggccatccgccgccacacgccgtcggccatgccgcagaggtcagaggcgggcactgctggggagggcgacgaggagcagcggctgcgggctgctctgcgtcacctgcaggcggaggcgggggtgctggagcgcctggtgtacaagcaccggaaccagcaccgcggcgccgcctatttccatacctcctcaaggtgaggagggacctgaagcttctgctccggcgccgctctcgctgaggtcctcaacgccgtgttcccagttctcgcatgccgcagcccgcccaacacgatcctcgtccccaacag

SEQ ID NO: 2964 - DNA, 2617 bp, Zea mays
  misc_feature (6)..(6): n is a, c, g, or t
cctcgnagccggccgggacatcgatcaatacggccccaagtacttccccgccgcgctacgaacgaggccatccgccgccacacgccgtaggccatgccgctgaggtcggagaccggcactgctggggagggcgatgaggagcagcggttgcgggctgctctgcgtcacctgcaggcggaggcgggggtgctggagcgcctggtgtacaagcaccggaaccagcaccgtggcgccgcctatttccaatacctcctcaaggtgaggagggacctcaagcttctgctcggcgccggcctcgcggaggtcctcaacgccgtgttcccagttctcgcatgccgcaagccggccaacacgatcctcgtccccaacaagcagactaagaagaaacctggtgcaaaccacagccatcaccagaggcttttgggtgtagcccgcttgttatcccagatgtctgaacctgttatgaaggcagcaattcagataacatttttacttgctagatcattcttcgttgatctttgcacggctgtgctttctttgcttgcacgagtaagggtcctgatccaacagatgttacttgatgttgtgtctatatacaataaggtcactgatcttactgaaaggaagcaggctgttaagattagcatcagtggagtgcaggctttcagagagtactacccctctatgaatgatgcatgtacagttctggagtgtgtatggataaaagataaattcgttttgcatgaaaaggttaaagatatctctcaggagacccaagttgagaatcagaagtgctgcggtcctgaatctacagtccagtatgaaacgcttgcactgattagtgaagatatgaaaatcctagaagaaacgaacttgccagacagacagacagatactgctctagcggagcaaccggataaaatgattcattgcaatgatgctggagattctcagaaggggaggcaactagaaaatgaaagcagtgctcgttcagttcctgacacccttagtactcggaagcacctgaagcccgagtctaggaagagagtagcatttgtagcagttggaaattcgaaagttacgggtgcagcctcagaaataaaatcatcagaggtgaacaagaagcaaaggctagacatgatttctccttccaacatacaatctggactgtacaacaaattgctggattgtgggtttgcagaaaaatccttactttagtatgttcagaatttaatacttcaatactttttcaactggaaaagcaatagataggaaagtgcgcttgtgcgaaagtatctcaaggtacggcaaatgtcagtgttctgaagctgaggccctttatcatttctgtttcaaatttctaaggatgatctgcaacattgttttgtagtgtttgtattagggagatgcccatcttcacatcaatgttcagaagttatgtgcgctatgagatttaaattatgagctgccagattgttttgtagagtttgtatttggtcattgtcgtgtcaatgttcagaagcatgctcttatacaactgagttttgtttgcatcagcagatttctgccttgcagattttattattcatttcaaaaaaaaaaaaaaaagcgcttgcttatttagttccattttaaattgcttctcatgccaatttgagactttgggtaccaaaaaaatatggctcaactatattcatctagggagcaatggtccacaagtaccaccatgattcgttgtccagggaacaccaaaccttccaacgatatatccaagcgatttcaagtgcttataagcctagaaggtatctcaggagcaaccataatttcctccagcaagctttccacggatgccttcagttcctgtggtttcatccttaccaatgagaagaatcaaggcacctctttcagccaagaacctgcacgttttcatcagacaataagcgccttcactagtaaaaaactcgagtacctgaaaaatgaagtcaacgacaagcaattcatgcatactacattggtagtaaatggcctcagtgattcacgcagtgcagcatttgggctggtctgctggatgcacagcacaccatggctatacgagcagtatatattacaatcaaatgctgcacagatacggttatatttcatcgaacagttggtgtacccgatctcctcaacgttgtactacagcttgccggcccgattgacaccggtggtcagccacagcttgcccctgctctccgccacatccgcagcgccgcgcgacgccatattcctatgcccagatccgcagaatccagcgaggtcacagtctcaggacgagccaacacagacctgaactcgactcttgaggaggcggacagcgcagcatcgaggaaggagttgaggtgctgctccttgccatcatcatttccaacggcgcgggcggcaccagctggccagccccagcacgtcaccttcgccgccgatcacaaagcacgtttttaaaaaataaattacacgaattaaacaaagttcataaaatttaaaacaataataaaagtacatgcttcttaacttcttatgtagtgtggtggccacaatcgtatctaggtattgtaccattttatgttcttgtctgaaa

SEQ ID NO: 2965 - DNA, 1070 bp, Zea mays
gcacgagaccattacctagaacatccttatcaacgatgaattacagaattagtctctagaaactgacgcgcttcgtgcgattccgctcttgttcgcggaaatcggcatcctcccggctaccccgggccgggaatcgaaaaggctgccgtgttctccacttctccgccttcccctgctctcctggacctccgacgcaccccaaacaccgcagagatgcagaaccctagcggccaccacaccgcgacggccgccccgtcgtcggcgccgtccaagggcaagtcgtcggcgccgaaccctagcggcaaccacgctgcgacgccggcgccatcggggacgccttcaaagggcaagtcggcggcagcgcaggccgcggctttgggccacggttcctcctcccaccaccactctgccggcggtggcggtggtggcgctgacgcgtccgccaccaccctcaagcgcaagcgcggcgtcttccagaaagacctgcaacacatgatgtatggctttggggatgatccaaatccacttccagaaaccgttgcacttgtggaagacattgttgtggaatatgtcactgacctggtgcacaaggcgcagaacgttgcctcaaagagggggaagctcctgacagaggattttctttatcttatacgcaaggatttacggaaactgcaccgtgctactgaactactgtccatgaatgaagagctcaagcaagcaaggaaagcttttgacgtggatgaagagacgctggctacgactaacatatgatgttttcctagtcgtagaatctgcgtgttactgtaaccagttgtacaatgcactgcatgtgtcggacaattgtttggtgtcgacttgtaactgttccgctacagactttatctattttcttgacagttactgcgttaatggctgtatgccctgctgagtgaagaagtcagctggttccacacattcgcaatgtaaaaatgcacagtttttttttttgcttgctttggcggaggagatatttggaagttactggtggaggagatattttgaagtaaaattgccagacaatttacagattt

SEQ ID NO: 2966 - DNA, 2609 bp, Zea mays
  misc_feature (25)..(25): n is a, c, g, or t
cgccgcctcgcgcctggcctgccgngaggtggaggcggaggcggaggccgaagccaacgccgcccgcgcctggcctgccgttccgcgtcatcttcttccttcgcgtaacgacgccggccaggccaataaataaacaatttccaattccgttcctggaggacgtctgcacggggaccttcccagcgggcgacggccggctgcatccatggcggtggccttcctgctgctgggattgggtttcctccttggcctcctctccctggcgatcgcggaggggctgacgctcctttgggccatccgaagcctcacgcgccgcacatcggcctcacgcagcacgccgccgccatcactccccatccacccgacgccggcgcggtctgtgtctcgccacagcctcaaccgacagggcttcttatggatgctggagcaacccaaggatagcagcatcaatggcgctggcccagggatcagagacaggaagctcctcgtcgaggttttccctgtaaaaatgtctgctacgcttcaaggacactccctcaccttgtctggacccgatgatgcctcgcagctaaccattgacctgctcggttgcacagttgctgctgtttctgcatccaatctgccctcacgtaaatgggccaagaggtatccgataaaactggaaagcaaggaatctggtatttgcagggggagcaaggtatgctatgtttatgcagacacctcttgggagaaggaatcatggtgtaaagcactccgtcttgcttctactacggacaaggacaaactcaaatcccatgaaatgctgacccaagagttccgcagttacatgtcctctctgaaagctggatacccttcctttctgggaccctcgacactctccagtcaggaacatgtgcttgtggacaacactgtgaagaatgatggaccttcaaaactccgaggttttctcaaacgattggtgggaaagaaggcatctgccaaggcttctcaggagagcaaaacaggtccggcgccatctaaacaagatacaagccaacccagtactcctagctccactatgagtttcaacagccagctaccagcttcccccagtgcaaaggtggatgaaaagcttgccgatgacggtacactttgttggaacctcctaatctcccggttgttttttgatgctaaaatgaatgatgagatgaacaaagccatcagagcacgtattcagcgcacatggtcctgcccctgtcctccgcccttctttggtgagatcacgcttactgacctcaaccttggcaagctcccaccatctctgcacagaatgagagtcctcccactggatttggacgaatcgtgggctttcgaagttgacttcgagtgttctagtggaatactgctgcatatcgaaacaagacttgaggttcaggcgccagagctggaaaaggacattatgaagactgatattagaggcaatcctaatggggacgcgagttcagatttccttgatagtattgagcaatatggtaaccaattcgggccttcagaagtttcggattttgcagcagaggtcaacgatgaagcagataccttaaggaaatcaaagagcgctgggtgggcatcaacatatatgtcaaggtggagaagtatcttgaattcaatagcggaccaggtttcacaggtgccgctatcattggcgattaaaatttcttcagttcgtggaacgatgcggatacatctaaagcctcctccgggtgatcgagtttggtatgggtttacgtccatgccggagatagagtgggagttggaatcatcggttggggataggaagataagcagcagttacatcgcctcgcttatcggcaacaggatcaaggctgcgcgtcgtcagatcttggtgatgcccaactgtgaaagctttcctatttcctggatgatagcagatacggatgactgggtgccccgcagaattgcaccttttatatggctgaaccgtgagcccgctgataggcgtgctgcagacacaactagagagatgatgccaggggaagcttccacatccaaggccattgcaaagaacaagtcgagtccgctgccgtctacaaaaagaatcaccaacggttcctggaacaagacaaagatacgtgttgatgggcaagagcaagagcaggcagaagcatcaacgagctcgcagtcttggctggtttcagcaaatggtgatgcaacaagggaacagctgaggatgccactgctgagcagcagcggagacgagagagcaggccctgtggaggagcagcaagcatcaccttctgctgctgaggaggagggagatgcgaagaagaggaagaggcgtgcacgggtgatggatctaggaaggaggatgggcgacaagctggaagagaagggcaagcgtttcgtcgggaagatgcgggagaacgcgaggaacaaccgcatgctattgccggacttggagcaggccaccacgcctcctgctcctgctcctagttaggcattttaaggatgttactcgacaaaatgaaaattaatcagttgcagcgcctagcaacagctcctaattaggagcacttgtattatgtaaaagaaagaaagaaaaagcttatgag

SEQ ID NO: 2967 - DNA, 2023 bp, Zea mays
cagatggcagtccccttgttagatctgaggttgctatagcgcttactcgctttgcgttgggtcacaacaaacatctcaaatctgttgcttccgagtattggaaacctcaacccaattcattgctgaaatcactaccatcgttggcaaatataagtaatccaagcaatgtttacagtcccaacaatattctacaaggcaggattggtcctgtgttgagggttgccagtgatagcggtgccgctggtcgtgatggaagaatttctacaagcaacccaattgcaacaagtactatcatgcatggctctcccgagtcagatgattcttcccaacactcagattcaggcatattactgagggggaatgcaagttatggtggcttcatctacactgcatcgaggcctgatgataatgtcatttattctcaatttatatcaactatgtattctgtttctaaagatcctgacccaacaattgcaactattggtcggagagcactgtcccttattggtgttgaacaagtggttatgaaaaatactatgtttaacagtggcggatcacatcgaggagagacatctgcgtcaaattttgtaatggcacgatcttcttcctggcgagatatgaagtctggaagcatcttgatgaaatttatgacccctcctgatagcccccctcagcatgattatcttccaggattacgacgagtgtgttctatggagtttggtacacatcctctaaatccccccaatggcttagcttgatcgccttttaagctctgctgcaggtcccagtaatgcagaaccacttcccccatcaacaattttacaactggagttgtgttcaattctctaggccagttttaactgtctctgatgataatgaagaaaccaatgctagaagagaagtgggggacctcgtcgcccgccggtgcatcactaagtgtcagcgctcctcttgcaagatgacaagccagattgctagttgggatacaaagtttgagttgggaacaaaagcagctttattgttgccattttctccgattgtcgtcgcagctgatgaaaatgaacaaataagagtgtggaactacgacgatgcactaccagtgaactcttttcaaaaccataagttatctggcagagggctatctaaacttttgcttataaatgagcttgatgagagcttgcttttggctgcctcaagtgatggaaatgtacgtatatggaaaaattttgctcaaaagggtggagagaaacttgtaactgctttgtcatcagttcagggacatcgagctgctggtcgcagtattgtgattgactggcagcagcaatctggttatctgtatgcatctggtgacatgtcttccatcttggtatgggatcttgacaaggaacaacttctcagcaccattcagtcaactgctgatactgccatttcttccctgtctacatctcaggttcgctccggacactttgctgctggttttgctgatggttctgtcaggatatatgatgttcgctctcctgataggttcgtctatgtggccaggccacatgccccaagaacagaaaaggttgtgagcataggatttcaacctgggtttgatccatacaagattgtaagtgcatctcaagctggagacatccagtttcttgatgttagaagggcagcagaaccctacctgactattgaggcacacaggggttcacttacagcattagtggttcatcgttatgccccagttgttgctagtggctcagccaagcaaatgattaaagtgtttagtcttggtggggagcagttgacgataattgggtacctgccatcttttatgggccaaagaataggcagtgtaaattgcctttcttttcacccatacaagtcactcctggctgctggtgctggtgacaatgctctggtctctatctatgctgaggaaaattacaagtaagatgaggccttatatctcatgacaatgcagccacagtgcattcggtaggccttacattttttcggccaagtgatgctc

SEQ ID NO: 2968 - DNA, 2200 bp, Zea mays
cccaactctctgattctggcttattactgagagagaatgctagtaatggtggtcctggctacactaggtccaggcctgttgataatgccgggtattcccaatttatatcaactatgtgttcttttgctaaagatccttacccaagaattgcaactattggtcggagagcactgtcccttataggtgttgaacaagtagtcatgaaaaatactagatttaatagtggaggtgcacatcggggagagacatctgcttcaaactttggaatggcacgctcttcatcctggcttgatatgaattctggaaacaacttgataaaatttaggacccctcctgttagccctcctcagcatgattttcttccaggattacgccgagtgtgttctatggagtttggacaacatcctataagttcacctgatggcttagctgttccccttttaagctccgctgcagctaccagtaatgctgaactaagtatactccctcaatcaacaatttataactggagttgtggtcacttctctaggcctcttttaattggctctgatgataacgaagaggcaaatgctagaagggaagagagagaacgacttgcactagattatatcgctaagtgccagcgctcctcttgcaagatgacaaaccaaattgctagttgggatacgaggtttgagttgggaacaaaaacagctttattgttgccattttctccgatcgttgttgcagctgatgaaaatgagcaaataagagtgtggaactacgacgatgcgctgccagtgaactcttatcaaaaccataatttgtcagacagagggctatccaaacttttgctgattaatgagcttgatgagagcttgcttttagctgcctcaagtgatggaaatgtacgcgtatggaaaaattttactcaaaagggaggacaaaaacttgtaacggctttctcatccgttcagggacatcgaactgctggtcgcagtattgtgattgactggcagcagcaatctggttatctttatgcatctggtgacatgtcttccatcttgatatgggatcttgacaaggaacaacaactcagcactattcagtcatctagtgatagtgccatttcttcactgtctgcatctcaggtctgctctggacattttgctgctggttttgctgctggttctgtcaggatatatgacgttcgctctcctgatagggttgtctatacggccaggccacacgcaccaagaacagaaaaggttgtaggcatagggtttcaacctgggtttgatccttgcaagattgtaagcgcatctcaagctggagacattcagtttcttgatgttagaaggtcagcagaaccctacctgactattgaggcacacaggggttcacttacagcattggcggttcaccggcatgccccagttgttgctagtggctcagccaagcagatgattaaagtgtttagtcttgaaggagagcagttgacaataattcgctaccagccatcttttatgggccaaagaataggcactgtgaactgcctttcttttcacccatacaaatcactcctatctgctggtgctggtgataatgctcttgtctctatctacgccgaggaaaattacaagtaaggtgaggcctacatctcatgacaatgcagccacaagacaaccggcaggcctggtgtttttttggccaagtgatgctcccccgcagcatggtccagctacaagatccaagatggcgtgaagaggctcccggtgcgtattgcctgttgttggacgacgtgtgcaatttgtaagatagagccaagattcgttagccgcctccttgcagaaggtttgtggaacccctaccctgatcatgtcattgaacttggaggctccccccaaataattaatcatacctaggttaaccaaaatgtaaatagacaccgcgtttcgggttgtcggtggtcagcattcctccttttgaagatgcttgtgatgatatgagaaatcaggtttggtaggggctgctgcctgggcaagtggggtttgtgcatatgggcccaggtagtatggttgcacatgtctgctcacagatgctgttgaatggaaggaatgttgtctagtcgcttgcattgtaaccattggagattgtccatttgtatgtatggatcttgtctgtacatctgtaatccgtgcgatggtgtgttttatggaac

SEQ ID NO: 2969 - DNA, 1645 bp, Zea mays
ggggagaagaaacacggaagggaggctctcaccagtcaccactcacctgacgacgagcgagcgagaggaacggggcgagggaagttaaacgcgcggcgatgccggagctgccggaggtggaggcggcgcgtcgggcgctgcaggcgcactgcgtggggaggcgcatcgcgcgctgcgccgtggcggacgacgccaaggtggtcgttgccgccgccggccgcgcggccttcgagcgggccatggtcggccggaccatcgtcgccgcgcgccggaggggcaagaacctctggctccagctcgacgcgccgcccttcccgtccttccagttcgggatggcaggcgcgatatatatcaaaggcattcctgtgacgaattataagagatccgttgttaattccgaagaggagtggccctccaaatactctaaattctttgctgagcttgatgatggtttggagttctctttcactgataaacggcgctttgcaagagttcgtttgtttgaagatcctgaaaccgtacccccaatttctgagctaggtccagatgctctgtttgagccaatgtccgtcgatagtttcttggactccctgggtagaaagaagatagggataaaagctcttctacttgatcaggtgaccagcatccaacctacaagctttgcctgtgcaattttttccctgcactgtacatacttgacttgttgcagttttttataaaatgagcagagcttcatatcaggcattggcaattggattgcagacgaggtgctttaccagtcaaggatccatccattacagattgcttcaaatctacctagggagagttgtgaagcactgcaccagagtatcgaagaggttgtcaaatatgctgtcgaagttgatgctgacatggaccgctttccgaaggaatggttatttcatcaccgttggggcaagaagcctggcaaagtcgatggaaagaaaatcgagttcataacagctggtggcaggaccactgcctacgtgccgcaactgcaaaaactggttggaacccagtccagcaaaacgatatccgtggccgagaacggtgatgccaaggatccagggaccgagggagaagatgcagatgttttgaagccaagaaagcgagccgcgacctccagtgctgccaggggacagcgaaacaaagataccgccggctcgagaaaagcaagagtaaatggcgccgatgctgaggcagctgaaccaacaacaggtatcgtcggaagcaacggtgagcaagcttttggccaacccaacagtgacgctgtcgataaatcagatcgggctacaagacgatcgtcgaggaaagtgaaagcccgcaagtaaatctgaacaaggtagccagggatctgtccatggagtttcattatatgtgtactggccagcgtatttgcgcctctgagtaatgtatcttaggaacagaagattatattcatgctgcatattcctgggggattcgctccggaccaacgtttgctcagtggtgcagctccttgtgctatggatagtagcatatctaggttgtgcataaatgcactgaggtttatgtactctttccaatcttccatgatgcattgatgcatattgtgatggaataaaaaaaaaaaaagtcttgagcatct

SEQ ID NO: 2970 - DNA, 3151 bp, Zea mays
  misc_feature (2275)..(2275): n is a, c, g, or t
tatcggataaacccgtcggttattcgaatttcgggtacttattgccatatctgttcctatggctatgagaatacatgcatctgcatgcaaagccaaactaccacttcatcagaaacacaaatatccattaaaaaatctctctatcgatcaatcattcaatcctagggagctgggacggaggaaatgggtagaagatggacaccaaattgtcatgcctgacgtcatgattggcatcacgttcatgaaccaacaactgaaatccactcaaaggcatactcgtacgccgggcaaaatgacaggttttccttttgagatgatgatccaactgaaatccaaccaaacgcccagtgggccaggcggcaacagcaccagactgcgctgcgcacagccgcccgtactggtaccgaagaactcggctgcgggcctgctgcggctcgtacctcaccgaacccaacgcggcgtcgctccgcccgccctaaaataccggacacctcccgcccgcccgaaccaacacccgactcgctcggcccagcagagggagcatcgcaattcacaccagcgcagcgcgacgaggggaagaggagtttctcagccgcagtcgccgaaccacacgccgccgaggccgtaggcgcgcttgctgtcccgccgcccgcatggcaccgaagcgcccggccgccgcagcggcggcggcctcggggtcggcgtccgaggcatccgacgcggaggcggacgtgggccaccagccgtcctccccatccccgtccaagacgccgccgaccaaccctaaccctaagtccgctgccgctggccccgccgaggactccaccgcggccggatccgactccgaggccgcgtacgactctgacgcggaccaccgccccgcgcaccggaaggcggcggtagcggcgtccccatcgcgcaagcccaggagccccaggccgcgctcccgctcccgctccccggacgcagcctcgtactccgacggcgcggcctcagatgccgacgctgaccctgccgcccgagacggcgccgactccgccgacgacggcaacgcctctccgctcgcgctcccgcgcctatcccgcgccgaggctgccgccatcaagcccctcagctcgcgccccatggatccgccgcgccgctccatggtacactctttctccgagctgcgctcgaagcgcccccgcagcgccgccgtcccgtcatccgttgagcagctcaagaggccgacgcggctctggagcctccgtgacgagatcgtcatcctgcggggcttggtcacgtaccgcgccaagcgtggggtcctccccggcgccatgtatgacatttctatgttccaaggccacatccagagcgagctcagtgttaacgtaacccccacgcagctcagtgacaaggtacggcgtctcaagcagaagtacaaccagcttgcgtcccgtggcaagaacgggcgggatccagacttgcccacccagcatgaacagagtgtttatgagattggcaagaaggtatggggaacaagtacgggtggtgatgggtatgagattggtggtgacagccaagaggagcatgaaattggagagagtgacgaggatgtggagagtgggtgggatgaacgtgcccgcaagaacaggaggctgatgccaatcactatggcaaatggacacggatctgggttcggggctggcagagggaagtttgatgttgagaagggaaaggatgcttatccatacctttgggagactgtagaggatctgtcaaaggagcacccgaatggggtagcattcaagaaagcctttgagctgatcgaaggcgccagagcgcgtgggatggaggagaagctacgaaaattcaggctgacagagatcagacaccagctgcgacgtatggaattgatgaaggagacagtgaagatggtgcttgatgcgctggaaggttgactgagtaatgatcttctggtgggtgagttgtgcaatgtttaaaggagcaatcagtgtcttcttttgtttctagatagagtttctgtgactgaattacttgacttgcatagacaagttgcacttgtgtctcttgggtgctaacttttgcattatatggtatacagtttctatgctcaaaaaaaaaaagaaaaaagagttcggtttgatgcatctgatgaaggttttgttctatcttactccttttgcagtttttttttttgctactgtatctacaaattggaataccatgattggtgaatatcatggttcctaacctactagatttaggttgtttnctgtgctaggagggttaattttaaatggcatgtagttgatggtcaaaaccaaggaggaattgtgtgttgctattgaagaataaaaggtttattctaagacacaataatctctctgcgaagaagcatttatatcctttaccaaaaaaacccatcctgatggtgatctctttgtggtctcccactagtgctatgcatatatgcatcttgatattttagatgttatttgtacacttatcgatctgcctatgctcctctataaatggcctccccgtacttcagtcttatgttggcatacatggcactcaattaggagtgaatgtgttccttgttggcttgttctgcctgaatctgctgtttttttttgtatcccctccgtttttaaatacagtatgtgacgtttacgagtttaaactaattgtgaaaaataaggattgttttctcttagcttagcttttgtacctcaaatcctcaatccctttatttgctttcatatttctgaggatcatgatgtgaatgagagtcatgctcattgtctttcatgaatcgctcttattattcagcagcttaacatcagtgttgacttcaatttctagtccatactcctactttgtaaaatttgctgacgcaaatgcttccaaacttagcatcttctatggcgacatgataataaaagttacaggaaaatctgacacttgagcaactacgatccgggttcaggataagtccaaatcgaacaatgaagtgaagtttgtcgttttatgactccagccgttgtctttcttgtttgatgctgtccacaattatgtgggttcgctgattgctgtcattactattgcccaagtgcgctccgctgaataggaccacgccgagttagcc

SEQ ID NO: 2971 - DNA, 1711 bp, Zea mays
cattgggtacctcgagccggccgggggaacaaaaacaaccaacccaccacaagtcgcaattcacaccagcgcgacgacaggaagaagagtttctccgccgcagtcgccgaaccacccggtgccgaggccctaggcgcgcttgcttccccgccgccagcatggcaccgaagcgcccggccgccgcctcggggtcggcgtccgaggcatccgacgcggaggcggacgcgggccaccaccagccatcatccccgtctccgtccaagacgccgccgccgcccaaccctaaccctaagtccaccgccgctggccccacctcggcggcggaggactccaccgcggctggatccggctccgaggccgcctacgactctgacgcggaccaccgcaccgcgccccgtaacgcggcgtcgccctcgagcaagcccaggagcaccaggccgcgctcgcgctcccgctcccgctccccggacgccgcctcgtattccgacggcgtggcctcagacgctgacgccgacccagccgccgtagacggcgccgactccgccgacgacggcaacgcctcgccgctcgcgcccccgcgcccgtcccgcgccgaggccgccgccgtcaagcccatcagctcgcgcccaatggatccgccgcgccgctccatggtgccctctttctcggagcagcgctcgaagcgcccccgcagcgtcgccgtcccgtcatccgtggagcacctcaagaggccgacgcggctctggagcctccacgacgagatcgtcatcctgcggggcttggccacgtaccgcgccaagcgtggcgtcctccccggctccacgtacgacatttctaagctacacggccgcatccggagcgagctcagcgttaaggtaaccaccacgcagctcggtgacaaggtacggcgtctcaagcagaagtacaacctgcttgcgtcacgtggcaagagcgggcgggatccagacttgcccagccagcacgaacagagcgtctatgagattggcaagaaggtttggggaggaagtgctaacggtggaggaagtaccggtggtgatgggtacgagattggtggtgacagcgaagaggagcatgagtttcgagagagtgacgaggatgtggagaatggccgagatgaacgtgcccgcaagaacaggagggttatgccaatcgccatggcaaacggcaacggggctgggttgggggctgtgaaagccaatagcagagggaagtttgatactgagaagggaaaggatgcttacccctacctttgggagactgtggaggatctgtcaaaggagcacccgaacggggtagcattcaagaaggccttcgagtcgatcgaaggccccaaagcgcgtgggatggaggaaaaactgcgaaagttcaggttgacagagatcagacaccagctgcgccgtatggaactgatgaaggagacggtgaagatggtgctcgatgcgctggagggttgaccgagactgaatggtcttctggtcttcttttgtttctagatagagtttttgtggctgagttacttaacttttatggacaaaggtgcacttgtctcagtaagaatataggtacagaaagaaagtgagactgatggtgtttcccttgttcctgtggatcatatgtgctgtttggtttaagaaatgtaacgcaaagggtaatggtaatggtttacattcgatcaaaaaaaaaaaaaaaa

SEQ ID NO: 2972 - DNA, 764 bp, Zea mays
  misc_feature (16)..(16): n is a, c, g, or t
ctcgagccggccgggnaaaccctcccaccaaatttcaatgacgccgtcgaaaccccctggcaagcgccgccgttcggctccacctccgcgcttgccctcacccgctccacccgtggcgctctcgccgccgggcttcgtcgccgaccgcgccgaggccgcggcgcgcgtggagcgcctcctgcggtaccagttctgcgaccgcgcccttctagaggaggccctgacccaccaatccttctcggatggcgctctctcttaccagcggctcgagttcgtcggcgacgccgctctcggcctagccttctctaacttcctatacctcaccaaccccaccctcgggcccggcgcgctctccacgctccgcgccgccaacatctctaccgagaagctcgcgcgcgtcgccgtccggcacgacctctacccgctgctccggcgcaagtgcccccgcctcgacctactagtaggccagttcattgagtcagtgaagcaagaactaatgcatgaccttgccactgcaccgtatggtggtagcgtggttaaagctcccaaggtgcttgcagatattgttgaggccatcgctgctgcagtctacgttgattgcaaatttgaccttgagaagctttggaaggttacaaggtggctctttgagccaattatcacagcagaaacaatagatgagcaacctgtgactacattgcatgagttatgccaaaaacatggcaaagttgcacagttcaagactgggcagaaaggatgggatgatc

SEQ ID NO: 2973 - DNA, 2033 bp, Zea mays
tacaccatggttctaatctgtctcagttaggattaactgatctgttggatggaccaattgggtgttccaataccgacgtgttgtgccagtgtgacaatcataaaaatcaatccaatgaggacaaggtagaggaagttgaggcggtgtctgctgctaaatacatagaaagtgaagttgtgctgctcccatctcaagagagatcaaatttgaataatgagcagcttaacaccaagttggaaagcccaaacattatgggatcttgccttaactgtgataacgatgtttgtaatacttcggacaatggatctgtttttgtcattggtaaaagaactccatctgcttctggcttaccagaagattatcctaaggatagtgacttgcaacaaccggttttagatagcttctcagtggtttcatcttttcaagacaatatatctgggaaaaaactgtttctggtgtagcaggcagtgagattctttctttaagtttagcaactcctgattataaacatgaagatggtttctctgaggaagcagtatgcagaacaaagaattatactggaacttcctcggtagatccgaggcatttagacatggaggggcactctatttactctgagggagatacataccaaggtccttgacaagatctaggcagacatgaagaacaagagagctgcatgtctattcctatgcaagccaaagaaagtggaggggttttgaggtctagccacacgaaagggtcagttacagcagcccaaattgatttggcaggtgatgcccatcttattgtgagtgataatgctgctgccaagcaagtgtttagtgaggagaaagaggaaacaaaatctatctcttcttcagatattgatatccttcatgaaaaatcatactccagtggacacgatgaccatgctgcttgtgctgccgaaactcagttctaccatccacagaaagcatctatatctgatggactacatttgggtcctagttctttgcaagtagaatcactggatgctttggatagcgatatactgtatgttaacacaggagttctcgagcagcatcataaagagggttactatgaacccagtgtctaccaaatcacttcaggcatttgcacaatgtctgaagctgaaccattcgaagttttagaaactggaaaagatgtaaaaacgccatctaagctagatgagcaacttaatcctgggttggacggagatgaagctgagaaacacagcttagactgtggtacagacaccagtcctgtgatgagcaagagaaccctttcttcaccaggatcaggaccatgccagcagtatgtaaatgaaagcaccaccagtacacagtcgactgataatcacccaaacgacctacccgctccgagatctcctgaacaatccgcgtgttttcagaatgacaacgattcgggttcagtaggcatttgtcaaagcagcaggcgaagaggtatagatgaactctgcggtaagctgcagagtttcaaagtttccagcgccgtaaaaggaagctacgtagctatgggtgcacctcgtccgaagcctggggacagcacgagccgatctgcagccgcgctgctcaggaacatagagaacacaactgctgttaaagctggccgtcctcctgtcaagccaaacgccgatggtaaggactcgtctaggcgagccctgcagcccataagcggaaggcctgacagtaggtagttcggcggttccttaataagtgtgtcgtgtttgtgttcaaccctttgttgaaagctaggtccgtgtatttgtgcagcttgttgtcatgaagctgctgtgtgcgtgtcatttaacttaagcgtgcgtgaagttgtgttatgcaagtggctaaataggtgttcgttaggaggtcaattggcttgaactgaccctgctgctccgtgatttctgtctaaatatacttgtgtggctgtgtcactttgattggccttaaaaaaaaaaaaaactcaagggggggcccggtaccaaaaaactcgaggaggggcgccggtac

SEQ ID NO: 2974 - DNA, 1996 bp, Zea mays
caaaaaaagacgcccgttgatcttgaatttgattaacccaaaacctcaagtacagaatcaggaacagagacatatttacagtgttgtctaagtctcaaggtttgggaccagcagcagcatcccgtaactttcagggcgaactttcactctttcacactgctgcatgcacttgccaaactggaaataactccaactacataaaaaacaattgctttgcaagaatgacaagggaccaatatgccgacaggcgacagtattagtagacaattctcactccctcggttgttactcacagcctgaaaatcttgaaactctccaacaaaacaaaacaaaaatgtaagagctcttggggaccccaatgaatctaagaattggagattggactacagcaccatggtaactgaagaaatcttctatcctgcagtaaatatttacagcctacaggttttctttcagccactttgcagcaccattagcaattgacccagcaaaatctgtaagtttcttcaaccaatcacccgctgctttagatttgtctgtatcttcttggctagcaccaacttctttctctagatgtacacgttttggctgggcaggttttggcttggcatctgttcgagcaaagccaccattactcaaagatgcaagttcctccagtaattccctttcacgcccacttatgcgcttgggtattgcaactttaacagtgaacagatgatcaccacgtatagtcggcttattcaatgatggaaccccttgcttcgctaaggcaattacatcaccaggttgggtacctggaggtattcgaaggtcattggttccatcaactgttctgaccttcttaatggtgcccaaaatagcttcaagatagcttattgacacagttgaatacaagtttataccatccctcttgatatctgatggctcctctatatcgaggcaaacaaagagatctccaggaggcccaccttttgatcctgcatcaccttccccacgtacacgaagagtactgcctttgctcactcctggagggatttttactttgatctccttcctgacacgggtacgcccctctccagaacatttcctacaatactctgagatgacttcgccctctcctgcgcaagtggggcaaatagaaacctgggagaacagaccaaatggtgtttgctcagttcgcattacttgccctcgcccaccacatgtcgaacatattctcatcttggagccagcttttgatccagaaccaccacatgtatcacatgtttccaaatgagatagtataatatatttctctgttccaaatatcgcctctgtgaaccccaaaaccacatcatatctgatgtcttcaccctgtaaaacagtattttgcctgcttgtcctaaacgtgctctggtccatgccagaaaaaccacccatgctgcctccaaagaatgtctcaaacaaatcaaatgggttggttgtgtaagctccacccgagcctccaaccgcactcttaaccccagcttcaccatattggtcatacaacgtcctcttcttttcatctgacagcacctcatatgctgcacttatctctttaaacttttcggtcgctcccggctccttattgacatcaggatggtactggcgcgcgagcttccggtacgcggccttgatgtccttgttactcgcggcgcgcggcacgcccagcgtcgcgtagtagtcagccgctgcccagaccagcaggccccctccgcgccgccgcctcggagcccgtccgcggcaccgaggcgcagcgcacgcgagcggttggccgccgccgctccttccggccgcggcaaagtgaaccccacgaggagcgaacgcggcggcggttgaggcgcgggaggagtaggacagcgaggtgttggatggcgcgaacgggaacgacgtgagcgccatgagcccatgaccatgagcggaaggcagttttagggatggattttcgattaggatgttctaggtaatggtctcgtgc

SEQ ID NO: 2975 - DNA, 2035 bp, Zea mays
  misc_feature (2021)..(2021): n is a, c, g, or t
aagtttgcaattcgatatcggtgaattttagcgtggtcgcggccgaggtacagtgtttgtctagtcccggggtttgggatcaacatcccacagcttcagacttctacgccgcttgccagactgaaaaggactccaactacataaaataatgcttggcaagaatgacaagggaccaacgccgcgacgacattagttgacatgacaactttcactccctcggttgccactcagcctgaaaatcttgcagctctccaataaaacgaatatacgagctcgtggggacccccaatgaatctaaaaattttgattggactacagcaccatgtaagacaatcttctatcctgcagtaaatatttacagcctacaggttgtcgttcagccacttcgcagcgccattaacaatggacccagcaaaatctgtaagtttcttcaaccagtcaccctctgcttctttagatttgcttgtatcttcttgaatagcaccaacttctttctcttgatgtatggcttttggctgggcaggttttggcttagtgtctgttcgtgcaaagcgaccattactcaaagatgcaagttcctcaagtaattctctttcacgcccacttatgcgcttcggtattgcgactttaacagtgaagagatgatcaccacgtatagacggcttattcaatgatggaactccttgcttcgctaagacaattacatcaccaggttggatacctggaggtattcgaaggtcactggttccatcaacagttctgacttgcataacagtgcccaaaatagcttcaagatagcttattgacacagttgaatacaagtttataccatccctcttgatatctgatggctcctctatatcaaggcaaacaaagagatctccaggaggcccaccttttggtccagcatcaccttccccacgtacacgaagagtactgcctttgctcactcctggagggatttttactttgatctcctttctgacacggatacgcccctctccagaacatttcctgcaatactctgaaatgacttcgccctctcctgcacaagtggggcaaatagaaacctgggagaacagaccaaatggtgtttgctcagttcgcattacttgccctcgcccaccacatgtggaacatattctcatcttggagccagcctttgatccagaaccaccacatgtatcacatgtttccaaatgagataatataatatctttctctgttccaaatatcgcctctgtgaaccccagaatcacatcatatctgatgtcttcaccctgtatagcagtgcttcgcctgcttgtcctaaacgcgctctggtccatgccagaaaaaccacccatgcttgctccaaaaaatgtctcaaacagatcaaatggattggttgtgtaagctccaccggagcctccaactgcactcttaacaccagcttcaccatattggtcatacaacgccctcttcttttcatctgacagcacctcatatgctgcacttatctctttaaacttttcggtcgctccaggctccttattgacatcaggatgatactggcgcgcgagcttccggtacgcggccttgatgtctctgttgctggcggcgcgcggcacgcccagcgtcgcgtagtagtcggccgacgccctgaccacaagaccccctccgcggcggcgccgaggcgcagcgcacgcgagccgttggccgccgccgctccttccggccgcggcgtggtggagcccacgaggagcgaacgcggcggcagttgtggcgcgggaggaatagggcagcgacgtattggagggcgcgaacgggagcatggacgtgggcgccatgagtgaaccttgtgggttctggtgccgctggtcggctcggcagatagtaatcgggatgcatttctcgattaggatgttctaggtaatggtctcgtgcgaattcctgcagcccgggggatccactagttctagagcggccgccaccgcggtggagctccagcttttgttccctttagtgagggttaattgcgngcttggcgtagcat

SEQ ID NO: 2976 - DNA, 1126 bp, Zea mays
  misc_feature (16)..(16): n is a, c, g, or t
cccacgcgtccggggngacacagggtttatgcacactatggatcaagttcaggcatgtaatgtatgtgtttgcttgttgttggaaagattgcactattcatggtaatatataaaaccaagagtctcccacgttcccccccccccctaatatatatgggaaaacaaaggcaacatccacggcgtgcacgaagagctaaatttttccacagaaaccatcaaagaaaccacatatagtgatacttacagctccactcttcccatattccaaagcagtttggaatgcaacatccattgcatctggcatctcggtgttatctagaagaaaataagttagttagacacaagaatcaatacaaaaggtgttaataagatcagggttcctaaccatcacttttccgtaatacatgtgatatcttctctgcacgatcatatgccttcataaacccactttcaagccaggaaaaaatagaagccgtcggagtgaaatccaatctttgtactacattcataggtgagtggccactcttagcaaggaaatgttcttgagaagatttagagaaattttcaccatctgatgtatccatgagcaagctacatgcatcaagtgcctctttccagatagttaataatacaagttcaattgataacgcctccaggtacaggcctttagaaagctgaataacacagaaaattaaggacgcataagagacaaaggggttatcatatctgatccatcaaatgacaaataccatttctatgattgttcaaaagagcttttgtggggtgtaacttgtaagtgttgaagtttggaaatgaataaacattaaaaaacaaatatatgtctaatatgtattaaaggagaagagttcgactgaaaataccatggctttattgcaaaagaatattaaaacaatctattttgaagaccataactttgagattacataaaaacacattgtgaagtttaagcctgaccagatattcatactgaactgtaaaagcacacgaagacagaatgatgatgaacatgaagtttagggccacagtcatagtttccagcatagcagtagtggtaccttttcccgagcaagatcctcaagaacaagaacatattgattggacgcgt

SEQ ID NO: 2977 - DNA, 1081 bp, Zea mays
  misc_feature (48)..(48): n is a, c, g, or t
ggtccaatctggatacgctctatgggagccccatactcagcaaatttnattgccttttttttgtagtggatgcagacgcagagctcgcgagggggcgcggggccttttttttttttttttttggcgaagtagtgctctacagttcaaacaaattgtgctttacaacaatttatattttccgcctcaaaatcaacagatataattgttgaaaacttgacttcacatggtagggaataggatgcgcagtgagccagtgaattgtgtatcaaaaccaggcaagtcacggccagaccaggcctcatgtctaccgcagcacctggcactttcagcaaaatctctggcaaacatcaggcttcgccaaagtccattactcgaggttctgtaactgctgagctcatttcgcatagacattcagccttactcgcgctgtcacgtctgggtgaagcttgatctctgcaacatactctccgatttcacggatttctggaaccgtcaccagcttcttgtcgacatccctattaagttgtgactttattatgtcaacaacatcctgtgccgtgacactcccaaagatctgttttccttttccacctttgcgagggagtttgaaagcgccaatggtttcaaaaactcgagcaagttgttgcgcgtcttcttttacccgcttcttctcagcttctattctctcctgctccagctgcatttccttgaggacttctggggtcagaagtgtagccttgcccttgggaaggaggaagttgcggtagaatccagctcgcaccttcagtgtatcccctttcttccccacctcttctatgtcgtctgtcaatatgacctggcggtacttcttgaccttcccctgggcgacgatgaccagcgacggagcccggcgagaggccgtgaggcagcgccccgccgagggccgcgggtaggaggcgggggtccagggcagcgtggaggcgcacgacagcgacgccattgctctcgcgcttcgctactcaagcaagtggcgcttcggtcgcctcctccgctcgcaccgctttcctttcttgccgcggggggccctacgtagctgactcga

SEQ ID NO: 2978 - DNA, 625 bp, Zea mays
tttttttttttttttttttttttttttttttttttattaagtttgcaattcgatatcggtgaatttgattaatccaaaacctcaagtacagtgtttgtctagtcccggggtttgggatcaacatcccacagcttcagacttctacgccgcttgccagactgaaaaggactccaactacataaaataatgcttggcaagaatgacaagggaccaacgccgcgacgacattagttgacatgacaactttcactccctcggttgccactcagcctgaaaatcttgcagctctccaataaaacgaatatacgagctcgtggggacccccaatgaatctaaaaattttgattggactacagcaccatgtaagacaatcttctatcctgcagtaaatatttacagcctacaggttgtcgttcagccacttcgcagcgccattaacaatggacccagcaaaatctgtaagtttcttcaaccagtcaccctctgcttctttagatttgcttgtatcttcttgaatagcaccaacttctttctcttgatgtatggcttttggctgggcaggttttggcttagtgtctgttcgtgcaaagcgaccattactcaaagatgcaagttcctcaagtaa

SEQ ID NO: 2979 - DNA, 1040 bp, Zea mays
taggggcctttttttttttttttttttggacaagaaagaagggtcgcttttggcgaagtagtgctctacagttcaaacaaattgtgctttacaacaatttatattttccacctcaaaatcaacagatataattgttgaaaacttgacttcacacggtagggaataggatgcgcagtgagccagtgaattgtgtatcaaaaccaggcaagtcacggccagaccaggcctcatgtctaccgcagcacctggcactttcagcaaaatctctggcaaacatcaggcttcgccaaagtccattactcgaggttctgtaactgctgagctcatttcgcatagacattcagccttactcgcgctgtcacgtctgggtgaagcttgatctctgcaacatactctccgatttcacggatttctggaaccgtcaccagcttcttgtcgacatccctattaagttgtgactttattatgtcaacaacatcctgtgccgtgacactcccaaagatctgttttccttttccacctttgcgagggagtttgaaagcgccaatggtttcaaaaactcgagcaagttgttgcgcgtcttcttttacccgcttcttctcagcttctattctctcctgctccagctgcatttccttgaggacttctggggtcagaagtgtagccttgcccttgggaaggaggaagttgcggtagaatccagctcgcaccttcagtgtatcccctttctcccccacctcttctatgtcgtctgtcaatatgacctggcggtacttcttgaccttcccctgggcgacgatgaccagcgacggagcccggcgagaagccgtgaggcagcgccccgccgagggccgcgggtaggaggcgggggtccagggcagcgtggaggcgcatgacagcgacgccattgctctcgcgcttcgctactcaagcaaagcaagtggcgcttcggtcgctacgcccttactcgtctctgggtgcctaggtatccaccgcaagcctttcctattttgacccggccggcctcgaggtacccaatg

SEQ ID NO: 2980 - DNA, 2939 bp, Zea mays
  misc_feature (2912)..(2912): n is a, c, g, or t
gagctcatgagggacgacgacaatggcgtcaggtggacgcgtgtgctcgaaatatttcagcgagattggattttgatgccaatggctatggtgacctgatggacatgattttcctacagctaagctccatggctagggacatgtgcacgcaggtgagaatggaagcattcgctgcacttggtaaaatgcaacgagtttctgagggtgttctgctacaatcgctagaaaagaaggtcatgaaaactgacaggatgggtgtttctatcatcaacggccaaaaattacctcctaaactaaaaattccctgtgctgctgggattttttcccatggagttgaagatgaattttacgaggtgagaagaactgcctgcaaatcattaggagcgctggcaaagttttctactcagtacacagagaaggccttggacttgttgatggacatgatgaatgatgatacagaagcagttaggctgcaggctctggaagcactatttagtatggcaacatatggatgtttgagtgtgcaggagaagcacatgcatatggtatattaactatgaacatagtttggcaagtaatctgcatatatatatatatatatataattggccactccttaggtaccacatgccgcatgttagtcctatggcactctttttaattcatagctagtcattttttcatactctgtttataagatatgccttgtaatgatatcacaggttcttggatagaatgaagatttttttctcaagcatgcaggagagctgcgtatcaggatatattttttatatcctcagtttatcatgcaaccatgctattcactgaaatattttgttgcaattgtaggaaaatattttgtagccactagccagagatcctcaagccaataccactgtaccagcgtattaaagaaagagtattggcacagatattattcagagaaatctttgctgatagtgatatgtacagttgaacatgtaattttcaagggaacaatataaaacaatatttgaccatgaacatatatgcaataatgcaaggataatggacttagccagaatatgaaacattcgtgcaaatataattttcggtcaaaacagttcggttttgtagttcctaaagtggcgggtccatatttttcgattcttgtgcattttactgtcacaaagcaaccttagctctagcttttaagtagatgaaaagcatgcataatcaaaagacgaagcaggtttgaatcttgtttttgttgaaagttctctctggattctgaatgacttataattgggtttgtacctgtttaaaaagatctttcaaataatctagacatatctttgctattgatattgctaaatgctagtaaaaatctctgaccttatgtatgtataactgtttttgtagtttcttgggttgctggttgatgccaatgtcttaattcgagatgcagcacgcaagatctttgggttagtcaacatgccaaaacttcaaatattcaaatctgcagttgatggtcttgttacaagtttggagaagtatccagaggaagaggatatatatggtattatgttttccattggtaagaaccatgggagcttttcagctaacatagctaaacatttggccaaagagattactatggcatctgacggagagcttatcttggacaaaccaagggtcaaagcattgttaatagtgtctatttcagcacctttttctgatgataagcacaagcagctgggtataccttcgattatcttctcgtatgcaattcccctactggagaagatctcatgcgcactaggagaggttgatcaggattcactcttatcttacttgtatcataaaggtggaatgccattttgggaaaacaggtcagtatctgcagagtttggagaatctgaaagctgcaatgttgaaacagtgaaaattggtgcccatatagaaaacactgcaaaggaagccaaatgtctagatgaagttctggtaatgaaatccatactagaaatagttgaaggagtctggactatgagaatgtcgtgcaatgtttgtgaagttcgaactattttcagaacatgcaaagaagagctgagattattggcagaaaattcttctggatcaattggtgcattattgagctctcgggccgagtcgcctcgtgcaatattattcattgttgaaatatggcagttgattcagttggacaagccttatacttgtggcctaacgtcacttgatattttactggagaggttggatatgtctgtaaggaggatgaaatattgttatattggattaaatagagtattggaggtccaagttttggagctttctttgatagctcatttatgtagactctcaaagattgcagtttgttccaaggtagttctgggtaaggtgctctgggtaattaatcgcttagaggatctgtgtgctgatgggtcctgtgaactgtctgacttcagtggagaaattaagaaggcctgtgataccaaccgtattggagataatctgattggcaacatcaacaatttgtttcaactcttccatctgaaaccaacaacagactttggaatgcttaaagtgataagtgcaatgttgcgggtctgtgataacgattctgaaaatccattacaatacatttgtggattaccggtgggtgtcagctttaaaatatctctgtggaacatatctggtcaccatcgactgtggctccgcatgaccattggtgaatctgtgcaacataccttcctagaattttctcgttttgaaggcaatgatgagggatcagcacccaccagggtggacatggaggaccgagtgattgtgtggttcaactctctgatgaactgaatgtttattttgttagtgctagccaatggtgatgattaaaataaaaaaaaaaaaaaaaaaanctcgagggggggcccggtacccaatcg

SEQ ID NO: 2981 - DNA, 6558 bp, Zea mays
  misc_feature (13)..(13): n is a, c, g, or t
  misc_feature (17)..(17): n is a, c, g, or t
  misc_feature (62)..(62): n is a, c, g, or t
  misc_feature (90)..(90): n is a, c, g, or t
  misc_feature (184)..(184): n is a, c, g, or t
  misc_feature (203)..(203): n is a, c, g, or t
  misc_feature (224)..(224): n is a, c, g, or t
  misc_feature (231)..(231): n is a, c, g, or t
  misc_feature (242)..(242): n is a, c, g, or t
  misc_feature (254)..(254): n is a, c, g, or t
  misc_feature (262)..(262): n is a, c, g, or t
  misc_feature (314)..(314): n is a, c, g, or t
  misc_feature (350)..(350): n is a, c, g, or t
  misc_feature (366)..(366): n is a, c, g, or t
  misc_feature (373)..(373): n is a, c, g, or t
ggttacgagctcnctantagattttagatctccagttttggtgtacttttgctgcatgtgtntcccagagttgcagatttgcaggtagcncctgattcttttttatttttggattgagatacagtgaaatttatatttgcctgttccccccatactgtaatatgaatacaaggatggcttgatntggcaagtgctcgccattntatgggcccatcatgcttttngagtacnctgtttgatcncaaggagcggtntgctgccnctaaacttcaagttgttgatcatgatggcctgaaaaattatcggggatatgntcatatgccttggccttaatttaaactacttgtatnagatggagaaatgtcncaaaacncaggatgaagacgactccaggaatccacccatgcctttcagtgactcagtggcacaaacgacagcctagtcaggtaacacaataacatatcagccatatgctatacatgcatatactatgttatggaaataactccgaagagtatatcacattctaactagttatgtatgcaaacactaatgcaagacaaccatcttgctcgtcgtgttggtgtggtgggggtcaaaagcgtcttgctgctgaaattgatggtataccgtacaagcatttacctttgatttttgctgacgttaatatgttgcttcactaaaggactaggagacgccttcacatcacggagtagaccactcagcaacaacagtgcaacggtgttcggacttttgttcacatatgggagtgtttaagctcctgcacctagatttagaaacaccaccatgtaaaatagacaagacagtgcttttgcaaacatgatgctaccacgagacccgaactcatgtatggccaaacatgttaacatattttgtatgtcaccaaaacgcttatttacatcaatgagcgattatctgaactgttgaatgctcaccaaaatgcttatttctatttcctactgctacttgctcctttgaagccttcagcgatggaggcctccacagaagctactaggatggcctccagcttatgacctctcactgccgaccgcaccttcctcagaatatgttgcttcatcaccgccctctcagcagactggagtttcttgcacatgttcaatccctggatgtacctcgacaccgcgccgccgaaaggatcaccggctttctcaagggccacgagcttctcgacgatctgagaagcgagcattctctcgatacagggtttggttccaacctccgtgatgtccaccagaaattgcatggctagatccttggtcttcaaagacttgcggtccagcaagttcaccagtttctctatggttcttagttgcagaaatctttgcaagacaagggatccacccttcgcaaagacgatctgatggagagcgtagtacgctgaatcctggagctcatcgatgttgcactgcagcatgtcaatgagctcgtgaacaatattaagctccaggaacctatgcacgtatggctctcctccagtgcaggccaatttcatcaccaaaaaggcggtctgggacctcacctggttcttttcaacctctctgcgttgtagcagccaagccaacctatcaaacagatggcttcccagaaggaggtcctgcacccttgtatcatttgccgtttcagcaagagataataaaccttggatgcctttaatgatatttttgttgtctctctgaaggatattatgaagaatcacctcaaatgattgttgaggctttggtgattgcggcacatttctgtcagataaaacaaatctttccaaactgatccgagcatgccagggcaaatgaagcagcactgcaggccctatgcacccttgaagtggagcaccaagttcacagaatgtttttagcgtgataatcgcgtggtgctgtgagatctcagaaccattgcccagaagcacaagaagtttattgtcaattcctgattcaatcattgtctcaacagccttcagctttccaacctttgtcagagatgcaagtgttgtaaacacaatttcatgccactgctcattttctgcagtcaagagatctgcaattcgaaccatgggaattcttgacaaaatttcatccgcaattgtggcatcaacatgctcagatatcttggtcagaacagaagagaggttggctagagttgaagtatcttcacaggcaccaagaagatcaattaatttatctatggaacctgctatttcaagagagtgagcaagatttatgtagtctgatggggaaaatataactgtaattgcggcagtgactgcaaaaataagatctagtgaccctatagaaattatctctgctattcgagggccaagtattttgctgaacccaattctatttgtctcaagttcagacagggatctgcatgccatgagagcttgagttgtgtttaccaataaaatctcgatgtccatgaattctagcagagaaaagaatgatcccatcttctgttcggctggccgtttcatacactctttgccaaaaacaaaaagccaaggagctactaatgccacattatatgaaatggaatcagataaaagagcacgagtggcatcatttgttttgttctccaggtaaagtgagaccatgtcatgcatatgatacaacggctggtcctccagtttgataataagtgatccttcgactagttttgaaaccacgagagagaacagtccgcactgctcaagcgctgaccaaatggattccagacaagcctcaggaacaggttcttcccaagagatagctgcaagagccatgaaaaaaattcttgaattttctggcattgcttctaagctgaactcaaaagatccaaatatggtcaacgtagtctccacatctttctcattgacgtatgaaactggaccaggtgcacatgtggcatatgttgagaggttggatatagctttctcccatttttccactctagtttccttcctcagagccttgcccatgacagcaactgtaaggggatggtgaccacatcgatccaacaagacttctgcgacaggctgtgaagtatagagaagttaaacattcaaaaaccatggtgtttggaatttttagttattctattttttcatgatgtatcttcttctaaaatatcttactttgcaagtttggcacaactactaattgaaaataaatatgtatataaaaaatactgaacatatttgtaaagctaaacacgatgctagttaagataatatgttgttaatagaataagattaatttttttttttttttttatttttttttttttttttgcagcaggggaaccttcattaaagcagcagatgaacatatgcaaattagaatcagcaaacaaagctaacagatgtgatatgcagctgaaactaattaaggaccatcaactacaagagtagagcatactggaagctctccagcactgagaaggctgtgatagagaagaatttccgtgctgatctccttgatgtcgtctttacatatttctaccttttcagcttctgctatctcgtagatagcttcatctcttgttgtcacgagataccggcaatcattatcataaagtcttgtgaagcgatcaacaatgtcttgctcccaaacatcatcaagtaggatcagcatgcttcttccgaccaatgccgtctggagcaagcaacagacatcatcaagatctattccagtctcctccttgagagtcatggagccgatcttcacaaggaacgtgcagatcttcctagcaaggcgcttatggtattcacttctgctcccattacatgctgccctgctgcaccacctcccaaaaccaatctcaatcgcaccatccacgaaactaagtggcggatcagaagcaatctgtcgtgcgaggcatgacttcccgataccagagagaccgactatgaggacgactcgatgagccccatccctctccaacagctccctgacatagctgcacttcttggacaccgggtatccatgctccgacttaaccctcaccaacgacggcgtgcttctggcagtcgacgctatgacattgccgatgctctgggtcagctcctgcagctccagccactggttgaggtcgtccctgattagcctggcgtacttgatgagcgggtcacccaccacggagctccgcaccaacctggcaaaccccttccctttgcccttgctgccctgcagcaccttcctggccttggcgacgttaccgcgcagctggtccatgagcctgcccaggctttggaactggcggtccagctgcgggccgtgcagcttgtgcgcgtgccgctgcctcgactgctgcgttagcgcgtcgaggtcggacacgaagtcctcgagcacctgcagcctcctcggggcctccgccaagtcggacgccgcctgctccagtgccccgaccgcggacaccatcgcggagaccagctgggtcgccgacgcgaggacctgcaccacgtccatgcttcctcgcttcgagaacccgcttccagatcacgcacggccgcaaaattagacctccgatttctgcgaaggctatagcaattctacaaagacatggcgtacatcctcatggccgccgccgccgccgccgctgccgtagacacggacaactaatccccaactccacccgcatgccgcagctaaccgagacctttccggcctgatcgggtcgattggccgtagagtcagagagttggtggttggtagcctgtcaaggaacccaagagtggcaagtcaagtcgcaaaggaagcggacatggctgggccggaaccttcgtcgaaggaggaggctggctgagcctcgcccccctgcccaatgccgcgacgggagcatatatttaggggcatatgtgtaatgtgtttggccggctattctggctatctattttagattcaaccaccttctatatttttctttcctatactgtatattgtttttcaaagaatactctcctcttatctcgcaacatatctggtgcaagcaataagacataatcacagaagaggaatgacctttttaggtgacctcagttttttttgtgtgctcacttatacctttagtcgtgttttttttttctcagttgtgcccttccagaagggcacaactaagggtataggtgagcacaccaccaaaactgagggcaccaacttaaataactctttttaataagatcagggagaggtgtgaggttattttgaagaataaaattatttttactagttcaatacccgtgcgttacgacggtacacaaataaataagtaacatgttttctttggattaaagctagttgttcgaactgttccagctgcaatccatagagacaaaacactgtaaaaaacaatacaagtcatttcgaattagaaccaagcgaacaacttgaagcttattcccttatcatcctaatcaatttgactgtagtaaccaagagacctagaacttgcagaagggcagatagtcatctcacccctaggaagtaatttatcttgaagaactttgataaggttaaaaaaaaaataaatgcatcaacaaaattcaaagacttatagaaaataaggaaaatgtacagcattgaggcagcgattttagtcgtcgtgactgggaccatgatgatgatgaggactttcagcagaatagacgtcatggcacccgtaggcaccgcagtctatctggctgggcgcgttcttcgcggtgccgtggcggtccagaggattgcttcagctcaagcggaagacgcaggccgtccaccccattcagacgtcgtgggctggcgacagcgccggctgggcgctggattccaaaggtaaaaaccaagtcggtctctttccctgacccattaatctctgctgtttggccctcagctgctgtcgaagagctggaaggtggaaagggtgttatttcggctgatgatttgaatcctggcgaccagacagcacaacagcctcagcttgctgctcctaccaaggttcgcgttgccgagcatttaagtttctcatatgttgtgttaagccctaaatctgtagagattgcatatcctaatcctgatacaactctgagtactttgcaacttataaatacaactagggtggcagcagccccaaattcaataaatcagctgttggatgtagaacctcaagcacttccacattcaaaccttaattgtgcatctgtcatgccgtacaacaacataaattcagaattattcacttcctctctgtcatgtggcatcctataacccacaagcaataatctagatgaatttgttgcatctatctctgaagcacctaaaccaccgctaatccgatcgccacccatttctagcacacctataaattttatggttgaggggtgtccaattcagcctactgtagatgtgtgtgtgagcccaactcctatcggcaagagatctagtgctaggctggctgcaaagaaaaaattaaaattcgaaagaaatagaaatgccatagtcaaagctcaagaaattctagttgctaagttaaataactttgcctgaaatcagtttcaaagctctaaggcat

SEQ ID NO: 2982 - DNA, 1617 bp, Zea mays
gcacgagaccattacctagaacatcctaatcgaaaaaccgagcctcccagtcccagtccgcgcgcccggcgcctccctcgaacgagggccgtacctagcgcctctgtcctccgtcggccgtcgcactgtgcccccgtccgcctccggcctccgccaacccgcgtccgcccacgactaggcggctctgggcaggtccttccacaaagatgtgaaggattaaagctcatgtgaaagattctaagactacaattggtatcaagcggttgctttcttatttctcatacgctcaaccatgctcctgcatgctaaggattcagttaggaagatgcattcagttgctaagaactactttgtgtctgatcttactcatcctccaagatccttgaacagagcttccagacatgttgttccattcaagacccgtttctttactcattgctcacttgagagccgttcagttgaccaagagattgtgattgctatgggaagcaatgtatgcgatagagtcagtacattcaacagggcattgcagctgatgaaaagctcagacgtgaacatcactaggcatgcctgtctctatgagaccgcccctgcttatttgactgatcagccgcggtttcttaactctgccattcggggcacaactaggctcagcccacatgagcttcttaaactgctaaaggaaattgagaaggatattggccgcactggcggaataaggtatggcccaagacctatcgatctagacatacttctttatggtaactcccagatccatagtgagactctaattgtgccacatgagcgcatccatgagaggtcatttgttttagcacctcttgttgaccttctaggtgcatctagtgacaacggtatcgaaacaagttggcactctctctcaaagtgcagtggaggtttctttgagttatggaataaccttgggggtgaatctataattggaacagaaagcattaaaagggtattacctgttggggatcgtttgttggattggtgtgagaggactctggtcatgggggtccttaatttgacaccagacagctttagtgatggaggtaagtttctagaagtgggagctgccatttctcaggctaagtcattaatctcagaaggtgcagatatcattgatattggtgctcaatctaccaggccctttgcaaaaagattatctccaaatgaggagcttgagaggttggttcctgttctggatgagattacaaaaatccctgagatggagggcaagttactctcagtggatacattctatgcagaagttgccagtgaagctgtgaaaagaggagctcacatgatcaacgatgtatccagtggacagcttgatccaataattcttaaagtggcagctgaacttggagttccatatgttgcaatgcacatgaggggagatccgtcaactatgcaaagcgaacaaaatgtacagtatgataatgtctgcaagggcctggtagattgagcaccaatatcaatgatatctgcaccttctgagattaatgactccacctggcaatggcattcttcttctactgatgaacacatcactaatgtattttggggattgagctgttcaaaaaaaaaaaaaaa

SEQ ID NO: 2983 - DNA, 1675 bp, Zea mays
  misc_feature (1586)..(1586): n is a, c, g, or t
gaaaagctctgacgtgaacatcactaggcatgcctgtctctatgagaccgcccctgcttatttgactgatcagccgcggtttcttaactctgccattcggggcacaactaggctcaggccacatgagcttcttaaactgctaaaggaaattgagaaggatattggccgcactggcggaataaggtacggcccaagacctatcgatctagacatacttctttatggtaactcccagatccatagtgagactctaattgtgccacatgagcgcatccatgagaggtcatttgttttagcacctcttgttgaccttctaggtgcatctagtgacaacggtatcgaaacaagttggcactctctctcaaagtgtagtggaggtttctttgagttatggaataaccttgggggtgaatctataattggaacagaaagcattaaaagggtattacctgttggggatcgtttgttggattggtgtgagaggactcttgtcatgggggtccttaatttgacaccagacagctttagtgatggaggtaagtttctagaagtgggagctgccatttctcaggctaagtcattatgcgcccaaggtgcagatatcattgatattggtgctcaatctaccaggccctttgcaaaaagattatctccaaatgaggagcttgagaggttggttcctgttctggatgagattacaaaaatccctgagatggagggcaagttactctcagtggatacattctatgcagaagttgccagtgaagctgtgaaaagaggagctcacatgatcaacgatgtatccagtggacagcttgatccaataattcttaaagtggcagctgaacttggagttccatatgttgcaatgcacatgaggggagatccgtcaactatgcaaagcgaacaaaatgttcactatgataatgtctgcaaggaagttgctttggagctatacacacaggtgagagaagcagagttatctgggattccattgtggaggctggttcttgatcctggcattggcttctccaagaaatctgaacataaccttgaagtaattatgggattggaatccattaggagggagatgggtaaaatgagtataggtgcttcacatgtgccaatattactgggaccttcaaggaaaagctttttgggtgaaatatgcaatcgtgccaatccagttgagagagatgttgctactgttgcagccgtgacagctgggattttgaatggtgctaacattgtaagagtccataatgctggatatggtgtagacgccgcaaaggtttgtgatgcattgcgtaagcgtaagggaagttgcagaaactgaactatcgctccagttttatacaagaaaaaagtgatgtcgaaaaatgtgatttgtgaagtatcgttgttgtaatgaaccagagataatgctttttcttgtgtcaccaaggaataaagtcaagaagctgctactcaagttgcattggtcctattcagatgattttgctgaacttatttttttgcctatttagtggttgtttggttcatagggactaatttttagtccctttattttatttaattttagtttntaaattgtcaaatctgtattttgcaatttagggacaaatgaaataaaatgaagggactaattagtcctgagataaaaaaaaaaaaaaaa

SEQ ID NO: 2984 - DNA, 2286 bp, Zea mays
cttttactggttagtggttacatggtatgtttcattttcatggcccataaattctgataaagtggtgtaaattaagttgatgttgtgatgcatgaaccgatgaatgttctaagctgattatgaaatgtgatgcatgaactgataaacgttgcaactgttttttttttttttgatgaattaaagtcatgaacttataatatggtatgtgaaactgtgataataataattattttctggtattatacttttttcgctgtagcttgtgagccaaacgaaccagctcaaactcgtaaacaaatcgagtcgagtttatcttctagctctgttttttaacgagtcaaaccgaactagattaacgagtcggctcgagctcacgccgagcccgacctgttagatatccaaccgtacgtaaactagtcacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtacggtccacctcgtccttaacccttacatgcgcatcttgtcttgttccctgcggagatctagattctaagcgggattctgggcacgattgctgtgatgtcgcgccaatctaactagtagctacagaaaatctggtttatagctgttagttgtcattgatttcatcctttcgcttgctgaaaattgtcttttctcgtggattttcaacgcatagggtctattattctgtaaggctgattgttcagggaaaaagtcctgcaagtttggcctgaattactggaggagctgatggtttgcttcgtttttttttttttttgtccagctgtagaattccgttttctgtattacagaaatccacaacttggattggatcctataccaaattaagaaaagcccagcacagttctatcctagcaaccatgtgacagttattgtcctttatgtggcaaccagattgttggctgctttgcatttcttggcacattctttgaaagaagccgtggttacttttactcttattgactgcttggttgatgtgaaaaggattcactgcttgttctgcttagcaattttatttactctgatgtcactgtgcaagtgtaagagaaatgtaaaacaaaagtgcagaccagtgccggaggctccacatgagtgaggtcttggcctcttgggaagggataagctgaggcaggccttcctcccgggataaactgaggcaagccttgcttccgcaaatgcggagagactgcttcaaacccaagacctggtgagagaaatgtgcttgacagaaattggaacaattctcttgagctttcagagcctcctgttaggtctaattctagatttgtgaatttagcggtggctcttgtgtccacctgattagctcactagatctcttgcagtgcagttcaagaagctaaacttaaatatttatcaagtttaacacagacttttgtggggagtacataactataagaaaatgcactgataagtgatatggtcagatactcatttgacttgagagcagcgaatgtacattgataacatctgaaccatgagtgtatggagatgacgccttatggttgtagttcctgtaccaaagcacatactcttatcagcactttatttgtctggagagctacaggtactgcaaaagagcaaaggccgtgtttaaggagcttgagttgaagaaagagccatatgttgtggagcttgatcagcgaggtttgctttacactctttttcacatcgctaatttactgttttagagtgcttgctctatgccccctacttcagtcatgttttttcccagtggaagtgccacattttcattgaaataaccaaggcagagttgtgaatacatctttttcagtgttttcagccagcatgcttttgtgatcacgcagctagattgaataatttgtttttcagttggatagtcagccatattatgaagtataaataaacatactgaaccccaaaagaaaaggtagagtattcatggtgggagtatttttgaatgacatccttggatggagatgtcctataggctcgtagtaagcacaaatgtcttcaagtgcctcatgtcataatgtgaattacatagaaccataaacacagttac

SEQ ID NO: 2985 - DNA, 885 bp, Zea mays
  misc_feature (10)..(10): n is a, c, g, or t
gtaccctcgnaggccccccggccggcccggggcccgacctgttagatatccaaccgtacgtaaactagtcacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttgagtgacatgctacatcggtcagcctgttcgtttggtttcaatccgtaccggcttctactacttctatattgtttttgtctctatggattacagctacaacagtctaaatagctgattttaatccgaagcgaacagtccaaacagtctcttgttttgagttaccaagggattttttgtgtgactctgataaaagatatgtaactgaatgttttattatagtttataccatttgaaccgtacttttattgctcgaaaaaaaaaaaaaaaaaaaaccggcccagctctcggccgttgttaccactgctaaaaaaagcgccctaaggg

SEQ ID NO: 2986 - DNA, 981 bp, Zea mays
gccggccgggttccgatcttctctcccagccgccgccgcctctattctctcccttccctcttctctctcccctcacctctctcctcccttccctcgcctcgctcctttctgtcccgaccgagcagcagccgcgagcggatgtcaagaatcactggcatgtcgtcatggcacgtcgtagccgcgagcgctccaggctccttgccagggccgcgagctcatcctcctcgtcgtccaccggtgggtacctcttcggcgctgtcacgtcggcgactagctcgctctgcttcggcttctccaagcttggtggtgccggcagcgccagcggaagcggcggcctgttcaagtcgctggtgcctgcacctcctacttcactgttcaagaactttggcatagccactgcgagtaagggcttgctggggccgagtttcaaggcatcgggacggtacagctacagcggcaagcagccaacggcacctctctccatcatcttctcctctccaagagaagcgctaggcatggatatcagccaccatggccgccatgagcaccaccaaaaggattatcacgccagcgacatcgccgatgagccactgaagaagaaggacgtgtcgttctttgatttcctcagcatcggtgtgtcctcgtaatcaataataatattgcattcctgaaataccaatcgatgttgatcaatcaagtgtattgatcagtgtttgtttttttaattattagggcgaactgcatgtggctgacaagtattcagggttagagttcatcgtgattgatggttacagtgttcttatcatcatgtgctgattcatcagtcaaataaggctccagacacatggctatttaatatttatttaaaagtttttttacgagcctactcaactcgatctagtgtgttgtctttctcatgatgcgctagccggtcatcagactgtattgtatttgtgaatgattttgttatggtgcttgttg

SEQ ID NO: 2987 - DNA, 907 bp, Zea mays
  misc_feature (842)..(842): n is a, c, g, or t
aggtccggccgggaaaagcgctccctctccccgccccgagccgcgcgctccctctcttctctcccagccgtcgccgcctctatctctctctcttccctcttctctctcctcccttccctcgcctcgctcctttctgtcccggccgagcagcagccgcgagcggatgtcaagaatcactggcatgtcgtcatggctcgtcgcagccgcgagcgctccaggctccttgccagggccgcgagctcatcctcctcgccgtccaccggtgggtacctcttcggcgctgtcacgccggcgactagctcgttctgcttcagcttctccaagcttggtggtgccggcagcgccagcggaagcggcggcctgttctggtcaccggtgcctgaatctcctacttcattgttcaagaatttggcacagccactgcgagtaagggcttgctggggccgaatttcgaggcgtcgggacggtacagctacagcggcaagcagccaacgacacctctctccatcatcttctcctctccaagagaagcgctaagcatggatatcagccaccatggccgccatgagcaccaccaaaaggattatcacgccagcgacagcgccgatgagccactgaagatgaaggacgtgccgttctttgatttcctcggtgtgtcctcgtaatcaataataatattgcattccgaaaataccaatcgatgttgatcaatcaagtgtatggatcagggtttgttccttaattattaaggcgaactgcaggccgctgaccagtattcaggggtagaggccatcgtccttgatgggcacggggtccttaccatcatgtgctgattcatcagncaaataaggcgagacatggctattttatatttatttaaaaagttttttactagcctactaccccc

SEQ ID NO: 2988 - DNA, 1059 bp, Zea mays
gggtccctcgaggccccccccgccagcacacagcccataacgatggcccccggcctattcgggctcgcctaccatctctcctccggtccttcctatcataccgtaccggcgggcggcgcggggcagctaatcggcaatccggcttcgcctcgtcgcagtccaatccgcactcaccgccgccctcccgcccctcacctgcccgcgggagtgtcggagtaaaccctaccggacctatcgtcacgcgactgcgggagttgcttgcttcttctgccgctctctcgctccgtcccttccgcccatggagacctcgctgcgcttgcgcagtggcggcggcctccgcatccacgccaaggagaagctgcccctcggccacagctcgctgctgcaggctcatgcggagctcgacctccacacaagccccgccggagttactaccccgagttacctcgctctctttgtcaggcacttctactcgcagctatcagccaatctcggagctggcgtccagttgcacaacggcgatgacctcgcctacagttttcgcgccaagaaggccgtcctgttcaaaccagataatgggttcctaggtctgaaccttaaagggcgcctacttaccgataaagagttgaagccgacgaagacaactggatccgttgaactggcatggaccatacttgacttgaaacagggccaagacgtaaggctcaaagttggttacgaattgtgtgacaaggtgccttatttccagctcagagagaacggttggacgctgaatgcttatatggatgggaaatgggatgttagatttgaaatgtgaatccacttgctcagtagtgttaccaattctacttgtctgtactgcacttggaactgttgatctggtaatatgtaaactggagagctttccatattcatctagttctgaagcctacgttgttggctcactgcatcatcagctttggttctagtagccgctattcatccaaacgtcacaacatgtaatgtgacgggggaattgagacttcatcatcattattatatacttagggctaggttgtc

SEQ ID NO: 2989 - DNA, 977 bp, Zea mays
cctctgctcgtccgccgtagtctcctcccctcctccgctcctcccctcctatactctccagatctcccattcacacacactcgcgccctccagactcggggagacggctgaagaggccgatggtgcggaggaggagagggacctgcgggaggcgttcgttggacgtgttcgacggcaacagggacgggctcatctccgccgattagctcggcaccgtgctgcgctcgctcggcctgcgccgtcagggcagcaccggtcgggccgccgccgattgccgcgacatgatacgacgcctcgtcgaccgcgacggcggcgacatggtcagcttcgaggagttcaagcgcatgatggccgtcgtcgtcgaggcctagcctcctcctctacaggcggagtttggtttggctttctacaggcagaaatttgctattttgcacgtgccatcagttcagttcgtactccgcgttactagttttagtttagctagcaagttaaagatgtgtttggcccggcacgactagcgagcggctgctctgtctgtaaaccctgagtgtaccagtgtatttccggcgccaccaccgacgatccacttcctgagcccggggagtgggatgagaaccgattttcacctcgggttcccggtggaagtagcaatatatcctgggatcgtactgtcagactgatacagccgtcggacccaggccagccagaaccagaggacacgaccgacgttggaaacgaacggctctcgcctacttcttcatttgagtgcaaagctgccggcatctgatccttgcttttagaacaaagcgaaagcccctgaaaatggcaaaggtgcagggttcggtgttgtttgcgtgggtgtgaccgtgagtcagaaagtagaaacggttccgcttacataacttttacttttctacatggtatagattcatgcagccattgtttttttcgaaaaaaaaaaaaaaaaaaaagcggcc

SEQ ID NO: 2990 - DNA, 1539 bp, Zea mays
  misc_feature (1484)..(1484): n is a, c, g, or t
accccgggtcacccagcgttcgcctccaccggtctcctctcctgctgcgccccgccgggtcgggggggggactcccaagtctccaactccatcaaccgccgctctacctcctctccacaagtccagatctcccattcacacacactcgcgcgcgcacagagacctccacgcgcagccaaagcatccacccatggcgcctctcctcctgctcttcctcctcggcggcctctgcgccctcttgtcgctggccacttcctcacgcgccagcgccaagaagtgcgatgacgtcaagagcaacggcaattgcggggactccggcgaggaggcaagatgcagggacggctgcgcctgcgcgccagaggagacgcagcagcaggggaagaggcaggcgcggcccgacccggagaaggacctgggcatcgtcttctccacgttcgaccacgacggcgacgggttcatcacggcggtcgagctcgaggagtcgctgcgccgcctcggcatcgcagtgtccgccgacgaggccgcggccatggtcgcgcgcgtcgatgctaacagcgacgggctcatcgacatccacgagttccgcgagctctacgactccatacccaagaagaggaagcaccagcaccccgcagccggcggtttcagcggggcagcaagggaggtgccggtggagggcgacgacgaagaggccgaggaggagagggacctgcgggaggcgttcgacgtgttcgacggcaacaaggacgggctcatctccgccgaggagctcggcaccgtgctgggctcgctcggcctgcgccgccagggcaacggccggaccgccgtcgccgattgccgcgacatgatacgcctcgtcgacagcgacggcgacggcatggtcagcttcgaggagttcaagcgcatgatggccgtcgtcaaggcctaggctgctcttcttcctcctcgcagatcaaatcaagtaccaaacttgagtagcgttatttcgttcttggatcggaaaagattaacacaccaggagatcgtatttgtttatggggggttttgaaagctgaagtagcttcttgatctgtgtttctcccctgttcttcaatctcgataacttgctctgcttttacactctgattctctcctactaccttttttagtccttggtactgttttcactgacagatattgatcagacatgtatgtaaatattacttcttgctcgctgtcaggtcagtctgtggaaaaaatgaacaactaaatgaatcaacgagtatgatttgttcattcggtgtttgtgtttgggacccttacctgttcaaacaattgtgtttaagatgatgtgcgtgccaccctttctgtgacccaactttcatagttgaaatattctcttcttggctgtaaggttgcctgttcatgaagtaaaactccaaagaaagttcttgtctttgtggacaagatttgccttttttttaccctgtgtttctgactaccangaaactgaagtgatcgtgtgagtttttcgtggcctgtgttcgtaccgggtccgga

SEQ ID NO: 2991 - DNA, 2008 bp, Zea mays
ttaaggatagtcgagagggacgcgtatagaaaaaagattgcttcttttagatgtctgttaaaaatatagggatataagattagatagaagaggtgttatagtgttttgatcttctaaagtactcatttttagaagatcagataggaggagaaccttcgttctcatatgaacactttaatgagcatccatgaccaatttaaggaattcgataatttttaaggatataatgtctaatgaagatgttttaagtccagtaatctctattatgcttagcatcttaacaatgtcttcccttgagtattaccatgtattgtactttctttattcttttttagttatcgtgttttactctaaaattgaactaggtgacgaaaaatattggagaagggtccattttaagtagccaagtagtatgcaattcttcggcgaaatacttgctctgtgcagggcacaagtgggaaattttctttcaaaaagaaatggagcctaaccacccacgatctaccaggtcatggcacgatccgcctctgctcctgccgtcccgtcctccaccgagtctcctctcctgctccgctcctcccctcatatactcccaagtccccgacgccggccacctcgaggccggccggggccgctctacctcctctccacaagtccagatctcccattcacacacactcgcgcgcgcacagagacctccacgcgcagccaaagcatccacccatggcgcctctcctcctgctcttcctcctcggcggcctctgcgccctcttgtcgctcgccacttcctcacgcgccagcgccaagaagtgcgatgacgtcaagagcaacggcaattgcggggactccggcgaggaggcaagatgcagggacgactgcgcgccagaggagacgcagcagcaggggaagatgcaggcgcggcccgacccggagaaggacctgggcatcgtattctccacgttcgaccacgacggcgacgggttcatcacggcggtcgagctcgaggagtcgctgcgccgcctcggcatcgcagtgtccgccgacgaggccgcggccatggtcacgcgcgtcgacgctaacagcgacgggctcatcgacatccacgagttccgcgagctctacgactccatacccaagaagaggaagcaccagcaccccgccgccggcggtttcagcggggcagcaatggaggtgccggtggagggcgacgacgaagaggccgaggaggagagggacctgcgggaggcgttcgacgtgttcgacggcaacaaggacgggctcatctccgccgaggagctcggcaccgtgctgggctcgctcggcctgcgccgccagggcaacgcccggaccgccgtcgccgattgccgcgacatgatacgcctcgtcgacagcgacggcgacggcatggtcagcttcgaggagttcaagcgcatgatggccgtcgtcaaggcctaggctgctcttcttcctcctcgcagatcaaatcaagtaccaaacttgagtagcgttatttcgttcttggatcggaaaagattaacacaccaggagctcgtatttgtttatggggggtttgaaagctgaagtagctttttgatctgtgtttctcccctgttcttcaatcttgataacttgctctgcttttacactctgattctctcctactttttttagtccttggtactgttttcactgacatatattgatcagacatgtatgtaaatattacttcttgctcgctgtcaggtcagtctgtggaaaaaattaacaattaagggctagtctgagaaccctattttctcatgagactttcattttttacaagagaaattagttcattttttcttgagaaaatagaaatctctttgaaaatggagttcccaaactaatcctaaatgaatcaacgaggtgtttgtgtttgggccccttacctgttcaaacaattgtgtttaaggatgatgtgcgtgccaccctttctgtgacccaactttcacagtttgaatattctctt

SEQ ID NO: 2992 - DNA, 1223 bp, Zea mays
gcacgagaccattacctagaacatcctaatcgaaaaactgtgtagcccaagattcaaactctcccgtgcaaaattttacggagacttgcccttccctctgccgtcccgtctctttgattcctgaaccccacccaggctggccaggcactccgcactcataatcgactgggctggccgtcgctggctcgctgctacttcggccccttcgccagcgacgataaccccccagttatccgagggaaaattttctatgtgctgattggaatggcgagtacagcatgctttgtaattgtcagtaagaatgatatcccaatctacgaggcagaagttggatctgcacccaaaaaagaggatttgtcttatcaccatcagtttatcctgcatgctgcgttagatgttgttcaggacctagcatggaccacaaataatgcaatgtccctgaagtcagttgatagattcaatgaccttgtggtgtctgtttatgtaactgctggtcataccagattcatgttgcttcatgactcacgcagtgaagatggaataaaaggcttttttcaagaggtccatgagctttacgtcaagatattcctgaacccgctttacctgcccggctctcgcatcacatcctctcattttgataccaagatcagggctctcgcgaggaagtacctgtaatacacgggcatgcatgaagggtttgcatctcgtagagtaaagactaaagaagcagcagcaccgaaatgcagagagattgctcgaaatgagatgtgatgaatggaatagagacgccgcgcataaaatgcccctttgcataaatgcctgtccctgttatgcataataaacaaagcgtgttccgtcaaagaacagcatgctgacacacacgacacgacgagccaccacccatagcctccaagctagggcgtcggcttgctgtggtgcttgcgtggagactgaccattggcacgccggtctctcgatgtatacctgcgtgtcacggcatccacgtcatgtattgtttggcgaagactataggttaggtcctctatattgcatgacatcgtctttacgtgtcatgtagttacgtatctatctatacatgccgtctaaaagaccacatgttttttttcttcttattcgtcgcatgtcctttagaaaacaaacctaacaattaacaaagcatatatatatatggcgagcaaaaaaaaaaaaaaaaaaggccccta

SEQ ID NO: 2993 - DNA, 1045 bp, Zea mays
ctcccgttccaactttattgtgtttttcccccccccccttcccgatcaaagattcaaactctcccgtgcacaattttactgagaaactcctcgggggtaaagacttccccttcgctctgctgtcccgtctctttgattcctgaaccccacccaggcattccgcagtggctggccgtcgctggctcgccgctacttcggccctttcgccggtgacgataacccaccagttatccgagggaaaattttccatgtgctgattggaatggcaagtacagcatgctttgtaattgtcagtaagaatgatatcccaatctacgaggcagaagttggatctgcacccaaaaaagaggatttgtcttatcaccatcagtttatcctgcatgctgcgttagatgttgttcaggacctagcatggaccacaaataatgcaatgtccctgaagtcagttgatagattcaatgaccttgtggtgtctgtttatgtaactgctggtcataccagattcatgttgcttcatgactcacgcagtgaagatggaataaaaagcttttttcaagaggtccatgagatttacatcaagatattcctgaacccgctttacctgcccggctctcgcatcacatcctctcattttgataccaagatcagggctctcgcgaggaagtacctgtaatacacgggcatgcatgaagggtttgcatctcgtagagtaaagactaaagaagcagcagcaccgaaatgggatggatgccctatgcagagagattgctcgaaatgagatgtgatgaatggaatagagacgccgcgcataaaatgcccctttgctccagggttatccttgcataaataatgcctgtccctgttatgcataataaacaaagcgtgtttccgccaaaaaaaaaaaaaaaaacctatcaatacgccgacctcaagggggggccgggaacccatttcgccttatagggatccaattacgcgcttccttggcggtctttttccacgttcggacttggaaaaccctggggttacccaattaaatcccttt

SEQ ID NO: 2994 - DNA, 1300 bp, Zea mays
ttttttttttttttttgtaaaccgcaaacgttctactaatttgatgtccttttttttggcacaaactcacttgccaatgcaaatatgcaatcgcactacagcattactccgcaacgaattgatgatcgctggagagaaaaaaaaaattggtctgcactctgacctaacactgtcggacatcgatcacatgcgagagtttgcttgggccatggcctgtgtcgcctggacagaaaaggagcacggggacgccaagattccgccggccgtctccttgcaatgcgtgctagtccccgttcgcccctcggccgtgcgccggcgaggtgtagtagaaggtgatggccctgccgttggcttcctggagtggcctcctgttgctcctggtgccgtcgtggacggcgttccgcagcagcctgacctggcgccgcgtcacccgccgtgtctggacgtaagtggcgccgcgtcacacacacgttcgtcgccgtggacagccttttgacctggtgcgccactacccacgtcacgccctccgtgcagggcggtgtcgtgaaggagcccgtgtacttgtagtaggccgtgctccggctcaccggccgccgcgggtccacctcctcgtcgatgagctcctcgtggttcttcctcctcgcgatcctccggatgtaccgttccagcctgtgaatggtcctgtcaggacgccgccgcgagatcctgtagagctgcgagaccacggcgtacctgttggtgtcgctctggtgcaccatctgcagctccagggcgtacctgcgcccgttgatggcgtgctcgctcggcgcgtgccagtgcatctgccggagccggtacgccacgccgtcgatcaccacgccgccggggttgctgttgaaccttaccataatgctgtggccgcggttgacgagggacgcggcggcggggcggtaggagcggcccaggcggccggaccggtcggctagccccgccaaggtgtcggagaggccgatgggcgactgcaggaggcccacgttgcacgttgcccactccctccggatcaagccccaccgcgccggcccgttcccggcgttccgccggtagctgaagtcctcctcgtcgagctcctgcgccgctgcccagtggaccgtcgtcgatgcgccgaaggggcggacgagcagctgcggcgagagggagatgacgatgaagaaggcggcggcggcggcggccaccctgctgctgctcggagccgccgcgtacatggcggccgtcgcttagtgcgtatcctgcctgctgcctactgcctcagccgtgtagttcg

SEQ ID NO: 2995 - DNA, 818 bp, Zea mays
tccggtagtctgtactcacatctttccctcccgtcggccagcagccttccggttcaggccccgtcgcatctctcctcgtcggccagctgcagggcacctagcgcgtggtcggcgagcgcgcgggcgggcggcagggggcgccgcggcggcgagcgcgcaggcccccactcacagacgactgggccggccttcactgctacttcggccccttcgtcgccgacgagaaccaccgcttgttcgggggaattttttctaggtgctggttggaatggcaagtacagcatgctttgtgattgtcagtaagaatgacatcccaatctatgaggcagaagttggatctgcacccaaaaaagaagatttgtcttatcaccatcagtttattctgcatgctgcattagatgttgttcaggatctagcatggacaacaaatgcaatgttcctgaagtcagttgatagattcaatgaccttgtggtgtctgtttatgtaactgctggtcataccagattcatgctgcttcatgactcgcgtagcgaggatggaataaaaagcttttttcaagaggtccatgaactttacatcaagatattcctcaacccgctttacctgcccggctctcgcatcacatcctctcatttcgataccaaggtgagggcgctcgcgaggaggtacctgtaatacgggcatatgctggggtttcatcgtaaagcaggcacgccgatttttttgtgccatcatcatctgataacacatacgtctaatttttcttggcgttggctttgttatgaccgacctatggatcattttttttttcgagaac

SEQ ID NO: 2996 - DNA, 934 bp, Zea mays
ttgggtacctcgaggccgtagtctgtactcacatctttccctcccgtcggccagcagccttccggttcaggccccgtcgcatctctcctcgtcggccagctgcagggcacctagcgcgtggtcggcgagcgcgcgggcgggcggcagggggcgccgcggcggcgagcgcgcaggcccccactcacagacgactgggccggccttcactgctacttcggccccttcgtcgccgacgagaaccaccgcgtgctggttggaatggcaagtacagcatgctttgtgattgtcagtaagaatgacatcccaatctatgaggcagaagttggatctgcacccaaaaaagaagatttgtcttatcaccatcagtttattctgcatgctgcattagatgttgttcaggatctagcatggacaacaaatgcaatgttcctgaagtcagttgatagattcaatgaccttgtggtgtctgtttatgtaactgctggtcataccagattcatgctgcttcatgactcgcgtagcgaggatggaataaaaagcttttttcaagaggtccatgaactttacatcaagatattcctcaacccgctttacctgcccggctctcgcatcacatcctctcatttcgataccaaggtgagggcgctcgcgaggaggtacctgtaatacgggcatatgctggggtttcatcgtaaagcaggcacgccgatttttttgtgccatcatcatctgataacacatacgtctaatttttcttggcgttggctttgttatgaccgacctatggatcatttttttttcgagaacaaaatgacttgtctaatttttcttggcgttggctttgttatgaccgacctatggatcatttttttttcgagaacaaaatgacttggcgataatgttcaaactttaaaaaaaaaaaaaaaaaaaaaaa

SEQ ID NO: 2997 - DNA, 3202 bp, Zea mays
gatacctacttcttcatatgtcataaaagatatattaagtcgatccggactacatcgtcacatatatgagtcgtatggccaattatatgtggataagattatgttttgtatacttttgtgaatgaaacttgtatgtggctgtgaatgaacgattgtgtggttaggatttgtttattgtgggcttttccgattacaattactgtttcccgatcaattccgagctattttgctcggaattatccgttttcgatataccggaatttaccggtcgttatccgttttcgacttttccgtttatcgattccgttttttttttttttttgcgagtaaaaacggtgagagattttttccgaccgttaccgatcgttttcacccttacatgtggcagacgtgctatccttagaatcacatgattttcgagattgcaattcgctcactcagtcacggaacaaggagtgtaaaccgcaaacgttctactaatttgatgtccttttttttggcacaaactcacttgccaatgcaaatatgcaatcgcactacagcattactccgcaacgaattgatgatcgctggagagaaaaaaaaattggtctgcactctgacctaacactgtcggacatcgatcacatgcaagagtttgcttggccatggcctgtgtcgcctggacagaaaaggagcacggggacgccaagattccgccggccgtctccttgcaatgcgtgctagtccccgttcgcccctcggccgtgcgccggcgaggtgtagtagaaggtgatggccctgcccgttggcttcctggagtggcctcctgttgctcctggtgccctgcgcagcgaaagccacacatgtttcgtcaggccttgcaagtctactactagctgcaactccatgacgcaacgcaacggcggtggcggcaccgcaccgcacggcacggccgaccggcgaccgaggtggatgactgaagggtgcttacgtcgtggacggcgttccgcagcagcctgacctggcgccgcgtcacccgccgtgtctggacgtaagtggcgccgcgtcacacacacgttcgtcgccgtggacagccttttgaccttatgtccgacggttttggtcgtcggacgttgttccgtttactgtagtgatgaaattttacgtttgtttacctggtgcgccactacccacgtcacgccctccgtgcagggcggtgtcgtgaaggagcccgtgtacttgtagtaggccgtgctccggctcaccggccgccgcgggtccacctcctcgtcgatgagctcctcgtggttcttcctcctcgcgatcctccggatgtaccgctccagctgcacacgtacgcgtgcatgaggcaacttcgaataaccgtcagagcactaccaatatctggagtacgtgcaatgtttataatgaacagctgaacgtggcctcgctcacgcaccctgtgaatggtcctgtcaggacgccgccgcgagatcctgtagagctgcgagaccacggcgtacctgttggtgtcgctctggtgcaccatctgcagctccagggcgtacctgcgcccgttgatggcgtgctcgctcggcgcgtgccagtgcatctgccggagccggtacgccacgccgtcgatcaccacgccgccggggttgctgttgaaccttacctgatcgaacacgcgcgtgcaggcacacgcagagcacgtcgctggtcataaccacggtcgacgacgaaatagaccggccaccaaaccaaagtatatacacccgtaccataatgctgtggccgcggttgacgagggacgcggcggcggggcggtaggagcggcccaggcggccggaccggtcggctagccccgccaaggtgtcggagaggccgatgggcgactgcaggaggcccacgttgcacgttgcccactccctccggatcaagccccaccgcgccggcccgttcccggcgttccgccggtagctgaagtcctcctcgtcttcatccaccgaccccagccatccagcgcgcaacgcatcgagcaaaaccatgcacagacgagacaacagcagcacggggagcgtgtcccaaggacgaacgagcgcatgcatgcatgacacaacgacctcctaccggtaacaatgcattcaaataataaagccgactcgatcggtcggtcactcacggcgctgcccctgcgcgcgcgcgtgtaaacgggggccggaaacgcctaccgagctcctgcgccgctgcccagtggaccgtcgtcgatgcgccgaaggggcggacgagcagctgcggcgagagggagatgacgatgaagaaggcggcggcggcggcggccaccctgctgctgctcggagccgccgcgtacatggcggccgtcgcttagtgcgtatcctgcctgctgcctactgcctcagccgtgtagttcgacgagaacgtgtgcatttctggggggtaaagtagccgtgtgtccgcgagcacgcgcggcggccggccgggaccgggagaaagcgcgtgagcgacggccggcaaaggcggccgtcacgcgttgcatgcaggagcagaaggatgcacgggcgatgtattgcttgctcgactgacaattttattttcagttttctaacaaagaaatgtcatttgttcttgcttttcaaagcgaaatggacaagaacatgtactctgtactttggtcgaggccgcatccgcgtgcgcggaaccacatggcgcatgactgacgaagagcaggcagatgaacacaacacaaccttaatttaaatcgaatggaaaataacaaaaacttaaagaagaaaacttgtattcaactaatggactgtggccggtcatcgacgatcacgataaactctattaattaagatatgtattttttcgaccatatccatacttttcttccatcccaaatggggtccgacagtacgacactgttctaacactcacggcacggagcggtcgtcgtctttattgggccgcgtcgttgctcctgcaggtttttcgctccttgtgggccctcatctcctcctcctcactcctcccttcctctctcccctccctttctcttatgcagtgggccgttctgggtgggctatttggctttcaggcagatgtagggtttcagttttcactatgggtccttggcacggttgggtttctggggtggagttggggtcgccatggatcgggcctttgaatcctggtacac

SEQ ID NO: 2998 - DNA, 1920 bp, Zea mays
gtacttgataagatgctggaactggcacagtcaaacatgaaagaaatggaaaaacatattagcagtcttcaagaggaggtaaagggtcatcaagataaggccactgaccatcagcaaatagaagaatcgctgagaaacacaatctcagaactcaaggtggtacaagaggcactggagctgtcaaagtcacaagtggcagatttggaacagaagcttgcctcccaggatgctgatatcagtaaactaactgaagagttgaatctccattgttcgtctgaagaatcccttaaagagaataatcttaaactacagactgaacttactgctgcgcttgaggaactacaatcaaagcttttgagtttgcaggaaatggagacaaaacttgatgaacaggctgacccccccctcccaagtgaggctgcactagagaagcaaaatgaacagctacttatcttacaggctgggcttgacaacttgaaggatgaaaatgaaactctccaagggtcacttgctgatcttaattcaaaactttctgagaaagattccttgttgcatcaggcagaagatgagcttgctaaagcacaattggtactctcagaagcattgtcacaaaaagaagagttggagctgaatctgaactctctcaatgagcagcatggtgaatccaaagcttttggagaaaatgcaagtcagaagattattgagcttgaagcacaaatacaggcaatgcgtgcagctgaagaggcactcaacctagagctaaaagaagctgaggcaagtgtcaaagctgctgagaagaaaggctcagacctcgagcaacagctcagtgagattgagaataaattagttgcatcaagtgaagaaatagagttgctgaaagagcgtattcaacaagaagctgctgtatcagcagaaagaggaatgcagcttgaagaaacaatgaccagtgcagagggatacaaagaaaaaattaacgagctacaatgctccctagattcctcgatgtctaaaaaccagctacttgaacaagaagttaaggagctgactgataaatgttcagagcatcaagaacaagcgcattcagttcagcaaagaagtctggagctggaagatctgcttcacacatcaaagactcatgctgaaggtgcatactctcggacacaggagctggagcaggagctgaacagcacatatgaaaagctcaagggggttgaagaagaacttgagcagtacagaagcaaggcttcgcagctctctgatgatctagaagcttatcagacaaaagcagctagtcttgaagctgtggtggaagcagcaagcgagaaagagaaggagcttatggagtcattgagccaaataactgaagaatagaactctattacataagctgaataaactaaagccgcatactgctagttctacacttctattaacatactgctagtctactactctgccaggtgagggtgtgagcgtgaggcacttgccttctcagatttgaagtaagagcaactaagaaacatctagttctactaagtactaactcattgcattactgacttactgtatatcaaaaagaataaaaataggagggacatataagtgtcatacttacgttgtaattgcaagactcaaaagactccgttgtgggttgaggcctttgagcgttggagaggggatcgcactatcgcagcagcacgcagccaggcggcggggcacgtcggcaatcggtgaggcttggggtttgagacttggaggcttggagagttggagctgttgggggcgtcagcaatagacgaggcgaccgacactccggcagtccggctccggcagtcgtcgaagttacacaggaggcgtcgcgagctgcaactgtattgagccccccagggacaactctggcgagcagcgacgcctaactcc

SEQ ID NO: 2999 - DNA, 2902 bp, Zea mays
gccggccgggcctgcggcaagaatccagcgagccaacaaggcatcaacaaacacctccctccttcttcacttccctgccgttgttgcaggaagcaagcgagggcacacaaaccgacaaggccgcccacgcgcgcgtcggccgccgccgttgccgaccagcaggcaggcagcatggtcgtgaacaacaaggtggacagcctgtcgtacgacgtcgaggcgccgccgccctctgccgccggcgccgccgcggggcaagcgccaccgccggcgtcgccagctccggcgccggcaccggcaacccacgcgcccgtgacgcgggaaggcggcgcggcgtcggtgctggagctgcacaaggtgtcgctgccggagcggcggacgacggcgaaggcgctgcggcagcgcctggccgaggtgttcttcccggacgacccgctgcaccagttcaagaaccagtcgtcggcgcggcgcctcgtgctggcgctgcactactgcgtaccccgcggccggccggggtccgcctacagcccgcgcctcctgcgctccgacctcgtcgccggcctcaccattgccagcctcgccatcccgcagggaatcagctacgccaagctcgccaacctgccgccaatcgttggcctatattccagcttcgtgccgccgctcatctacgcgctgctggggagctcgcgggacctggcggtggggccggtgtccatcgcgtcgctggtgatggggtccatgctccgggacgccgtgtcgccggacgagcagccgctcctctacctgcagctggccttcaccgccaccttcttcgccggcgtcttccaggcgtccctgggattcctcaggctgggcttcatcgtggacttcctgtccaaggcgacgctgacgggcttcatgggcggcgccgccgtcatcgtgtcgctgcagcagctcaagggcctgctcggcatctcccacttcacctcccacatgggattcctcgacgtcatgcgctccgtcgtcaaccgccacgacgagtggaagtggcagacgatcgtcatgggctccgccttcctcgccatcctcctcctcacgcgccaaatcagcgccaggaatccaaagcttttctgggtatcagcaggtgctcccctggcgtcggtgatcatctccaccatcctctccttcatctggaaatcccccagcatcagtgttatcggcatcctccccaggggagtgaaccctccttcggcgaacatgctcagcttcagcggctcctacgtggcgctgacgatcaaaaccgggatcatgacaggcatcctgtccttaacagaagggatcgcagtgggcaggacctttgcgtccatcaacaactaccaggtggacgggaacaaggagatgatggcgatcgggctgatgaacatggcgggctcctgcgcctcctgctacgtgacgacggggtccttctcccggtcggcggtgaactacagcgcgggctgcaggacggcgctgtccaacgtcgtgatggcggcggcggtgctggtgacgctgctgttcctcatgccgctgttccactacaccccgaacgtgatcctggcggcgatcatcatcacggcggtggtggggctggtggacgtgcgcggcgccgccaggctgtggaaggtggacaagctggacttcctggcgtgcgtggcggcgttcctcggcgtgctgctggtgtccgtgcagacgggcctgggcgtcgccgtcggcatctcgctcttcaaggtcctgctgcaggtcacccgccccaacgtcgtggtggagggcctcgtcccggggacgcagagctaccgcagcgtggcgcagtaccgcgaggccgtccgcgtgccgggcttcctcgtcgtcggcgtcgagtccgccgtctacttcgccaactccatgtacctggtggagcgggtcatgcgctacctccgcgacgaggaggagcgcgcgctcaagtccaaccacccctccatccgatgcgtcgtcctcgacatgggcgccgtcgcggcgatcgacacgagcggtctagacgcgctgtccgagctcaagaaagtcctggacaaaagaaacatcgagctggtgcttgccaacccggtggggtcggtggcggagaggatgttcaactcggcggtgggcgagagcttcgggtcgggccgcctcttcttcagcgtagcggaggccgtcgcggcgggggcgtgcaaagcggcgcagccctgacgacgacgacaggctgatccctgaggtgccgcacgggagcatgcataggaataggatgggtcagagacagactaccggtgctgctagtggtagtagggcaggacgacgtacgaataacatggtgatggcctctcttcctccactccgatgcgatgcgagtgtgcgacgcaggggaggggagaagagtttttgaaggatgtgaccagttgctgttgtagttgttgtcaagtacgtagtaatgaaacgagaattgctgcgtggcaattcaggcctgttttttctttttgcatcaaggaaaaataagtgctggtacagatgagattattttaactagaaccaagttacttgccagtaaaataagaagcttccatataaacttgaaacaaaagaaaaaggagacacgattctcagttcaacctttatggattctggtttcttgtcgtcttcttttcttaatgcaaacttgtaacaagtatgttttgttagaaactattttgtgaatggggtttctagctgagttgcttaattagatggtctgagtagtattcctaagatcataaagatgctttaactgatttcaaaaaaaaaaatctcatttaacccacgacacaattacaagtctaagacttactgactaagtttgacgggaaacatatcctgtgctcatggagctcttgtgctcata

SEQ ID NO: 3000 - DNA, 1501 bp, Zea mays
cattgggtacctcgaggccggccggggcaagaatccagcgagccaacaaggcaacaacaaacacctccctccttcttcacttccctgccgttgttgcaggaagcaagcgagggcacacaaaccgacaaggccgcccacgcgcgcgtcggccgccgccgttgccgaccagcaggcaggcagcatggtcgtgaacaacaaggtggacagcctgtcgtacgacgtcgaggcgccgccgccctctgccgccggcgccgccgcggggcaagcgccaccgccggcgtcgccagctccggcgccggcaccggcaacccacgcgcccgtgacgcgggaaggcggcgcggcgtcggtgctggagctgcacaaggtgtcgctgccggagcggcggacgacggcgaaggcgctgcggcagcgcctggccgaggtgttcttcccggacgacccgctgcaccagttcaagaaccagtcgtcggcgcggcgcctcgtgctggcgctgcactacttcttccccatcttccagtgggggtccgcctacagcccgcgcctcctgcgctccgacctcgtcgccggcctcaccattgccagcctcgccatcccgcagggaatcagctacgccaagctcgccaacctgccgccaatcgttggcctatattccagcttcgtgccgccgctcatctacgcgctgctggggagctcgcgggacctggcggtggggccggtgtccatcgcgtcgctggtgatggggtccatgctccgggacgccgtgtcgccggacgagcagccgctcctctacctgcagctggccttcaccgccaccttcttcgccggcgtcttccaggcgtccctgggattcctcaggctgggcttcatcgcggacttcctgtccaaggcgacgctgacgggcttcatgggcggcgccgccgtcatcgtgtcgctgcagcagctcaagggcctgctcggcatctcccacttcacctcccacatgggattcctcgacgtcatgcgctccgtcgtcaaccgccacgacgagtggaagtggcagacgatcgtcatgggctccgccttcctcgccatcctcctcctcacgcgccaaatcagcgccaggaacccaaagcttttctgggtatcagcaggtgctcccctggcgtcggtgatcatctccaccatcctctccttcatctggaaatcccccagcatcagtgttgtaagcatcttcagttccattgagacctcaccaatcattattcgtcagttcatctctgtaaaaaaacttttgtgtgctgtgtaaacacagattggcatcctccccaggggagtgaaccctccttcggcgaacatgctcagcttcagcggctcctatgtggcgctgacgatcaaagccgggatcatgacaggcatcctgtccttaacagaaggatcgcagtgggcaggactttgcgtccataacaattaccagtggacggcacaggagatgatggcgatcggctgatgaacatgcggctct

SEQ ID NO: 3001 - DNA, 2139 bp, Zea mays
taaagttcctaaataggccctcagtgttcctgtaagcctcctcttctcatattctatatacagtacgtactagtactacaacacactagctagctagtcagtcaaagtcgattgcacggatgcacacgcagtcacggtcacgggcttgagaatgaacgatggatgaccttagcaggcagcagctgttactctcatgttattaattatctgtgtgaggaaaacgaagggacacagccacccaccgcaacacaggggaatgaatggatgcattccacttgaccgttcgttccaatccagcgcttgacagtttgacactaggtagaacgccatcgaccacgctccgcactctataaatagagggaaggcctccactctcctctgcgggagataccagtaaacggcgacgaagacaatcctctaccaagaagaggactgatcgagtgagagagatggacggcggcaagggcagcgggattggtggcaatgtcgtaggaggaggcggtgatggcaagagcggcggcggcgctgtcaagggaggaggctccaactccgtgggaggcgcaggctctggcaactcaggtggcggcgttgcgggacatggtgatggtgcagggaagtcgggctccggcggcgacggcatgatgaaggctcccggcggcggcggctacatcccccgctccgacttcgaagccaacccgaaggagttcttccagggcctccaccagcagggaggaggaggcaaaaagtagatccatcgagctagatgctagctagctagctgcttgttgcatggcaagctagcgtgggatttgtgatcctgaatgaatgtatggaccgtcgtcagtctccgtagcctctaaataaaatgttaagctgctcgatcgtttctgggtatcatttgctcgcatgtttacgatagaagtttattatatgtcattaggcaggctcgtacgtcatcagctatttacccgatatatttcgatatatcctgttatatccatatatatcccaatatttgcacttttggagaatcctagggataaatctcttatctcgctatttaaaacaatggttcgattgagttagttccagaaaaaaaaatcttaccgccattgttttcttatctgataattcagctactagaagctcattgagttgggttagtggatggcctagtgcatgtacatatgtctcgtttgctcagttaatcagtttattgatgagaaaccagtgtaggagaacatgcaataatgttgagatgtgttcctttaggctgagatcaaaaaagctctcattaaccacattttatttcccggttttgatgctggccatatacatatggaaataatactttcaatttcatcccgttgtcctgattgattttcttataggcatcttgtatagctcaccttgtaatgcctgattctcaacatttcagtgatatgtagtatcgaacagctacaatccaatctgacccaactactgttgttttagttccataaacagaaaatcaatgcagctaattgtttcgaaattatatataatgtgttgttaactgaatgatcttgaaagacatgtcgtgttaactgagtgacacttctattctaaaaggcaaatgatctgaatgacatgtgatgttaattgaattgtcttttttaagtgaatgacatttgagtataaggttcatttttcttatatagtactgctactgttatttaatactattaccgacatcattggaaaacttgttcttttttccacctcgaccataattggtgtttataactgatggcttgtgttcacaaaaaataactgatggcttgtagaagtttataactgatttcaccattgttttgataatgcaggtgtttgatatcacaaaaatatctcattgtgtaagaaggatagttcttattcttatactcatctagtttctgtgttcttgggtctcgtgctattcaagagtgaataatgcataatttctgtatgaatctttatatgggttgattatatgtaagttaagatcagaataaatgtgtgattttgtaagttgcttggaacatatatgggctgatgtttagaatatgtggtcgaccggtggcgctgatttgaatatttggttaatcagtgtttgatttt

SEQ ID NO: 3002 - DNA, 766 bp, Zea mays
tgttctgatgatagctttttcaagaacttatgctagcattttcaagaactctctctctctctctctctcgctcactcactcactctgagtttgtgtgtttccatccattcctcctcttttccccattaacaagttcttgttaagcatgcattgctagtatgatgatgcgagccgccgcccgggcaggcgcgcgggggcgggagataccagtaaacggcgacgaagacaatcctctaccaagaagaagactggtcgagtgagagagatggacggcggcaaaggcagcgggattggtggcaatgtcgtaggaggaggcggtgatggcaagaacggcggtggcgctgtcaagggaggaggctccaactccgtgggaggcgcaggctctggcaactcaggtggcggcgttgcggggcatggtgatggtgcagggaagtcgggctccggcgccgacggcatgatgaaggctcccggcggcggcggctacatcccccgctccgacttcgaagccaacccgaaggaattcttccagggcctccaccagcagggaggaggaggcaaaaagtagatccatcgagctagatgttagctagctagctgcttgttgcatggcaagctagcgtgggatttgtgatcctgaatgaatgtatggaccgtagtcagtctccgtagcctttaaataaaatgttaagctgctcgatcgtttctgggtatcatttgctcgcatgtttacgataccagtttattatatatcattatcaggcccctt

SEQ ID NO: 3003 - DNA, 746 bp, Zea mays
gcgggcccggcccttcggcgccgcctcgttacagacagcgggagcgaaagagcaagcggcgagagaactccgggagagggcggcgagatggtgcagcggctgacataccgaaagcgccacagctacgccaccaagtcgaaccagactcgcgtcgtcaagaccccaggtgggaggcttgtctaccagtacaccaagaagcgggcgagtgggccaaaatgcccggttaccggcaagaagatccaaggaatcccacacctgaggcctactgagtacaagaggtccagattgtcgaggaacaggaggactgtgaaccgtccttatggtggtgttctgtctggtcctgcagtcagggagaggatcatcagggcgtttttggtggaggagcagaagattgtgaagaaggtgctgaagatccagaagaccaaggagaagaccaccaagagctaaacaactgggcgagataggcgtcgcggtgatgttttgtgtttctccgaatttgttttaagcaatcaagaattttctctcttgggatttgcagaatcctggttctagtatgtgaggtttgatgtgcttctctagattttgcgcgctggttctctatggatgcttagcctttgatgcgtgagctttcgggctccaattcggcttagatgctcttgagctgcttagctcagttaacgctgtcaggctttatttgtcacacgagaacagtttgctgcgccctattctgctttcatgcatttttg

SEQ ID NO: 3004 - DNA, 1411 bp, Zea mays
aaatacaaaaaagggggaaaaaaaaaaaaaaaaatttcaaaaaaaaaaaaaaaaaaaaaaaaaacgccgggccggaccatctctcccgttgtcgtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctggggtaatcactcgtccagtcagtaccctgatgttaaccacgccactgtgaagactcccagtggagagaagcctgttcgtgaacttgttcaagatgatgaatggctaaatggggagttcattgccactgtccagcagcgtggtgctgcaatcatcaaagcgaggaagctctccagtgctctctctgctgccagctcagcttgtgatcacatccgtgactgggttctgggaaccgctgagggaacatttgtttccatgggtgtgtactctgatggttcatacggtgtgcctgctggtcttatctactccttcccagtaacgtgcagtggtggtgaatggacaattgttcaagggctcccgatcgatgagttctcgaggaagaagatggatgccaccgcccaggagctgtcggaggagaaggcgctggcctactcatgcctcgcgtaaatccacattcgaagggcagctgctcctctgatgttttgaataaatgaaaccttccgctccttagaaactctcgtctccacccagaacagccgcacatcgcgatgcatgctccttttcgctggttttcccagtgtgtatgaatgaggcttgtagctccccttttgcctgatgatttacaggacagtacatttgctggaaggatgaaacaatttgacacctgattagaatcaacttgtttttctcttagagcatctac

SEQ ID NO: 3005 - DNA, 2826 bp, Zea mays
  misc_feature (2805)..(2805): n is a, c, g, or t
  misc_feature (2809)..(2809): n is a, c, g, or t
  misc_feature (2821)..(2821): n is a, c, g, or t
  misc_feature (2824)..(2824): n is a, c, g, or t
ctgcaggtactcttctcttgtagatatactacaaggttgtgacttcttaactgagcttgttcttaggatagagtttggccttgattccaccctttctctcgccccggatcgggcaagcaaaaaactagagataatccgccgagaaaggaggaggaacatcgaaatgttagaatctctactaaaagatacagctgcaaagatttttctagcaggtgggattgataaccctctggtcaccaagcgccgttctaggatgtgtgttggtgtgaaagcttcacacaagcatttgatgcctggtggaatcgttctaagttccagtggctctggcgcaacatactttatggagccacaggatgctgttgagctcaacaacagggaagttaaactctcaggagaggagagagcagaggaactggtagtattgagcttgcttacctcaatgattgcagactcccaactgaagatcagaaatttgatggacaatgttttggaattggaccttgcttgtgctagagggtcgtatgccctatggacaaacagtgtcagaccaaccttcactgatagttataccattagccaatcagaccagtgcaatgactattcaatttatattgagggcattcgccatcctcttctacttgaacagtctcttatggcagaagaatcaactacagaagcatctgaaatgcctgttccattggacatgtgggtcaaaaagaatgcaaggatagttgtgatctctggacctaacactggaggcaaaactgccactatgaagaccttggggctgtcctcgcttatgtcaaaagctggtatattcttcccagccaaaggaaggcctaggattccatggttcgatcaggttcttgcagatattggtgatcaccaggtagtctctgtcctttgatgagaatttctctagtcacttgtgggacaataagcttattgatgaaaactattttttggattgaagtcgctggagcacagcctctctacattcagtgggcacatatcacgtctgcgcaagattgtagaaatggtatcaaaagattctctagttctaattgatgagattggcagcggcactgatccagctgaaggtgtagctctttcaaccagcattttgaagtatcttgcaagtagagtgaatttagccattgtgacaactcattatgctgatctaagtcggctccagtcagttgataaccgattcgagaatgctgcaatggaattttgtgtagaaactctacaaccaacataccgaatcttatggggcagtactggtaattccaatgcacttagcattgcaaagtcaattggttttgatcaaaaagtgcttgatcgcgcacaagaatgggttgagaaactactgcctgataagcaaaaggagcggcaaggtttactttatgattctctcgttgatgaaaaagaacttttggaatcccaggcaaatgaagctgcatctgttctttcacaggttgaggggttgtaccatgagattcgcttcgaagctgatgatctcgaaagcagagtagctgcattgagagcaagagagacccaaaaggtacaacaggaattgaaggttgtgaagtatcggatggacaccataatcaagaactttgaagctcagctaaagaattcaaaacttgaacaatacaattcgctaatgaggaaagcagaggctgccactgcttccgtggttgccgctcatcagccaagcgaaatagctttcgatgatgacgatgaaaaccggatctcgttcgtcccacaagttggagacaaagtgtatgttcaagggctgggaggaggaacgatggctaccgttgtcgaaactctcggagaagatgagagctgtatggttcaatacggaaagataaaggttcgagtcaagagaagcaggataaaactggttcaaagaggcacaaataacgaggcaacaacttcctcttctgtaaaagcaaagggccgaacaccgaagcagcgatcggcaacgacgacggacgtctccttcggccccgtggtgcagacgtccaagaacacggtggatctgcgcggtaagcgggtcagcgaggcggccttcgagctccgcatggccgtcgacgcgtgcaggccgtaccaggtgctgttcgtggtccatggcatgggcaccggggcggtgaaggactgcgccattgacgtcctccggaagcaccctcgcgtggccaggttcgaggacgagagccctctcaactacggctgcaccgtcgcctacatccagtgaacgggtgggtacaggcagactgtttggaactgaacgcagacatttcagtacagaaatcagtttggttttgccttgcctaccagctcccagcgtgtccttgtcacagttgccgaatgccagttgggtgagctttttgctagtagctgatctgcgggtggatcggataaatggccttggcagttgtgatcagttcggccggcgtcctatgcattggcatcgcaaaatcaccagcggaagcaaggtgtgcgtgcacatgcgcgcctcttctttccagcaggattttgtgtagcgagggctgatgtggccaggttcgtgatgagccacgagacaaaatactcgtggctagtcagctcgttcgacttgttttagttttgtcacaagttaagctagcatcttagctcgatttgttacaagccagctcgagctaagcttgttagctcgaatgatctagcatttgtaaggataaactaataagtgataaactgtattaattaggtgttgtatttatgtggtatatgaaattacaagtactattactctaaaanaaanaaaaaaaaaaanaanaa

SEQ ID NO: 3006 - DNA, 932 bp, Zea mays
ccggccgggctgtgcatcgccggacggaaccattgggtacctcgaggccggccgggcccgtcccgtcccgtcccccgagagcgagagggcggcactggtgacgtcattcacctctcggtcgcgtgcgcttcacgcagcggctcagtcagtcctcacaccacgcatctgattctgatcgcaccgccgtcggcccaccgcttcagttggcagttgcgagtggctccaacaatccaccggcaccaacccagcgcggcgccaccggcgacccgtaccccctcccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagatcaagttccaggccaagtaccccgtcgtcgcccgactcgccgccgacgcctgaactcgtcagtctcggtctaaatttactctgtcctgcctcttgcggtgttcagtgctgtgcttgcttgcttgttgctagttgctttgctacccaataatctgaatggaaggacgtatgtgatgtgcctgctgaatagttcctagtccttgcatacactgctgtgctaccacatgacatgatgtactcgtgtgtgtgctttggttgttgtgtaattccatgaccatgatcagtaatctgaataaaaaatattggagatgtgcttgcttcctaaaaaaaaaaaaaaaactctaccatattcttaatgaaaaaaaaaaaaaaaaagcccgc

SEQ ID NO: 3007 - DNA, 945 bp, Zea mays
cgggatgtactgtacatgtggcccttgtcgtttcaccgtcccgtcccccgagagcgagagggcggcactggtgacgtcattcacctctcggtcgcgtgcgcttcacgcagcggctcagtcctcagtccgcacaccaggcatctgattctgatcgcaccgccgtcggcccaccgcttcagttggcagttgcgacttgcgagtggctccaacaaggcaacacaatccaccggcaccaacccagcgcggcgccaccggcgacccgtacccccttccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagaccaagttccaggccaagtaccccgtcgtcgcccgactcgccgccgacgcctgaactcggcagtctcggtgtaaatttactctgtcctgcctcttgcggtgttcagtgttgtgcttgcttgcttgttgctagttgctttgctacccaataatctgaatggaaggacgtatgtgatgtgcctgctgaatagctcgagctcctagtccttgcatacactgctgtgctaccacatgacatgatgtactcgtgtgtgctttggttgttgtgtaattccatgaccatgatcagtaatctgaataaaaaatattggagatgtgcttgcttcctaaaaaaaaaaaaaaaactctaccatattcttaatgatacgtaaaaaaaaaaaaaaaagcggccctcgagctcca

SEQ ID NO: 3008 - DNA, 862 bp, Zea mays
gccggccgggttctcacccgagagcgagagggcggcactggtgacgtcattcacctctcgatcgcgtgcgctccgcccggcggctcagtcagtcctcacaccacgcatctgattctgatcgcaccgccgtcgtcccaccgctgcagttggcagttgcgagtggctcgaacaaggcaacacaatccaccggcaccaacccagcgcggcgccaccggcgacccgtaccccctcccccggagagcgatggcgacggagctgacggcggcgcagctgcgcgcgtacgacggcaccgacccgtccaagcccatctacgtctccgtccggggcaaggtctacgacgtcacctccggccgcggcttctacggtcccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagaccaagttccaggccaagtaccccgtcgtcgcccgactcgctgccgacgcctgaactcggcagtctcggtgtaaatttactctgtcctgcctcttgcggtgttcagtgttgtgcttgcttgcttgttgctagttgccttgctacccaataatctgaatggaaggacgtatgtgatgtgcctgctgaatagctcctagtccttgcatacactgctgtgctaccacatgacatgatgtactcgtgtgtgtgctttggttgttgtgtaattccatgaccatgaccagtaatctgaataaaaatattggagatgtgcttgcttccgacaaaaaaaaaaaaaactctatcatattcttagcta

SEQ ID NO: 3009 - DNA, 2268 bp, Zea mays
ctcctctcctctgcccctaacccgtccgttccggctcatccgccattttttccctgtcgcggtaagcgatagggttcggcgtccgtcttctaaatccgcccttcttcgtttcgatttttccggcgttctgggagcaagcttcggcttcatcgacggcgttcttggtcttttgcggcttgacatctctggctgccctatgatcacggacaagggcctcgccgcggttgctcagggttgcccggaactgaagtcgctcaccatcgagggatgctccggtgtggccaacgagggtctcaaggctgtaggtcgtttctgcgccaagctacaggcggttagcatcaagaattgcgccctcgccgccgaccagggtgtgtctggcctcgtctgctctgcgaccgcctcttcgttgacaaaggtccggcttcagggtttgaacattactgatgcttcccttgctgtgatcgggtactacgggaagtcaatcaaagacctgaccctttctcgcctccctgctgtcggtgagaggggattctgggtgatggccaatgccctgggcctgcagaagctcaggcgaatgactgttgtctcctgcccgggactcacggatcttgctcttgcatctgtcgccaagttcagcccaagtttgaggcttgttaacctcaagaggtgcagcaaggtctcagatggatgtctcaaggaatttgcagaatcatctaaggtcctggagaacttgcagatcgaggaatgcagcagggttactcttacgggcattcttgcgttcctcctcaactgcagcccaaagtttaagtctctctccctgtccaagtgcgtcgggatcaaggacatctgctccgcacctgcacaacttccggtatgcaaatcactacgttccctggccatcaaggattgcccaggcttcaccgacgccagccttgccgtggtgggcatgatctgccctcagctggagaacgtcaatttgagtggccttagtgcagtcaccgacagcggcttccttccactgataaagagttcaaacagtgggctggtcaacgtcgatttgaacggttgcgagaatctcacggatgcagctgtttccgccttggttaaggcccacggcgcttcccttgcgcacctcagtctcgagggatgcagcaagattaccgatgcaagcctgttcgccatctctgagagctgcagccagctcgccgagctcgacctttcgaactgcatggtcagcgactacggcgtcgcggtcttggcagcggcaaagcagctcaggctgcgcgtcctctcgctgtccggctgtatgaaggtcacccagaagagcgtccctttcctaggcagcatgtcttcgtccttggaggggctgaatctccagttcaacttcattggcaaccacaacatcgcgtccctggagaagcagctctggcggtgcgacatccttgcttagaggaacacggcggttattcgtcgctggagatgctaggtcaaccttctccggatgcaaatacacgaccgaagcagtagtttagtactcaagtctatgctctgtagttgagtctggtttccggctcgtgtttgtgtcatggtgggtcttctgttcgtcgtcgtcctagggccagttgttttccgaggggggtgtttttttccggaggctcatttttttgcaggaatcctcctgtgaggatctctgtttcttgagcctttggcagccattgctatggcactctgcccccttttgtcccaaactaagccctcgtgatcagtcgttccaccatgcagtttctcaagttgtgtttgaaacccaagtatctgtgtcaagtgtgtgttcttttccggtattcctggttatagagctgcagacatcaacactcttttgattgcaattgtagcaagtccagttgtcggtggttgcaactctccatccagaattgcagacatcaacattcttttgagtgcaattgtatcaagtcccaactgtcggtgtctccattcagagaaacttagctccatgtctttgatgtctgggtgcctgcaatcttgccgagtgcagtgtgttgttggccatgggcggaagtgtcggtatggtttgcctatgtgcttggggatctggcctttgcaaggttcattctacagagccttttgccttcacagccctgtgtggttgtttttcttctgcagagacctgattttgacaggcaggtggtttaaacactgtaatatttgcaaccttcctctgaagataaataaaggttgtgtttcggttct

SEQ ID NO: 3010 - DNA, 3096 bp, Zea mays
  misc_feature (20)..(20): n is a, c, g, or t
  misc_feature (812)..(812): n is a, c, g, or t
cgtcgcctgatttgcatcantacagtgcatctcctctacctcagacagtgagacggagaggtaagattcaatgaacccagcagatccagaagggaaggggtacgaattgcgccaacttgggcaacttgcctcccgggttcgccaccacataaaacgccggcgccaccgggcactccttccccaccccaccaccacctcctctcctctgcccctaacccgtccgttccggctcatccgccattttttccctgtcgcggtaagcgatagggttcggcgtccgtcttctaaatccgcccttcttcgtttcgatttttccggcgttctgggagcaagcttcggcttcatcgacggcgttcttggtcttttgcggctcgacatgtctccgttccagggatacagaggtaaaggcctttgcttttggctaaggggttgatgatttgcagttgccgctttggggattggattcccttttcgtgtgttcttacccctcgtttcttcgattaggcgatgcggttctctccggcgtccggtcgcggaagcgcgtgttcgcgacggcggccgcggagcccgtgacggcggcgcccaagaggcagaagcgcggggatgagatgcccctggacgcgctgccggacgagtgcctcttcgaggtcctgcgccgcgtgcagggcacccgcgcgcgctgcgcgtcggcctgcgtctcccgccgctggctcgcgctcctcgccggcatccgcgcctctgaggccgtgctggccccggccgcccccgccgtgccggacctcaaccaggagtacctcagcgaggacgacgangccgatctgatggacctggacggcgacgcccgcgagaggaccctcgagggcatggaggccacggacgcgcgcctcacggcggcggccgtcgccggccgtctggctgccgtctccgtccgcgggagccaccccgcgcgtggcgtcaccgacgccggcatctccgccctcgcccgcggctgcccagagctccgctcccttaccctgtgggatgtcccgcaggtgacggacgccgggctcgccgaggtcgcggccgagtgccactcgctggagcggctcgacatcactggctgccctatgatcacggacaagggcctcgtcgctgtggctcagggttgcccggaactgaagtcgctcaccatcgaggcctgctccggcgtggctaacgagggtctcaaggcaattggccggtgctgcgccaagctacaggcggttagcgtcaagaactgcgcacatgtcgacgaccagggtgtgtctggcctcgtctgctctgcgacagcctcgttggcaaaggtccggcttcagggtttgaacatcactgatgcttctctcgccgtgattgggtactatgggaagtcaatcaaagacctgaccctcgctcgcctccctgctgtcggcgagaggggattttgggtgatggccaatgccctcggcctgcagaagctgaggtgtatgactgtcgtctcctgcccgggattaacggatctcgcccttgcatctgtcgccaagttcagcccaagcttgaagactgtgaacctcaagaagtgcagcaaggtctcagacggatgcctcaaggaattcgcagaatcatccagggtcctggagagtttgcagatcgaggagtgcagcaaggttactcttgtgggcattcttgctttcctcctgaattgcaaccccaagttcaaggcgctctccttgtccaagtgcatcgggatcaaggacatctgctcggcacctgcgcagctcccagtatgcaagtcgctgcgttccctgaccatcaaggactgcccaggcttcacggacgctagccttgccgtggtgggcatgatctgccctcagttggagagcatcgacctgagcggtctcggtgcagtcaccgacaacggcttccttccgttgatgaagggttcggagagtgggctggtcagtgtgggcttgaacggctgcgagagtctcacggacgcggcggtttccgccttggccaaggcccacggcgcttctctcgcgcaccttagcctggagggatgcagcaagatcactgacgcgagcctgttcgccatctccgagagctgcagccagcttgccgagcttgacctttccaactgcatggtgagcgactacggtgtcgcggtcctggcagcggcgaggcagctcaagctgcgtgtcctctcgctgtctggctgtatgaaggtgacgcagaagagcgttcctttcttgggcagcatgccttcatccttggaggcgctgaatctccagttcaacttcatcggtaaccacaacatcgcttccttggagaagcagctctggcggtgcgacatccttgcttagagggaacaagggcgacatctccgtagcggtagcatatacttaagtctaagcctcgttagttgagttagagtctggtttctggctcgtgtttgtgtcttggtggggggtctctcccgtttgtcttagggccggttgttttccgaggggcgtatttttttgccgaggctcggtttttttttgcaggtatcctcctgtgctgtgaggatctctgttcgctgagcctttggcagccattaccatgtggtggcaccttgcccccctcctccataccaacctaagcccttgtgatcagtcattccaccatgcagtttctctcaagtcagtgtttgaagctctcaagtattctgtcaagtgcgcgttcttttccactgctcctggatcctggttatagagttgcagacatcaacactccctttgattggtaccgtagctccgtgtctttgatgtgtgagtgtctgcaaatcttgctgctcaagtcagtgttttgttggtcatgggtgtgtggttgctactttgcggtgtccggttagggtgttcgttctgcggagcctttgccttgacaaccctgtgtggttgtttttcttctccggagacctgattttgcaggctggtggttggaacaccgtaatatttgcaaccttcttctgaagataaataaagcttgtgtttctgttctgaaaaaaaaaaaaaaaaaaaaaaaacccaaaaaaaaaaaaaaaagaaaaaacacaaaaaaata

SEQ ID NO: 3011 - DNA, 973 bp, Zea mays
  misc_feature (1)..(1): n is a, c, g, or t
ngccacgcccacccagcccagcgagcagcagtcgccgcccaacctcacgctccgccccgccgcgttcaaggccgtcaacgacatccgcgcccgcctcgaccaggcctgcggccgcgtcgtctcctgcgccgacatcgtcgcgctcgccgcacgtgaatccgtcgccctgggtggcggcccggcgtacaagttgccactgggcaggcgcgacgggctggcgccggcatcgaacgccgccgtcctagcggcgctcccaccgccgacgtccaaggtgccgacgctgctgtccttcctggcgaagatcaacctggacgtgacggacctggtggcgctgtcgggcgggcacacggtgggcatcgcgcactgcggctccttcgacaaccggctgttcccgacgcaggacccgacgctgaacaagttcttcgcggggcagctgtaccggacctgcccgaccaacgcgacggtgaacacgacggccaacgacgtccgcacgcccaacgccttcgacaacaagtactacgtggacctgctcaaccgggagggcctcttcacgtcggaccaggacctgctgaccaacgctaccacgcgccccatcgtcacgcgcttcgccgtcgaccaggacgccttcttccaccagttcgtctactcctacgtcaagatggggcaggtcaacgtgctcacgggctcccagggacaggtccgcgccaactgctccgcgcgcaacggcgccgctgctggtgacagtgacctgccgtggtcgtccgtcgtcatcgagaccgtcgcggacgccgccggtagcctcgtgctctagataataagcaaataagcagtttgaagcttgcttcgcatgcatgttgcaacaaataagcagctagtagcgatcgatcgattggaaataaagcagctagtagcgatcgttattacagaaaaaaaaaaaaaaaaaaacccgacgaaaactagaacttgctctgca

SEQ ID NO: 3012 - DNA, 1121 bp, Zea mays
ttgggcaccgccgggccggccggggcatgatagcccatttcttaggtttcggcgcctcagtgggacgaaactcactggctccctctcctcccccagtccgcggcgctcgctccgttcacctcggccgcggcgaccttcgaggcgacgagacgatgctgcggctctcccgcttcctcccctccgcctgcaggaggggttttgatctaaaagaatctctttggagtggttcattgacattccaacaagctgtttccactgcagcaacaaatcttgatgggaacttgtctggcaaaaagtttgcaagttataccgtgttcaagggaaaggctgcactttctatacatcctatactgccaagtttcagcaaattagaatccggaggatctcgagtgagcaaaaatggatcagtaatgctgaccttctttcctgctgttggacaaaggaagtatgactatacaaagaaacagctctttgctctgtcacctactgaagttggaagcctgataagtcttgggcctgctgaatcctgtgaatttttccatgacccatccatgaaatcaagtaatgaaggaacggtgaaaaaatcgctgtcgatcactccacttggcagtgacagtggatactttgttaatataaccgttgtgaacagtgcagagaggactaatgatcgtctttcagtccctatcacaaaagctgagtttgctgtgatccgcacaactctgagttttgcattgccacatattatgggttgggaccaggctttaaccaatcaccatccagctccagctcctccagctagcagcaggcccacggtagagcgtccacacccggattccgaatgggagaggtgaagctccctgctagaggatggaggcctttggctttgggcaccagtacaagttgctgctgcaaagtatgtgtgcttgaacaatctcttagaacactgtctgccgaccgcattagatttctggaacttaaggctagatgaagcacgatgaaccattgtatttgttcagtgcatgtataactatatcacgcctactaaaggcatatttctagtcgagtcgagctgttttacgcttgcttgtaaaaaaaaaaaaaaaaaaaaaactcgagactag

SEQ ID NO: 3013 - DNA, 1193 bp, Zea mays
  misc_feature (12)..(12): n is a, c, g, or t
ggtacccctcgnggtctcggcaggatgatagcccatttcttaggtttcggcgccttggcctgccgcctcagtgggacgaaactcactggctccctctccttcccccagtccgcggcgctcgctccgttcacctcggccgcggcgaccttcgaggcgacgagacgatgctgcggctctcccgcttcctcccctccgcctgcaggaggggttttgatctaaaagaatctctttggtgtggttcattgacattccaacaagctgtttccactgcagcaacaaatcttgatgggaacttgtctggcaaaaagtttgcaagttatacggtgttcaagggaaaggctgcactttctatacatcctatactgccaagtttcagcaaattagaatccggaggatctcgagtgagcaaaaatggatcagtaatgctgaccttctttcctgctgttggacaaaggaagtatgactatacaaagaaacagctctttgctctgtcacctactgaagttggaagcttgataagtcttgggcctgctgaatcctgtgaatttttccatgacccatccatgaaatcaagtaatgaaggaacggtgaaaaaatcgctgtcgatcactccacttggcagtgacagtggatactttgttaatataaccgttgtgaacagtgcagagaggactaatgatcgtctttcagtccctatcacaaaagctgagtttgctgtgatccgcacaactctgagttttgcattgccacatattatgggttgggaccaggctttaaccaatcaccatccagctcctccagctagcagcaggcccacggtagagcgtccacacccggattccgaatgggagaggtgaagctcccttttagcggctagacgatggaggcctttgggcaccagtacaagttgctgctgcaaagtatgtgtgcttgaacaatctcttagaacactgtctgccgaccgcattagatttctggaacttaaggctagatgaagcacgatgaaccattgtgtttgttcagtgcatgtataactatatcacgcctactaaaggcatatttctagtctctagtcgcaaaaaaaaaaaaaattgtggacgatgtctgtgcttggttacgcatcggcattttacgcatcacacgccaggaccaggatgcattaagagaaaccaaggaaatgggcattttagatt

SEQ ID NO: 3014 - DNA, 1922 bp, Zea mays
acttttaaagagaattagcatataaagatggcatgtttgagatatttaattatgttttattattacaatggttctttaatcctgctgtaggcctattacacgtgggacgctatatccaagaactcattattagaactacgtcgtggtaaccttatcttctctctctacggaacacacaccgtgtcgttctagcgttctcatcctccatccgcttgctcctgctccctcgagtcaaagcagtggatatggtggcgcgagcagcgagctagggaggctaggtagcagactagtgtcgctattaatcgtaccacgccgccgccgggaaattgcccttctccgccactgccactgaagctatactgtcgcagagagagcgcccaccacccgcggaccagacatctgcgatgaccactctggcgacggacacggcggcgtggacacgggaggaggacaaggcgttcgagaacgcggtggcggccgccgcggcgccgccggccgacgggccgcctgatgatggctggttcacggcgctggtggcgagcgtgccggcgcggacggcggaggaggtgcggcggcactacgaggcgccggtggagcccgtggccgctatcgaggccggccgcatcccgctcccgcgctacgctggggaggagtcgtccgcggcgacgcccgagggctccggtgccgccggcccctccacgcccaaggtcggaggaggagggagcgggcaccgacgcgaagaacggaagggcggcgtcggcgctgacgcggggaagagttgctctaaggccgagcaggagcggcgcaagggcgtgccgtggacggaagaggagcacaggttcgtactccgctccgtagcataaaaaaattccacgcgttcttgccttcaaataaagcttgcatctttcatgctaaaaacatggatcgatcgatgatgctgttgtgttggtgcctggtggcaggttgttcttgttgggtctggacaagttcggcaagggcgactggcggagcatctcgcgcccccgcgtccgctcgcggacgccgacgcaggtggcgagccacgcgcagaaatacttcatccgcctcaactcgatgaaccgggacaggcgccgctccagcatccacgacatcaccagcgtgaccgccggcgaggtggccacggccggcgcgcccatcacgggcggcggcccgaccgcggcgggggcgatgccgatggggccgggcggcatgaagcaccaccacccggttccgccgatgggcatgtacgggcacgcgcccatgggccacccggtcgccgggcacatggtggcgccggcggccgtcggcacgccggtcatgttcccgccgggccatcactcgccctatgtcctgccggtgggatacccggcgccaccgaccaagatgcaccagtgatcgtctacgaccggcatttgcgcagctgcgcagctgcatccctttgctcgttctttcttgatttcgttgatgatcttgtgtagccaaagctatctatccatcctttcctcatctcccgggtctttgttttttgacgtaacatatagatgacttgagcgagtgcagggcaggcaggcgaataatgagtatcgctacttacaggactcaaggaatgtgtaattagtagcagccttcctgggtgcaaatattcatcatttgtgcaactggggactgacagaatcccatttcccggatgtaaatcgattgtctataatatctcatctgtgcgaaatatgtgttcatcacctgttttggtttaggattgatttggttctactttttttccttctcaagcatctctgtttcagtttaggattgatttggttctccttttttttttccttctcaggcatctctttcagtttgagtttaggattgatttggtattgttttagtttcagtgcccatct

SEQ ID NO: 3015 - DNA, 1453 bp, Zea mays
ctctacggaacacacaccgtgtcgttctagcgttctcatcctccatccgcttgctcctgctccctcgagtcaaagcagtggatatggtggcgcgagcagcgagctagggaggctaggtagcagactagtgtcgctattaatcgtaccacgccgccgccgggaaattgcccttctccgccactgccactgaagctatactgtcgcagagagagcgcccaccacccgcggaccagacatctgcgatgaccactctggcgacggacacggcggtcgtggacacgggaggaggacaaggcgttcgaagaacgcggtggcggccgccgcggcgccgccggccgacgggccgcctgatgatggctggttcacggcgctggtggcgagcgtgccggcgcggacggcggaggaggtgcggctgcactacgaggcgctggtggaggacgtggccgctatcgaggccggccgcatcccgctcccgcgctacgctggggaggagtcgtccgccgcgacgccctagggctccggtgccgccggcccctccacgcccaaggacggaggaggagggagcgggcaccgacgcgaagaacggaagggcggcgtcggcgctgacgcggggaagagttgctctaaggccgagcaggagcggcgcaagggcgtgccgtggacggaagaggagcacaggttgttcttgttgggtctggacaagttcggcaagggcgactggcggagcatctcgcgcaacttcgtcatctcgcggacgccgacgcaggtggcgagccacgcgcagaaatacttcatccgcctcaactcgatgaaccgggaccggcgccgctccagcatccacgacatcaccagcgtgaccgccggcgaggtggccacggccggcgcgcccatcacgggcggcggcccgaccgcggcgggggcgatgccgatggggccgggcggcatgaagcaccaccacccggttccgccgatgggcatgtacgggcacgcgcccatgggccacccggtcgccgggcacatggtggcgccggcggccgtcggcacgccggtcatgttcccgccgggccatcactcgccctatgtcctgccggtgggatacccggcgccaccgaccaagatgcaccagtgatcgtctacgaccggcatttgcgcagctgcgcagctgcatccctttgctcgttctttcttgatttcgttgatgatcttgtgtagccaaagctatctatccatcctttcctcatctcccgggtctttgttttttgacgtaacatatagatgacttgagcgagtgcagggcaggcaggcgaataatgagtatcgctacttacaggcttaaggaatgtgtaattagtagcagccttcctgggtgcaaatattcatcatttgtgcaactggggactgacagaatcccatttcccggatgtaaatcgattgtctataatatctcatctgt

SEQ ID NO: 3016 - DNA, 1581 bp, Zea mays
ccggccgggcggtttcgctttcctgctcccatcttctcctctcccccctccgcgcccgggccaaagccatgcctccttcgacttctacttcccccaccacgtcacaacagggcctccacaccgcctccctccgcccccttccgcttgcgcccacgaaccctaaccctaaccccgtcgccgccgcgggacctacccggctagcactcgcaccgcgccttcggcgtcacattcggcgcctgcgctctccgtcctcgcgcggcgagccggggtgctagggttttctagatggatccacgccgcgcacccccgcggggcgggggcgccaacgggctctcttactccacgctgttcaatctcgagcctttgctgaacttcagggttcctgtaccggaagatcttgcccgctacgagaatagcagctcaaatgggagtccaagcagtgaaggtcagggatccttattggatcagtacaatggtgtaaatgatgcttcccatggcctgcaccggaagcggaaaaggcatcttgacggtgccagcgatgatgatgaggcagatgcctatagtaacaaaataactgaggagcaataccgtgctatgctcagtgaacatgtccagaagtaccggaggtcaaagttcaaggagggtgcttttagttctgatcctcctcgtgtggcaacccctcaattaaaacacaaaaatggtggtaaaaaaaatatgaagcgcataagtgatttcagcgatgatgtggcattagatgggatagaagcctcacatgaatataatgggatagagtgtattaaaactcatggcggttttaataagcttgttgcaactcttgattccacttatttagatatgggggatagtacacgttacttagttccagagggttatgataagttagcatcatccctcaatctccctgtttcttctgatatacgtgtcgaggaacacttcttgaagggcatgctagatttacgcaccctagcagcaatgcttggtactgaccaaaggtttgaggcttccaatcgtggtggaatatctgaacccctgccacaatttgaatctctcaaagaaagggtaaaggtgcaggaattttctcttcaagttaccaaggacccctttgcaattccggaaggatcagctgggaggatacgaaggtatattatatcagaagctggcgatttgcaggttcattatgttagagtcatggaaaaaggagatacatatgagattatcgagcgtagcttaccgaagaagcaaatagtaaagaaggaaccttcggtaattatgaaagaagagtctgaaaagacttacaaactatggcagtctcttgctacaaaaagcataccaaagcatcacaagaattttactgctttgataaagaaacgacaagtagatgcgaagcgcttctctgatagttgtcaacgagaggtaaagctcaaagtaagcaggtcactgaaactgatgaggtgtgctgcagtacgcacaagaaagtttgttaaggatatgcagatgttttggaaacgtgtagacaaagagcagtatgagttgaggaaaaaaaaaaaaaaaaaagcggcc

SEQ ID NO: 3017 - DNA, 2193 bp, Zea mays
ccggccccggcagaaatagacagaacgcaccctccagtaaagtccccatggctgctttctggttgctgctgctgttcgtcgccagcgcagtccttgttcttcgtacatggagagctcaaagcttcgtcaacaaggcgcggcaggcagggccgaggtacccgccggggctggagccgtacccgctgatcgggcacctgccacagttcttggctaaccggcaccgcgtgctcgactggatgaccgaggcgctcgcgcgccagacgaccacgtgcacgttcgtgctgcgccggccgggaggcgtgcggggtgcgatcaccgcgaacccggcgaacgtggagcacttcctgcgcaccagcttcgaccactaccccaaggggccccggttcgcgtcgctgctgcacgacttcctcggccggggcatcttcaacgccgacggcgaggcctggcgcgcgcagcggaaggtcgccagccacgagttcaacacgcgctcgctccgagctttcgtggcgcgctgcgtgcacgccgagctacacggccgcctgctcccgctgctgcgccgcgccgcggcgtccggctcccccctcgacctccaggacgtgctcgagcggttcgcgttcgacaatatctgccgcgtcgccttcgaccacgaccctcgccagctcccggacgatggtgacgacactgcggacagcagcttcgccgatgcgttccgcgacgctgcgaatctcagcgcgggccggttccggtacgcggtcccggggttctggaagatcaagaaagcgctgaacttgggttctgagaagcggctgcgggagtccatcgccatggtgcacgacttcgccgatcgcataatccagtcgcgccgggaggagatgttgagcgccggttttgagaagcacgatcttctgtcgcggttcatggcgagccaggacgagacctactccgagtccaaggtgcccctccgcgacgtggtgatcagtttcctgctcgcggggcgcgagaccacgtcctcggcgctcacctggttcttctggctgctgtcctcgcggccggacgtgcagcgccgcatccgcgaagaggtcgctgctgtgcgcgcccgacgggcacaggacgacgtcgatagcgtcgtcgggttcgatctggacgagatccgcgagatgcgctacgtgcacgcggcccgcgcggagtcgatgcggctgtacccgccggtgccggtgaactcgctgctggcggagacggacgacgtcctgccggacggcacagccgtgcgtgcagggtggttcgtggcgtacaattcatatgggatggggcggatggagtcggtgtggggcgacgacgcgcgggaataccggccggagcggtggctgaaccccagagacggaacgttccggccggacagcccctttcggttcgtggcatttcacgcggggccgaggctttgtctgggcaaggaaatggcgtacatccagatgaagtccatcgtggcgtgcgtgctggaggagctcgacgtggcggttgacggcgcgtaccggccccggcaggttgcgtcgctaacgctgcggatggcggacgggctacctgtgaccgtgaagcagagacgggactgacgagctgctgtcacaaacctgcaactccatcagccacccatgaagcctctgcagcagcacaaggcaggcaaagctgttgttcaccgacgagcctgaacaaaactgtggtttgctcaatgcgcttgtctctgaaccaatgttttcaaatcgtctcattaatcgtggatagtcgcgattaatcgtccaagtcagtttggaccaatcgtgattatcgcccacgcccaaatcatccgatatcacgactaatcgccctagtcggtcgaacgaccaacaaatcgtccgacttgaaaacattgctctgaacatttggaaatggtgtgccgcgtatacgtgaataaatccactaaattcgtctatttctctcggaaaaacctctcggttgcttaaagttcaaagttaattcgtataagatgcgaacaaaaatcaagatccagtctgaaattaaacacaagaatattcttaggctcttgggttgctgtttagatgtagaaattccaatgctggtctatgagtttgcacctaaatgaagcctctgcgacgtccttcatggtacccgacacacggcagggaaagcaaggtaatggtt

SEQ ID NO: 3018 - DNA, 1127 bp, Zea mays
ggacctcaagccggcgggaaaatcaaaagggggctcccttcgcctccgctcctggatcgattatctttggaataccctgagatgcggttcaggtttacctcgccacacccaaaggatttcccagatgagctactgtatttgatgcgggatagggataacatctgcaatcttattcacttaccagcacaaacaggcagtacagcggcgctggaacgaatgcggaggggttacactcgagaagcatacttagaacttgtccacaaaattcgtgatgtcattcctgatgttgggctaagcagtgatttcataactggcttttgtggagagacagaagacgagcacgccgagacccttagccttgtgagggctgttggatacgacatggcctacatgtttgcatacagcatgagagagaagacccacgctcaccggaactacgaggacgatgtacccgaaggtgtgaaacagaggcggctcatggaactgatcaacactttccgcgagaccacgaagaagaactacgactctcaagtcggcacagtgcagctcgttctcgtggaggggcccaacaagcgtgctcccaaaacggaagtgatagggaagactgatcggggccacaaggtgtcgtttgcccgcgtccctgtcccgcacacgttcgaaggcgaagaagcacgtgagccggcagtcggtgacttcgtcgaggtgagaattctcaggtcgtcgacagcaacgttgttcggggagccgattgcacgcacaagcctgagcgcgttccacagaaatgtttcacccggagcgcaggctgctgctgcgtgagtagcggttgaatttttggttgtggattgaaatatgtagtgatattttaaatgactagagtttttgatatagaggagaaactgagaacgtgcatgtcagcctcatgagccttggtcatttacttttttgataaggttgtattgccatgtaaaggtcaaacaatgttgacaaagttttttgcttgttactatgaagtatgaacgtcagcttgagatggctttttacagcaaaaaaaaaaaaaaaaaaaaaaaaaaaaaaaaaaaaaaaaaaaagggggcggccgttttaaaaggaatccaaaaaaaaaaaaa

SEQ ID NO: 3019 - DNA, 1313 bp, Zea mays
atccatcgcatctcgtgcagtgacacaagtgagctcagcaaagccaaccaaagttcagaagaagcgagcgagcaggaggacaggaagcaagtatggcgcactaccagcaggggaggcggcagcaagtggacgagtacggcaacccggtccctgggggccacggtgtccagggccagcagctgggtgaagccgccggcgggtacggcgtcgcaggcaccggcagctacggcggccagcagcaggccgggtatggccccacgggcaccggcacgcatgacgccgggggctacggcggctcgggccatccgggttacggggctaccggaacgggcgtccacgacgccggtggcccaggtgcgtatggagcagtcacaggcacgagagcccacggcactcatggcggcgtgaccgggatccaggacggcgccgccggcctcaccggtggtggtctgcatggcgcaacaggcatggggacgactaccggtactggcgcgcacggtgccaccggaatgctcgacacgggggtcttgggcggcggagggcacgcggccaccggcatgcccgccggccacggcacgcgtcccggcgccacaggcgtagctggaaccggcggcgcgttcccccatgcagctgagcacaagacgggcggcggcatccttcgccgctccggcagcagctccagctccagcagctcggtgcgtttcgttgctccatcgcattctcgttacctatttccattcccatgcacaccatgcatgtgtgtgcagtacctggttattacatgttctctccatgcagtcatctgaagacgacggcatgggtgggcgccgaaagaagggcctgaaggagaagatcaaggagaaaatgcccggaggccacagggaaggccagggccaggcgacggccaccggcgcgtacggtgggatagggtacgtggctgggccgacgaccggaggcccccacgagaagaagggtgtgatggagaagatcccaggcggccacaaggactacgaccagcatcagcacaccaccgcggcaactggcggcggcggtggctatggtggagccaccgacacgacgtatgggacgacgactgagggtacgcacgagaagaagggtttcatggagaagatcaaagagaaactccccggtcagcactaagcaactgcctctcccggccgaggactgccgataactacatgtatacagaataaacaaagcaatgaagaataagcggcacctacgtatgtgttgtgtgtttgcattgtaaccacctcagttcatgatcctgtgtgtgtgtttatgtgacgaag

SEQ ID NO: 3020 - DNA, 1574 bp, Zea mays
ccggccgggcctccagccggcccggcagcctccaatctcatgcgttcgaggaaaagccgaaaaggagaaagtaccccgttccgtcggccgcagtgccgcacctgcacccaccgcacgccgagtcacgccccccctggaccagccaacgtgacactccaccgccgccggcgccgcggcagcccgtagcaaccgccaccgcctgcccatctcctctctatcccgcgccgcatggccgcgtacttcaaccactcctcgtcctacccgccgccgcctcccccgccgggcacttccccgtacggcgcgtaccgccacgcctacccgccggcgccggcacccccggccgcttacggcgcctactacgaccgcgcagagcaggccctcccggcgcgggacgaggtccgcaccctcttcatcgctggcctccccgccgacgccaagccgcgcgaagtctacaacctcttccgcgatttccccggatacgtctcctcccacctccgcacgggcaaatcctctcaggcgtatgcgtttgctgtgtttgcagatcaacagtctgcactagctgccttgagtgccacaaatggaatggtatttgatcttgagaaaaattgttctcttcatgtagatctcgcaaaatccaattccagatcaaagcgcttgagatcagatgatacttcaccttattctcctgaaaaaagaaataggaaaccaaggggatttcctgattcaggtgctggaagcaatatttacatatctggaatgggtagtacttcacacagcttgagtggttatccttctgcacaaagttacacaagccttgagtctagtacttctctcagcaaggacccatccacatttgcccctcaaaataatcctccatgccctactctttttgttgcgaacctggctccagcttgttcagagcaagagctgatagatgttttctcaagttgtgcgggatttgtgaaactcaagatgcaaaacaagcttggagctccagttgcatttgttgatttcaaggatgcaatcagttcaactgaagccataaatcgtctccaaggagttatcctgtactcatcatctggcgagggaatgcgtttagaatatgcaaaatcacggatgggccttcggaagcgtgataagcacccctaagtgcagctgaaagacggcacgacagttgtattttcattcagcacaagcggcagctgagcatgctcaatgatgtctaatagcagacgacttgtcctgacacctgagtccaatgtcatcttcatgcagcgaacgttttgctcatgagttaggctatgaggtccttcagctgcgtaacattatgttacttggtctggttgtatcacttattattgcatgtgcacctctttttttcctccttcggaccttgcctcctagtcatcttcagattttaagctaggattatcccttatttacagttgagttattattagaatctattgtgcctgaaaggatcaatctgaactatcaatctgaacgagagggtgaattagttttttctaattttttttttaaataaaaaaaaaaaaaaaagagagggtcgcggt

SEQ ID NO: 3021 - DNA, 2267 bp, Zea mays
ctgtgcggcgctcgaggcggccggcttgggaatttctataccgccacaacaggtctgatcttttaattctgaagacaataaaacaggctgtggaaatgaggaatagcgtttgtcacagtgcaacaatatgtgccaatgcaatcatgcacgttgctgtcgctgtagatacctttctaagagagaacctggagtggttaagcagggcaaccaattgggcaaaattcagtgcaactgctggactaggtgtcattcatagaggtcaccttcaacaaggccgggctttgatggccccctacctacctcaaagtggtgcagttggcggtggcagtccatattcagaaggtggtgccctctacgcactaggtctgattcatgccaatcatggtgaaggaatcaaacaattcctccgtgaaagtcttcgcaacaccagtgcagaggtcatccagcatggtgcatgtttggggcttgggcttgcagctttgggcacatcagatgaggaaatatatgaggacataaagaatgtcctttacacagacagtgctgttgctggtgaggcagctggtattggcatgggcttgctcatggttgggaccgctagtgaaaaggctagtgagatgcttgcttatgcacatgatacacagcatgaaaagattataaggggtttgtcactgggaattgcactgacagtatatggcagagaagaggaagcagacaccttgattgaacaaatgactagagatcaagatcccatattacgttatggtggtatgtatgcattggctctagcctataggggaactgcaaacaacaaagccatccaccagctgctgcattttgctgtatcagacgtcagtgatgatgttcgcaggactgcagttatggctcttggatttgttctatacaacgagcctgagcagactccaagaattgtgtccctgctctctgaatcatacaacccacatgttcggtatggtgcagccttggctgtcgggatatcatgtgcaggatcaggattaagtgatgcgatttccttgttggagcctcttacatcagatgttgttgacttcgtgcgtcagggagctctcattgccatggcaatggtaatgatccaaactaatgaatcctttgattctcgtgttggagcatttaggcgtcagttggagaagatcattcttgacaaacatgaggacaccatgagcaagatgggtgccatattagcatctggtatcctcgatgctggtggtaggaatgttacaatcaagctcctctcaagaaacaagcatgacaaactcacggctgtgattggtcttgccgttttcagtcagttctggtactggtatcctctcttgtatttcatcagcctggccttctcgccaacagccttcattgggctcaactctgatttgaaagtgccaaagtttgaattcctgtcgcatgctaaaccgtctctctttgagtatcccaaaccgacaactcagcagactacaacttcaacagtgaagctgccagcagccattctgtcaacttatgcgaaggcaaaatctagggcaaagaaggacgcagaaagcaaagctaaccaggagaaggccacagaagaggcttctggttctacctcaagcaagacggctaaagctcaggagaaggatgctgatgcaatgcaggttgacaatgccagtgagaagaaagctcctgaaccagaagcgacttatcagctccttacgaatccagctcgcgtgatccctgcccaggagaagttcatcaagctccttgaaaacagccgatatgtacctgtgaaaccagcgccttctggattcatcctcctccgagacctgcagccgactgaggctgaggatcttgcgctgaccgatgcccccacaacagtcgcaggaagcaccggcaacactgcccctgctgcaggccaacaggggtcaggatcatcagccatggccgtggacgatgagccacagccgccacaaccctttgagtacacctcgtgagcgaccgagcgtcaccttttcttattcgttttttttttgactttttgagtatgtagtgtgcggaaatttgttgttggctggaagaccttttgtagaaacatgagtagagaattttacttgaattgaagctataggatcaacgttgggaatctgggatatagcccaggtcaaaacccgcgctcccgcctgtgatcttttttttcgtgcaatgcaaagtcgagttgacaaaaaaaaaaaaaaaaaaactcgagggggggcccggtacccaat

SEQ ID NO: 3022 - DNA, 1719 bp, Zea mays
cctcgaggccggccgggatacgttatggtggtatgtatgcattggctctagcctacaggggaactgccaacaacaaggcccccccccgccgccggcattcggctcgagcagatgccagtgatgatgttcggaggactgcagttatggctcttggttttgttctgtacaatgagcccgagcagactccaagaattgtatccctgctctctgaatcatacaacccacatgttcgctatggtgcagccttagctgttgggatatcatgtgcagggtctggattaagtgatgcaatttccttgttggagcctcttacatcagatgttgttgactttgtgcgtcagggagctctcattgccatggcaatggtaatgatccaaacgaatgaatcctttgattctcgtgttggagcatttaggcgtcagttggagaagatcattcttgacaaacatgaggacaccatgagcaagatgggtgccatactagcttctggtgtccttgatgctggtggtaggaatgttacaatcaagctcctttcaagaaacaagcatgacaaactcactgctgtgattggtcttgccgttttcagtcagttctggtactggtatcctctcttatattttatcagcctggccttctcaccaacagccttcattgggctcaactctgatttgaaagtgccaaagtttgagttcctgtcacatgctaaaccgtctctcttcgagtatcccaaaccgacaactcagcagactactacttcgacagtgaaactgccaacagccattttgtcaacttatgcgaaggcaaaatctagggcaaagaaggacgcagaaagcaaagctaaccaggagaaagcaacagaggaggcttctggttctacctcaagcaaggcggctaaagctcaagagaaggatgctgatgtcatgcaggttgataatgccactgaaaagaaagctcctgaaccagaagcaacgtatcaactcctgacgaacccagctcgggtgatccctgcacaggagaagttcatcaagtttcttgaaaacagccgatacgtccctgtgaaaccagcgccttctggattcatcctcctccgagaccttcagcccactgaggccgaggaccttgcactgaccgatgctcccacagcagttggaggaagcaccggcaacactgccacagctgcaagccaacaggggtccggatcatctgccatggccgttgacgacgagccacaaccgccgcaaccctttgagtactcctcataagcgtagatacctgggtccgtagagggttgtgttggtggtctgaacttgcgattcccctcgtcctttctataccttttgttatcttttttttttttactttctgagtatgtagtgtgcggaaatttgttgttggttggaagactttttgtaggctcgagaattatacttgagtcggctctataggatcatcgttgagaatctgggtgctcttatagctaagccccaacaaccctgattttatcctagccgtgaagtcatacatagagcctgggttattcatctgggttattcattgctgcggttttaatccaactatagcttctataatattttgtcttcatagattgcagctactacagtccgacgaccaacggaggtgttctttaggggcaatcatacctaccacatgggcatgtatattatgttgtatcaacaaacaacgatgtctagtatgaca

SEQ ID NO: 3023 - DNA, 937 bp, Zea mays
  misc_feature (156)..(157): n is a, c, g, or t
  misc_feature (175)..(175): n is a, c, g, or t
  misc_feature (194)..(194): n is a, c, g, or t
cattgggtacctcgaggccggccgggaagtttgagtcctgtccatgctaaaccgtctctcttcgagtatcccaaaccgacaactcagcagactactacttcgacagtgaaactgccaacagccattttgtcaaccggcgcgagggcaaaatctagnnggcaaagaaggacgcagnaaagcaaagctaaccaggnagaaagcaacagaggaggcttctggttctacctcaagcaaggcggctaaagctcaagagaaggatgctgatgtcatgcaggttgataatgccactgaaaagaaagctcctgaaccagaagcaacgtatcaactcctgacgaacccagctcgggtgatccctgcacaggagaagttcatcaagtttcttgaaaacagccgatacgtccctgtgaaaccagcgccttctggattcatcctcctccgagaccttcagcccactgaggccgaggaccttgcactgaccgatgctcccacagcagttggaggaagcaccggcaacactgccacagctgcaagccaacaggggtccggatcatctgccatggccgttgacgacgagccacaaccgccgcaaccctttgagtactcctcataagcgtagatacctgggtccgtagagagttggtggtctgaacttgcgattcccctcgtcctttctataccttttgttttttgttttactttctgagtatgtagtgtgcggaaatttgttgttggttggaagacctgttgtaggctcgagaattatacttgagtcggctctataggatcaacgttgagaatctgggtgctcttatagctaagccccaacaaccctgattttatcctagccgtgaagtcatacatagagcctgggttattctgctgggttattcattgctgcggttttaatccaactatagcttctataaattttgtcttc

SEQ ID NO: 3024 - DNA, 744 bp, Zea mays
gggaccgctagagaaaaggctagtgagaggcttgcttattttcttttttcacagcatgaaaagattataaggatggtgctgtttgattgctgtacagtgcttatgcacttgatcttaacaacaatcctctgacaattctctctttctccaggggtttgtcactgggaattgcactgacagtatatggcagagaagaggaagcagacaccttgattgaacaaatgactagagatcaagatcccatattacgttatggtggtatgtatgcattggctctagcctacaggggaactgccaacaacaaagccatccaccagctgctgcattttgctgtatcagatgtcagtgatgatgttcggaggactgcagttatggctcttggttttgttctgtacaatgagcccgagcagactccaagaattgtatccctgctctctgaatcatacaacccacatgttcgctatggtgcagccttagctgttgggatatcatgtgcagggtctggattaagtgatgcaatttccttgttggagcctcttacatcagacgttgttgactttgtgcgtcagggagctctcattgccatggcaatggtaatgatccaaacgaatgaatcctttgattctcgtgttggagcatttaggcgtcagttggagaagatcattcttgacaaacatgaggacaccatgagcaagatgggtgccatactagcttctggtgtccttgatgctggtggtaggaatg

SEQ ID NO: 3025 - DNA, 1622 bp, Zea mays
gtaccctcgggttcggccgggacggcatcgttctccctgcgctctctctctctcacactgcgtctttggctcctgctccatctcctttgctgcgaagctccgagctctgctcggccggatttttcatggcgcccagccccttgcgtcggccagcccctgccatggagccttcggctgtgcagctctctccctctcgcgtgccttggatttgtgccgcgccctgcagagctcccttggtgagcgcccaggtcgtccctctccggctctctctgctggcggctgagttccctggaagccgtgctctgctcgccatggatgtcgtccaccatggtgctcggtctagacgtcgattccctcgtcgcagtgagctccagccgattccttgcctcttccccgtttaaatcatggagcatcagccgctgctccctgtttccggcagccaagcccctgcgcgcgcatcctcccgcgcagtccccagcgccaccggccaacctcgccggccaagctccctcgccttcaatcctttagccgtcgcgcccctcagctcgctggccgtgacctcgccgaggtttttcccatggccggctcactgctcaacccaagccgaggtcttgtacgaaacagcaccttccatggccgctgcgtcgcgctccttgtgcttgcgcagctgaacgccatactgcgcagtgttttgtccgatgtcgagcttagctcagtctctgtttctctgcgcacgtcgagttccttgccgcgcgctgagctttctgtcggtctccaactcgccatggtgtccaactcctgtaccaaccgtgacctacgcttggtcttcccagctgcgttgacctgcgtcgacctctgctcgcttcgctcgggatgtcgtgctgggtcgctccatacttggtgcacacccagctgggcgtcgcgatgctgtgcaccatgcgtcaccagtcatcctcaccatggccagcagcttcaaaaatatggacgcctaagcctttttcctatctttcacgcccacctcggtcttcatcctcaacctttgccagaaatttggttaaatggacgaaccagaagatctccagaattttatggatgaagaagaaaataaagtcgaagagtgacgctcgctagatgctcgacgaaaggcgtgaaccgaagatttatcactattcctcaattgccgaattaaattttttttgaggtgagtgattcactgctcctccatgatagatcgaagcatggaatggtttcgtatattagatgcgataattttcttgtcgtggttaggatgtgttgtggctgtattaaatattcgttgatgtatcatatgtgcgatgtatgtttgaattggtgacgagaaggataggtctagtatttttattgactagccatcatatttttcaggattatgctagttttgtttattaagatgtagtcgatgctcgactctagtagtcattattttctatgttcggtgaccgattaaatgtcttaagttgatgaaaacgtagataaaaaaaaaaaaaaaaaggtagacgtgtaggtctagtacgcttgaatcagttctatgtttacgacgtgaagtataacgatgatgcgtggaataaatttagtatttactc

SEQ ID NO: 3026 - DNA, 2778 bp, Zea mays
cataccagaatttgtaggataagaatactgttagacatctaatggattgtgatgatgttataccctgataaccactttaattagtacttcccttaccttgttagttgttttattttgtttccccttaccttgttagttgtttattttgtttctcatgatgttgttagcatgtatcaagtgatttatgccacatgaatatccatgacctttaatgctgggtaaccatgtgatactttgctatttttctaaacagtgtgatttgcaacttggatttggtgtacagaagcagcatatattttctaggcatggagagcttagaacggctacagctcgatcccctctgcctgggagcatcgccaaaagaaattctgtacccactgaatcctcacagtttgagagcatggatgggcctaaatctttccccaatggaacatcgcagttcgggggctttgcaaggcctacctttgtgcctgctgcaccttctcagtttgggagcatggctcaacctaattatgtgcattcttctcaatcctctcaattcacaagcttggttcaaccgaattctgtacctcctgctgagtcctcgcagtttggaagcaaagcccaatctagttctgcaccccttgctaaaacctctcagttcaagggcatggctggaccaaattctgtacctcctgctgagccctctcagtttgggagcatgattagacctaatttggtacctcccgcatcttctcagtttttggggagcatggttcgaccaaattctgtaactccagaatcctcacagtttggaagcatgaccagaccaaactctgtacctcctgtatcgtcacagtttgttaacatgcccagtcaaaattttgtgagcgcatccgagccaactctagttttggggtacgcaccgcagattggaagtgaccctccacatcaagtccagttaggatgggatttgtccttgccaaggatggttactggcggcagcatggtcacttgtttatgtatatggtgcaacagtcagttccatcattttggccctgttgatggacagcaggctagttcttttggcttcatttgccccacctgtaaagataggatgtctggtcatcacagtatgcccagcaatggttcatggcagccttgaggtgcagtgctgtttgttaatcatctgcatttctgcatctgagggatctcgtggttttctgtacaccatgtctggcgactgttgaggacagaaaattgtccgcacaagcagaagtggtcccgcctccaagttcagtggactgtcaagggtagctgggagctggaatgtgtttagttggtactagggtatgcaatgagagaagttgggtttctctactacttgtcaaagatagcaatgggagaccatgatgaattcaggccatctttttttttcttgaatccaccagttaagctggcatgtttgtcggagctatatctcaggttattttgagctctagcttcgatggggagttgacttcattattggtactgaacttaaaatgactccagtccagtgtcttgttggttgtgtaaattatttgttagctcaggtggattaggcgcctagctcttgctgtaatatttccctaacactgggcagcctttgtctatcctttcctgatgaggttctgttagtcaagctgaagtacatttctaggtaagcgtggctcttgattcttggacgtaaaatgccaagaggctatacgttcgtttccgcctgtttcaaccttacaaggtaagaagaaaggaaatccaaacgaaaaaaaaaaaaaaaaagcggccaagagagcctggcagttacaaccaggctgagctgggataggccaaatgcatatacaggactgagcagagcacaagtttggttgcatgtatgagctagaaaaaatggaaccccctaaaccctctgtttctgataaatggaactgtttggtttagggaatgaaaacgaacgggaacagtagaaaaaaactccctctttcatttcggttaccatattttcttagaaccagccggccggtcttctcagccctcagctgtaaactgtcgtgggcgatggtgggcctaggagctcgcaggaggttcttttgagttgaatttctccatcaatatgtgctaaattatctttcatatatcaagtgatgaagctacaatatattctcctgactacgggatataaacgggattatctcgatcaaatatggtcaaatatggttggaaaataccctcaggccctgttcggttgttccggattggagcaccggattaatttctagtcagattacttctctaatttatataaattttgatgagctggaatgaatcctggcttattccagtataaccgaacgggctctcaactgtttccgcttccgctcctgactcataccacagctagtctcatactctcatgggctcaatattatagcaaagaattacacaaagcttgtgcaataaaattaagataataacgatgatctgaacaatgataatgatatccttggttgtgcaataaacttgatgtacttgcagtgaacagggcattcttcctctgtcttgtaaccttaataccaggctcctttgacttgcgcatgccattctttcacaccagtttggcgaacatatcgatattgcttattctaaccacaaattctttttcaaatcaacatgttgagatcggatgcccgcgtgcgtgtaagcattatcgatacaattttttggtggtggtagcagtacattttattatttaaatcgaaa

SEQ ID NO: 3027 - DNA, 4578 bp, Zea mays
ggtcttccttactcgagtgctaacgatggtgatgatagtgctttatgttttcaagatcaaattggttcaattatggacaagacgaatgtgcattcaatttcttctcttaccttctccagctattccagtgatccaaatgatgtgaatgaaaggaacttaaacaaagcaaatgtttatcaatgccagaaatgcaatttgactttcggtgaccggacttcatatgcgcaacaccatttggcgtatcatgaaatgagtgttaaggggcgtaggaccggcaagtttggtgagccagtagtagggaaagatggaaaatttgaatgccccatttgtcataagacctttgaggaggaaccacagtactttggtcatgtcggatctcatgcaagatatgaaggtttagctcctgaagcattcttggataaggctacttccagaagggcagctaatgattcattggcagaaattccatttagccttcaggaattgactgaatcacaatggacagaacaacaaggtttcttatggtgaaaagggttttcagcaccacaatcattcaaataaacatggtgataataaccttacagccattgatctttttggtacaaattattcggataatttcatcaggccaaataaaacttgcggtagtcctgaagagggaccttcctgtaatgatgctccaagtgtatctagatatacaaattgtacaggccatgctgatgtgatagtttccagaaagggcatcaatctccaataatcaatctggtagcaacattaatgggctttatatttagtgatcagccgggaggtaaccatgttgtcagacctactgcctctgtaacagccaatcattatgaggaccagattattgatcgtggcagggctgctccgaatgctgacaataatactgtgaaagcaagagatgtcaaccttaattcatgtgcaagtgcaagtacaatatctttccctattgcttatgcaaataatgaaacatcagctgcccttaatgaagctaatcggtcatcttctactgccaaatgttttagtggcagttttaataacaacgatggtgcatgtagtgcgtcttcctcttgtggaccaacctaataaaatatctagttcatttggcacatcaagcaaaacccaagctgctggctccagaagcattggtgcaagctatgaaccttatggtgaagattgtagtgcccttagagctaacccttttgccagcaagtacaatacctcagtgtatcagtacaatttggccacacagcctgtctatgcagtggcagctagggcagattgttttgcttctggttcagagcagtcaaaaaacagtgttaaagaacttgcatccagtgccaagcatcggattgataacgtggagaacagtacaagtaaagaagcaggatttgtcgcggaagcttataatagtggtgcttttaatggtggtattaccgaaaagggttttgctcagatcagtaacagttttactcacataaagtccaatgcttctggctctcgttcactacctgaatcaaaaactccatcaaatggaagtgatagcaacggcatctgcggctctcgcgcctgcacggctggcgatagcttcacaaaggtctcaattgtcaatagacccatcaacaacaatgaatcaaatgtagctagacttgaggcgatgggaaagttgaatgatgagatgcaaaaccgctataactatcatgctcctggtattgaccctcatgttgcagctagtgctagccggaatgccaatggttttatgcctatgcaggccaattttggttgcatgtcctctacagttcaatctgttgttgatgtttcagtatccagcacatctcaagatcagtgtgatttgcaacttggatttggtgcacagaagcagcagatattttctaaccatggagagcttagaacggctacacctggatcccctctgcctgggagcattgccagaaaagattctgtacccactgaaccctcacattttgggagcatgaatgggcctaaatcttttcccactggaacatctcagtttgggggctttgcaaagcctacttttgtgcctgctgcgccttctcagtttgggagcatggctcaagctaattatgtacattctgctcaatcctcccaattcacaagctgggttcaaccgaattctattcctcccgctgaatcctctcagtttggaagcaaagcccaatctagttctgtgccccctgctaatacctctcagttcaggggcatggctggacaaaattctgtacctcctgctcagtcttttgggagcacggttcgaccaaattatgtaactccagaatcctcacagtttgggagcatggccagaccaaattctgtccctccacagtatgttaacatgcccagccaaaattttgtgagctcatccgagccaacactggttttggggtatgcaccacagattggaagtggccctccacctcaagtacagttaggatgggatttgtccttgccaaggatggttactggcggcagcatggtcacttgtttatgtatatggtgcaacagtcagttccatcattttggccctgttgatggacagcagcccagttcttttggcttcatttgccccacctgtaaagataggatgtctggtcatcacagtgtgcccaacaatggttcatggcagccttgaggtgcagcgctgtctggttaatcatctgtattgctgcattcgagggatcttgtggttttctgtacactactcatgcctgtcgactgtcaaggtctgaaaatggtcttctcaagcagcagttgtccgtcctccaagttgagtggactgccaaggaatgaacggcatctctgtatcaacagtgtcagctgggagctggtgtagtagggtaatgagagaagctacttttcaagatagcaatgggagaccatgatgaatccaggccatatttatattttttcttgaatccaccagttacgttacgtgggaatgtcttgagttcactggttgcattacatctggaattttgctgccctcggatgacccagccacctttgcattgggctccgaggatgttgccactcagcttccccatgttttggtttactttgagttctagcagcgatgggagtggcctttgttattgcagtgtcttggtggctgtgtaaagtatgcgttagctctagctgtctcaggtttaatttgtccccattgaagtagttgtgcctttgtcgatgattgctcatttaagttgtgtatactcaagctgaaaaggctgaaggtaattgtaagtgttagctcgacgagcatagcctaacgtccgctctcccggcgccccggataggagcaaaaacgacgcccccagcaaattccaaacacggaaacacctgagaaggctaaggggccattcgtttcttccagaatagaggaataaaataatttctagctggtttgtttctctaatttatataagttttgatcggctgaattggttcctaatctatttctggacaaacgaacaaggcataaagaaacatgggcaaaaggaaatccaagcaacatagactagatatataccgttgtaccaacattaaattgcgctggattgtaaatccaatttttgaatgatttaaatggacgcctttgatattaacaaaaattcaagctttggcctggctatatactcattaatcgtgagtgggagtcttctattacttactacacacatgttttcttgatataaaccacattattggatttttggtagactatttttcggtcaaaaatcataggtattagccttcgatatcaaccaaaactcacgatttgagcaaaaaatgctagccatatgtccattaagagtgagagtcttctattacttaaaccgcatatgtttgctagacataaatcacaatatttgggttttggtggagaccatttatcgattaaaaatatataggtgttagctttcaagattaaagaaattcacggtttggttttgtttacgtcaaaaatattggtcatatgcccattgatcaagagtggaagtctcgtattacttaccctatacatgttttcttgacataaatcacattatttagtttttagagaagatcatttaattgtaaaaaatccatagatattagccttcgatattaacgatggctaaatcaatgtctcgtgagaggatcctattacttatcccacacatgttaacttgacataaaccacattatttgtttcttggtggagaccatttatcggtcaaaaatccataggtgtgttagcctacgatattaacaaaaactcccgctctggccgttttcggcaaaaatgctagccatatgcccattgatcgtgagtcaaagaatcatattacttacccccacacatgttttcttgacataaaccacattatttggtttttgatggagaccgtgtgtcaaaatccaaaggtgttagcctacgatattaacaaaaactcacgcattgaccgttttgaccaaaaaatgttggtcatgtgctcattgattgatgagtgagagtctcgtattacttaccccacaagg

SEQ ID NO: 3028 - DNA, 751 bp, Zea mays
  misc_feature (699)..(699): n is a, c, g, or t
  misc_feature (724)..(724): n is a, c, g, or t
cattgggaccctcgaggccggccgggttttgtttggacagccgctgactcctatgctttccactatgggtatgacccccctactggcagccgtttatgtgggcgccatgcagaatatatttagcaagagtgcaaagtacagtttatttgacccatgcaaggagatggcttatattcctttggatgaagatatgaaggtaaaagggaaggcagccattgatgttgtttgcaacccactgggcaagtccggcggtgcacttatccaacaattcatgatcctgacgttcggatccctggcgaattcaactccataccttgggggcatactgctggtcatcgttctcgcgtggctaggcgcggcgagctcattggacaagcagttctcgagcttggctaaggaggacctgaagaaggataaggctgcccgagagaaagtagaaccctcgctgctcaaggcgcctgcagagggcagtgatgatgtactggcggagcagacaaatggatctgtgacgccccaagcaaccggaacggagagctcgccgtcgaactcatccccccattcaataatagctccagcatcataagttgtactagctaggagagttattacagcgagcagaaataattggtactccctccggttttttttatatatttggcgttggttagtgtaaatttgaactagctagcgtcaaataanaaaatggaaatggagataatattanaataaaaaaaaaaaaaaaaaagcggcc

SEQ ID NO: 3029 - DNA, 1718 bp, Zea mays
aattcggcacgagggtttcatgctcctgtacaccaagctttccaacgttctctcacgcggacccctgggcggacgcgtgggcttcccgttcatcgccttcttcggcgccttcgcctttgtgctctacccgctcagggacgtcatccatcccaccgcgctcgcggacaagcttctcgccgcgctcggtccgagcttccttggtccggtggcgatactgaggatttggagcttctgcttgttctatgttatggctgagctctggggcagcgtcgtcatctctgtgctcttctgggggttcgctaatcagattaccacagttgatgaagcaaaggaattctacccgttatttggccttggggctaatattgctcttatcttttctgggcgtactgtgaagtatttctcaaatttgcgcaagacattgggtcctggaattgatggctgggaagtatctttgaaaggaatgatgagcatagtggtactccttggacttgtcataacttccatctattggggagtgaacaagtttgttttgaatgatccttcacttccaaaggctgatcgtaagaagaaaaaggaaaagcctaaacttggcatgaaagagagtctgaaggttctgctctcctcgaggtatgtgagggatctagctaccctagtggttgcttatggcattagtatcaatcttgtcgaagtcacatggaaatcaaaactcaaggcacagttccctagtccaaatgaatattcatctttcatgggtgatttctcgactgcaactgggattgcaactttcacaatgatgctgttaggccgtattatactacggaaatttggctggggtgtggctgcaaagatcacccccaccgttctgttgctgactggtgttggattcttctctctgattttgtttggacagccactgactcctatgcttgccactatgggtatgacccccctactggcagccgtttatgtgggtgccatgcagaacatatttagcaagagtgcaaagtacagtttatttgacccatgcaaggaaatggcatatatccctttggatgaagatatgaaggtaaaaggaaaggcagccattgatgttgtttgcaacccactgggcaagtcgggcggcgcacttatccaacagttcatgatcctgacgttcggatccctggcaaattcgactccataccttgggggcatactcctggtcatcgttctcgcgtggctaggcgcggcgagctcgttggacaagcagttctcgagcctggctaagcaagacctggagagggagaaggctgcccaagaccaagagaaactagaacgctcgctactcagtagtaagcctgcagaaggcggcactggtgatgtactactggtggagcagcagacaaatgggtcggcgacgagcaaagcaactggaacagagagctcgccatcgaactcatccctccccccccattcaatagatcgtagttaggagagtgattacagcgagcagaaatagtcggcatttaaaataattcgtggctttcgagtttgtaacagcgtgcggcttcaagcctgcccgtaattttcctttgtaataataacatgagcaaaatcttgacagccggcagcgaatgtcgctctggagatggcaaatgtgtgttttgaactgaacggtaaagtgtgcggtctctcctcgtgaatagtgcggtttctcttcaatagtatatttggcg

SEQ ID NO: 3030 - DNA, 1590 bp, Zea mays
  misc_feature (12)..(12): n is a, c, g, or t
accgcggtccgncacacgacacccccactcgtctgtcgactcacgtctgatcgtctctccccaacaatctctcgagtcttgccattcgcctcagcttgcccctcctccaagcgtccaagccccacccggccattgcctcctcctcctgccgcaggcacatggcgccgaccaggcacgcggatgagggcgggcagctccagctcatagacgccgccagcgtcgacgaggaggaggagtgctttgagtccatcgacaagctgatttctcaggggataaatgcaggagacgtgaggaagctgcaggatgcagggatttacacttgcaatggcctaatgatgcataccaagaagaaccttacaggaatcaaaggtttgtctgaagcaaaagttgataagatctgcgaggcagcagaaaaacttctgaaccagggcttcatgacaggaaatgatctccttctcaagcggaagtctgttgttcggattacaaccgggagccaggcacttgatgagctgcttggcggggggattgaaacactttgcatcacagaggcattcggggagttccggtcagggaagacccagttggctcataccctatgtgtctccactcagcttccaatccacatgcatggggggaatggaaaggttgcctacattgacactgagggaacattccgacctgaacgcattgtgccaattgctgagagatttgggatggatgccaatgctgttctcgacaatatcatatatgctcgtgcgtacacatatgagcaccagtacaacttgctcctgggccttgctgccaaaatggctgaagaacctttcaagcttctgattgtggattctgtgattgcactgttccgtgttgatttcagtggcaggggtgaactagcagagcgccagcaaaagctagcacagatgctgtcacgccttaccaagattgccgaggaattcaatgttgcagtgtacatcaccaaccaagtgattgctgatccaggtggcggcatgttcataaccgatccaaagaaaccagcaggcggccatgtgttggcgcatgctgccaccatcagattgatgctgaggaaaggaaaaggcgagcagcgtgtctgcaagatcttcgatgcacctaaccttcctgaaggagaagctgttttccaggttacatcaggtggaatcatggacgtaaaagactgattcgggttttcagccagagtttctgccgaagaagattgttcatgtttctgcagtgaagttcacatagcttgcataggtacacatcgagcgaagttacagcagtggtgtactctgttttatcattgacgtaggaaaaataaataggcgaaactctatgttgcttaggcctcccattgggtagttttttgccacggattacatgtttccttatggagggagtatgttaccgtgtcctttgctttcccaaatgagtgctaggcactaggcagagaccatctactgttagttgtttaagcatgctcatctccatgcttgcgtataaataacactgttctttctcattaaaaaaaaaaaaatcaaaaaaaaaaaaaaaagagagccaatcgatcaatacagt

SEQ ID NO: 3031 - DNA, 945 bp, Zea mays
cctcgaggccgcccccggcccgaacgctagagaagcactccgaggagctgctctccttcgttctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtcacctgaagcttcctcatcagatgaacttcctcgaggagttgcgccgtgcagtggacgctcatacagaatttgcgtcgcctgtcgtcacctggaactaatcgaagctgttcgccaggtctatgtatgatgtatcccatacacggatgatgtgccaaaaggctttcgtctgacctgcagctgcttctggaatctgcatctgtacaattgtaccattgttacccctggccttgtagctgcaaagcagtttgttgtaacaattaaatgaggcgccggatcctcacgccatcgaaagtttgaaacagcttggttgttgtatggtagttccaagacttggtgattataatgtgcgcattttctcaaaaaaaaaaaaaaaaaaaaaaaaaaaaaactcactaaaaaaaaaaaaaaaaaaaagggggggggc

SEQ ID NO: 3032 - DNA, 968 bp, Zea mays
gttggatcgtaactaacgctagagaagcactccgaagacctgctctccttcgttctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtcacctgaagcttcctcatcagatgaacttcctcgaggagttgcgccgtgcagtggacgctcatacagaatttgcgtcgcctgtcgtcacctggaactaatcgaagtcagcatctgcatcattatgcgttatgactaatttatggaaggcaggctgttcgccaggtctatgtatgatgtatcccatacacggatgatgtgccaaaaggctttcgtctgacctgcagctgcttctggaatctgcatctgtacaattgtaccattgttacccctggccttgtagctgcaaagcagtttgttgtaacaattaaatgaggcgccggatcctcacgccatcgaaagtttgaaacagcttggttgttgtatggtagttccaagacttggtgattataatgtgcgcattttctcgaccggacccggagaagcgcggccctaaaaaaaaaaaaaaaggggggccc

SEQ ID NO: 3033 - DNA, 3059 bp, Zea mays
cattgggtacctcgaggccggccggggcgtagcctgcgatctcctcagaccggcaagcaccaagcacagagcatagccgcgctcacctccccagtccccacacgccctaggcgctggcgctgcaagctcgggcagtcgagcgctccccgctcggcggacgctggccgtggctcgccctcgctgtgccggcacgccggcaaccatctcccctccagatccgccactgatggttggctcaaacttatgaaaagagctagctaaggaaacaaggccaaagtgagctccagggaaaaaaaaagagcgccatggagaaaggggacgtgctggtggacctggacaagctccctatgaagcgccttgaggccatcgacgagactggcaacgagcactacccaccggacactagcaacgaggagcagcggcttgcggccatccgccggattgatttctcttgggtcattgagaaggacacaaagaaggccaagaaggcggctgaggctgatactacccagcaggcatggccctggcagggccttatggagagcctgcagcaggcacatcaggagctctccgtcgtcatagacctcatcggcacggttgaggctaatgacgccgtggcagtcgcctcgacaacgaagcccaagtcgcagccaaacgaaatactagttgacatggcagtgtgtgctgccaccaagctccagtgccttaggcatttgtcacggtacttcaaacaatctgctacgacaatggagcaacagttccaaaaggagactaggttctacagctccttaataagattacagcagaactggaaagtgaagcggcagcggtctgttggcagtccaggaagtgagggcttcatgtttgatctagttgatacttctcagctagacacaacaacaatgcctcgattatcaccattatctttgattccaattgatcaagactcttcaggcactttgtctgtacaaattccacagaagtctttccgttccttgagccttcgatttcatggagacatagccaataatgcagaaaatagtgctgtcaaaaggaaagaaggcacattaaccaacactactaccggagccgaaaatgatgttttggagaatgatgatgtcaataagtctactaaacatgcacattccatcttgcgcgacatccataagtccatatttgaggagcaggtttttgatttggtgatccaggagacatttatccaatctcaaggcatcaatgttactggaatgtgtgaggattttctccaattagcgattggccaggaatgttctttgtgcctttcgcttgagctctctgggcagaataataactcggggacagtagggcaggaagatcatatggatatagatcatactggaaaccttgcagtagccactgtaaatgggaaggagtcttcaaataaggacgtgagagggtttcctaaccccaaaagcttagaaatttacctgctacatgtgttccatgaaggcatccttagaaaactcagggagaaatcccgtcatgtggttcggtaccagagttctgctcagggtacacctgacgagtgtggcctgctaagtcatttttgcatgacagtgtctcacaggatattttctagcaaagtacatttggagcttgaaagtgtggttagtagggttccttatctccatctgtgttcccttcctacatggcattctcgaacgtcctcctggtctctctgcctgaaagttcctcagcctatcctggccactgatcgagtcagaaggccttcagactacagtgagttgaagtgcaaatccaggtcacagttcggtacaaaggtgatcttgaaagatggacagattagtttaatgggcgagggctctccaagcattgctggatcgttagctgggaagccatccgatggacgcctggtaaatagttacaattgtgacttggaagatctcccaatgatgcttctgcagcaggttgccagccaagtaatccactggctccacgatgaagcggtggtccttgggatgaacgcgacaatagatttcctgtgcctgtacttggaccttgaccaaggtgaaacactaggcctggtggcacacgttgacccggatgacacctacggctgcgtctcatggtacctcactcttgatcatcacccaacggaggaagggaagatgtcagcgggtagtccggagctagaggagcgcaggtttttggggtacctttccccggaattgctttactctaccctgatggacctggtaaaactgtgcagcacaggtgtccaacgctgagactctgcccacggagtagtgggagtctcatgcgcggtaagtctcacggataggggtagtaatgggccttaaaattttgcactgtgaaatttaagaattagatcagattaggatataatcatcaaactctatctttatccattttaaactaaattagttaagaagtcaaacactttggatctgggatccgttaccaatcatctctactcgctgccctcctccaagtccagagaaacgtgcaagtgcagatagcaggaaaaaaaaagagagataagatgtgcactctgggccaggcctagtccgctgacctgtcgccggcccaccaaaaagagatggcaatccttccttccttcctagctcctttcccgactgcctctctactgtccgtgtcatgtcaagtcttctgatgatctccgtacccatgtccgtcttttactattcctcgtgagacggcttccagtgaaaaaaaaccgacagctttggcagctagcaacatttcgctttgcgttttgaccggtgcacttgccagaagccaggaaaaaagttttctcgtgtgttcggtaacggttgaagccagcagatcgatcgtgttcgcgttttaatcgtggtcattatggtgacaagacaggactagagtcaaggtgaggtagggtggccgggaaggctgaagcttatccacacagcactgtgtgtgaaggcatgcagctccatctttcacactctcttcctcacggtcacggccatggtcgatcgaaccgacagcatatatgg

SEQ ID NO: 3034 - DNA, 2316 bp, Zea mays
cccacgcgtccgcccacgcgttccgataaaaagaattctccacttccccactctccctctcccgctcgtggctcgtcagtgggtgggagtgtgcggggctagccgctagggtttccgcgagcccatcgccggccggccacggacgatccgggactccatccggcgcccgccctgaatcggcttcgcggggcgcaaggagcgagagaatgaagtcgtcgctgcggaagctgcggggcttcgcgctgcagcgccaggagcagcgggtggaccgggaccgcggccggggccacgccgccgccgccgccacggcggcggacgagctcctcgcggctgctcaggatatggcagatatgagaagctgttacgataacttgctttctgttgctgcagcaattgcaaatagtgcatatgagttctctgaagcacttcaagaaatgggaacttgtctgcttaaaagagttacgccaaataaggatggaataaatgataaagttttgctgttgcttgggaaatcacaatttgaacttcggaaacttttagatagttatcgtgtgcatgttcttaacaccatcaccactccatcgctgtcgcttcttaatgaacttcaaactgtggaggaaatgaagcaccaatgcgatgaaaaaaaagaattgtatgaattcatggtaaacgcgcagaaagaaaagggaaggtctaagaatgctaaaggtgataatggatcatcagagcaattgaaacaagctcaggaagattatcaagaggaagcaactctttttctattccggttgaagtcattgaagcaaggacagttccgaagtctttttacacaagctgctcggcatcatgctgcacagctaaatttgttccgaaagggagtcaagtcccttgaggctgtagagccacatgttaggctcgctgctgagcagcaacacattgatcatcagttcagcgcacttgaggaagaggattaccttgttgaggatgaaaatgatgacgattacaatggcagtcatgatggagagttatcttttgattatggagaaaataaggaagttgaggaatctggtaatgcttctaggaatcatacagagggtttttttaacagaagcaaagaagagtattcttctgttccacatgaaagacaaagaatcgtaagtcagtcagcaccactttttcctgagaaaaagctcaatacagaagagagaataaaagatttgcggcgttctgcaacaaggaagttgaatacttatgttttgcctactccaaacgacgttggagctacttctcagagagcatcaggaaatcctacttctgaacctctcgagagtaaaggtgccttccattcatctccactccactcatctgcagacataagagatttgggagacaataatctacctagtcctacaagattgtctaacgtacagtctgtgctgaaagatagcaataccaataaaacagaaacaaggaaagtactcccagtgggtgatctggctttacctagctatcatgacctgaagacttctgataacaaaaaagtgaaaagagggtcattttctggtccaatagcttccagaccacggtcaacagagaacattgatgttatttctgcagcgcctaggcatagctcagcacatcagccagtgcacatgagagtatcccccggcaactcgccgccacccatttcctcaccgaagatcaaggaacttcatgagcttcctcgaccacctgttaatacatcaaaaaatatagcattccccagtttagttgcccactccgccccattggcaccaaatcctgcatctttgactcccaaagttcaagatcattttaggacaaaacaaacgctccaaagaactgcttcacctttaccaactccaccacctggatctatagcccgcagtttttctataccttctaggggtatttcagacagtaaagagacagaagatcaacacaagggagctgccagaatgagtctttcttctcttccttcagcacaaacattcttggaagatcgtcagccattgtcagcagctgctggatcggtcagcaaaacataggagtattctctattatcattatcaagcagctcgccgagccctcttcctgaaagaatgttgtacatattagcatttgaactctggccagtatcgccgaagaagttggtgtttcgcgtgccctttggttggttaagatgtagcctgtgcaaataatgggttctgcggaaataaaatccccatttttctcaccaaaaaaaaaaaaaaaaaaaaatcccctgctgcaaaaaaaaaaaaaaaaaaggcccctagggcc

SEQ ID NO: 3035 - DNA, 1106 bp, Zea mays
ttttttttttttttttgtcaattcgttgctattaactggtaatgtgtccacatctgagtaattaaacttccgtcacggcacgtacacataactcaactgactgaatgatgctagcacaaatgggcgtcgacgctctaacgtaagggaagacctcaggttcaaactcaccaagagcatttcgctcgctcagctgtccagggggacctcgccgcagttaacgattcggcaaggctgcttgggagtatcggacctgctggtctcttgcgattcaagctgcttcaccacgtccatcccctctaatacatgtccaaacacgacgtgacggttgtccaaccacggtgtcttcacagtgcaaatgaaaaattgacttccatttgtgttggggccagcatttgccatgcttagcacaccagggccaacatgcttcagtgtaaaattttcatcatcaaagcattcaccataaatacttctcccaccagtaccattgttttgctggaagtccccgccttgaatcataaagtccttgatgatccggtggaaggagcagcccttgtagccgtaccctttctcaccagtgcagagcgcacggaagttgtcgacggtcttaggtacgacctctccgaagagcccgatgacgatgcggcccgcaggctccccgccgacctccacgtcgaagaagcacttgctcgtcaccttggcctgcagctccacggctccctctgccgcagtggcgcggacgacgacagcgccacgggcgtcgcggtggccgccgagcctcaacgtggggatagcgcgggcgggacggagggagagcgcgccgcgtcgcatttccgttgagtagcagaggtgggtgcgggtcgacgccggtgccggcgcgaggacggagggggcagacacagccggcatgcacgccatggttgggtgggggggtttgggtttggcctggcttatcggatttttttcgcttatatatcggaatggagggagaaatcaagaggccgtagtgggcaagggcagccgagcaagagcagggcggcgctcgaatggccggggaaggggctgaggccaggtctccggacttccggagccaataaggattggcattt

SEQ ID NO: 3036 - DNA, 2147 bp, Zea mays
tgcaaatagtgcatacgagttctctgaagcacttcagaatgggggcttgtttgcttaaaagaattacaccaaataaagatggaatcaatgataaagttttgctgttgcttgggaaatcacaatttgaacttcggaaacttgtagatagttatcgtgtgcatgttcttaatacgatcaccactccatcactgtcgcttcttaatgagcttcaaaccgtggaggaaatgaagcgccaatgtgatgaaaaaaagagaattgtacgaattcatgctaaatgcgcagaaagaaaagggaagatctaagaatgctaaaggtgataatgtagcccccgctctccgcccacgcgcccgggaagattatcaagaggaagcgactcttttcctattccggttgaagtcattgaagcaaggacagttccgaagtcttttcacacaagctgctcggcatcatgctgcacagctaaatttgttcagaaagggggtcaagtcccttgaggctgtagagccacatgttaggctcgctgctgagcagcaacacattgatcatcagtttagcgcacttgaggaagaggattatgttgttgaggatgagaatgatgacgagtacaacgacagtcatgatggagagttgtcttttgattatggagaaaataaggaaactgagaaatctggtatcgcttctaggaatcatacagaggatttttttaacagcagcaaagaagattattcttctgttccacatgaaagacagagaattgaaagtcagtcagcaccgctttttcctgggaaaaaggtcaatacagaagagagaataaaagatttgcggcgttctgcgacaaggaagttaaatacttatgttttgcctaccccaaatgatgttcgagctacttctcagatagcatcaggaaatcctatttctggacctctcgagagcaaaggtgccttccattcatctccactccacccttctgcagacataagagatttgagagacaataaactacctagtcctgcaagattgtctaatgtacagtctgtgctgaaagagagcaataccaatacagcagaaacaaggaaagtactcccagtgggtgatctcgctttacctggctattatgacctgaagactctcgacaacaacaaagtgaaaagagggtcattttctggcccaatagcttctagaccacggccaacagagaacaatgatgttatttctgcagcacccaggcatagctctgcacatcagccagtgcacatgagagtatcccccggcaactcgccgccacccatttcctcaccgaagatcaaggagcttcatgagcttcctcgaccgcctgttaatacatcaaaaaacacaacatttcccagtttggttgcccactcggccccattggtagcaaatcctgcatctctgacacccaaagttcaagaccattttagggcaagacaaatgcttcccagtactgcttcacctttaccaactccaccgcctggatccatatcccgcagtttttctataccttctagggggagaacaggttcagacggtaaggagatagaagatcagcaagacaagggagctgccagaatgagcctttcttctcttccttcagctcaaacattgttggaagatcgtcagccattgtcagcagctgctggatcggttagcaaaacataggagtattcactgcgaaggtggattactatcattatcaagcggcttgctgagcccttcctggaagaatgctgtacatattagcatgtgagccctggccagtatcgcggaagtagtaggttgtttctcgtgccctttggctaaggtgtagtctgcagatagtgggtttgcggaaataaattcccccaattttctcaccgcttggttgattgacgcgagatttgctgttgcgcgagcttgtttgcttgccttgaagcgaggtcggagtgccatctgttttctgcagcttctgtaattatcacctggtttcgtttcctgtggttatgtaattaccatccgcttcacccccgatcaaaaccacctgtggtaaggggaaaaaaaaggcaagaagcgctgtgttgtcgtattggcactctacatttaaagccccgggtttggctctgcgttcgtttctccctgactcgttggctgac

SEQ ID NO: 3037 - DNA, 1008 bp, Zea mays
gagatgtcccttgccaattcgttgctattaactggtaatgtgtccacatctgagtaattaaacttccgtcacggcacgtacacataactcaactgaccgaatgatgctaccacaaatgggcgtcgacgctctaacgtaagagaagacttcgcggtacctcaggttcaaactcaccaagagcatttcgctcgctcagctgtccagggggacctcgccacagttaacgattcggcaaggctgcttgggagtatcggacctgctggtctcttgcgattcaagctgcttcaccacgtccatcccctctaatacgtgtccaaacacgacgtgacggttgtccaaccacggtgtcttcacagtgcaaatgaaaaattgacttccatttgtgttggggccagcatttgccatgcttagcacaccagggccaacatgctgcagtgtaaaattttcatcatcaaagcattcaccataaatacttctcccaccagtaccattgttttgctggtactccccgccttgtctgcctgagtcgccggagttgataaccagagttggctcttgttcttgatcagcaattcaacgcagcagttggtcggggtctcggggaggaggaggaggaggagccagggatcagctcagggaggaccggatgagtcgttcctcgttcaccaggaaggagaagacagatgggaattgagaatttgagatcacgagacagagagatcaaaagaaaacaggaaagtaaatatggttttggaaacaagacgcctgctcggagtacatcaacgggaatgcctcctcagcgccgcaacgtcctgctgttgggcctcatcgtcggcgaaatcgagcggatccgagtcggccttcctccgccttgcacatcgtcgcgtccaggcctccgcgctggagtccaaacccaccgcaacggagcgggaggtttcttcgccaaggcgcgctcgctgccatcctccggaaggaaaggtgggggatgaatagtgctccgtcgtatct

SEQ ID NO: 3038 - DNA, 1040 bp, Zea mays
agtctgtgctgaaagatagcaataccaataaaacagaaacaaggaaagtactcccagtgggtgatctggctttacctagctatcatgacctgaagacttctgataacaaaaaagtgaaaagagggtcattttctggcccaatagcttccagaccacggtcaacagagaacattgatgttatttctgcagcgcctaggcatagctcagcacatcagccagtgcacatgagagtatcccccggcaactcgccgccacccatttcctcaccgaagatcaaggaacttcatgagcttcctcgaccacctgttaatacatcaaaaaatatagcattccccagtttagttgcccgctccgccccattggcaccaaatcctgcatctttgactcccaaagttcaagatcattttaggacaaaacaaacgctccaaagaactgcttcacctttaccaactccaccacctggatctatagcccgcagtttttctataccttctaggggtatttcagacagtaaagagacagaagatcaacacaagggagctgccagaatgagtctttcttctcttccttcagcacaaacattcttggaagatcgtcagccattgtcatcagctgctggatcggtcagcaaaacataggagtattctctattatcattatcaagcagctcgccgagccctcttcctgaaagaatgttgtacatattagcatttgaactctggccagtatcgcggaagaagttgggtgctgtttggttcacgaaatgtaacgtaaagggtaatggtaacggtttacactcgattacggacggtaacaagtttgaatagtccggtatcaaattttagtatggtatctgattacggttggactaaaacaaacatgatttaacgttatcacttacccattacgttacaaatatttgaaccaaacggtaccttggtgtttcgcgtgccctttggttggttaagatgtagcctgtgcaaataatgggttctgcggaaataaaatccccatttttctcacccatttgattgaaaaaa

SEQ ID NO: 3039 - DNA, 2159 bp, Zea mays
ccattacgttacaaacatttgaaccaaacggcaccaagattcatttgatcatatatacaattattacatctaagcactagagtggagcacgtctcgcgggagtgcatgccgtagcgcgcgtgcgcacagggcggacgacgggatctcaggcggacgttgaggagcggctgatgttggagccgtcaacactcaacaaaaagcacacgttcataccctagctagcatcacgagagaaactgcctataaaatccaagctatgtgaaacagaaacaagaggtcgatcggccagagcaactgagcgtgagagaccccccataccttctagtctagcatggctgaacctcaccacacaagcagcaacggagctgctcacggtgatgctgatgatgcgtcggagaaaatgccgcccaagaggctacagagatatgattcactgcacatggaggctggaatgttccctgctggtggatcgacgcatgcagccaaggtatatgttagttctccgactactcttatccaatcagataatgatcctccttttgccttagagccgtgtgtaactgcacagtaaaattttgaatcctcatcaatttatttcaacaaaagttcaaaactaattaaatatataattctcatacaaacgtaccgtgttgcacgaaagattctcgacccttgaactccagggtccatgaaacccctgttgccttcttagaacaaagtctaatgggagtatccatatgtggttgagtttttttttcttcttgtatgtgttctttttttcatctcgtaaagtgtttctatggttctgctgaaatcttaagtaactgctgcactgtcgtgttcgtccttgccttactgaagagactaagcatatcagctagctgcttcatcatctaagggttgtgtgcctaaaagcatattgtctgctttctttcttgctttcttttcgaggcaaatgtaatctgattcagagtatgcactttggtaatgaaggttggctgggcgaccacactgcacctagcattccagagcataggtgtggtctacggagacatggggacttctccgctctatgttttctccagcaccttcacaaacgggatcaacaacacagatgacctcctcggagtcatgtctctcattatctacactgtgattctccttccgttgataaaatattgttttattgtcctgcgagctaatgataacggtgatggtaagtaagtattgttacatacatcttctcatcacaacttcgactcttctagtatggctatataacaagtgtttttaagaactagacatgggatgaaggttgaaacaagatgttgtaaagaatgtcagaaatatatacaaatgaaagtcgttcacaacattggtttagactgtcccaacagaatataataaataaaagatgtgtaagtgtgtatagatactgtagtatctttaagaatataggtaaaaacattaggctacgtccgtgagaatcgaacacctaatttgctaaattaaaataaaaagaagcatcacaggaaaacattattcgttttatgagagaagctaacatgtattatcaatctataatattgcaggaggaacgtttgcactttattcattgatatcacggtatgctagggttgtcctgcgagctaatcagcaggctgaagatgcgatggtatctcactacaagttagagtctcccacatatcgcatgaagagggctcattggatcaagaagaagatggaaagcagtccaaaatttaaggtcttgctttttctagtgacagtcctggcaacatccatggtgattggtgatggtgtactaactccatctatgtcaggtgagttcagtatccttcctcatctcttgtaaaaaatgttgtatacagggtatagttaaaatacacatggattattaaaataaataaggcagtgtatcacttttatgcactcttttgatgcacatgctaaaaatctactctcagttcaaatatgaaagacgtaaagacaaaagtgccacttgcaataattaagagagagctattatcccgccatgcgatgcatatcctctggccactagaatatacctacaagattgattttttaaaatggaaattcataggtattcttttgcagtacttagcgctgtcggggggatc

SEQ ID NO: 3040 - DNA, 2113 bp, Zea mays
tcgagccggccaaaaagggcctccccccgatccgcttcccccttccacccgccgatcgccctccgctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttagaaatatggtttgcactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaaatgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaggtaccacgcggagtgcgtgaagcagtggctgatggtgaagaacttgtgccccatctgcaagacgacagcattgtctgccaacagaagacaaggacagtgagcgggaatggagaagcctgttggttatttgctttgacaaacgttcagctcaattttgtatataaagaagtggtagacaatggcgctacctgtatttgttgttcactttgttgtgactgggagtactcagcttcctgaaactgtacagccataacatttgttatttttcttcaaatgtagaatgttttaaatcacaaaaaaaaaaaaaaaagtgtccggcaactgataaggcgaaccaaggagacggagct

SEQ ID NO: 3041 - DNA, 3541 bp, Zea mays
gtggttgtaatgtatgctgcatgttattttagtgaacataagttgtatgaatcgagcaaattataagtgaatcctgtcacttttgatcgattttgccagttttcatcgatttacccgtggatagcggtttttttttacccaaaacggtttgataatcgttggtcgagcaacgttcgtgccaatcgaaaccgagatcgccaggcccatgacacagtacgacggtggctgcgcggttggtcagtgagtcacggccaaagcaagcacgcctctcagacacgaaactgcagtgtgtaacttatctcctggaccgcccgaccgccgccaattcagctcggcgattcgtttcggtgccgccgcagtcgagcggagcggagccaacctcctgcagtgccaggcgcgtccggggccgaggggcgacggccaaccgaacgggagagtgtcaagtcaagtgggcggattgcgggaaggaaggaaaacctcccgcgcgactcgcgcctccgccctcctcgtcctcgtcctcgtcctccattccaacccctgcgtttcggattctgttgcgccctctccagagcctcggcgagcggtggaaactctaggtggcggcgacggcgatggcgtcggcgagcaggggcaccggggtggcgccggcgggcgagcccggcagcccgagggcgtggggcggcgaggacgaggcgtgcagggcgaggaaagtgaagctgatgtgcagctacgggggccggatcgcgccgagacccggggacggggcgctgcggtacgtgggcggccagacgcggctcatctccgccccgcgcgccgcctccttcgcggacctgctgcggaaggtggaggcggtggacgaggcctcggcctcctctggcggcggggtggtcctcaggtaccagctccccggggatgacctcgactcgctcatctccgtgtccggcccggaggactacgacaacatgatggaggagtacgagaagctggccgccgcggcgcccgacggctccgccaagctccgggtcttcctcttcccggcctccggggccgacgcggggccccatctcgccgccgtggtggacgagtccgggcagcggtacatcgacgccatcaactgcgtctccacggaggccattgccacggccacggccatgcggcggaaggacggcgtcgccagcgccggctcctccgcgcacaactccgaggcggccgagtacagcggtctagtcgaaagtacgtcgccgcgggcggtgccgccgcctgcttccgttgcgactgagtattcgtattcaggtggagcgcattacctccgtgctttcccggagtcggttgggctcactgcagtctcggcgtcacctctggcgatgggcatcccggctcaaaaccccatcctggttaggacagagcagtcgacgttgccgcctcatcaggttgctgctgtttatgcagcagcaacacagcatcagccgcctctagtgaccacttatgtgcagcagcagcagcagcagcagcctcaaggcacccattacgtaccacaccagcagcctcagtctgctgcttatgtgcagcagatgccgcagtcgtatatagagccgcagcaggtacactacatcaacgcccaacaatttggtgtgcatggggtgccacaatctgtcaactatgtgcctgtgcaaatgagccaattcatgcccaacattcctgtgacgggctctatggcgaccactgctgctcaagtgggtacgttgaagcccgcttccgcaggtgtagaacctgttccagagaccacgcagttcacaaggccagtgcaagctcaggttgatcagagttaccgggtggtgcacactccactgtcacagcttcctcctttgtcttctgtgcatctgcagacaaatgatgcgcagaggcagaaatttggtgcccaacaagcgatgacaagcgcagtaagcatgccagtggtgaccagctcaggcacaattcctgttgtggttagctcggccactgttccatcattgaggtatgatggttgcacaatgtgccaaaaagcattgccacatgcccattcggataatactatccgggagcagggaagttcttgtgcaatgggcaaccttgaggcagctccaatgttttacagcccacatcaaggcaccgcatccaacaaatctaatccaggtgcaagttcaggaacactcacgaactatgtggcagaaccaagagctgggaacacagcagtgatggcacaatttgattcgactcttcctgccagaaaacctgcagtccaggcgactgcatatccggatacaggtgtgccggttcaacccaccattattgctttcccagtgtctagtgcacctgctccaaaaggagtatttgtgggttattctcctccggctggggctgaagatcatgtcaggtaccagcagcaaccattctcttatagcatgcaaccgtcgctagttccagtgaatgtcccacaaggcattggtgccagtgcatacaaagattcaaatcatgcagcagtggaaccgcttagagaatatgcccgtgatcttcctcatgactatgctagagctattgatgctcgtatgcaagcagttcatttgggtcctattgcaccaccagaatctagtgtgcaaggaaatccttctattcctcatgttgtcattgatcatgccaaagttgggaagccacctgtaaataatgatgttacttctttctgcaaatctcaagctggagggtatcatatggggatcacaaatgcctttacttctcctgctttaacccaagaggacaacattgccaggcacagcgagcagccaccttgtgattttgatgttggtgcacaaaatgtccaccctgacataatccagcgaccaccactcaatctgcctgtccagagcaaccttagagttccgattgaaccacctgtttctaatgaaaagttcaccgttcaaccatctaactctggtgctcagcttcctgctgggcctcctctacagcatcctaaggaaatgcccaatcacttggtttgtgctctccccaatcgtagcagtaaatttcaattgcaggctactgttggaattgatcgtgttgaagctacacaagaaccagcatacactgattcacttttctcaaatcaggatccttggaaagcagtgggtaatgcttctttagtgcctccaagaccaagcaagttaactaaggaacctgttgtttctggaggtcaatatgctgatggtcatatgcctgatatgaacacacatgctgccttactctttgaagaagacccaagtttaaaggatatccacacagttaaattgaacaaaggttggtacacactgtcatcctatactatttgggcagtattactatcatattatttcaaaataataatggactaagcaacaattcctctgacactctcttatcttttttactcctgaaaggatttgggaaagctaatattaagcgacaattacaagatgttgctgaaggggtagcagcatcagttcttcagccatcctttcctgaaaaaccagga

SEQ ID NO: 3042 - DNA, 1919 bp, Zea mays
  misc_feature (18)..(18): n is a, c, g, or t
  misc_feature (29)..(29): n is a, c, g, or t
tgggtacccctccgaggncccggccgggnaatctactgtgcatgggaagccttctacttatggtatcattgatcatgccaaagttggaaagctacctttaaatattgatggtagttctatctacaaatctcaagctggagggtatcatatagggattacaaatgcctttgctgctcctgcattcaaccaagaggaaaacatttccaggcacagtgagaagccacgttatgcttttgatattggtacacaaaatgtccatcctgacataatccagcaaccacccaatctggctgtccagagcaaccttatagctcccattgaaccacctggttctaatgaaaaggttactgtgctaccatctaactctggtgctcaggttccttctggatcacctgtacagcgtcctaaagaaatggccaatcacttggtttcaattccccccaatggcagtaacaaatttccattgcagtctactgttggtattgatcgtgttgaaggtacacaggaaccggcttatgcagattcacttttctcaaatcaggatccttggaaagcagtgggcaatgcatctttagtgcctccaagaccaaacaagctaactaaggagtctgttgtttctggaggtcaatatattgatggccatatgcctgatatgaacatgcatgctgccataccctcagaagaagactcatgttttaaggatatgcacacagttaaattgaacaaaggacctggagaagatagtatcaagcgacaattacaagctgttgctgaaggggtagccgcatcagttcttcagccaccctttcctgaaaaaacagtggtgttctctggggatcacatcgattcgcatggagcagaagttgatgtcaagttccaggatgaagggaacaatcagtcagacaaaataagtcaaggggttcaagttttagatgacaacgataaccttcagataataaagaacagtgaccttgaagaattgcgtgaacttggttctggaacctttggtactgtttaccatggaaagtggagaggttcagatgttgctataaagagaatcaacgatcgatgctttgctgggaaggcttctgagcaagagcgtatgatggacctggtggatctgttgcaacggtaacagaatacatggctaatggctcactccgacaagcattacaaagacatgaaaagatctttgatcggcgtaggcgtctactaattgcaatggatgttgcatttggaatggaatatctccatgggaagaatatagtgcattttgacttgaagagtgacaatctgcttgtcaacctaagggatcctcaacggcctatatgcaaggttggtgatttgggattatcaaaggtcaaatgccagacactaatctctggcggagtaagaggaacacttccttggatggcccctgagttgttgaatggcagcagcagccttgtctcggaaaaggttgacgtcttctcgtttggcattgtgatgtgggagctacttacaggtgaagagccttacgccgagctgcactatggggccattataggtggaatcgtgaataacacgctgcgacctccggtgcccgagtcctgtgatccccagtggaggtcactgatggagcggtgctggtcagccgaaccgtcagagaggccgagcttcaccgaggtcggcaagagcctgcgcgccatggcttctcctaccaaggcacaacaatcgaaatagatgctttagccttgcctctcgcgtccttttgttcagcagattgtttcagtcttcaaaccgaggaggtgccaccatggctggcctgccttttgtacatgaataagttgaagaaaaatacgagaatgtggcctgctttagagtcggtggatgcttgatgctaaaaaaaaaaaagaaaaaaaaaaaaaaaaaaaactcga

SEQ ID NO: 3043 - DNA, 1998 bp, Zea mays
aggccggccgggcccggacgaacaccagttaactaatcactacctctccctctccgtcgcgacacaggccacggcgggcggcggcggaggcttccgtgcggctcttggcggattgaacgcccactcgagctgcgccggcggctgtttcagccgtccttagatagaccctgctttcctcccgggcgaatcaaagttgcacaaatgccgacaccagtgaagtcggtgctccccgtggtgctcctcggctgcggcggcgtcggccgctacctcctccgccacatcgtctcctgtcgtcccctccacgccaaccagggcgtggccatccgggtggtgggcgtcgccgatagctcctccctgctcgtcgccgaagatgtccactccaccggcctcgatgacgcgctcctcacccagctctgcgccgccaagtccgcaggctctcccctctcctccctgctcggccgagggcactgtcagctgttcaagaaccctgaggctaggggcaaagtcatagacgccgctaccacacttggaagtacaactggtctggtgctagttgactgttctgcaacttatgacactgttagcctgctgaaagatgctgtggatcatggatgctgtgtcgtattggcaaacaagaaacctcttaccggtgcttatgaggattttcagaagttggtctccaacttccgtcggataagatttgaatctactgttggagcaggtttgcctgtgatagcttctgtaacccgtattattgcatctggagaccctattactcgtattgttggcagtttgagtggtacacttgggtatgtgatgagtgagcttgaggatggaaagaaatttagtgaagttgtaaaaactgccaagtctcttggctatacagaaccagatccacgtgatgatcttggtggaatggatgtggctagaaaggcattgatcctggctaggcttcttgggcaacagataagcatggagagtatcaacgttgagagtttatatcctagtgaattaggacctgatgcagtgtccacaaaggacttccttgaaagtggtttagtgcaacttgacaagagcatggaagaaagaatcagagcagcatcttcgagaggaaacgttcttcgctacgtctgtgagattgaaagcgcagggtgccaagtaggccttaaagagctcccaaaggattctgcgctgggtagattgaggggaagtgacaatgtggtcgagatatacagcagatgttaccagagctcccctctggtgatccagggcgcaggagctggcaacgacaccactgccgccggcgtccttgctgacataatcgacctccaagacctgttccagacgatggcttgatcgttgatcggcatccacaccagtacaccatcttgatttttgcaaggcaccagagcgtttgatactttgatcggtgccagtggaatcccccactgcccactggttggcttcgctccttgtcatgtgtgcattttgttcacgggcatgctctcaggctgagagcctgagacgtctgacattcgaaatgtaattttgagcaggcgtgtgggggatttctttacagtttacataaaggaactttgtttcagtgaaataatgtcgcggtctccacattaaactaataaacagtccgagctatattgccgctatctgatagtgaaataatatcgctggcagcctgaaaccgtgaacgagagacgtgggaaattgatgcaattcaccctgatgcagattcggcaattgatgcaaggttgcaattcagtgtcctgaaatgtctacgaggagaggagaggagatgagatggctggaattttaaatactactcttgcatcacgcaattcaattctgtgttccgttattatatatcgttcactgatgcgacagcatagcagactagtagtcaataataatttttgttggaattgccacgaacccgccaccataaggcattgttcgtttctactcaaaaaaaaaaaaaaaaaa

SEQ ID NO: 3044 - DNA, 864 bp, Zea mays
ctcgaggccggccgggccgggatatgtacgctgttgtcttaattactgtgtggtgattgctcgcggccggccgggccgggatcttcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgccggcggtgggcgtctacgtgatcaacttcgtcatgtccatgtccacgcagatcttctgcgggcagctcggcaacctggagctcgccgccgcgtcgctcggcaacaccggcatccagtccctcgcctacggcctcatgctggggatgggcagcgcggtggagacgctgtgcgggcaggcgtacggcgcgcacaagcacggcatgctgggggtgtacctgcagcggtcgacggtgctgctgatggccaccgccgtgcctctgaccgtggtgtacgccttctcggcgcgcatcctggtgctcctgggcgagtcggagcgcatctccagggccgccgccgtgttcgtgtacgggctcatcccgcagatcttcgcgtacgcggccaacttccccatccagaagttcctgcaggcgcagagcatcgtggcgcccagcgcctacatctccgtggccacgctggggctccaccggggcctcagctg

SEQ ID NO: 3045 - DNA, 1973 bp, Zea mays
attcggctcgagagctacctctccgatccgaggcctgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtcgacgggccacggcgaggcggtgatcttctcgggccacctcggcacgctcgagctcgccgccgcctcgctcggcaacaccggcatccaggtcttcgcctacggcctcatgctgggcatggggagcgcggtggagacgctgtgcgggcaggcgtacggggcgcacaagtacgacatgctgggcatctacctgcagcgctccaccgtcctgctgatggccacgggggtgccgctggcggcgctgtacgccttctcccgccccgtcctgctcctgctgggggagtcccccgagatcgcgtcggccgccgccgtcttcgtgtacggcctggtcccgcagatcttcgcctacgccgccaacttccccatccagaagttcatgcaggcgcagagcatcatggggcccagcgcctacatctccgccgccgcgctcgccgcccacctcgccctcagctacctcgtcgtctaccgcctcggcctcggcctcctcggcgcctcgctcacgctcagcgccagctggtgggccatcgtcgccgcccagttcgcatacatcgtcaccagcagccgctgccgcctcacctggaggggcttctcgtggcaggccttctccggcctgcccagcttcttcaggctctccctcgcatccgccgtcatgctctgcctcgagacctggtacttccagatcctcgtgctcatcgcaggcctcctcaaggaccccgagcttgccttggcctcactctctgtctgcatgacaatttcagggtgggtgttcatgatctccgttgggttcaatgcagcagccagcgtaagagtgagcaacgagctcggcgccggcaacccaagggcggcggcgttctccgtggtggtagtgacgctgctctccttcgtcctgtcggtcctcgtctccgccgtcatcctgctgtgccgggactacatcagctacatcttcaccgagggtgaggacgtgtcgcaggcggtctcccggctcaccccgctgctggcgttcacgctcatcctcaacggcatccagcccgtcctctctggggtcgctgtggggtgtggagcgtggtcgcggccgaggtacgtcaacgtcggctgctactacatcgtcggcatcccgctcgggtgcctcctaggcttctactttgacctcggagcagcgggtatttggagcggtatgatcggcggcaccttgatgcagaccttgatcttgatatgggttacattcaggaccaactggaacaaggaggttgaagaagcacagaagaggataaacaaatgggacgacggcaaggctcctctgctgtcagcgcaagaatgaaacaactcgtctctctggtgcccaaccaaagaacaacgagacgtggatatatatgacctgtagggcttgtttggaagaaagagtattggagaggattgaaggggttataatctcttgctattcaaaattgaataacaagggattatagtccccacaatctccttcaatactcttgtttccaaacatacccgtagggaactagggatgcccctcggcaggctcagcggagacgtcgacggagtttgatgtcaagtagcaattaattccaccatgtcctcaaatggacagaaccagatgcctgaaatagacagaaccagatgcctgatgaaattctacgtacctgccatcggttccattatataattcgtttaactattttatattaagtttgaccgactcatattattaaaaaatatataattgtcatc

SEQ ID NO: 3046 - DNA, 850 bp, Zea mays
  misc_feature (815)..(815): n is a, c, g, or t
cattgggtcccccgggcccgccggggatcgagcctcgacgagcgagtcgaggactcatcctagctagctaagctgtccgacagcgcagcagaccgatacgagtacgacgatgatgagtagcaccggcggcgagagcaagctggagagcccgctgctgggcctgcccgcgccgggctcgtcggccggcagcgggcacagccacggcgaggcggtgagcgggcagctggagagcatcctcagcgacgcctccctgccgtggaggcggcggatgctgtcggcgtccatggtggagatgcggctgctcgtgcgcctggccgcgcccgccgtgctcgtctacatgatcaactacctcatgtccatgtccacgcagatcttctcgggacacctcggcacgctcgagctggccgccgcgtcgctcggcaacaccggcatccaggtcttcgcctatggcctcatgctgggcatggggagcgcggtggagacgctgtgcgggcaggcgtacggcgcgcacaagtacgacatgctgggcatctacttgcagcgctccaccatcctgctgatggccacgggggtgcctctgaccgtgctctacgccttctcccgccccatcctggtcctcctcggggagtcccccgagatcgcctccgccgccgccgtcttcgtgtacggcctcatcccgcagatcttcgcgtacgccgccaacttccccatccagaagttcatgcaggcgcagagcatcatggcccccagcgcgtacatctccgccgccacgctggccgtgcacctcgccctcagctacctcgtcgggtaccagnttcgggctgggcctcctcggcgcgtcgctcatgct

SEQ ID NO: 3047 - DNA, 1070 bp, Zea mays
atgcgcccccacctaccaaaccgcggtctcggctcgctcgctcgcttgcagtcgcaggacgagataaatagtcccctcgggcacctcgcggccggccatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatgggcagcgcggtggagacgctgtgcgggcaggcgtacggcgcgcacaagcaccgcatgctgggggtgtacctgcagcgctcgacggtgctgctcatggccaccgccgtgccgctgaccgtcgtctacgccttctcggagcgcatcctggtcctcctcggcgagtcggagcgcatctccagggccgccgccgtcttcgtctacgggctcatcccgcagatcttcgcgtacgcggccaacttccccatccagaagttcctgcaggcgcagagcatcgtggcgcccagcgcttacatctccgtggccacgctggcgctgcacctggggctcagctgggtcgccgtctacaggctgggcctgggcctgctggggggctcgctcgtgctcagcttcagctggtgggtcatcgtcgcggcccagttcgggtacatcgtcaccagcgcccggtgcagggacacctggacgggattcaaccacgcagccttctcgggcctcggcaccttcttcaagctctcggcagcgtccgccgtcatgctgtgct

SEQ ID NO: 3048 - DNA, 2055 bp, Zea mays
gcacgagaccattacctagaacctcctggccggccggaaccgatcgagcctcgacgagcgagcagaggactcatcctaggtagctaagctgtccgacagcacagcagaccgatacgatacgacgatgatgagtagcaccggcggcgagagcaagctggagagcccgctgctgggcctgcccgcgccgggctcgtcggccggcagcgggcacagccacggcgaggcggtgagcgggcagctggagagcatcctcagcgacgcctccctgccgtggaggcagcggatgctgtcagcgtccatggttgagatgcggctgctcgtgcgcctggccgcgcccgccgtgctcgtctacatgatcaactacctcatgtccatgtccacgcagatcttctcgggacacctcggcacgctcgagctcgccgccgcgtcgctcggcaacaccggcatccaggtcttcgcctatggcctcatgctgggcatggggagcgcggtggagacgctgtgcgggcaggcgtacggcgcgcacaagtacgacatgctgggcatctacttgcagcgctccaccatcctgctgatggccacgggggtgcctctgaccgtgctctacgccttctcccgccccatcctggtcctcctcggggagtcccccgagatcgcctccgccgccgccgtcttcgtgtacggcctcatcccgcagatcttcgcgtacgccgccaacttccccatccagaagttcatgcaggcgcagagcatcatggcccccagtgcgtacatctccgccgccacgctggccgtgcacctcgccctcagctacctcgtcgtgtaccagttcgggctgggcctcctcggcgcgtcgctcatgctcagcgtcagctggtgggtcatcgtcgccgcgcagttcgcctacatcgccaccagccagcggtgccgcctcacctggacgggcttctcgtgggaggccttctcggggctccccggcttcctcaagctgtccctcgcctccgccgtcatgctctgcctcgagacctggtacttccagatactcgtgctcatcgcgggactcctcaaggaccccgagcttgccttggcctcactctctgtctgcatgtcaattacagggtgggtgttcatgatatcagttgggttcaatgcagcagccagcgtaagagtgagcaacgagcttggcgccggcaacccaaagtccgcggcgttctctgtggtggtagtgacgctgctctccttcgtcctgtcggtcataatctccgtcgtcatcctgctgtgccgggactacatcagctacatcttcaccgagggcgacgacgtgtcgcgggcggtcgcccagctcagcccgctgctggcggtcaccctcatcctcaacggcatccagcccgtcctctctggggtagctgtggggtgtggatggcaagcgttggtcgcatacgtcaatgtcggctgctactacatcgtcggcatcccccttgggtgcctcctgggattctacttcgacctaggagcagcgggtatctggagcggtatgatcgggggcaccctgatgcagaccatgatcctggtgtgggttacattcaggaccaactggaacaaggaggttgaagaagcgcagaaaagactgaacaaatgggaagacagtaaagcgcctgtccagtgagcccaagaacgaaataaggcttctctgttgccaaaccaagaacgagagacgtgggaaattgatgcaattcaccctgatgcagattcggcaattgatgcaaggttgcaattcagtgtcctgaaatgtctacgaggagaggagaggagaggagatgagatggctggaattttaaatactactcttgcatcacgcaattcaattctgtgttccgttattatatatcgttcactgatgcgacagcatagcagactagtagtcaataataatttttgttggaattgccacgaacccgccaccataaggcattgttcgtttctactgaattggtggatcggaacgatttctaaccagattgtttctcctaatttatataaactttgattaggtgg

SEQ ID NO: 3049 - DNA, 3199 bp, Zea mays
  misc_feature (179)..(179): n is a, c, g, or t
ctgtttaagggctaaattacaaaaaattcggtctgatcggcttctcgggcaagcggtactcaggccgcttttttccatcgttgcggacgggcagccagacgacggccacggcacgagaagcaggaagagaaggctagcccatcgatccaccggctacccctctgagtctattaaactgnacaccagtggtcccacgcatctaatggtggtggctgattcatcgggatccgcattttgggcccacacgccagagagaggaggtctggtagtgcgagtaccacccacacgaacaccagttcactaatcactacctctccctctccgtcgcgacacaggccacggcgggcggcggcggaggcttccgtgcggctcttggcggattgaacgcccactcgagctgcgccggcggctgtttcagccgtccttagatagaccctgctttcctcccgggcgaatccaagttgcccaaatgccgacaccagtgaagtcggtgctccccgtggtgctcctcggctgcggcggcgtcggccgctacctcctccgccacatcgtctcctgccgtcccctccacgccaaccaggtatcgctcttctccttgcccgtgtccgcgggtacgtatggccgattcggcgatcactgatccactgggccgccggtagggcgtggccatccgggtggtgggcgtcgccgatagctcctccctgctcgtcgccgaagatgtccactccaccggcctcgatgacgcgctcctcacccagctctgcgccgccaagtccgcaggctctcccctctcctccctgctcggccgaggtagacaggcatcccccaatttgactttgcccacttattacgatgtacgcgctccgtcgttttcgttgacatgtagaatgatcgatacttgggtgtgcggtttcagggcactgtcagctgttcaagaaccctgaggctaggggcaaagtcatagacgccgctaccacactcggaagaacaactggttcgttgttctgtgctcagctgcacatacatcatctgatcttcctattcatctattttattttttgtttcttcctttatagttttatgttccaatcagtagagcaccaaaaaagcttacatcgtcggtgttctgtgtacaataaatttcaattgtgtttctgaatttaagcccacatttcacatttcatcgtcgcatttcaggtctggtgctagttgactgttctgcaacttatgacactgttagcctgctgaaagatgctgtggatcatggatgctgtgtcgtattggcaaacaagaaacctcttaccggtgcttatgtaatactatttgacttgctcttctctgataatactctttcctaatgccagaatcgcactgcctcatgttgttctctgattaattaacaagtacatttgatgttgttgcaggaggattttcagaagttggtctccaacttccgtcggataagatttgaatctactgtatgtttgtgtttggttttttttcttccattttgatgcctgtacatttttacaaattgctgctatgcattttttttctaactactactatccatgaccagagttttgctgttatgatttatatgaccttgcctttaaatcgttgaatgcactggtgtctaaagaagtgaactatatcgctcaatttcattatttcattgtttccattgttcatttgtactggtcagcatcatttgcttgacaacagaatacaacaaacatacatgataggagtcaggacgtacatacagttccatttcacatttttctcttagagtcccttgttatactttcaggttggagcaggtttgcctgtgatagcttctgtaacccgtattattgcatctggagaccctattactcgtattgttggcagtttgagtggtatgcagctattagtctattgtgtaaaatggtgacagttttattaaaaaaatattacaagtttttccttcatatggatttgtaggtacacttgggtatgtgatgagtgagcttgaggatggaaagaaatttagtgaagttgtaaaaactgccaagtcccttggctatacagaaccaggtattgcagatatcttttgatatatttttattacagttagtatatgtgccaatttctagtagatcttctttgtgaagtagagctcaaacaaaagtctctatgaatttgaataatctaaggtcaaggaacacatccataatatttactcctttacctgtttgcaatatgtatttattgaagtgtttttgtttgccagatccacgtgatgatctaggtggaatggatgtcgctagaaaggttagatacctcacgatttcccattccattaactgtattctgttttctgcttttttccttgcctaagtgaactgttgtgtgttgcatgaactgctgctttgttgagtttattcatgtcctactagaattttatgtaaaaaatcatgtaaacataacccttatcacaaaatggtcggttgtgttatccagttttcacattcgcatttaataccttcatctttggatgcaggcattgatcctggctaggcttcttgggcaacagataagcatggagagtatcaatgtatgcctgtctgtactatttcttgagaagttgaggtttattattttacatttcataacattgttatatagaaacggtgctctgtacactgggtggcattttcactgttactggttagagacatgggtgcgctactctgctgttagttcaatgcttacaaataatcaagtagtttctgggaaaagtaatccttttcacatattgtaattgaggaacgtcagcctcatattcatttaaatgattagttgattacatgtagccatcctttaggcttatgtcctgttttatgaggaatagattgacttgtctgaatttgttacatcaattatatgctgatatgttagatctgtaagagtagacaaaatagtcctccaaacttgtaaagttgccgaatagctgagctgattgattgcaccacttgttttcttgtggtaggtggtaatttgattcttttatatgtcaggagtgcttttcttttgactttatatgatatgagagagctattaatttgagtatttctaacgctaaaatccatggttgctttcaattccgttttcttatacaatgctacggtattgatattttgccctgcagtcagtg

SEQ ID NO: 3050 - DNA, 2609 bp, Zea mays
gatcaaactcgaatattgataaataatatcaacattcagcaccaaacaatagttttaacaaaatttaacaatttcatcaatccagtagcatcaatcaatatatcatagatgtaaattggagatagtgtattgaattcgaatggcccacatgtcagataacagatataaagatatgatatatatatgcaaaataatatctatagatattttattatatccatacttgtacatatggataataaatgtcaatatatccatatctaatatataattactcactattatttattcatatccttaccctggagtagagttctgtcttgaagccttgaagatccaccggcgcggaatctcatcgattggctagacgcctacgtgtggcgtggcccacccgactctgacaacgcggctttgcatggacctcccgacgaccatttcaaaagggttcagaatttggctgctcatgcgttcacacaactcgcttttgatcgcgacagaagcgcctttcttttgcggtttaggccgtaccagtacaaccgcataaaattgacctggctgtggactatggtcactgctccgtacaaggagactccctgcacggggacccgtgctgagcttgggcaacaagagtggcagggggtggacccaacaagtgtgcccgccgatcgaggcagcggtggaccgaccgaccgtggtcgtcgacgacgctggctttccatgcaatgcaagcgccctcagtgacgcacgggaaaaggcgcatgcggcggcggggatcctttgcggacaggagatgacgatgagcgagcggtggacccagccagacgggtacctaggtggggcccgcacctcagcggccgccggccgcagcccaccggcacggcacggcgtccgcatgtgatgggaatgggatgggcggatggccagccggcagccaccgcaagcgcggcagcgacgcggtttccgtagggccccactccaccgtccggtcctctcctttcgctttcctcttccgcacccatcgctacgcgcaccctgaacccctactaccacgtagaggcctcatcccctgcttatgtttcctttttcgtgtttcttgtttttgttgaaaaatcatgtgcacctactcctatactctgctccactcgtcctcataaaacataaaggaaagaactattccgacattcaaatttgtcttgagttataagagataaagtgtaaccctttttaaaaccgagtttaaaaaatgattagatcggcatacatatataaccaaagtatcaagtatggttatatcacgaatgtcttcctatgatcaagaggtagttaaatacatcatttgtttcgcgccctagaatttctaaagacaccttgtgttccacaaacaacaaggaggcaagacattagggccaattttagctcacctgcgtctctcaaatgctgctatgctaatgtttcgaaagattctactgaaaatgatggtgtagacagcccgtgtgctcccaccatttcggcctcgcaacgctggctgctcacagtataaattcccgctggccgccgtcgcctcccgctacccgcctcacctttcctcgcctacgcctacccccaccacctgtcaccccaatccaattccaagctgcgagctgtcgagctgctgcacctcccctctctcgctagtcgcttccattcccttcgtcacatggcggcaaaccgctgcaccggcctcgacccaatctgggcccacgccggcgccagccactgctacttctcgtcgccccccggctgcctcacctccgcggccgccttcgagaactcggcgctcacctcggcgctccgcgcctccatggcgcccgcccacgccagctccgccgcggcccggcccttctccccgtccaccccgtcctcctcgacctcgtccgcctccgagctcctgtccagcggccacgacgcagctcccgcgccggcgtccagcgggccggcccagccgcccgccgcccgggccgcggcgggaggacctagagggggccgcgtcgccaagcgcaagccgcgcccgtcgcggcgcccgcagaccacatacatcaccgccgaccccgccaacttccagcgcatggtgcaggagatcaccggcctccccgcccctgggccctcctcctcctcctcccccgctgccgccgtcgccgcgcccagctggacgcccgccgcgcccgcgtgcgtgctcccgacactggacacgtccgctttcttcctgctcgaccgcgccgccgctgcgccagcgccggtggacaggagcccgggcgcgcgcgcgtggaccgcgacgcacacgcacgccgccgtggcagctggggccgacggctcggactcggcggcgctgctagagctggaggcactggtgcgcgccattgagggcgagtgtggcttcccggccctggagagctcggggctcatctgatgagttgggattggagcttttgtccgtccgaatgtccgatggcacatgatcggacggcggatgtcggttgagccgatgcctttgagatgtatactagcaagaagtattaggctgctgcctgcttttagttgagtacatctcttctccatgaggattacatgca

SEQ ID NO: 3051 - DNA, 814 bp, Zea mays
ttgggtccctcgcggccggccgggcccactgcacttgctgcaggagcagccgtagtacacacgcacaccgcctcgattcgactcccacctcccctgttctcaccgtgcttgccctgtttcgacctctgcccatccgcgctcgcgcgcccgccgtacagtacaggccagacagccatggtggtgctcgccaaaccgcctgtcgtcgaccagatcccgctcctgcggtccccgggccccagggacagcttctcgggagtgccggtcgtcgacctgtccagccacggcgcggcgcgggcgatcgtcgacgcctgcgagcgcttcgggttcttcaaggtcgtcaaccacggcgtggccgcggccaccatggacagggccgagtccgaggccgtcaggttcttcgcgcaggcgcaggcggacaaggaccgcgcggggccggcgtacccgttcgggtacggcagcaagcggatcgggctcaatggcgacatggggtggctcgagtacctcctcctcgccgtcgacgccgcgtcgctctccgacgcctgccccgtgccctccagcgccgcgttccggagcgcgctgaacgagtacgtcgcggccgtgcggaaggtggcggcgcgtgtgctggaggcgatggcggagggcctgggcattgcggacgcggacgcgctgagctccatggtgagcggcgccgggagcgaccaggtgttccgcgtgaaccactacccgccctgccccgcgctgcagggcctgggatgcagcgcccacgggcttcggcgagcacaccgacccgcagatcatctccgtgctccgctca

SEQ ID NO: 3052 - DNA, 1607 bp, Zea mays
cccagcgtccgcggccgcgtgatgcactgatccccatttagagctgatcgtcgcgtcgaggtactctactcatgcacccagccactacgtactatttgctcatcaagctaccaaggatttcttggttacgctagctcgccggtttcttggttgttactagcacccggcggcgtctgttcgtccacagctagccaatctctctctccgggggacgagacgatggacatcatcaacggggccgtgctccctcgctgccacgccgcccccgtcacgggcgccgcggcggcctccgtcgccgacgcgagagtgagcggacacctccagcttctccggcgcgtgcgctgcagaggaagcggaagcgccagtgccgggctgctgcatgcgacgacgccccgagccggcgtggcagcgcgcaggttcttctccccaccgctggggaacgggaacgggaatgggaggaccatcggctggcggccggctcgctgcacccacggcggctcctcctccgacggcgacggcgccgccgccgcggacttcgacgcccgtgaggaggagttcgttgactccagcgtcatggaggccgttgagctcaggagcgtgtcagacggcggtttcgtcatcaagatgcgcgacggcaggaacctgagatgcgtccagaacaacccccgggtgctgaggctccgggactccgcgccgcaccacgcgatcgtgctcaagatggaagacggcagcgaccttctgctccccatcatcgtcatggagacgccaagcatcatgcttctggctgcgcttcggaacatccgaattccaaggccaaccatctacaatgtggtgctggagatgactacaaggatgggatatgaggtgcgtttggtgcggatcacagaaatggtccatgacgcatactattctcgactatatctcgcaaaggttgggaatgaccaagacactatcagtttcgacctcaagccatcggatgctatcaacattgctttccgctgcaaggtccctatacaagtgaacaggcgtatcgcgtataacaacggattgaaagtcctacagccaaaggcggccgggagttatttaggctccgacgacattcaaatcacaaggcttgacaggcctgacgaccagcattgcagcgaggcccaagagttcgatctggtccggaacatgctcattgctgccgtagaagaacgctacaaggatgctgctcaatacagagaccaactttccatgttgcggtcaaagaaaaagaacgcgatatagccagatgggtgcaaagcttcaacttgttagagcttgatgggggtgtacagaggaggccttttttgctgaagcacgtgaagcttcggcaaacatctaaggaacaccatgtaaatacgtacgtattacagaatttatgtatagacacacacatacacggagagcctaattctggattctttagctcatagttgcactgttgcagtgattgtactctaaaatgcaaatgactgttgtgtacgcctaaaaaaaaaaaaaaaaagttgcatcaccgctgtttgtcttcaaatcggcaatcggttttgaagaaaaatagcatcgctgtgcgcgtttattggtcc

SEQ ID NO: 3053 - DNA, 2469 bp, Zea mays
ggaacgcaaggagacaagcaaatacattgttcagctcagtgattcctggatctgtaactgatgctttggatccagctaatcatcatgttattcacaatgttgtcactgcagacatcaggccgccccggccggtacacagtgttgaaaattcccaaaattcttccaaatttccctcgctgaagactgttatttacattgtaacacacaatggatacttccgagagtatctgatcggcacaaccaagtcaaatgaatcttcatggttgttggagcgtgaatttaatctcctggatgcttattcgggtagtcccaagcagaacgagctgcacatagactgacttgtaatgctcgctcctctgaccggaacctgagcatctccaacagaagttctatatttgagtccttaaaattaaaatatgacctgatttaaagtgtttagggctataaaactgtttgtaactccagcaattgagttctatatcatattattaggaaataaatcatgttatttaggaaataaaagattaaaaatagtgtagaaaatgaagatatggctctagtagatggggtactatatttaagacccgggagactgagccctataactgtttgatgagtttttataaaataggacccctgttggagtatgttggagtatgtttctggtgttagggtcctatatttcaaaataggatcctatttaggactcttgttggagatgctctataggtgattatatcttgggccttgacttaaccggtcattgggactaacttcaactgtacatagtatagaggtgttcatcactggtgggaatctacatgttgcggctcgtggcgcgtgtaaattatcatacaagtggacagcaagtttggtgcaatgcataaaaagctttcctaattttgagtacgtttcactttgagccagttaccccacccacccagaaaaaaacacccttcatcacttttgatcattttgatcactttgaacaagtgtgtaattgttttaccgttgtaacaaaaacaagtcttgtcttcttgctaattacgcttcatcagattgtctttagtgaggactcccttccataggtaccacaagaagattttatttttgagggtacttttaactttttaactttcataaccgttttttatatttgggatccgtgtccttatcatggtttcatatagagatttcaccaagaattgttcattctagtttaaattccaatgaaacctatcttgcccatgcgacgaagaaatattagtcaagcgtgatgagagttcattcaatactgctaatttgggaccaaataaaactcttcaatcaaaactaggtggatcaaattgaaaagtttctgcagccctgctgaattatatagcctcggatactgatctttgagagtgctaatatccggttagatatcttcacaaaatctcacttttgatctgtctttagtaggggtgataacgggctctaaaattttcagtataaaatttaagaatcggattggtttataatcagactctatttctattcatttttaaactaaaattaattaaagacttaaataaattgtgaagaaatatttagatcgtgatctattaccaatctagtctttagtgataaatataagtgtatgtttaggccgggtttgatgggtcgacccgaaacacggaaaaaagcacggcctgagaacaacacaattcgaaatattttaatgccgggtcgggtttgggtcgcggcccatgagcgggcacgagcacgacccgtttaaggtaggcacaaaatggcccatataaaggcacaaaaaagttcatatctatacttctatactatacttaaaacatccgtttcaacggtcgttctgcgtcattttttacaaataacacctgacatctatttaaaattaacctaccggtccccgcatatagatgaccaaacgacgacctggcacgggcccgctaggcccgacgccgcaggcatgacacaccggcctactgatagtgctgggccagctcgccggcccatttggttaaatcagcgtaaaatgttaaaaaatagtgcagtatatggggtttgaacccacactctaatagaagaagggtgagagacactggacgaagctgtctaaccagtaaaacatcatgatcagatgtttataattttgaatataaattgtacatacgtatatatgtttttttaataaaaaaataatcgtgtcgggctagcactacgggccgaggctacgacccaagaaccgcacgacgctcgtgccgggttggcccaggcactattaaatgggtcgagcctccgaccgacttgccagacacgacccgtttggccatctatatctccgcacgataatgatggttctcgcctcagttgccaccacctcattcaccatcctgcttattttctctctccccttatgcctccacctccgcactaccccattctcggcagaga

SEQ ID NO: 3054 - DNA, 1043 bp, Zea mays
aatttgcctatttccggtgcaggcagtctggcagagcgagcaggcaggcaactgggccagagtcagacaggcctgcccgccacgccgtcccgacggccatggcccgacccttctcttccccacacatcccgtcttcatcctgggtgactcgccgccctcctccctggacctcctcaccgtccgtctccaccacgagaactagcgcctcgtctattaccgcgtgcagaccgcgccgcagggcagtcgcgccggcggcctccctccacctcggcccgggggagatcgccgagctcgcgcgcaacaaggttttgattgcggcgacagtggcgagcgcgatcgggcagctgtccaagcccttcacctcggtcaagaatgggggcgtcggcgccggccttgacctcaggaccgtcttccgctccggagggatgccctccacccactccgcgagtgttgttgcagttgctacttcgcttgggctagaaagggggtttgcagactccatatttggaatgtcagtggtgtttgcagcaattgtaatgtatgatgctcagggagtaagaagagaagtgggcaaccacgccaagatcttgaacaggttttggatcctcaaagagaaggtacctctggagtattctgaagtggacatggcagctcctgggtttgtttcggtcaccgaggaagcgagctccaacgcgagcccctccttgaagcgcggttctagcaccgaatcaccaagggtgaatgggctccgtgggtcagagcctgagctgacagagctgaagcaggcttgcgtagaggaggattaccggttgagtgaatctgttggccacacggagcttcaggtcacagtcggcgccctgttgggttttgctgtaagcttagcagtgtatgcaacactgtaacggaccttttcatatcacgtccttgattgattacacatttacacttttttttacacagaaacaatacatgcggtttattgttcccaccgtttaaatcagaaatgcctatgctagctcgtttcacaaaaagaaaaaaaaaaa

SEQ ID NO: 3055 - DNA, 1448 bp, Zea mays
tttgaggcatagacagttcggtcatgtagtttgttcttttaattatattagtcggttacataagattgtcttctaaactcgtcagaaaatttaggcacaatttttttagcactttgccatgacccatgatcccctcccctagcattaatttgtttgcagaaagatgagatgtgcgcgctgtactagttgggtacacatggaagcgcgcgccactgtgactgtgagtctcaggacggacgatgatcactctccattaattcaatagggaccatggtttgctttgtcttgtctctaacgaatgcatccacggaaggacggaccaaccacttgcattcgacagcatgcgcatgcgatctcgtcgggtactgaagtagcgtccacgcctcctgcccccgcaatcacttccacctccctgctctgctttgctgtttgcatcgcatcgcgtcgcctttgctgaatcccagcgacggacgggccgccacgggcactgtacggtgccgacgagcattgcttgctgctgcctcggccggcatggcgatggcggcgccggtggaggtcggcacgcagggcacggtgggctcgctggtgctccgggaggtcgagcacttccggaggatggaggtcgccggcggccacggcaagaagagcagcaaggtcgttgcagccggcggcgccagcccccggagcaacggcggcaagaagcccaggccgaagaagggcgccgccgcagtagtaggcaatgcgtcgtccttcttgccgaggatgtgctcgtcggcggaggtcgtggaggaccccgccggcagcggccggagggagcggccgtccagggtccggtaccggcctctcggcgacgacggggacggggacgccctgccccagcaggactagctggtcacactcacagagcagggccgggcatgcaggaggatcgatattatgctgtgccagatcagattcagatccggagagatctgtgccaatagggtactggatggatgatgtcttgcctttttttttcatccgtttcttttgcttccgcttgttcagtgatgtttaggagtggtagatgtatgacgactgtggtttgactcgtatccaataataataataatctctattttgctaacaacattgcacagtggcacagaattgcagcttcacaatctgcttacttcgaatgtgttgttccatctgcatcctctactgccgttctcgaatatttatcgtccactaatttatttttaaactaaaacgtaataaataaaaaacaaatattccattaaccaaccctgcatttggacaatgtgatttcttgcttcgttttttttttaaacaagccacgtcggctctccgtaaccatattaaaatggtctattggatcacatatacctcttggtcaaacttctaaactttacaactcttgtaccaaaaaaaatcttcgtcaaaac

SEQ ID NO: 3056 - DNA, 1904 bp, Zea mays
attcggctcgagcgccaaacggaccaagaatttccacgcagatttcaacagagatgatgggctcgcccgccggtgctggtgcactcgcccatgtctcgcgcgtcgcaccgccgaggacggcgccccgattcgtcctccttatttaggcaccgtcttttgtcccccccatccgttccgagccgaaccaaggcgccatgagctccccggccgtgcgccgcgtcgtactcctctcgtcactcctctgcgccggagcgctcggtttcttgccctgctcccatgccgccgcggtggcgcccggctacgtcgccgtctccgccgccagcttcgtgccgtcctcaacgtgcagctcccccgaccgagttccgccgcaccggcggaacggcacgtccgccgtgctgcggctgacgcacaggcacgggccgtgcgccccctcgcgggcgtcctcgctagcggccccgtcggtggctgacacgctgcgcgcggaccagcgccgggcggagtacatactgaggagggtgtcggggcgcgcgcctcagctgtgggactccaaggcggcggcggcggtggcgacggtgccggcgagctgggggtacgacatcggcacgctcaactacgtggtgacggcgagcctcggcacgccgggcgtggcgcagaccatggaggtggacaccggcagcgacctgtcgtgggtgcagtgcaagccgtgcgccgcggcgccgtcgtgctacagccagaaggacccgctcttcgaccccgcccagtcgtcgtcctacgccgccgtgccgtgcgggggccccgtgtgcgcggggctgggcatctacgccgcgtccgcctgctcggcggcgcagtgcgggtacgtggtcagctacggcgacgggtccaacaccacgggcgtgtacagctccgacacgctgaccctgtcggcgagcagcgcggtgcagggcttcttcttcggctgcgggcacgcgcagagcgggctgttcaacggcgtcgacgggctcctgggcctcggccgcgagcagccgtcgctcgtggagcagacggcgggcacctacggcggggtcttctcctactgcctcccgacgaagccgtccaccgcggggtacctcacgctgggcgtgggcgggccgtcgggcgccgcgccgggcttctccacgacgcagctgctgccgtcgccgaacgcgccgacctactacgtcgtcatgctgacggggatcagcgtcggcgggcagcagctcagcgtgcccgcgtcggcgttcgcgggcgggacggtggtggacaccggcacggtcgtcacccgcttgcccccgaccgcgtacgcggcgctgcggtccgcgttccgcagcggcatggcctcgtacgggtacccgacagcgccgtcgaacgggatcctggacacctgctacaacttcgccgggtacggcaccgtgacgctcccgaacgtggcgctcaccttcggcagcggcgcgaccgtgacgctgggcgccgacgggatcctgtcgttcgggtgcctcgcgttcgcacccagcggcagtgacggtggcatggccatcctcggcaacgtgcagcagcgctcgttcgaggtgcgcatcgacggcacctccgttggcttcaaacccagctcctgctaactcatggattaacagtcggcgacttgggatcactactagtagtagtatatgcacgtacgtagacgagagtgcagagatacatacaaagttactgtacatgatgatagtaaagataaacttgcaggagagcgtataccatacacagcacacagcagtagcggtggaagttctttcgttggtggaattaaggggctaaccagagacgtaagcgtgacgcgttccaattgattcggcattgctaatcgagttagtgcagtgttaaaaaaagcggcc

SEQ ID NO: 3057 - DNA, 1977 bp, Zea mays
  misc_feature (1464)..(1465): n is a, c, g, or t
  misc_feature (1467)..(1469): n is a, c, g, or t
  misc_feature (1471)..(1472): n is a, c, g, or t
  misc_feature (1476)..(1477): n is a, c, g, or t
  misc_feature (1479)..(1479): n is a, c, g, or t
  misc_feature (1489)..(1489): n is a, c, g, or t
  misc_feature (1491)..(1491): n is a, c, g, or t
  misc_feature (1496)..(1496): n is a, c, g, or t
  misc_feature (1500)..(1500): n is a, c, g, or t
  misc_feature (1502)..(1502): n is a, c, g, or t
  misc_feature (1512)..(1512): n is a, c, g, or t
  misc_feature (1515)..(1517): n is a, c, g, or t
  misc_feature (1519)..(1519): n is a, c, g, or t
  misc_feature (1522)..(1522): n is a, c, g, or t
  misc_feature (1529)..(1529): n is a, c, g, or t
  misc_feature (1532)..(1532): n is a, c, g, or t
  misc_feature (1544)..(1544): n is a, c, g, or t
  misc_feature (1548)..(1548): n is a, c, g, or t
  misc_feature (1550)..(1550): n is a, c, g, or t
  misc_feature (1553)..(1556): n is a, c, g, or t
  misc_feature (1558)..(1558): n is a, c, g, or t
  misc_feature (1561)..(1562): n is a, c, g, or t
  misc_feature (1566)..(1567): n is a, c, g, or t
  misc_feature (1572)..(1572): n is a, c, g, or t
  misc_feature (1582)..(1583): n is a, c, g, or t
  misc_feature (1590)..(1590): n is a, c, g, or t
  misc_feature (1596)..(1596): n is a, c, g, or t
  misc_feature (1611)..(1612): n is a, c, g, or t
  misc_feature (1614)..(1614): n is a, c, g, or t
  misc_feature (1620)..(1621): n is a, c, g, or t
  misc_feature (1624)..(1624): n is a, c, g, or t
  misc_feature (1626)..(1627): n is a, c, g, or t
  misc_feature (1629)..(1629): n is a, c, g, or t
  misc_feature (1632)..(1632): n is a, c, g, or t
  misc_feature (1636)..(1638): n is a, c, g, or t
  misc_feature (1646)..(1646): n is a, c, g, or t
  misc_feature (1649)..(1649): n is a, c, g, or t
  misc_feature (1652)..(1652): n is a, c, g, or t
  misc_feature (1654)..(1654): n is a, c, g, or t
  misc_feature (1657)..(1657): n is a, c, g, or t
  misc_feature (1659)..(1659): n is a, c, g, or t
  misc_feature (1662)..(1666): n is a, c, g, or t
  misc_feature (1675)..(1675): n is a, c, g, or t
  misc_feature (1680)..(1681): n is a, c, g, or t
  misc_feature (1685)..(1685): n is a, c, g, or t
  misc_feature (1689)..(1689): n is a, c, g, or t
  misc_feature (1702)..(1702): n is a, c, g, or t
  misc_feature (1704)..(1705): n is a, c, g, or t
  misc_feature (1708)..(1710): n is a, c, g, or t
  misc_feature (1712)..(1712): n is a, c, g, or t
  misc_feature (1714)..(1714): n is a, c, g, or t
  misc_feature (1716)..(1716): n is a, c, g, or t
  misc_feature (1719)..(1720): n is a, c, g, or t
  misc_feature (1722)..(1723): n is a, c, g, or t
  misc_feature (1725)..(1726): n is a, c, g, or t
  misc_feature (1728)..(1729): n is a, c, g, or t
  misc_feature (1736)..(1736): n is a, c, g, or t
  misc_feature (1740)..(1740): n is a, c, g, or t
  misc_feature (1742)..(1743): n is a, c, g, or t
  misc_feature (1750)..(1750): n is a, c, g, or t
  misc_feature (1753)..(1753): n is a, c, g, or t
  misc_feature (1756)..(1757): n is a, c, g, or t
  misc_feature (1760)..(1760): n is a, c, g, or t
  misc_feature (1765)..(1765): n is a, c, g, or t
  misc_feature (1767)..(1769): n is a, c, g, or t
  misc_feature (1772)..(1773): n is a, c, g, or t
  misc_feature (1777)..(1778): n is a, c, g, or t
  misc_feature (1781)..(1782): n is a, c, g, or t
  misc_feature (1788)..(1789): n is a, c, g, or t
  misc_feature (1792)..(1792): n is a, c, g, or t
  misc_feature (1795)..(1795): n is a, c, g, or t
  misc_feature (1797)..(1800): n is a, c, g, or t
  misc_feature (1803)..(1804): n is a, c, g, or t
  misc_feature (1809)..(1809): n is a, c, g, or t
  misc_feature (1812)..(1812): n is a, c, g, or t
  misc_feature (1824)..(1824): n is a, c, g, or t
  misc_feature (1826)..(1826): n is a, c, g, or t
  misc_feature (1830)..(1830): n is a, c, g, or t
  misc_feature (1841)..(1844): n is a, c, g, or t
  misc_feature (1847)..(1847): n is a, c, g, or t
  misc_feature (1849)..(1849): n is a, c, g, or t
  misc_feature (1852)..(1853): n is a, c, g, or t
  misc_feature (1856)..(1856): n is a, c, g, or t
  misc_feature (1859)..(1860): n is a, c, g, or t
  misc_feature (1862)..(1862): n is a, c, g, or t
  misc_feature (1864)..(1864): n is a, c, g, or t
  misc_feature (1866)..(1866): n is a, c, g, or t
  misc_feature (1868)..(1868): n is a, c, g, or t
  misc_feature (1870)..(1870): n is a, c, g, or t
  misc_feature (1872)..(1872): n is a, c, g, or t
  misc_feature (1880)..(1880): n is a, c, g, or t
  misc_feature (1883)..(1883): n is a, c, g, or t
  misc_feature (1889)..(1889): n is a, c, g, or t
  misc_feature (1897)..(1897): n is a, c, g, or t
  misc_feature (1901)..(1901): n is a, c, g, or t
  misc_feature (1905)..(1906): n is a, c, g, or t
  misc_feature (1915)..(1915): n is a, c, g, or t
  misc_feature (1917)..(1919): n is a, c, g, or t
  misc_feature (1927)..(1927): n is a, c, g, or t
  misc_feature (1937)..(1937): n is a, c, g, or t
  misc_feature (1947)..(1947): n is a, c, g, or t
  misc_feature (1954)..(1955): n is a, c, g, or t
  misc_feature (1959)..(1959): n is a, c, g, or t
  misc_feature (1962)..(1962): n is a, c, g, or t
  misc_feature (1964)..(1965): n is a, c, g, or t
  misc_feature (1974)..(1974): n is a, c, g, or t
gtgagagagacaaagcagtgcaggatctggctcggctgaagcagcatttgttagataaggatcttgaagaccaagaaaagatggatgaagatagtaaactcattgaagagttgcgggtagtatgcgagcagcaaagggctcatataatgcagttagagagggctttaaaggtcgagatggcaaagcaggaggagaacaaaaaggtcataagtgaagagcaccagaggtcaaatgaacaaatagaaaatttgaactacaagcttgcaagctgtatgagtgcacttgaatcaaaaaatgtggagctgctaaatcttcagactgcccttggacagtactatgctgagagtgaagccaaggaccgacttggaggtgatttagctgttgctagggaagaactgtctaaattgtcagagtcattaaaggtggcaaatcaaaccattgagatttcaagaagggaaaaggaagatatggctaccaaactttcacaagcagagaggatgttggcagatgggaaacgatccatgcagaagcttgaggatgacaattcaagattgcgaagagcgctagaacaaagcatgacaactgtgaataggatgtcactagattcagataactccgttgacaggcgcattgtgataaaactgctagtcacctacttccaacgaaatcacagcaaagaggttctggatctcatggtgcgcatgcttggcttctccgaggaagacaagcaaaggattggctttgcacaaagtaatgctggtaggggtgtcgttcgtggtgttttgggtctcccgggacgcctagttggaggaatcgttggtggaggtccatctggcaaatctactcaatcgtcccaggatagccagtccttcgcggacctatgggtggacttcctgctcaaggagacggaagaaagggagaaacgggaagcctcagaagctgcaaggcaatcacagcaagagagccacaccaccaccggtccaagtacatcgtcgagtatccaacagccatcacagcacaacccctcaaacgttgcacctggcccatccacaatgccacacaccgcttgggtctcccagaatcggaatcctcaacagttccgctagcatcatcatgctcgtccgtgctggctccatccccaagaccacctctaagatgatactcgacgatgccaattttctttttatggagtagaaatcaagtgcacactgtacagtatcggatacctttttgttgtgctgggagtgatcccgcatgcggacgccaaggctatttgttccattcgttgacaatgcgatgatgatagtagtagattcaaaaattggcctccttcctggagcatgtaaagagatcgatatgtaaaatggattcctaccctcgacaacagatggaggtaaaatgggagttggttatacgtatgttttgaagtaagaattttgatctgcaaaaaaaaaaaaaaaatanntnnnanntaanntnttataatatntnaattntgantntttattatanttnnntngcntgggggnccngtacccaaattnaccntntcnnnngncanntaanntgcantgggcagtannttaatanagcggntcaacatgtgtaacnncnttgttnntancnnantantcannnttatattncgnttncnttntnatnnnnntgtatttcnacatnnttangccncattcctattttncnntgnnntncnanttnngnngnncnnatgtgcntatntnnatttgtnatnctnnttnatatncnnntannaacnntcnnacgaanntgntcntnnnntannacttntangtgttttcactntncgtnttatatgtgannnnatntnttnnatncgnnantntntntntnccaatatntgnttatantgcgtgtntccntatnngatacaatnannnttattaanaatatttatnaaaatagagncttatgnncctnttnanntgtcaatgngac

SEQ ID NO: 3058 - DNA, 1595 bp, Zea mays
tgggtaccctccgaggccggccgggatataccactcagtgacgaagatactacgtctcacaagtgcattcaggtggggaaagcgatcagttgtctggtgcaattcttattaaagcctacttgagcaatgcatcggatattcttggtggatataatgcggtggttatccctgtaatttttgtgtcgagatttgatgatgataaagacaccagtgctttatatgaagaactttgggaggatattcctagtagtgaaagagtaaccctaacactatatttaccagaaattgtatctcttttatgtgatggcatgtcattgtcatcatgggctggtaaaagaaagtcagccaaggctataaagaagctatgtgatgttctaggagaacccctttcagcacactaccagaatattctcaaatcacttctgaaagaattgccaggtcgattttgggagggaaaagatgctattctggatgcattggcttcattgtgtgcttgctgtcatgttgctataactgcagaagactccagcttgccaagtgttatactaaattctgtttgtgctgcatgcagtaggaaatcaaaattgtaccgtgaagcagctttcttgtgtttacacaaagtgattacggcattcagagatccaggatttttcaatagtgtgtttccaatgctgttcgaggtttctaaccaatctgccatctcgaagacaaagggctctgctgaactagatgaaagtgaaggtgcttctgtttctctggataaagtgctcaattgtgcaacatcttgcatcagtgttgcttttccacaggatattatcaaccaaaagaagaatgttgtagaactaatattgaattctctcttgcctgaggagagttggcaagttaaactatcatccttcttgtgtatcaaggagttgtgcctcaaatttcacaattctggtgatagtaacacatggcctcaagacacagcttacttggttgaggagctatttcatttggtatcaccgaaattagtagactccataagattagtaaagattgctcaggttcacgttgctgcatcggagtgccttcttgatttgagcaaactgtacagagacttcccgctgtcgaacagaacagaggccaagttcgaggatgaactcacagagctctgcgagtctgaaaaaagcgaacaagcaaaggcgattctgaaggaatgcctggccattcttaaagctctccctggagtaaccatgacgacggattagaaaccagaagagggaacacgcaaagttctcatggtgattgtaaactcgttccgatacatagtaaagttctcttggtgattcgaaactcattcggatgtatgcatgtggtacagaatacggcatagttctccctccgttttgtgtcatatggcaggggagataggcgcatgcttccattagttttgctaatttactgcctagatccttatccttaaccgtgatattctgatacatgtgcatgtaagaaacacgagattgtccggcagcaagaaactgttgcagcagcatttgttgtttaaaaaaaaaaaaaagaatatgaaataaataaataaaaaacaaaaataa

SEQ ID NO: 3059 - DNA, 1268 bp, Zea mays
cggcgggtcctcgccatgaaaatcacaaattgagagagagggagaagggggtgggggttacgtaacacggcgattcaggaggggatagcatcgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccaattgcatctcctgtggggtctacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttgggtaccctggggttctggtcccaattggtgtgcacaattatttctgctggaattttggcattctctacagttgtaacggggaaggtgacatcaccctttacattctatgcaactgctgctggtattgctgctgcttttatttcagtcttctggtcatttggttacatccgtctctctgaaaggcttagaaaaacatccaaagaacctgctaaggctcctccacgtgctgatgttgttaagagccttaaaaatggcatcgtggttaatattcttgggatgggcgctgctgttctcggcatgcaagctactgttggtgctttggtagcaaaagctctcacaacctctgcagtaccctattatcaggctgctggccaaagccctgtcttggctttagatgttttcctagttcaggcttcagcgaacaccatcctgtcgcatttccttggggtggcgagctccctggagctgctgcgctcggtgtcactgcctccagcagaagccgccgtcccggccccggcccctgcacgggcctgagccatggcccgttgggcaggtcaagaaaaaccttcaatccttggctttggctctagacagttgctatttcttgattgcatgtacaacttgcatcaagaatacatacacatcgatgccttccagttcacctggacgcaacatgttcgcgtaattcccgccgagtgtgagctcttgcatgagcactcgcgaaccacatgtggcgcttgtttgctgtgcaagtgcaagtgagtgcagtgaccggctctcgctcgttcttaatcatagtacccgaaaaaaaaaaaaaaaaaaaaaaaaagcggccaaaaaa

SEQ ID NO: 3060 - DNA, 1289 bp, Zea mays
aatattctaaaacaccaggacgctgttctcacgaagcccgccgttcggagttctacaatcccaaatagcatcgtcatcgcaaaatgcaggcgctcctactccccgcgcgggccgcgccgccaccgccggcgatccttcggcagcgtgcggtttccgcgtccacgtgtgcgtcgcagggctgccgcctcctactcggtgcctctggttgtctcagctgtggggtaagatatcggctgcgcctcacagttgtggcggcggcctcgtcctcgtcgggaccgctatacccgacgcctctacccaccgaggaggaggtggagcgggtcaagctcgagcaggttatgaggagactagagaaaacagcaaggtatttcaagaatttgggtaccctggggttctggtcccagttggtgtgcacaattgtctctgctggaattttggcattctctacagttgtgacagggaaggtgacagcaccctttacattctatgcgactgctgctggtattgctgctgcttttatctcatccttctggtcatttggttacatccgtctctctgaaaggcttagaagaacatcaaaggaacctgctaaggctcctccacgcgccgatgttgttaatagcctgaaaaatggcattgtgctgaatattctcgggatgggcgccgctgttctgggcatgcaagccaccgttggtgctttggtagcaaaagctctcacaacctctgcagttccctattatcaggctgctgctccaggccaaagccctgtgttggccttagatgttttcctagttcaggcttcagcgaacaccatcctgtcgcatttcctcgggctggcgagctccctggagctgctgcgctcggtgtcgctgcctccagcagaagctgccgcccctgccggggcctgagccatggcccgtgggcggcagggtcaaggaagaaccttcgttccctcggcggcggcggctctggtagacgtagacgctctcgctgttgctgctccggattgtgtgtacagctcgcatcaagcttggtacatactacacacacatcgatgccttgcccttcggttcagctggaaccaacgtgtctgtctgcctagttcccgccgggcgtgaggcgagctcttgcatgagcacttgcgagttgcgaatcacatgatgtgtgtggcgcatgtttgctgtacaagtgagcgactgggttccctcctagtcattgtacccgcttcgctggtcgggtataaaaaacggccagtataaatatccattttttttaaaaaaaaaaaaaaa

SEQ ID NO: 3061 - DNA, 4614 bp, Zea mays
  misc_feature (734)..(734): n is a, c, g, or t
  misc_feature (990)..(990): n is a, c, g, or t
  misc_feature (3148)..(3148): n is a, c, g, or t
ggagaatagtgggtagcaattaataatatttattatgacgcagattacagaaatttaaatatttcgagcaggtacacatatatattcaacgaacatgtttaattagatgaaactccaagaagatttcatgaaatctcagacaaaatccaagcaaaagtctaaacgcaaagatttcaggagagtaataaacgacataccttacatgaaactccaagaagaaaattaagtgaggagctattctccggccccaccgaggctatggtccgcaggaactctatatcagattgtgggagagaagacaacgaggagaggtttccaggcaaagaaaaaccctcctaaaattagatggctcctgaatgatggccaccaatcagcaggcttaatttagagctccaacccacaaaaataacttgtttatacatacatatatgctctttttttcctaatgaagaaaattactgatgtgagttgaaacttgaaacacaactggtcattgcttaattttactgctgtaagttgtaaccgatcacatgtccttgtaacagcatccttcctaaatgcttgtggaagaaacaaaaatcaggcaattaaggacagcacagttcccacaattgtttacaagactttttttggcaccttaaaattatgaaagaaagcatggcagtttttgctgtctctgtatgtatacgtacattcaacaaattcctacgaaatgctgcaaaagcctagtgatnaaaaagatataagttcaacagcatatagtattgatcacctagagaaagcagtacagttttcatagccagtgacccaagtttatgaatacaccacccaaaattaaagttcagtgcaaatttgcaaaaagtaacaccattgagacttaactaataccttccaaagtgtgtgtttccatggagcattattgtggccctgaaaaacggtgtcatagttttaattgtatatcatttaaataaagaggggaaagatttaggncactaacctctagtcctcctctagaacaattctctgttaagtaaaagtctcagtgccagcctgcacatctgagtcgtagttcttgtttatggttagcgcgatgcgcttgtgtgctgcgctgtcaaaacaaaaacaatttattaacactaaaaatgtaaggaatggttcttatttacatgcttgccagctcattaccatgcatttcagaacacgttgagttttactacgaattattaggcaaactgctcaagtataatgccaaagacggttattgggagtgccaatattctaagacacctggtggacgctgttctcacgaagcccgccgttcggagttctacaatcccaaatagcatcgtcatcgcaaaatgcaggcgctcctactccccgcgcgggccgcgccgccgccgccggcgatccttcggcagcgtgcggtttccgcgtccacgtgtgcgtcgcagggctgccgcctcctactcggtgcctctggttgtctcagctgtggggtaagatctcggctgcgcctcacagtggtggcggcgtcatcgtcctcgtcgggaccgctatacccgacgcctccacccaccgaggaggaggtggagcgggtcaagctcgagcaggtgctttggtagttcctttccttcctttgacctattggttcgaagccccccctggtcatgctctgtgtgggtggagtagggtttatgtgatagcttgaatgaggaattttgtggtccggtgttctctgacaaccttggtaacattttgaggtttttttttccattaagaaatctagttagctgtggactacgtagatggtttcttgttgaaatgctcttgggcaggattggttttgtggcactgcctacgatgtgtgttatgtcgcttaggaattgtaacagcctagggagaaggaacgcaaacaaatttgtcgggagctagctaaggctagatctttgttgctagttgatcatccttcattctccactgtagcatcaacttgttgtcagatagttgatagacaagagtaacgattactcttgttcatcagcgattttgaaactatgcgtaatttctgactgacattttcgttgaacatttaccactttccaattttaaaagcatcaacgaaggcatgcttgcagtttagttccatgtgcttattaggatttcttagttcatgcctactaggcacttaggttctttattaatacaagaggcatggaaaaatagttttaactcatatgccatttaattgaggtatacaaattatggaagttttagtacatgagctggttaatctccactcttgttttttgtttgaaatcatgtttcttattcacatggtatcattgtaaaattgattatgtgtttcttgcttggctctaaatggtctcgcatacatacagggattctgaaatatcgttttccccctctttcttctgtattggctaaatggacaggttatgaggagactagagaaaacagcaaggtatttcaagaatttgggtaccctggggttctggtcccagttggtgtgcacaattgtctctgctggaattttggcattctctacagttgtaacggggaaggtgacagcaccctttacattctatgcgactgctgctggtattgctgctgcttttatctcatccttctggtcatttggttacatccgtctctctgaaaggcttagaagaacatcaaaggaacctgctaaggtacccccatttttctcgacttcgcactgatttgacattgttagccgcaatagctgaattattcacataaaagaagggcagacccagtgcccaaagctaccacatgagtgtggtctagggaagggataaattgatgcgtagaggctgcttcgaactgtgatagctctcaccaacacagacctctttccagtgaaaaatccctgcacctccttcccactcgctttggctcatcttttttaaatgcctactgctatccctgtgctatcgaggtggttcagaccacggtatttgtctattatcatagacagcttctagctgcttttcaacatacgtattgaatagttagctttgtttgggaagcttggttaggttagaaacgaaactgttttactttcgttaagatacatacgaaactgttaatcatttgcttttcaggntcctccacgcgccgatgttgttaatagcctgaaaaatggcattgtgctgaatattctcgggatgggcgccgctgttctgggcatgcaagccaccgttggtgctttggtagcaaaagctctcacaacctctgcagttccctattatcaggctgctgctccaggccaaagccctgtgttggccttagatgttttcctagttcaggtactcgattgttcactcctatcaccatttggcatgaatcattctctcatcgatgtttgcacctgtagccagtcaaacagtgttgttagagttcactgcatcaacgtctgcacctgtaacctcagggttaccttaatcagccttttttttgggtgggtagggggggtaaagtgctttaatcagccttgacattggtttaggagcactgcacctaacttcgtttttacgagaaaatagtcccgtctgtagagtctagtaaatatttgcttagtgaaatcacatgtccaatagagaagtatcttgccttgacctcactactcagggttaccaatgcagcctgcagactgcgaccctgacaatgcaaataactgtaggacactcccaagattaggatcctgcagacatttgctactactcaagatcgttcatcatagtagaaccttgcagggggacagacctgcagttgaagttgtaatctgctagggtactagaaggggagaaaaaaagaagaagaaaacgcactgttagctattcgtttgctagtccgttattatgttatgaaagaggctttaacatcagctttgtagtaacctttgttggtcgtctcgttgagcaggcttcagcgaacaccatcctgtcgcatttcctcgggctggcgagctccctggagctgctgcgctcggtgtcgctgcctccagcagaagctgccgcccctgccggggcctgagccatggcccgtgggcggcagggtcaaggaagaaccttcgttccctcggcggcggcggctctggtagacgtagacgctctcgctgttgctgctccggattgtgtgtacagctcgcatcaagcttggtacatactacacacacatcgatgccttgcccttcggttcagctggaaccaacgtgtctgtctgcctagttcccgccgggcgtgaggcgagctcttgcatgagcacttgcgagttgcgaatcacatgatgtgtgtggcgcatgtttgctgtacaagtgagcgactgggttccctcctagtcattgtacccgcttcgctggtcgggtataaaaaacggacagtataaatatccattttttatacggattcgggcccctttaagtctagtttgggaacaccatttttctaacggagtgtttggatcccttcattttagaagaattggaatttactaaataaagtaacttatttagtttggaatttgacattccaccgaaaaaaaaaaaaaaaaaaaaaaaaaaagcttgtttgt

SEQ ID NO: 3062 - DNA, 4302 bp, Zea mays
gccggtcataacagccattctcttgttttcagcattaccttaatcagccttttttggataaactaccttgattttgagtactgcaactaacttcatttttacctgaaaatagtccatctatatggctgtaaattaatatattataataatatattttgtaattaatctaatgttatttattgatatcataaatattgataccttttatttgtatttggttaaacttaagataaaaacatgatattctgctaaaatcggggtttgctagaaagtattagcaacatttatatctcttaataagtttatgataaaaatagtgaacgatctatctaagatactaattacatagtccctccacatccaaattgtaaatcgttttgcacaaaatttaagtcaatcttgtaaaattctgactacaaataacggttgttatttagttttgaaacctaatagtcatatgcaccaaagtataaatgcatgaatagttcatttgtatttttttaaaaaacattggtcaaagctatattttggagtgttgttgtcttaagcgacttataatttaattataattcaaacctgtagggagtactataaatattaatctttatatatatatatttggaggttaaatccgtttgactcgtcgaaacgacccttgttttggaacggatggagcagaaaataaaaataaaatgcactggtagctgttcgttacttgtattaaagagcatttaacatcaacgtgtaaccctgtcttgcctttgtgaatgttttcctagttcaggcttcagcgaacaccatcctgtcgcatttccttggggtggcgagctccctggagctgctgcgctcggtgtcactgcctccagcagaagccgccgtcccggccccggcccctgcacgggcctgagccatggcccgttgggcaggtcaagaaaaaccttcaatccttggctttggctctagacagttgctatttcttgattgcatgtacaacttgcatcaagaatacatacacatcgatgccttccagttcacctggacgcaacatgttcgcgtaattcccgccgagtgtgagctcttgcatgagcactcgcgaaccacatgtggcgcttgtttgctgtgcaagtgcaagtgagtgcagtgaccggctctcgctcgttcttaatcattgtacccgtttcgctggtctcaaaaaaaaaaaaaaaacgatcagaacaagacccccccgaacagttttcctggcgggcctgctggaggatgatgaccacttccactgggccaacccgccggtttgcacgggagtcggttacggccagccggccaatgatgcacgcacatctcatcctccgcattcaccaccgcttgtccgcttgcggggcgctggaatccgcgtagcgtgctaccagctatgcacgcacgcgaaacacattccgacggcggcgtgtttaccggcgagcctgcgtgtgccgtgtgtcgtcctttatcccgatccccgtctcgtcgccacccacccaccggacagccgtacgtatgcacttcactgctactccggtggcgatggtgatcaattctcggatccacccacacgcggaaccaccaaccaaaccagccgcccgccgcggagccggagcaacaacgctgaaccccgggtggacgcgacacgacacgagacagactcagagaggccagagcaccaaacggggcctgaaatatcccgaatcccagacgacggcacggcggacggttgcggttggggctgtggggatcgcgcccgtcgcgggtacgtacgtggtgctggtacgagcgctccgtacacggcccgccgggtctctggaccgcgcgcgcataaacaaagccgcacggccgtttggtgggcggccagcagggattcccgccgtgtacgcggcaagcggcgtggagtgaatcttggactaataggcgagcgagtggccctctcgtctagtcatctcctccccttttgccagcccggagataaaataacaacgcctgagtggcccctctcgtctagtcatcgggagcgagggaagttgcaaggaagctgcgcgcgtgactggctggaacgggtaaggaggttgtttggtctggttcggtcgccgtggaggtggatctgcccgcccgcccatccctctattctattgcaacgggatcagccacacccgcatggtacagtccagtacagtacccgcccggtgtcggtgcggtgggaggccgttaaagcctcgccagccaggctggccctgcgcctccccagatccaacacgtcccaggtcccgccccgctcctaccctctctctctctcggatgccgatgcgatgcagatgcggcctgcctgccgcctcctctgacttcttttcgctccttttcccctgctgctttcattgaggcgttcgagggcggggcgcggccgtcgtcgtctagcgcgacgcgttctggggccattgcatgtacgcggtactggagagtagtacgtggagccgcctcgcgtatcggctggctgggcctcgacacggacagcgtgtggtttcattgcattggcgtgcgttgcaatctggacgcgatggggggaggagatcggccggtccatccgtttgcttcgctgtgctgcgcgctgctcccccgtggaggtggttgcttcctgcagaggatggggtggtgccgtggtgggacttgaagtcaatgctcccagtgctctttacggtgcctgcctgccgcccatcacctatcggtcgccgcctacctccccgttcttacccaaacggttgcacttgctcacttgcatgcacctaggcggtagcttcctctctctctccaagttactccatgatgcgcccgcccgtaacccagtctcgagctggcagatgatgacgcgtcgtcgtagcccactcgtaccatgcactccactaatcaaagccccgccacatggacatggaagcagtgtgtgtatagcacatgcttacaacatgaccagctacaacgcagtagcagtaaccacgatccagcggccggtccggtaataaccgggcacgtttttttattctagactcaactcacagtcacaccagcagtggcagtgccagctcctgccgggtgccggccgtacgggtacgagccactcgtgggctcgaggcgcgtcagagcgagcgcacacgcacacgcacaggagagacacctgggccgcgggagctgagctgtgcccataactgccatgccctcctccctccacgaaatcgcgccggttttattgccccgcgcgccccacccttgccccgagagattgcgctccagcctggccccgggccccgccacccgcaaaccgccgcgccccttcccctgtcgccttcctcccctgtcggcccaccgcgtgcctccctcgctgccccgcgggaccggccgctgcgtcgcccgagctgtcagcggcggaccgggtcccatcggtgcggtggcgggagactcccctcccaaccgtcgcgcacagcggtcgtactgtccggcttgtacacatgtacgggcgcgcgggcaggggtttgggggttggggcggacggggactggcgcggcacgggcgactcatcaattcgccgggatgggccgcgggtcgggtacacgcgccgtgccgctctgcgctgagcttgcatgatttgattccagctccaagggggatggaccgatggatggattgatgggttccgttggaggccttgttcgtttgtgtcggattggtgggtcggaacgatttctaaccggattgcttatctaatttatataaactttgattaactggaaagattccagatgcaatccgaacacgtccttagggactctcgaagagggggaaaaactggacgtgtaataattaactttcaagaagggactaattgcgtgggacccgtcaacctgatgaaatcactcctttgctcgcgatcctcgtcagctcagctccaaccgacgactattaggataagctagtagtagtagagtactcctagtaataaagcctagccagctagccgtgacgcgcgcgagccatttgcatgccggtcgttgccttcccccttgtacgcttcgatcacacagacacaagtggcgcttttgttttcgtggtacccggaccgcgactcatccttttgcgctttttctgggtaagtacggtcatggtacgggctctaaagttaccgggagaactcggcgtcgtcgtcgcgccaccatcgcttcgccgccacccacccacctgacctcagacgacagacctcaccaagaccacttctcgccgccgcgctcgtca

SEQ ID NO: 3063 - DNA, 1058 bp, Zea mays
tgctgatgtgtgcagaatctgagaaagtgccatctgatggaagttcctgttggatgtttaatctaattaactttgttttttatgaagtagcatgaagctgaatatagtccaacagtgcaaaagcataggtctttcatttgagcttgctggtcaacttgtacagagagtgatcatatttcttcttctttttttacgttgattacacccaattagtatatatagttgcatacccacttggatgatttagttagtgaggaacacaagtgaagatgagctttgcactgttcaatgcttgtgcttggaagaaggatgctcttgcgcccgcagttcgttgttatctggaaagtggcttgctactgagcattctcttactacatgatgtaaattgtgaatctccatcaaggctggcttatggctgaagagtcagtatcatagtttcctttgatgggagaggacagcaaagccagctaatctcgctatccaagaaatcggctagtagttttttcccttttgaaccttgtcacgatgccttgtcttctggataaagttcacgcaggtttcaaataagaaatcacatggacgactatcagacttgtatggaatatggatgctgtacaaagatttctaatgtacattagtctaactttttttttcgtgatccccgaaatgccgactatcaccagcgcatgtacatgtatatatacatacactaaaggttggggcatttttaccacgtgctggtctctatgtatgacgcctttggttccgtccaacttttagtctttcacatttttgaaattttgtgacattatagtttttttgttaggatagcgtctagtactgggaatttgttgcagaatgcaaaataaattccgtgctgtacaacttgtagccgagtttcaggtcgtcgagtgaagtgatggtaactgctccccgaatttgcactatgcggtctgtggatatagctacttgaatgaaaagtttgtttccccccatccaaaaaaaaaaaaaaaaaaaaaaaaaaaaaaaaaaaaaaaaaaaaaaaaaaaaaactcgag

SEQ ID NO: 3064 - DNA, 1076 bp, Zea mays
cgccgcgtttgcgttcgccacctccacacgcttctctctcctttatctttgtgtctgcgcctccctcgcacagactctcgcgcgggcacaactgcgcggccagacagggctcccacagaccatcaccacaacacacaaagacagctcagagcctcacacacaggctcctctcccccgttgcgcaacgcgctttcccccacttcacccgcctcggcgccatggctaagctcgcgctggcgctggcgctcctcctcctgctggccgtggcggcgtccgcgtcggccagcagcgggagccacctggatctcgacctgggcttcctctcctctggggaccgccggagggagtgccgcgggacggtggccgagtgcctcgccgaggagtcggatgaggagggccttgacctggccggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgaggcggcgccggatccgcccgactgccgaggaaaggtctggttggtcaaggtcccggccctttcgccgacaataatttctttcgccttgttcgttcaggcgctaccgccaccgccactgctgtttactatagcaccagacctacggattgaattgttgtatggatttgtttggccaaatctttgttctgttgtaaagtaaggggagggattcctgcccctgcgcctgcttaaaatacttatatgaacatatcagtctttcttgttttttttcaaccacaaacccaaccgcccgattggttggttctcgtatgtcctgcttgatttgaattgattgttacaaaacggcggattctgagttcgatttgctggttgccggctggccatggccatggaatgctgtgatttcgcccagcctgggattcatccttcagatctaggatatgcagaaccgaaccatggcctggactggactggagtgccattcctgatctgcag

SEQ ID NO: 3065 - DNA, 438 bp, Zea mays
atctgtgtctgcgcctcccttgcacggactccgtctccactccttgacgactcacgagcacagcaaggctcgctcgcttgcacacaccaagcaagcaggccgcaggcgtctcacaagctctccgccgttccccaacgcgctttccccggcgccatggccagactggcgctcctcctgctgctgtccgtggcggcgtccgcgtgggccggcgccggcgcgagccacctcgatctgggcctgggcttcctctcctccggggaccgccggcgggagtgccgcggcacggtggccgagtgcctggacgagtcagagggcctggacctgggggcggggcccgcgtccgtggagtcccaccgccgcgcgctctacggcggcggcggcgggtacatcagctacggcgcgctgcggcgggacaacgtgccctgctcccgccgcggc

SEQ ID NO: 3066 - DNA, 764 bp, Zea mays
cattgggtacctcgaggccggccgggatctttgtgtctgcgactccctctccactccttgacgagtgacgactcacaagcacagcaaggctcgctcgctcgcacacaccaagcaagcaggccgcagcccgcaggcgtctcacaggctctccgccgttccccaacgcgctttccccggcgccatggccaggctggcgctagcgctcctcctgctgctggccgtggcggcatccgcgtgggccggcgccggcgcgagccacctcgatctgggcctgggcttcctctcctccggggaccgccggcgggaatgccgcggcacggtggccgagtgcctggacgaggaggagggcctggacctgggggcggggcccgcgtccgtggagtcccaccgccgcgcgctctacggcggcggcggcggcggcgggtacatcagctacggcgcgctgcggcgggacaacgtgccctgctcccgccgcggcgccagctactacaactgccgccccgggggccaggccaacccctaccaccgcggctgctcccgcatcacccgctgccgcggctgagcggatccggcattccacccgccgccgagaataagttcttttgccctgttcaccccacccgagtgctaccgctaccgccgccgctgttcacaagtagtactagagctatggatttcattgttgtgggggatttgtttgccagatccttgtgctcccatgtccccttaataccccttattattcttctccattccattgcttt

SEQ ID NO: 3067 - DNA, 1499 bp, Zea mays
ctcgaggccggcacgcgacatgtcccttacctttgactagcagcagcagcagcacagctgtggccagttgtgcgctccgcgccgcgcaccgcgtccgccggctgcaggaggcgccgcgtttgcgttcgccacctccacacgcttctctctcctttatctttgtgtctgcgcctccctcgcacagactctctctcacgagcacaacagggcggccagacagggctcccacaggccatcaccacaacacacaaatacagctcagagcaactcacacacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggctggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgaggcggcgccggatccgccagactgccgaggaaaggtctggtccaggtcccggccctttcgccgacaataatttctttcgccttgttcgttcaggcgctaccgccaccgccaccgctgtttactatagcaccagacctacggattgaattgttgtatggatttgtttggccaaatctttgttctgttgtaaagtaaggggagggattcctgcccctgcgcctgcttaaaatacttatatgaacatatcagtctttcttgttttttttctctctctcccattgcttgattggttggttctcgtatgtcctgcttgatttgaattgattgttacagaacggcggattctgagttcgatttgctggttgccggctggccatggccatggaatgctgtggtttcgctcagcctgggattcatccttcagatctaggatatgcagaaccgaaccatggcctggactggactggagtgccaactcttgatctgcagaaaatccagatccgtttgtgttcgtcgctccctgttcttggttcgattccttctcgcctgtgcatggagtgccccagcacaccaccgccacgaacatggggagtagtggaagaacatgcgtccttgttttgaatctataatctagtttacttactcctacagcgtctttcttctttgtttaatactacgtactagttcttgcaggttggatcagacgatagtgatggtcacgttgcctcatgtggtctcttgattggaaccccccattgcatttgttgaccacacgttgaagcattgttgacagtatcgtctggtagtac

SEQ ID NO: 3068 - DNA, 1535 bp, Zea mays
tctgattcctatgtaaccgaataagggcttcaccagcacagataatttttggggttcattttcacccagctaaaacttagtctctgttacattaaatgttcgaacaataactatgagtattaaatatggttcgattataaaacaaactaaagaataaaagacaatacaaatttgttaaacctaattaagcttatatttaatacttataatatatttaaatatttaatatgataaaaaattaaactttattcaggaaaccaaatatcccttggttggaagtcaggtcgaaattgtcggatcctggctgccagagccacgagtcctcggcaaacctgtcacatgttttaggctttgttgtcatggagaagcagggcctaaccacccaatcagaatgaatcatgcgcgccacctggatgattagcgccggcaccgccgatggccctgtggttatgccggccaccgcaatcacgatcaatcacgtcattgtccttggattagcaccatccgtcgtggcgtggcctcttttagcagcccagctgtgcgctcctttcttttatcggggtcccccccccccgtccgtccaggccgtctccactcctcgacgactcacgagcacagcaaggctcgctcgctcgcacacaccaagcaagcaggccgcaggcgtctcacaggctctccgccgtcccccaacgcgctttccccggcgccatggccaggctggcgctggtgctcctcctgctgctggccgtggcggcgtccgcgtgggccggcgccggcgcgagccacctcgatctgggcttgggcttcctctcctccggggaccgccggcgggagtgccgcggcacggtggccgagtgcctggacgagtcagagggcctggacctgggggcggggcccgcgtccgtggagtcccaccgccgcgcgctctacggcggcggcgggtacatcagctacggcgcgctgcggcgggacaacgtgccctgctcccgccgcggcgccagctactacaactgccgccccgggggccaggccaacccctaccaccgcggctgctcccgcatcacccgctgccgcggctgagcggatccggcattccacccgccgccgagaataagttcttttgccctgttcaccccacccgagtgctaccgctaccgccgccgctgttcacaagtagtactagagctatggattttcattgttgtatggggggtttgtttgccagatccttgtgctgatcctatgtcgccttaatactcttattattctttccattccattgctttgattgctgcttggttcctgcaagtgtcctgttcagacagattctgagttcgggttgctcattctcaagagtccgggattcgtcgtggagacctgacctagagcagcagatgcagatccgtgttcctggctgatccctgctctttgttctttctgctacgatcccacctgcattgctgcttgcaggaatggagttttttttttttttggaaccaattggatctatactattaaaagatccaaactttaga

SEQ ID NO: 3069 - DNA, 1341 bp, Zea mays
ccggccgggcttcctcttccttttcctctgcatccatcatcctcagctcctaccatgagtacacggatacacccttcgtcttcggacgctgccggccgtgcccatcgtcgtcgtcgggctgctgctgctgaacgggaacgccggccgccggcggtgtacacggtgtggaagaggtccagcatgggcttccagggcaccgacggcttctgcgtctacgacgacgccggcaggctcgcgttccgcgtcgacaactactcccgccgccgcaagctctgcgccggcgacctgctgctcatggacggccatggcacgcctctcctctccctcaggccacagcttctcagtctgcacgaccgttggaactgctacacagcaacggaagacgccgtggtcgacaagaaggcgcctcccgcgtcttcggcgcagcagcaggtgttcacgatgagcaggtgctcagctctgcgtagcagcagcgacaacgcggaggtgcacatgtcagcctcaagaccgggctccgctgctgctgcgtcgtcctcgtcctcctctctcagtctcagctgcaacaagcacaacccgcaggccgccgctcccggctaccgggtcgagggctccttctcgaggcgaagctgcaagatccggcgcggcagcgatggcagggaggcggcgcggataacgaggaagagcgccggcgtggcgtccaggccggtggccacgctcggggacgacgacgtgttcagcctcgtggtccggccgggcgtcgacgtggccaccgtcatggccatcgtcgtcgtcatggacaggatctgtcgcaggccgtacacgcccatggtgtgcgtgtgcccttcgcagtgcgagtagtaatgagaaacgtgtataagtgttctgattttgacattgcatttgctaattgctagcacctctcctagctagtggtgtgggggaatgaggatacgggatacctgaagacaactactacttttgtcagtgctgcatctcctgatcagcagcatctaataagaaaaggacagacagaattagcaatactaatctggagtcccaccggaccacaaaagcaaccacttgtttgcgcatgtcaagtaggccagggcaagcagattgtttgttgcaggtgacctaatccagcggaaatgtcttctgatggcgacaggagatggtgccagaccacaattcatgtgtcatgagtaattcagctcaggacatcccaacatgccaatagatagagacagtggcctccagcgaggggcatccaacccaataaaacaacgttcaaattcctaatccgagacacacatcggtaccagtagggggtgtgatgatcta

SEQ ID NO: 3070 - DNA, 5485 bp, Zea mays
  misc_feature (2836)..(2836): n is a, c, g, or t
  misc_feature (4306)..(4306): n is a, c, g, or t
  misc_feature (4551)..(4551): n is a, c, g, or t
tgggacctcgagccggccagagggagccatgctgctcgagcctgcaaggaagaccgcaatacagagcttcgccactgccagcgcgctggccctggagcggaggcaagaggggtgactacaaggagcttttcgtcatggcactgcctaaggacggctgcctcgatggtgccaagatcacagaggtaggaggggtcggctacaaggagcttcttgtcatggcgctgcctaaggacgacagcatcgatggcgccaaggtcgcagaggccatcggcgtcaagctgccagacgtcgggggggccataaggactattttgaatagcagagaggccagagaatttgccagtggggcactagctggtgctatgtcaaaggctattcttgcacctctagagactatcaggacaagaatgattgtaggagtaggacctaggcacatttttggtagtttggtggatatcatccaacaaaacgggtggcaagggctttgggcagggaatacaatcaacatgctccgcatcattccaacccaagcagtcgaactcggaacatttgaatgcgtcaagaggagcatggcagaagcacaagagaaatggaaagaggacggatgcccaaagatacagcttggtaatatgaaaatcgagcttccacttcacctcttatctccagttgctattgccggtgctgctgctggaatagctgccacactggcgtgccatcctctcgaagttatcaaggatcgcttgactatcaaccgagaggtttatccaagcattggccttgccttccgcaggatctataagacggatggtataggtggtttctatgctggcctgtgtccaacgctgattggcatgattccttacacaacatgttacttctttatgtatgacacgatcaagacctcttactgccgcttgcataagaagtcgtctctgagccgccctgagcttctacttatcggcgctctttcaggtcttactgcaagcacaatcagcttccctctggaagtagcaaggaagcggttgatggccggcgccctgcaggggaagtgcccgcctaacatgattgccgccttgtcggaggtgatccaggaggagggcgtcatggggctttaccgcgggtggggggcgagctgcctgaaggtgatgccgaattctggcatcacctgggtgttgtacgaggcatggaaggatgttcttctggctgacaggaacaagccacgctctttagcgaactaaacaggccgtccttgagcaatggaggcgttgctgggattcctgatctattttcagttttggaatcccggctgcggcgagtggggtacatagggcgcgtttctctcttttttgattgactgatgagtggtaagcgttttgttgtgtcatcggcacacagacaaacatcattaatgtgtcaaaaaactaagcgaaaagacaaacccttctgtatttcctgagtggaaagatggggaacctaaccctacctggagcctctgcaggaaccttttccttcatctaccaatcagatacagggagcttcaggttgacagatcgcaccaactgaaggacgaacctgttctgcgacaacaagcaggataagctgaggaacctgttttgcaagctaagttgagatgtaatttttgtcttgggctgggtggttatagtgttttctttcggcttttcttttctttctgcctcaagtctgaagcgaagtttataaattatttttcctcggctaatataatttgggtggcaaagcttttgccgcttccttaaaaaaagagtggtaagcattttgttgtgtcatcaattctgaattcttgtgctgttataagaaaaaaggatttgggtagattgattgactgaagaatgtctgagtagaaaaataagccttgcacacaaccaaacagccataaaacagatgttgcgtgtcctagaatgaacagcaaagcagccataaaacagaagatgttgatgttcgtgttggtctggcctgagttcagtcttgggcttcgtttcatcttctgaccattcgcgcggcgcagcaactaaccattcaagtacagattctctcggtctcccaggcgaaaattagaaaaacagtcagcaaccagaacaaagtagaagcgcatacgagtcagcgatcagaacaactgtataatgcatagttcatttaactaaaaaacttaagtgttggcaaaaataagcaaatagttctttgaggttttataagctggcaggctattagctcagaaacctttttttaactatagaaggggaataatcaagcctctagtgatgtatgtttgactgaaactacatgatacctgatgagttttccctgtcaagagattaattttacattcatcagcagcttcctgctctggccacccgcaacaaccatttacactgtaaactttcctgagcaaatgacttggccatagccatagaaaaaaaagttgggaagaatattgggagatagaatttaggaaacccgattctaaggaattgggcctctgattccaaatctcaattccatatgtaactaaacaatagaatttaggaaacccgattctaattctcaattatgtgctccaatatctaaatgatagtaaatttctaatcgagtaaaattcacagtatgtttctgaacttttctcgcattctcataggtctctttttaactatcaaagttattctcaaagtgatatatgcaatcggttccaaattgatgctggataggttatcgaggtccacgagtggacttaagagtttatggacccaaaaaagaatcgaaaaaaatgtttagggctagtttggaaatttaaatcctctcnagaatttctggagattgagtgaaaatttaggtcattttcctctgtccccaagaatcccggagaagatttaagtttcaatactagctcttagggctagtttggaaactcaaattctcttcaggattgaagaggatttgtcaaaaaatgaactaatttccatctaaatcccctcagattggagttttcaaactaaccattaagatacattttactctttccaattccatcatcctactccttgaaccaaacaggatatcagagaagaaacaggctcttggtacacaagtataccgaagacttccttgaagccaaggcattgcataaatatggttacaaagacttggaaactgtagttagcacaagtatacacaggaaatgaatccaaaaacctactctggttagtctacaagtatgtcgaggaaaacaacagccatcagatgcagctgattttttttcccaacgagctgggtgtcaggatggagagccgattgcaggttatcacttgtaccatccggtgagcatgtgccttagccagaagcagaatacgcgcctgcgtgcctgcagacatgaagatatatgagattgtgatttgtagcatttgcttccgtgaaccgacttgttcagaacatccatgatgcagatgtatatccaattagatcgtctatgttccgggctactggtataagaaagctaaatcaatggtgcgaccatgcaacattatcaagaaaaataaaccctacacatattgcatgcttaattttggtgtgtgacagcatgcacaatagctattgtcgtgcgaagtatcagacaactctgctgatttatattgacaagcactctgaaagggttgttattaactgatgaatcttttgcctagttcaacataaacacctatagttaactagttctttcctgtattctctagctgttagaaaagagcttatcccttgttcagaataagaattttgcaaatgtgaataattatggcttgtttgcagcataaccaaataataaaaacagagccagttcacgagatcttcagaagtcgagaaaaaagtttgcagcaagtacaacagtactctgcagcaacagtacattttaagtctacctggaaaataaggagccttatgcaaagggccctctctgagcactttccaaataacctaaggaatatgttaaccagattcccatctttggtaccagtcaacagacccgctccaggatcaaacctgtggatggaaacacattttagaaacttcataagaactcatggcctactcttcatggttctaggtcaaagcaacccaaaagtacctcggcaacctatgtcttgggcaaggaacaaagtgaaagagctgcaagaaacaaagacataattgtgagacagtgaactaggggaattgatggatgattattgagagcaatgctcgagtacatataggtaaggatgcccaatggaataggaaacantccaatcagggggatccttgcctaatacaatcaactatccaaatagggaggaggcacacaaggcaacaagcctgtgcagccatccactacccaaacccaagggatctgccaaacataggatgatccctcctaatatagctcatgctaacaccccccgcagtcagatcgtcagccactatgcacgttcagactagtccggaattcggtgaagaccgaggaagggatgcccttggtgaagatgtctncatactgtgatgtcgtcggcacatgcaggacacgaagatcaccgacaacaaccctttctctgacaaagtgaagatcaatttcgatatgcttggtgcgttgatgttgaacggggttgaaggacatgtagacagcactgatgttgtcgcaatacacgagagtagcgcgacggagaggggcatgaagttccaagaggagctggcgcaaccatgtggcttcgacaactccattcgccacacctcgatactcagcttcagcactagacctcgagacgatgttctgatgcttggaagaccagagatcagattgtcaccgaggaacgcagcatagcccgaggtggacctacgcgtgtcgagtatcataattaggggtacctagattacacccccaaaacacgcttaatcccaagaccaccgtcaagccatttcccgaggtcaagagagcataaaccgagcttcgcccgaggcctctctcggtggtcaccaaaactccgcttcgccctgccctcggacaaggtacgttctcgggagaatcctcgtcccgaccgaggtcccctctccctagatctgttgtctctgcctcgcccgagcccatctcgggcaaggaagacaaccccgaggtaggtctcgtccgcaggccgcaggagacatgagcattcaatgcgcacacctaccccacgcagtgttgcaggtgaacaggaacgacaagaccgcagtcccgtcagacttcaccaactacgatgagggaattgggactcgacagcgagccaggtgtcccgagcagtgccaccctaagagacaatctcgacgaggttgtcgatgagggagccgagaatccaggacttgacgacgtagtctatccgatcccaatccgaggaggggaccagagcgtcgaggtggacgtgaacctagagagagaacttgagggttagtaaaa

SEQ ID NO: 3071 - DNA, 2819 bp, Zea mays
atagcgcgggttgccacccgtccgatcgcgcccggacgaccgcgaccccctcccctcatgttccgcggccatgcccctctcctccaccacctcgccgtcggcgggggcggccgccgccgccgcagtgcgcaccgcttcgccgcctcgccgcatcgccacccacgttttgttcaggcagaagctaggcattccggcggggttccaggctcaacatgtgaaatgtttacctcatttgatcagatctattgtaagaggtgctagatcagatatcactgacggtgacaatggaacaactgagcccgcgagggaactattggagcgtctgtttgccaagacaaagagtctagatccaagcgcttctcagggtagggaactgagcatgagcattgaggtcctgaagactgagtttgaggctgccttatcaatcctaaggaagaaagagaaggatcttcgtgatgcggagaagaaagtctccgtggataggtcaaggttgaaccagacgaagcaggacctcgatcagagggaggaggacatcatcaaagcatactcgaggcaacatgaaatggagaaagcactgatgaaggcgagcagggatttgactctacaagtccgacagatcaataacctgaaggttatgatcgaggaacaagacaaaaaacttgttagttcacaagacgcactttctaagaaggttattgaagtggataagcttaaacaagagatgctgaagaagaatgatgaagtagctttgctgcattcagagatcgagtccaaggaacaagagcttcttgtagctaatcaggccattgcacgtcaagaagcaacaattagggagcttcgaagtgaaactaaaagaaaggaaactgaggttgagagattaaatgaattggcgaaagctaatgaagacaaactgaaatttgcagaacaggaacttgagaagcagaattcaggatggattgcagcacagcaagagttaaaggaattggcacaaatggcattcaaggataaagatgatatcaagaatacaatcaatgacttcaaacgggtgaggtatttgctggatgctgtgcgttctgaactaatagcttcaaaagaggctttaaccttctcacgcaagcaagtagaagatcaagcggcacagttgagtaaccaagtgcaggaactcacagaccaaaaggcactgattatttcttatacccggaatctgcacgcggcccagctggagattcaaggaaagtcaaatgaactcagtactgtacaatctcgttgtagtgaacttgaatctcagttacttgaggaaacgaagaaggttgcgtccctagaggctatgttaaccaaagaaagggagatcttggaacagaaaactaaggaagtggagttccttcaagaggaggtagttcagaaggagaaggattacttcaattcgcaaaagcttgttgaaacaaaagagactgagctgttagaggctaggcatgaagtcgaagatatgaaattgaaggtggattccatacaatttgctgttcgagagaaggatttggagcttctggaggcacaaagaaaacttgatgaagttaacagcgaagttgttgaacttcagcagctgataaatagcaaggaggatcaactggtccaagttagaactgaattacaggataaagagcaatgcatacaattaatgcaggatgaattggataagatgagattaggacgctcgcaagctgaatctgtggtgcaaaagatagtcgagcttactagcaatctcataggttctgtcaaaggcgaagaattcgacatttataacttgctggatgatgaaattttaagcacgagcacagcccttgagtacagtttgcataagcataaccaactggaggctgacatagacatgttaaaagaatccttgcgacagaaggacatggatctgactgctgcttataaagcgcttgacgccaaagatcgagagttgaaggcagtagttggaaggttagatgttagggataaggaactagaaaacttggaagagctatccatagacccctatggcaccaggaaactgtctagagttgctgatgaggcaaccgaagacaacattgctggtgaagcggagctccaaaagcatgagatggaatctgtggagatggaggcactagctgctagcactatgttgaagaagcttgcggatgtgactaagaaattcttgagaagtggtagaactgattctggtaccaatttagattcaaacgttagtgaaggtgcttctgaattagaaccacaaaggaaacttaatgtgattctcgaggctaaaaaggagattgtcgggctattttctttgacagaagagctcgtcactggtgctcaagtgaaggatgacgaggagcatcataagttcataactgaacatataactgcatcatgaatgttatgcatgtcaactggaatgacgcagctgaaattgttaccatcgtttcctttccttttggggctcaggatttctttatgttcttttggttcatggatggcatcgcaaaatgaaaaaaaaagattgtttagattttggttaaaaggatgatgattgtgcacttgtgctgctagatctcgggtgtttacatcatatttcaggaaatcttgataatattcactttttttttactttttgagtgcttgaagaagtgcatcatcagctggctgcctggctattgtattatggaacattactgtcagcagcaaagaaagggtacagaggtcagacaaaaaaaaatcgttgtgttgaaaaacagtgctgaattcaacttttgaatccaaatctagacatgttgcgc

SEQ ID NO: 3072 - DNA, 2782 bp, Zea mays
tctgtacattttagaaaatacaagtaaatcgacaaatcgtaccctgtgtgactctgtcaataaggcatgtaaaccctttgtaaaaaagaatgaagagaagaagaaagatgatcctgtacgctcgtcgaaaccaaagaaatacagtgcggaccactcagaggccggccggcctgcgggattattttcaatcatctcgtgacggaaaaacaaagtcaacacgaaggactcggccggtagcactggcgctagcagcagcagagatcgaccggccatcgccgttttataaaaagagagtccagcgggagccgtcgctgacggacgcccccctcccagacctccgcccggatctcgccgcctctcccgcccctgctcgcgagccgccgtcgacagccaccgccatgggcacggccaacggccagcagccggcagagggcgctccctctgacaagctccgccacgtcgagtccatgtcggagctgccctccggcgccggcaagatctcggggatcaacgccgtcgtgctcggggagtcgctcgccgccgaggagaacgacctcatcgtccccagccccgagttctctgccagcgccctcgtctcttctccgaaacagtatcgcgagatgtatgagaggtccattaaggacccggccgggttctggtcggagattgccgagaccttttactggaaggagaagtggaaccccgccgaggtctgctcggagaacctcgatgtcaccaagggacccgtccagatcaactggttcaagggagggaaaaccaacatatgttacaacgctgttgaccgcaacatcgagtctggcaatggcgacaaggttgcaatgtactgggagggtaatgagcccggtcaggatgggaagcttacctattccgagctcctggagaaggtttgccagcttgcaaattacttgaagagccttggtgtcggcaagggtgatgctgttattatatacctaccaatgttgctggagcttcccattgccatgcttgcctgtgcccgcattggtgccgttcactcggttgtgtttgctggcttctcagcagattcgctagctcaaaggattgtcgattgcaagcctaagcttgtcatcacgtgcaatgctgtgaagcggggagtcaagcccatctttctcaaagatatagtggatgcagctttggttgaaagtgagaagaatggagtctctgtaggtctctgtttgacgtatgaaaaccagtcagccatgaagagggaaaacacaaaatggcaagcagaaagggatgtttggtggcaggacgttgtcacaaaatttccaaccaaatgtgatgtggagtgggtggatgcagaggatccattgttccttttgtacacaagtggcagcacagggaagccaaagggtgtactgcatacttctgggggctacatggtgtacactgcaacaacatttaagtacgcatttgactacaagccaactgacatatactggtgcactgcagactgtggctggattactggacatagttatgtaacatatggtcctctcctgaatggtgctacggttctcgtttttgaagggacgccgaactaccctgattcgggccgatgctgggatattgtggacaagtacaatgtgacaatattttatactgccccaactcttgttcgttcactcatgcgtgatggcactgagtatgttacacgttactctcgaaagtctctccgagtcctgggaagtgttggtgagccaatcaatcctagtgcatggagatggttctacaatactgttggggattcccggtgccctatatcagacacctggtggcaaactgaaactggcggtttcatgatcacccctttgcctggcgcctggcctcaaaaaccaggttctgcaacctttcctttctttggtgttcagccggtcattgttgacgagaaagggcaagagattgaaggggaatgtagtggatatctttgcataaagaaatcatggcctggggctttccggactctgtatggagatcatgagagatacgagaccacgtacttcaaaccatttgctgggtactatttcactggtgatggttgcagcagagacaaagatggttaccactggctgactggaagagtagatgatgtcatcaatgtcagtggacaccgaatcggcacagcagaggttgagtcagctttagtgtcacatccacagtgtgcagaggctgctgttgttggtgttgagcatgaggtcaaaggtcaaggaatttatgcttttgtaactttggtggatggtgttccgtatagtgaggaactacgaaaaagcctcataatgacagtgcgcaaccagattggggcatttgcagctcctgacaagatccactgggcaccgggacttcctaaaacccggagtggcaagatcatgcgaaggattttgcgcaagattgctgcacggcaactggatgaacttggggacataagcaccctcgctgaacctgctgtagttgaccagcttatttcgctcagcaattgttaggttgcaacgtaattggatggtggatacatccttgagcgcatgttgcgtttgtctgtaatatgagtagaaggtgcatttcaatatcgagaactcaagtgggacgtggtgacatgttgtcgatgtttccttttaaacttttgtatcagatatcaagataggtccatcagaatgtattattgattgacacagacaaatatatcaataaaattgttaatttttcacaaaaaaaaaaaaaaaaaaaaaaaaaaaaaaaaaaaaaaaaa

SEQ ID NO: 3073 - DNA, 5499 bp, Zea mays
gagtggtaaaaaatagaagtaaaattattacatattgtacagatcaccttgtcctctaacatttctagacacaaaatcatcaataataaattcaatactaatatcatctaacaaaaaaatttcaatacataaaatttgttagcccattaaactttttttagatgtagaccttaaaaagttaatcaataattttagttattttagttttaagaagttactttcaacagatgccatattttctagtattgtaaataatatatgataatcaacagtatattgactcaaatatttctatatcactagggtaagcccctcgaaagtgggagcccaccgaccgtctcactcgactttccatgttggagcctctgaaacacgttgttcggttggcttgcttgatgtgttgtttcctattgtttctaaagtatattgagccttaggatagcgacagcagcagccggagcggctctaagcccaagcgattaaaggtatatttggttggacgtacaagaagggatataagtgggcggccatattttctatagtgcgtggttggatgagagtcacgtgagagcgaagtgaacaccgaatcaattgttggtggcggcatggtccaaaaaaatcgaggggacgatgtcgtccccgtatcatcctaatttgatcttaaaccaaacacatcacgttctgttctgacttcggtggtgtacaagcctgccagccagctttggccggtcacagccgtagttgtgatcttaagtaaaaaataaatctatacaccgtaaaataagaatttgtgccgtaaataagaatttgtgtggattcaatttcttgataatttagaagttactttctagaaactgtttgagagattcttaagaagttcaaaaattttggaactaaactttagaaactctttaaacatgacgttgtgtcaaatggatcaaacagggcattggtttgtcgtaccggcaggccgcagcagagaactgaagcggagttcttttaccatttcttacggctcacggggcctcgagacgcgaacacatatagccaaatctagtgacgaccggagcaggcgctcgcgaccaaaaacaaccgccaggcggagcccgcccgccaccgccacgccaggtaggcgagtcaaataccgtccaaatcccagccacagacacagcacaacccccgtccgccgatcgagtcctcgaaccctcatcgcgcacgtataaaccggggcaaccggccagccacagacacagcacaacccccgtccgccgatcgagtcctcgaaccctcgtcgcgcacgtataaaccggggcaaccggggacgcggacctcttcatctccgttcccgtcgccggcgacgctggtctctaggtgtcaggccgcgcgagccctagcatagcagctgtagtagtgctagactagctagtagtttagcagggcgctccgcgcgtcagttccaccagaaacagaaaggcaaattcggcttcgcttttacgcccgcttgatttgcctcttccaccctcttccaccagaaggcgggcggccgagcgaccaaaagtcaaaaggaggattggcccacggccacggccgagagcggcaggcgggcagggtgaggtgaggagaggccatcagggccgagagaccatggcacagcatatatacgccaccggctgcggccgctgccggggcgcccgccccatcatccggacactactgcccgcgctgacccaccatctcgcctcctcgtctctgttgcggcgccggaaggctcccatgggcgccagcgatcacctgggcctggcggcggtggccgccgccaagccgcggaatggcaggacgtgcatggccgtgctgggcgagccactgccggctcttgacgaccccggcatcctcgtccaccccagcgccgacttcgccgcccaggcgctcgtctcgtccacgaaacagtaccgagatatgtaccaaaagtcgatcgacgacccagctggtttctggtcagaaatcgcagatgagttctactggaagcagaagtggagccctgataatgtttgcgctgagaaccttgacgtgaccaaggggccgatcatgattgaatggtttaaggggggaaagaccaacatatgctacaatgcagtggaccgcaatgtggaggcagggaatggggacaagatcgccatgtactgggaggggaatgagcccagtcaggatgggaagctcacctactctgaactgctggaaaaggttcgccagctgtcaaattacttgaaaagcgtcggcgtacgaaagggtgatgccgtggtgatctacctaccaatgttgatggagctgccgattgccatgcttgcttgtgcccgcattggtgctgttcactcggttgtgtttgctggcttctccgcagatgcactggcccaacgagtcattgattgcaagcctaaggttgctattacctgcaaggctgtgaaaagggggatgaaaatcatccctctcaaagatatagtagatgcatctctggatcaaagtgcaaataatggagttgatgtaggcatttgcttgacatatgaaaatcagtccgctctgaataaagtagacactcgatggaaaacaggaagagatgtctggtggcaggatgttgtgcctgatttcccaactaaatgcgatgtggaatgggttgatgcagtggatccactgtttcttttgtacacaagtggcagcacaggaaagccaaagggtgtgttgcatacaactgggggatatatggtctactctgctacaacatttaagcatgcatttgactacaaaccaacagacatatactggtgcactgcagattgtggctggattactggacatagttatgtgacatatggtccactattgaatggagccacagttggactcatctcttaggccccaaattaccctgatcctggccgctgttgggacattgttgataaatatggagtgacaatattttatactgcaccaacacttatacgttcacttatgcgtgatggtactgagtatgttgctcggtactctcgcaagtctctccgagtacttggaagtgtgggtgagccaatcaaccccaccgcatggaggtggttttatgatgttattggtgactcacgatgccccatatcagatacttggtggcagactgaaaccggcggattcatgatcactcctttacctggtgcttggcctcaaaagccaggatcagcaacgtttcctttcttcggtgtgcagccagtcattgttgacgagaaaggtcgggaaatggaaggagaatgcagtggatatctttgcataaagaaatcatggcctggggctttccggactctgtatggagataaagagagatatgagacgacatacttcaaaccatttgctggatattatttctcgggcgatggctgcagcagggataaagatggctaccactggctgactggaagagttgatgatgttatcaatgttagtggacaccggattgggacagcggaagttgagtctgctctggtttcacatccaaaatgtgctgaggctgctgttgttggtattgatcatgaggttaaaggccagggaatatatgcttttgtgactttggtggatggtgttccctacagcgatgatctacggaaaagcctcgttacgacggtccgcagtcagattggtgcgtttgctgctcctgacaagatccattgggcacctgggctccctaagacacgaagtgggaagatcatgcgaagaatcttaagaaaaatcgcatccaggcaactagatgagctcggcgacacgagcacgcttgctgaccctggtgttgtggaccagctgattgcactcagtgacagctaatctatcggctatgtgggagggggtgagacatgatcactgcctgcactatacttatgcaaaattcagctttatgatgcgaggtctgttgggcccagcgttctcttaattgcttcggtgtcatggggatgccaacaaaagagagatgctgcgaacttggggagatgcggacatatgcggggtgcgtctgtaaattgttggatcgcagtcactgatagttattgtacattggtaaataaggagatgaagtgtatatgcgagttttggctaaaatgtttaatgatagatctcgcattttatggttacgtacaggattcagccatggacattgaaggacaacgtgtttactacacctctttgttcgctgttcaaagcatgagcaccatcttagaaacattggaatttagggatctacatgagaattgagctgcttcggtcgaatttctgcggaggcagctgggatgtgtcccaaactagacacggtcggtaccaatactccttgaaccaatggggcacgggaatttggcagagttccgctcccaacttcggagcggattctacgtatctctaccaaacacgatacaattgtattttggtaggtgataaatcgcttcttcatttatactattgagttctgacttctgaggaaaaatatatgctcctcgtttcttccttttcaatcgtcactaacaccatttcataatcgattcacacctatttccattccaaaatcacttcatcgaatattcaagaagtgaagctcaactcaaaaatcaggaacgagagttctaccaaactaatcttaaactatcctctctctgtttttttttgtctaagaggtcctttgtcattgtcaactggaacaggaattcctcgtatatggacgagcatcatttttccgacgctgatattgtggtgaaccggtgaccatttgtatttgtaccctgttgaaatacgcagatctagcgtgagtgaggatctctaggtcaacatagcacgagatcactttgtttgggagcaaaatatttataggggtttggaggggataaaatattgctatttaaaattgaatgataagaggattttatccctcaatcccttccggtattcttactcccgaacaagtcctcaatgccggtgtgtgcgctcgcttcgccatgaacaaccatgctacacattgcctagccaatgaattgggacgcttatgtgacaaatagttcatcccaaactagtatttgttttaactcttagttatttatatctatatttaaatggatgatgataaatctagatacatatataaaacacatacatcaagtactgtacgaatatattaaaaacgaattttaatttgggacaaagagagtatgtctttccacgtcaaatagtttagatctagaagtttctcccttttatctcttgtttgttatttgtttatcctttctcttgttttctatagacttgaatgaacatgttacccgtacatctaaatacatcgattggatctaaaggatcataggcaagctcccttgtaggttttggtgttttgagtgtcaacacaattaaaggtctaactagggtgtcaagtgttgaacatgtgctaagcgaagagactaagaggttcaacacatagagatcggtggatga

SEQ ID NO: 3074 - DNA, 1065 bp, Zea mays
ccgagctatgaacgacacggccgtgcgcgccatgatcggcgaccggttcgagaggcgggacgagttcctggagaacgtcgcggagggagtgaggatcagcaccgggttcagcctcggcgatctgttcccgtcgtcgaggctggcgagcctcgtcggcggcacggctcgccgggcggcggtaaaccaccgcaagatgttcaagctgatggactacgccatcgagaagcacgaggagcggagggcagccatgaccacagatgcagagggcgtcgtgaaggaggatctggtggatgtgcttcttaggatacagaaggaaggaggcctggaggtgccactcaccatgggaatgatcaaggccgtcattctcgaccttttcggtgccggcagcgagacgtctgcaagtacactccaatgggccatgtcggagctcgtaagcaacccaagagtgatggaaagggcacaggccgaggtacgtgagaagctccaagggaagccaacggtgaccgaagatgacttggtcgacatgaggtacatgaagctcatcatcaaagagaccctaaggatgcatccggtggtgccattgcttctcccaagggagtgccgagagccatgcagggtgatggggtacgacgtgcccaagggaactaccgtgttcgtgaatgtctgggcgatcagcagggatcccaagcactgggaggacgctgcgacgtttagaccggaacgattcgaggccgcgggtacggttgattttaagggcacggactttgaatacacgccgtttggggcgggccggaggatgtgccccggcatggcgtttgcgcaggcaagcatggagctcgtgcttgcagcgctcctgtaccatttcgactggaagctgcctggtgggatgctgccgagtgaattggacatggcggaggagatgggcatcactgcccgaaggaagcgcgacctttacctgcatccagtcgttgtcagtgtgccaccacatgtctcataaaccatagctgttctacttgctattttaccgtagctatatgctttattgatgcagcaaagttcactagt

SEQ ID NO: 3075 - DNA, 1793 bp, Zea mays
taaatttttatccgatttcgactaaaccattattatctcaaatatccagtccatctaaaccccgctcacatccaaactgtagaaatcaaatatatatataaatgtttgtgttcaaaaggagggcataaaaagatctcttttgtctactaaactcccaccgtcttccgtattcagatttttttggccgtagccctatctccttcgcttgggatttttcagccgtcgttctcatccgcgtcgcacagcagctggggaaaaaatcctgccactcagccgccgccctccctctgatatttctcagccatcgttatctcctagcgcgcgctccttgtcttctcccagcgctctccttcactgccgcgccgccctcctcccttctccctgctccttcccatggtgcgcagggcgtcctcccctcgatttcctccgtgcctccttccagtcagcgacgaacgaggttctaggcggccacgtcgttgtccggcacctcgtctgtgtttttctctgtgccacggtcgagctcgccgcgtccctttgtttgagtccgtcaacctccatctcgccccgagctccttccatggctgtcgtcgcctccaagcctggggtattgccgagctcgcccagcccttccccatcacacgccggcggtcctccattcccagccacgccgctctctgctcactggtgctcgcccctgccctctgtctagcgccctccctgctccacctcttcccatggccgcctgcagctctcgtcctccctcaagccctagtcgagcttttctatggcgccctggatgccagcccctttactcgatgcccctactaggttcctggcatgttcgccgagccatcgcccaagctcagcttatccatggcgcagggaacaacaacccctttctgttgatggcatgctgcagccccctccatcacgctatctcctgttctccatttttgctgcagcaagtggacgcccccagccctccattatttgcccatcttccccatggtgccagcagcatgccaacggttcaacgataggtgcagcagtctgcgcgtcgtcaatctcctcacatcaggtcgtgtccctctctgtccttgcatgttctagtttcatttcactttgttgtccatgtcgtgacgcttgtgttatctctggtttatttttgtgtatggtgaggaagagaattctaggaaaaatcgatgaagaaaacatgtttcagttcggtgcgctctaggtgtttgacgaaatgggagcaccagggaacaatcgtcgttcttgcataaaccaagtcgatttgactgtggtacgctacatgatcacgtgatacggaattcaagaactgagttgatctcaagatgatgaaatgatgagctactccgacaaatgatgtctgtgaatcaacctaatgagaggtggaccgatcaagtgccaagatgaatatggtcgtcaaatgatcgtcatctaaccaacactaacctagtgttatcccagacaagccccggtgcatttgccacctcattctgttttaaaaagttttatcaccttgaatgatgcattaggtgataggagttgtgatcaaacagttgatgcatttccttccttgattagacaaccctaatacccgttttatgaaaatttagtgatgcttagcccttcttattaatttaggatttgtttttttaaaagatgatatgtaacacgggataagggagtttgtgaaataaaatgacttgtgatgatgaagccgttgtggccgcgatgatttcatcattcaggtagggtacctctct

SEQ ID NO: 3076 - DNA, 2500 bp, Zea mays
caaaagctggagttccaccgcgttggccggccgctttagaactaggggatccaccggggtgacagaaatcggctcgagagcagtacttagaacatcgtaatggaaaattctacttcccggtatcctaaaccctagccgacatgcgccgcccgcagcgccgcgtcgcggcgaagcagactcgcctgcgggaggtcgacgagatacgcctcctcaacgaatggatcgacgccggcaagcccctcccgcgcaccaaacttctgcccccgtcgaaatcagctggaccggttccgaccgccggggagcacccggagtacggcgcgtgcacactgttcgacgagctgccgctgtcgcagaagaccaaggacgggctgcggaaggcggggttcactgagatgagtgagatccagcgcgccgctctgccccacgcgctgtgtggccgcgacatcctcggcgcggccaagaccggctccggcaagacccttgcctttgtcatcccgcttattgagaagctgtatagagagagatggggtccagaggatggtgtgggctgcattattctctccccgacaaatgatttggctgggcagatttttgaggtgatcaagaaagtggggcagttccataactttagtggtggcgtcattgttgctgttggtgcttgacgaggcagatcaaattcttgatcacggattcagaaaccaggttgatgctatcatttctcagattcccaaagttagacaaactttactgttttctgctacacaaacgaagtcagttaaggaccttgcaagggttagcttaagggatcctgaatatataagtgtgcacgaggaggccagaacagccacaccggatacccttgagcagtatgccatgattgtacctcttgagcagaagttaaatatgctctggagcttcattaaaaggcatctaaattcaaagacgatagtcttcttatctagtgtcaagcaggtcaaatttgtttatgaaatttttaagaaacttcgtcctggtattcctttgaaatgtatgcatggacggatgaaacatgtggtacagcaggccatagttgcagatttcaatgaagctacctcagttcttttctcaactgatataacatctcgaggactagatataaagaatgtggattgggtggtgcaggttgattgcccagaaaacattgataattacatccacagagttggccgtacagctcgttacaataagaaaggaaaatcacttatattcctttgtcctgaagaagaagcaatgcttgaaaaattgaaggcaaccgaaagtaaaatacctatacatattcgaaagccaaaggcagaacaactggagcagatatcgcagagtatagcctcagtgctggttaaatttcccaatcttcaggaattgggtaaaagggcttttgttacctatcttaaggcagtatacctccagaaagacaaaaaagtgttcaacctgagcaggttctctgcagagcagtttgctgcatatgctgcttcgcttggtctgcctgttacccccaagatccgcttcataagccacaagaagaatgtgtcgaagaaggatatggaggacattgatatgaaacagatgaaatccagtttggaacatgaagttaccatcactccaaagatcaacattgatttaactttgtgtgatggagatgatgatatcctttatcccaagaagcccactgcagatgctaatatggatgacagacttgatgatgtccttcatcccaaggagtctgccacagatacaaatgtgactggacttgaaagacccttcaaaaagaagaaactgaagataaacgtgaacaggccatcaggaacaagggtcaagtatgatgatgagggcaacgccatcccacctcttgcatctgtcgctgaagaagtatctttagaacctgtggttcacaaggataaaatttcccagcggtatgcagagatgttgagagaaatgcagaaacacgacaaggaggacaagcttgaacacaagaagaccttgcgggagaagaagctgcagaagaagatgaagcttaagcgcaagaggcaggaagacactggagcagggtcagaggaggatagtggatctgaatcagacagaggccaagacacagccaacaaaggtaaaaagaggtacttcaatagcgacgatgaagacaatgacgcagcaaaggacggtgatgttctcgcccagcaggaggcgttggcactgaagctcctgagtaatatgcacagttagctttgggatctgatggtataggttacccttgaatgggggtttgcctattagcgctccagccaggaaggggctgaaattttgaacgtgtcgcggttttttttttctgataaccgggagttaattcccactttcaggcatacgttcatggatgtatgagaaatcagtgtggccgtattaccccaagaaatcggacttagatgaggttttaagtaaaatgcctttgattttaaaaaaaaaaaaaaaa

SEQ ID NO: 3077 - DNA, 3133 bp, Zea mays
ggatccatcataaaggttgagtgcccaaaataaacaatgtatcagtaaataatatttttatttatatatatatatatatatatatatatatatatttatttacttatttttatcctcaccatatttatttccttctcttttttagattcaagaatttcttttaggtctcaatttccattctagatttaacatattcatttttatattattttttttttatattgtcacaagtaatgcacacacaataaaatcccagcatgatgcatgtgtcattttgggtgtcttttgttgtttattgtttaagtgagatgttcacatgtgatggtaaaatagaagtaacacacatatagataagggaatacaagtaatttccactttttatatctccttacaaagcacgagaccattacctagaacatcctaatcaaaaattctatgtggcctagctagctactgttgccgtccccccctccgtgatctgttgttgtgtgtccatgtaccctcctcgatcgtagtgtctatatctcctgccttgcagctttctgcagggagctgcgccaacgatgggcgtcttccaggacaccggcgtcggtggcggcgccggcagccggacgtccaggagggttttccagtaccagaggctggagtgctgctgggacgacggagccacttccaggtggcggtgtccgccagccgcgaatggtaagaaggctgaagccccctgtttgttcagtgtcaggcggctcaagtggagcaaggtcacctcggttctgataccgaggaaggtcgccgagttgtctgcaaagatctgccacgccggcgccaggacggaggccgtcgtctgcccggccgtcgtcttcatgtcgccgtggggcctccctgtgctctcccgcccgctcttggtcggccacaacacttgcaggtatcaccgtggaagagacaccttctggtgagcaggtagctgcacctcgatctgtattcctggccgtggtagtatcggtatatgcgggtgtgatatatgtggccagcttagttgatcttgtaggatttgtattattactcctccattttgatttctgcaatacttgtgttgtgttttgccggctgcatctgagcttagatgctgtttggtttatgatgattaatagataactgttggggacttgttcttaaatgctatgaattaagaacaagataaaaaaaaaaaaaaaattcaaatttgtgtaaattattatcattaacatctacgttaggattcgtgaacgaaacaacaccttagatccgatccatgtgatgcaaagcttttcactcccctcgaggttcaacagcagaggtctcactctgctgacctttctttcgattgactgttgccaaccttgtgccgacatataaaatccggagccagagtttcgtgttgtcagtcttgtgccactccacatgcttcgtggtgtgccttgagctgtcagtcgtgtgccactccactccctggctacaacaaggctattatattgggcgagcaagcaatttcggtgtcagaaacgtaagtggcaccctataaaaaactgtgagaaatcctggatcgccctaggagtttctcagtccagcgttccgaaacggccacgagtgcaagccgtcacgtggaggcatccgtggtgtgattgattaggtccctttacgccatgcgtgctgtactctccgtcaacatctacaccgagcaatcgccatacgtggattcggatatctcgcaggaatatatgcgctcgctgttcggtgttcttttttctctctctcccaatgcatgttgcagacaccagcactcaagtgcatgcatcgcatgcatatatatatatatatactaatccctaataatacttgcaagagcatgatccaacaataagtcttgatattaacatctcgtatgcgtatttttgtggacgtgcacggtgcacagcacctgctacaattgaaagaatagttagcgaaaaatacgagagcactgaatcgagacaaaccctattcgtagtgtttggttccggggctatttggaatgcagtggctccattcgacaaaaccagtattgcattgaattcaagttttatatcaatacacgatataaattcaaagaaataaataaataaacaaaagaagtaaacatgctgttaagttcttactagcctaataaaaattgggtgtaccttgtcgatgatgggcaggtgtgccgagaaagaggtgggtcaagggacgtctctagttgagagatagggctcgttggttcgacaagcttgctgacctccaaggacgggtcacatcatcgtgacaaacaagatcggacatgtcgagctagctagcgtcatgaggatgacgagtgagatgggggcaccgggaaggggtggggttgtgtagtgtcgcgacataaggatcgagacaccgaagcggactattgattaggcggtgtagataagaatggatctgggtcatacaaaatgttcctggattgaggagcagggtcatgagtcgttggtcgacactttaaaaagggaagtatacatctatgggatgggaatattatgaatttgatatgttgagtctaatgggccgatgatctcgggttgattctacgggtcaagggtcgtgttctaaaattttaataacaacctaacaccagtctaatatcatctcattctaccattgaaactttaagctatctctatcagattccctatcttatcctctattttaaaccttactctacaaacagtatcatctacaggtttgtgtcccctattttacactacctgctggagacaatgttatacaaatagaaaacttcaacagacctaaaactttaatttttctctgtactaacactaaatgaatattagatatataagagagagaaaattgaggggggccatggcccactttacccccctctcggtccgtctctgggtctgtcccacacgatactccgaaaccaaacactaccctaactagccacttataaccaatcactaccctaactagccacttataactaaacactactaccctaagtagccacttataaccaatcactatcctaactagtcacttataaccaaacactaccctaactagccacgtatgtccgtca

SEQ ID NO: 3078 - DNA, 2281 bp, Zea mays
gcttgcatgcctgcaggctgagggcattcgccaagggcatttcacacacattttcttggatgaggctggtcaagcctctgaaccagaggcgatggttcctttgtcggggttgtgtggaagagacactgtggttgtgttagcaggagatccaaagcaattagggccggtcggctcgaccggcacgacggagagatgtggtctggggacatcatatctggaaaggctgctaactggcttcgagcagtaccaaacagggaatcctaactatgtgacaaagctggtgaggaattatcggtgccatcctgcaatcctagagctaccatcagagcttttctacgagggtgaattgattgcctgtaaagaaggagaatcatctgcttacgactgcatcggccttcctaacaagtcgttccctgttctcttcgtcgggattcaaggatgcgacgagagggaaggcaacaatccatcatggttcaacaggattgaagttagtaaagtagtatctatcatcaggaacctgacaaggggtgaggatgttcatgaatctgatataggagtgatcactccatatcgtcagcaagttgccaagataaagaaagccctggaggcatttgaaatgcccagcttcaaagtcggaagcgtcgagcaattccagggccaagagagggaggtgataatcatctccacagtcaggtcgaccgtaaagcacaacgagtttgacaaattttttaacctgggattcttgagcaaccatagaaggttcaacgttgccatcactcgcgcaaaatcgctgctcgtcatcatcggaaacccttacattatcaccaaggtagtctctctgtcattcattattatatatctcctttaggctctagtccatattgcacgctgtttatgtattcattgtcaaattaactactacaacttcaggaccgtcactgggataggctcctgcggtactgcgctgacaacggctcctatcaaggatgcccccttccaccaccagagtctccttattcagacgacgccagattcttttccaagtacgacgaagaccatggtggaccttctgggcaggactacagccaagagcctgcctactgcaactacaaccaagagcctgcctactgcaactacgacgaccaagagccttctgacttcggttcggggcatgacactggtgttgctcaacctgaacctgcttcggagaatcaagagtcatggtccgaggagttgcctgaagacgagagccagccattcagcaacccccaagcagatgttgaggagacgccgaagcaggacggcgaggaaggggctgcagctgcacagggagacgcgcaggccgaccagtcgttgaccaacgacgacagtcagctccaggacgcaggcgcggggaagtacaccttccctcccggttggtgcgacgtttcgagcatcccggcaacgggctggggcgactgatcagacccgcaaccgcaaccgcccctggcaggggggtacgttgggagaataactgaggctgatggcctttcaccctccttccatcaagcctccactcagctcactgctgaacagttgttgtagcgagtgagctgcgtccgtgtgtttaggccacgtgtgccaggtgctggcaacgtgcaatatggtgggttagctcgcgtgccattgagcgtgtgctaatggtttttaaatgcttaggccttttcggttacaagggataaaattctaccatggatttaatccgaccagaattaagtaaattcatacctcacatccaatcacatggtgggattaaatccattaattaatccatgtatatctcaaagatagttattcttttaatccatggattttaatataaaaaaaaaaaaaaatgtcatggatttatttcatacctaatgagctatggatagaattcatgtcttctatagtttaaaaaattctcaaacctttgagttataattttgatgggtttaaccgaataaaaaaccgaatagacttggattattttgtagcatgaattgtgatatggatttaattccaatccataataatcaaggagaattgtgatatggatttaattccaatccataataatctaggactggattggtgtaaacgaataagaccttagcgatatgatcccagacagttccataacgccaacagaatgtcagcttatcaagcattgtctcatcattagtggtatcatcgtatgggcctccagagctcatgagagccatgtacattcttgtgaggtggggagacgtgggcaatgcag

SEQ ID NO: 3079 - DNA, 1755 bp, Zea mays
aattttggcgtgctttacttccgcttccaatataccttttttctgcgacaaaaatcatttttgttaattgcgaaaaggaaagagcccgtgtgaacaggaggggtgaggagaagagggggaaaagagagagaaatcggagggcattagcaagaaaccatgagttctaggttcgcaatccctagtcgtcttgtcctgatcttacttgagtgctcgtgagctctttccagtggctaaagactgcagatttgagttctggcccaagaaccgcgtgctagcccgccatggaggtgaggtccgagcaagggctgatggcggggagggatctattcggcatgccgaagagcccgccggcgcccgcgccgccgtcgtccgccgccatgcagagcgtgcgcatggcgtacaccgcggacggcaccgccgtgttcgctccggtgagctcttcgcctgcgacgccgtcttaccagccgcagggcgcagcccacggcgctagcatgtccgcggcgacggtcgttggaggcaatggcgctccagctgcgccgagcatgggtgagccgctggccaagaagaagcgcggacgaccaaggaagtacgggcccgacgggtccatggcgctggcaatggtgcctgcttcggcggcttcagggtcgccggcgacagggcagggtttttctgggccgttctcaccgcctgcgttaaatccggcgagctctctggtggtggcgtcgccagacggattcaagaagcggggccggcctaagggttctaccaacaggccacgcgtggacgctgctgggtcatcaggagctggatttacacctcatgttatcacagttcaagctggggaggacgtggcatcaaagattatgtcattttcccagcatggaacacacggagtttgtgttctttcagcaaatggctccatatcaaatgtaacgcttcgtcagactgctacatcaggcagaactgtaacatacgagggtcaattcgagatactgtcgctgtcggggtcattcttcctggctgaggatggtgtccagcgcagccgaaacggaggcctcagcgtgtcgctggctggtcctgatggccgtctgttgggtggtggggtcgcaggacttctagtagcggcttcaccggttcagatagtactgggaagcttcaattctggaggcggaaaggagccacaaaagcaggctccttcagaacctacatcggctccaccgagggttgctccgacagctgggatgggaggacccagcagcccttcttcaagaggcacattgagcgagtcatccggtggcgctggaagcccaccgccactgcatcgagccatggctgctagtgctagcaatagtaaccagccaccgttcttgtccagcatgccttggagatgagtttgcagcttgcattctcttggccaattccaggcaggatgtagcaatctgcgctttcagtagcgcccgttgtgtgagtagctgtgtgcagtacaagccagaagcttgggtgggaatataattgcgtctggtaaatctgtagctctgttgtaggttccaccctgaattcctgtgctaggtgtgttgagctgtgtaagcaatgtaatcctttcagcgttatcaaatgctatttagttaaatgtttctaccaaggcatgtcgatttgaatcataagatatcaatttgctgtttgcgtctcggacaacttctgttctagagaacgttctactcactgaaatttgagcctgttgccaagtttgaaaac

SEQ ID NO: 3080 - DNA, 1645 bp, Zea mays
  misc_feature (596)..(596): n is a, c, g, or t
aagaaaccatgagttctaggtttgctgaaatctcctttgatctttaatctgttcatctccttgcgtgagtctgtggcgttagcgtgatgccttctcctagttcatgaacttccttccggttcgcaatccctagtcgtcttgtcctgatcttacttgagtgctcgtgagctctttccagtggctaaagactgcagatttgagttctggcccaagaaccgcgtgctagcccgccatggaggtgaggtccgagcaagggctgatggcggggagggatctattcggcatgccgaagagcccgccggcgcccgcgccgccgtcgtccgccgccatgcagagcgtgcgcatggcgtacaccgcggacggcaccgccgtgttcgctccggtgagctcttcgcctgcgacgccgtcttaccagccgcagggcgcagcccacggcgctagcatgtccgcggcgacggtcgttggaggcaatggcgctccagctgcgccgagcatgggtgagccgctggccaagaagaagcgcggacgaccaaggaagtacgggcccgacgggtccatggcgctggcaatggtgcctgcttcggcggcttcagggntcgccggcgacagggcagggtttttctgggccgttctcaccgcctgcgttaaatccggcgagctctctggtggtggcgtcgccagacggattcaagaagcggggccggcctaagggttctaccaacaggccacgcgtggacgctgctgggtcatcaggagctggatttacacctcatgttatcacagttcaagctggggaggacgtggcatcaaagattatgtcattttcccagcatggaacacacggagtttgtgttctttcagcaaatggctccatatcaaatgtaacgcttcgtcagactgctacatcaggcagaactgtaacatacgagggtcaattcgagatactgtcgctgtcggggtcattcttcctggctgaggatggtgtccagcgcagccgaaacggaggcctcagcgtgtcgctggctggtcctgatggccgtctgttgggtggtggggtcgcaggacttctagtagcggcttcaccggttcagatagtactgggaagcttcaattctggaggcggaaaggagccacaaaagcaggctccttcagaacctacatcggctccaccgagggttgctccgacagctgggatgggaggacccagcagcccttcttcaagaggcacattgagcgagtcatccggtggcgctggaagcccaccgccactgcatcgagccatggctgctagtgctagcaatagtaaccagccaccgttcttgtccagcatgccttggagatgagtttgcagcttgcattctcttggccaattccaggcaggatgtagcaatctgcgctttcagtagcgcccgttgtgtgagtagctgtgtgcagtacaagccagaagcttgggtgggaatataattgcgtctggtaaatctgtagctctgttgtaggttccaccctgaattcctgtgctaggtgtgttgagctgtgtaagcaatgtaatcctttcagcgttatcaaatgctatttagttaaatgtttctaccaaggcatgtcgatttgaatcataagatatgaatttgctgtttgcgtctcgggc

SEQ ID NO: 3081 - DNA, 888 bp, Zea mays
  misc_feature (819)..(819): n is a, c, g, or t
attatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggggagggatctattcggtatgccaaagagcccgccggcgccggtttccgggccgccggcgtccgccgccatgcagagcgtgcgcatggcgtacacctcggacggcaccgctgtgttcgctccgatgagatcctcggccgcgacgccgtcttaccagccgcagggtgcagcccacggcgctagcatgtccgcggcgacaatcattggaggcaatggcgcggcagctgcgccgagcatgggggagccggtgcccaagaagaagcgcgggcgaccaaggaagtatgggcccgacgggtccatggcgctggcattggtgcctgtgtcggcggctacggggtcgccgacgacagggcagggttcttctgggccgttctcaccggctgggtcaaatctgacgaactctctgttggtagcctcgccggacgggttcaagaagcggggccggcctaagggttctaccaacaagccgcgcatggatgctgctggatcgtcaggagctggatttacacctcatgttatcacagttcaagcctggggaggacgtgtcatcaaagatcatgtcgntttctcagcacggaccgccgtgcagtctgtggtctctcagcaaacgtgccatatcaatgtgacgcttcg

SEQ ID NO: 3082 - DNA, 792 bp, Zea mays
atctacttctcttcccttcttatctgctacagcaattttggcgtgctttacttacctgctttttattttttcctttttccgcgacagaatcttttttgttaattgcgaaaacgaaagagcccgtgtgaaccggagaggtgaggaaaagaggaaaagggagacataaattggaggccattatcaagaaaccatgagttctaggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggggagggatctattcggtatgccaaagagcccgccggcgccggtttccgggccgccggcgtccgccgccatgcagagcgtgcgcatggcgtacacctcggacggcaccgctgtgttcgctccgatgagatcctcggccgcgacgccgtcttaccagccgcagggtgcagcccacggcgctagcatgtccgcggcgacaatcattggaggcaatggcgcggcagctgcgccgagcatgggggagccggtgcccaagaagaagcgcgggcgaccaaggaagtatgggcccgacgggtccatggcgctggcattggtgcctgtgtcggcggctacggggtcgccgacgacagggcagggttcttctgggccgttctcaccggctgggtcaaatctgacgaactctctgttggtagcctcgccggacgggtcaagaagcgggccgcctcgaggtcc

SEQ ID NO: 3083 - DNA, 1975 bp, Zea mays
attcgtttaggctgttcccggcggggaacatggaccaaaccctatggatccctcccaccgggaaagaagcctggtccatagaaaaacggtcgttcggttaagcccgatgtggattgtatcccgatctaacctcgccgttctaggtcgggaaccgcacccggtccctggtggggcggaaatattccagcgaggaaccgcacgcgaacgagtcgaggcatcaagaagggcagtgtcggcgatggctcttcggcgtcgatctgctctggctccggcggcggtctactggtatgcttcttccacccatctcgcaatgcgctgggcagtccacatgccccccatcccgcgtcagcccacgacgcttcgtctcgccgcatgcacatctccggaggcgcccggcgtcgcatggcgtgctcatgtcgctggagtcccgggcgctggcggatccggcgagccctgcaacggcggagtcccgaacgcactcacatccctggagacacttggtgcctcgtgctgcccactccaggtctcaaactacactgataggttatagtttagtcagttttcctccaacggattcagagctccattagttcttgcttcagattaaaaatgtgcactctttctgtaactattgttagttggtgcaagaatctcaatggtttgggaaacaatgtgcaatacaactctttgcaggctagcaggtgcaagttgctcacgcatacacacacatgccagatacaaaattggaggatatcaaaacatctttttagttccaaatctatcaatggtagattaggattctttcattctacggaaattactttgatggatgttgttataaaacaaaaacaatgtggttgtctgcccctgctcgtccagttcaggtcggtcggcagtcatctacgcccacgccagctgcggcgcagccaaccccctgcccggccagttcaggctgactgacagtcggccacggccacacccacgcagccccgcttgaatctttattcttcacaatttgttagagagaaggctagttctggatggcttccatgtaacttgatgggtgatctttgttgtgttgtgcgagttgtgacaaaatcatctctatctactatgcttgcagatggtgggagtgtgttgctttgcctgaatatgttgattccaccgaagaagaattgtttagacataaaataagggatttggcgtttacgcttctcaattaaggaggcaaattttgatcatgagtgtgcaccttgtatccttttcagtagtccacagacttgttcgagatctatacgtttacttgacattattttcatttttgaagtttccttgaccatggtctacagttttcgcttgacatatattttatatgcatttataatgagcacaaatattcattctgcatttgaaatcataaccacaatatctcacaatgctctcctctcctttgttgcagtgatttagatgtcgcgtcatcagttgaagactatttcatatacattgatggtcttccagtgagtgagaaggtctgttcatggttggccaaagtttatgttattttcccagcagtttgtaaacctaaattgcagtctgatctagaaggaagcagagaaggtggcgggtccattcctagatgttttagccttttaggagaagactattcagtttcgtgcaagggtatgcataactccttttgcagtaattgatctagactgccagccattttgtttgaggcaggggtatcaagtgcaccagaagaagttcctttctgtagctgcatttgaagaggtcaggcactagaagatgaattgccttttcacgtttgcttattgattgttcttttggtcttagcaacattaccagatactatatggttctcatgcagtactagcgtgtttgagatgcttcgaattattagtttctattgatataggcctttcattatctcccttatacaaaaaaaaaaaaaaaa

SEQ ID NO: 3084 - DNA, 2628 bp, Zea mays
  misc_feature (938)..(938): n is a, c, g, or t
  misc_feature (1110)..(1110): n is a, c, g, or t
tgagaattggagcttgtgtgttgtccgtttcaatagttgcactacacaaatccatatgaaccaaaagaaacatgaaacaaaataaagaaaaagggaactgaatcttaggctgaatcagagcgaatgtatcatatatgtaacaaaggcattttgtcatataggtaacagagcgaatgtatcaccagattcttcctcaccaaagcaaattcactatatgtcgctggtcacctttctttaatcaactacagctacaaatattggattcaatcaacaaacgaataagtgctataagcaagttcatctaaactttgtgcactggaagaatctggtgcgaggttctacatctttgggtacatggactggatgcaattaagttcatctacctaaacaaagagctctgtaacattcaacacataagccccaatacagagtagatatgtggcatgaaaaaatggaacgaatatgtacatgatgctgacaataaaactaggacaacacccaaagaatgtagcagaaggcatgtcaatggtaaaactcaagagcaaaaaaaatgaagataaagggcgtccgaggaagtctagcataaattaaaatagcagccctatagtgcagcagaatattaagcaatgacatgccaggtcagaagaatatataaaagttatgttcataagaaaacttcacgcatctaattgattcatcattccttgctaatgaactattgtatgcaaacacaaaagcagtggactaatattcaacttatacacaagtgtagcagaacagtgaatagtcttgtggcatcaattctgtctgccatcagttgttgcttgccctggtggatgtgagggagaactctactacaggtttgtgttcctaataatttacgaatacttattgtttgtaaagtgacacaagagatggtatataggcctgaaaactantttagatcgctggaataaactgtcttaactgatcatatttttgccatgagagagagagagagagcaaggtcagtttaatgcatacacatagcacatgtactctgtcttcaaagtgtacgattttaactcttccttttccatatctacatacaactatttaatccttttgcanctgctattcccaactaagactttcaacatttcattcaacataatgatgcatggaatcctagataaagataattgtactcctagtgaacctgttagctgttttttgcagctaactatttaatgtgaagtcgcagaatgaaaaaatatagtgtggatgcaaattaccttgccgaccatcaaaatgcgataataatttgttgaatgctaatagctcttggtgatgattcctcaagccctcatgctttggcatccataataagtgtatgactattatattccttgttccgcaattccattagcttgataaagtttactgtttttttcttcttcattaagttaaaaccttattcctgtcaccttcaagaactacgtaatagctaccaactggattgcctggtgtctgaaaagcgaaatgcctgacagaggaaaactaagttcctgcagcaagggcgctggggctggttggctaggttcggatatgctgcgcgattatggattgatctgcgtctgattatggattctgaatgctaaagcaagtagtttaaacctagatgtgcacgcgcccgacgatgagaccattcagaaaatcggaatgcaggtcaccatgatccaaccaaactgctctccaaccatgctttaagaaatcggaaaactcgtgcgacagccatttcagtggcagaagaagccatggggcagaagccgtcgtacctcctgctgctcgtcggcctcctcgccatcgccatgctctgcgccggcccaggtcacgcgctgcgccaactgaacgacgccaacggcggtggcctggagttctccttgggctccaaggcggccacggcgggggccaagaccgagccgctggacccgtccctgagcgacgactacgaggttagtgcggttatgggttctggggatggctgtttcgtggctggtgggggcaggatggttgtggcgttgcggtggggctgcacgctgcggtctgggcaggttgtggttcgtggcacgcgggtgggtggcggggccgggggcactgtggacgcctatattataggcttaataggagtagtatagattcaatctatatgtgtttgagatatatgagaatataaattattttaagttatactctaatatgtcttaatacacgtagattgagcataataccaaagtacccaaactagaccttcagagagaccgtggcaacaattaaaaataaactcacaaattgtattctttttcttttttatatatagtttaatcgactcgtcttattgaaaaaatattattgttattgttatttactatgatattgtttagtacataatatattataaatatggctttgtataaaaaagacaaatgaattataaattgggaagaagggagtaaaaatatctatgggaaatctgccatgattaaacttgtattgtgtttatatatatgtgtatatataagaagagagaaaatattatactccatcctaaattataattcgtttgactttttttatgcatcataagcg

SEQ ID NO: 3085 - DNA, 2288 bp, Zea mays
gtaagcccgcgaggccgcccgggccagcggccagcaaaagcagcggcggcgcggccagggaccgacgtacccgccgcgagaagctccggttggcaccccaacggcatggatgctagcagcgtcagcccgtgcgatctagacagggagtttgcgctccaaatcgctcagctcctcgccacgcctcctctccaatcagcccaggaatactatggtgaactcatacggtccaagaagcttgatggcattagagtgagctacagtggcaagcatgggaaaggtgtttatgcaaatagggactttggtgaagacgaccttgttctgaaggaccaaatgttggtcggtgctcaggacagccttaacaagattgactgtgttgtgtgtagttactgcttccacttcattggttctatagagtaccaaattgggcgtagattgtatttgcaaagccttggtggtagtggtgatggcactaccgagagacactgccatgggagtgatgttgggtcaagtactggctgttccggtgcatcaaatggaaatagcaatgctgtgccacaagaggtcctgttgtcacttatggatggtaatacgctgttgcctttaaccgatcagttctgtttgccaccagttgttgcttgccctggtggatgtgagggagaactctactgcagccaatcatgtgcggattccgattgggattcttatcactctttgctgtgtgctggatccaagactgaaccattgcggaaatctgcccttcagaaatttgtggggcatgctaatgaaaccaatgatatttttttggttgctgccaaggctatcactttcaccttgttgagatataggaaactcaaaagacagcatgtgtctcatgaatcaagctcttcgctcctcttggaagcatggaaaccactttcaatgggcttcaaaaagagatggtgggagtgtgttgctttgcctgaagatgttgattccagtgaagaagaattgtttagacagcagataagggatctggcgtttacgtcactgcagcttctcaaggatgcaatctttgatcctgagtgtgcgcctttgttttcgcttgacatctatggccatataattggcatgtttgagctgaacaatcttgatttagttgtcgcatcaccagttgaagactatttcatatacattgacggtcttccagagagcgacaaggaggaagcagagaaggtgacagggccattcctagatgctttaggagaagactacttagttccgtgcgagggaacggcattctttcctctgcagagctgcatgaaccattcatgccgtccaaatgctaaagcatttaagagagacgaggacaaggatggccatgcagtgataattgcccttaggcccatcagcaaggacgaagagattaccatcgcctacatcgatgaagaccttccttacgaggagaggcaggcgcagcttgcagattacgggttcacgtgtacatgcttgaaatgccaagaagagcgaccggtctgaaaggacaaatatgtttgaattttgcggcattcagcctatgtcactgggtagttttgaaagctcgcgagaagtgagtgcacaaaatgatgtttgttttcggctgtaacttgcaaaagttttgttgttgtccaatgaatatgaatagtgacgaacagacgatcagtcgtcgtaaccaacaaaaaaaaaaaaaaaacacaaccgcggccgcctaatggcaatagcagcaggttgacacttgcaactattttggttatacttgtacattaacacaactggctgattcgccaagtatgctagtattacatttgtcatctccctgcatagattatgggggcactgcatatcgcacaacaacgtgtacatagcacaggcttttacacatggtacaggaaaaatgagttccatcactcgagccgagctgacgaaagaaggaaaaaaaaaacaatgatgtcctccgttctcactaagccgctgccaacacttcgctggatggagtttgacctctatctctggtctaggcctccaaaatattgttccaggcttggagcgctgaagacattggatgctgttctttccggtcgctgcggtgaaatgtgcagttgatatttgataaacctagctaattggtgaacgatttcaggacttgtgtcgatgtgccaatcaggttcgagttgccgaacgaaagatgtgcggccgttatctgtactacagaagagaaccttatcttttatcaagccgccaccagcaaaaaggccccccgcgcccggggccga

SEQ ID NO: 3086 - DNA, 755 bp, Zea mays
cattgggttcccccaggccggcccgggtcgggttttgctagggtttactgcttgtcttcctttctcggcagtcggcaccttcgcggcttcgcctgatcgcctacgccgcttcgtcctgattctgattctctggtgctcccaagaagaaagtcagggaatgaaggaccgccacctctcgctgaaccagacccagcgggtccgcctcgaggccgcgcttcaagagctccagtccgttgcgcccgccgccgcgtccgccgccgccgtcaccgtcgcggacaccattcccgtcaatcaagaggacaacatcctcaaggggcatgggacgtcggatcaggacggggaggtggttgcgacgctctgcggggtggtggagcgggtcaacaagctggtctacgtccgcactcttcgcgcgagatacaagccggaggttggtgatatcatagttggccgtgtgattgagattgctcctaagcgatggaggttggagataaattttagccaagatgctgttctgatgctttcatctatgaacttgcctgatggtattcagagaaggagaactgctgttgatgaacttaatatgcggagtatctttgaagaaaatgatgttatctgtgctgaagttcgaggcttccaacatgatggatctctgcacctacaggcaaggagtgaaaagtatggaaagctggagaggggccaattgctgatggtagctccatacttggttaaacgaaagaagcagcattttcatcatc

SEQ ID NO: 3087 - DNA, 2810 bp, Zea mays
gtcggtccataggcccagttgaagccgggtcgggttttgctaggcgtggccgcccggcccccgttctcggcagtcggcacattcgcggcttcgcctgatcgcgtacgccgcttcgtcctgattctcaatctctggtgctcccatgaagaaagacagggaatgaaggaccgccacctcgcgctgaaccagacccagagggtccgcctcgaggccgcgcttcaagagctccagtccgttgcgcccgccgctgccgtcaccgtcgcggacaccattcccgtcaatcaagaggacaacatcctcaaggggcatgggacgtcggaccaggacggggaggtggttgcgacgctctgcggggtggtggagcgggtcaacaagctggtctacgtccgcactcttcgcgcgagctgcagattctcgatggagatgaatggggttctgcaagccgcggatgccaagtactgggtttacaagggtgagggcgccgcgaatctcatcctcagctacaccggctcatcccctactatgcttggcaaggtattgcgggtcaagaagcttctaaatgacaagtcacagctgccaccaagttgtatggtcttctcaagtcatgagcaactcctgtggggccatattccagaactggttgagtctgtcaaacaagattgcttggctcaagcctatgctgtacatgttatgagccaacatctgggtgccaatcatgtcgatggtggggttcatgtacgtgtttctagggattttctagagcttgttgaaaagaatgttcttagcagccgtcctccttggagagtaaatgcaagttcaattgatatcactgctgatgccgctcttctaatagcagaccactctttattctctggtactccaaagggtagcagctgcatagctgtagagataaaggccaaatgtgggtttgtgccatcatcagaatatatatcaaaagataattctatcaagaaacaagtaacgagatataaaatgcatcagcacctcaaatttcatcagggtgagatatcgaagactagtgaatacaatcctcttgatctattttctgagtcgaaagaaagaataagcatggccatcaagtcatttttctcaactcctcagaacaacttcaggatttttgtcaatggatctttagcttttggtggcatgggaggtggtgcagatagtgttcatcctgctgacactgataagtgcattaaagatctcagcaaggtcagtggcctggaactccctgacttcactgagctcctgtcagagacaattttcaaatctggggtattgggcaaactgttgaccactcaaaagctggatgatcatgacattgaaggggcaattcatctgtactacaacataatttctcagccttgtttagtctgcaaaaacctaactgatgtagagctattgcggaagtacacactcttgcattctcttccgttggacaagagcttgaagattgtcagaaacttcctcatttctgctactgcaaaggactgtagcctgatgatcagctttcggccaagagagaatggaagtacagattctgagtatgattcagtgtttcttgaatcagcgaagcgaacctatgagtacaagacatatttcgttgatctggatgtgaaacctctggacaagatggtacattattttaaactggatcagaggatagtcaattcctacacaagatatggggaggtcttgccacctccaaagggcaagtaataccaaagacacttcggcgattcagctccaacaatgaggagcctctcttcttactatatacgtctggactatggagaagggtgcatcagagagctccagcccactacgcccttaggttctgtgcatatattgttgtatctcttaactgtttgatgatatggaatattcttttcccaatatggtaccgagcctttcttgagcctcctcctcgctgccgctcttcttcggaatgccgcggcatttgccctcccctcatgtttggcgagccggctgcacgtacagcacgacagtgagtgccagggacatgcacatcatggcgacggtttaagcttgtggacactcagcagatagggtgatgaccgccattccctgtatgacagacacgatgtgcatgcaacatgatcagccattcgatgcatttgatttgatggatccatcgatgttaaccaatcttataatatgctatcctagtccagaaacatcattttcaatatccgaatgctctgcagatgttgggtgttagtagcgctcatgccatatccacacgtgatctgatcctttactagcgcacgtgactccaggaaaaaaaaaggtaaattaagcgcgtgcgagtgctgctatcacatcagaactacagcgtcaggtggttaattaacgctgcggtagcaagtggatgcgtagcagtgaaagcacatgcgattgaagatttgaagtaccgaccgcttaccgccaatcgccatacccgtaccgccacgaacgttttcccattataaatgcattaattagagtgcaacgtcccattttttaaggacataactctatactaggttggtgcccgtgcgttgctacgggagtaaaaaatttgtatgaaatatagatacaaaacgacatcatcactacactgtgtccccttggacagtgccgttggccaagacaggagcaggggcggcttccatatccacagcgactctcaacacaatataaccaattaagcgtacatatgggtaccaaagaataagttaaaaatattctagcatgaaaacatctaatggtatgttacatatttaaga

SEQ ID NO: 3088 - DNA, 2140 bp, Zea mays
gacgctggcggcggcgcgtcgccaatacgcagcgcggatgtggagcccatgcaagcgtgtgtccgcctgcgtggcgtccactctccctccacgtttcggcgtcctcgtcgccttcctgggaaatctccagctactgcccactgccccttcccttcagtccctttccccgggctgtggtactagtactagtaccagcatctcttcaggtctccaccaagcgcagacaccgcagcagcggcagcagcacgatccggtgaccccccgccgcgtccagcctgctcctccggtgatcgccggactggcggggtaggaaccagcggagcgcagcccgcctccttccgctgtgtctgacagcagcagatcctcgatggagatggatggggttctgcaagccgcggatgccaaggactgggtttacaagggggaaggcgccgcgaatctcatcctcagctacaccggcacgtcgccctccatgcttggcaaggtactgcggctcaagaagattctaaaaaacaagtcgcagcgggcaccgagttgtattgccttctcaagtcatgagcaactcctgtggggccatatcccagaactggttgagtcggtcaaacaagattgcttggctcaagcctatgcagtgcatgttatgagccaacacctgggtgccaatcatgtcgatggtggggtccgtgtacgtgtttctagggattttctggagcttgtcgaaaagaatgttcttagcagccgtcctgctgggagagtaaatgcaagttcaattgataacactgctgatgccgctcttctaatagcagaccactctttattttctggtaatcctaagggtagcagctgcatagctgtagagataaaggccaaatgtgggtttctgccatcatcagaatatatatcagaagataacactatcaagaaacaagtaacgagatataagatgcatcagcacctcaaattttctcagggtgagatatcgaagactagtgagtacaatcctcttgatctattttctgggtcaaaagagagaatatgcatggccatcaagtcccttttctcaactcctcagaacaacttaaggatttttgtcaatggatctttagcttttggtggcatgggaggtggtgcagatagtgttcatcctgctgacactcttaagtgtcttgaagatctcagcaagattagtggcctaaaactccctgacttcactgagctcctgtcagagacaatttttaggtccggggcggccggcccccggcggcccaccctccggctggatgatcatgacattgaaggggtaattcatctgtactacaacataatttctcagccttgtttagtctgcaaaaacctaactgatgtagagctattgcggaagtacactttcttgcattctcttcctttggacaaaagtctgaagatcgttagggacttcctcatttctgctaccgcaaaggactgtagcctgatgatcagctttcggccaagagagaatggtagcacagattctgagcatgattcagtgtttcttgaatcagcgaagcgaacctatgagtacaaggcatatttccttgatctggatgtgaaacctctggataagatggagcattattttaaactggatcagaggatagtcaatttctacacaagaaatgggggaggtcttgccatctccaaagggcagtaataccaaagacacttcgaggattcggctccaagaatggggagcctctcttcctgtatacatctggagaagggtgcatcagggagtgttggttgttgttcctgctgcttggtgctgctgttgtaacttcatgagtacagtcccaaggttgggaggctcgaccttaacgcctggaaagggcatagggagctgtgttgtccgtcagtcgctgtggcttgtcacagtaatttccgaagatgtccaacgttagttgagacaactgaactgcttaccgtggcaatcactcattgtaacatcaagttgaaaatgagggctgaagtttccctcataggctaccatatgtgagatatgtcctttgtaccactaagtgtccctgtgtcatgtatgaatgtatcttaatttgctgttgcagaaatgtttggggaaactttcaaccaccaaaaaaaaaaaaaa

SEQ ID NO: 3089 - DNA, 2203 bp, Zea mays
gacgctggcggcggcgcgtcgccaatacgcagcgcggatgtggagccacatgcaagcgtgtgtccgcctgcgtggcgtccactctccctccacgtttcggcgtcctcgtcgccgtcccgcgaggccgcccgcgactgcccactgccccttcccttcagtccctgtccccgggctgtggtactagtactagtaccagcatctcttcaggtctccaccaagcgcagacaccgcagcagcggcagcagcacgatccggtgaccccccgccgcgtccagcctgctcctccggtgatcgccggactggcggggtaggaaccagcggagcgcagcccgcctccttccgctgtgtctgacagcagcagatcctcgatggagatggatggggttctgcaagccgcggatgccaaggactgggtttacaagggggaaggcgccgcgaatctcatcctcagctacaccggcacgtcgccctccatgcttggcaaggtactgcggctcaagaagattctaaaaaacaagtcgcagcgggcaccaagttgtattgtattctcaagtcatgagcaactcctgtggggccatatcccagaactggttgagtcggtcaaacaagattgcttggctcaagcctatgcagtgcatgttatgagccaacacctgggtgccaatcatgtcgatggtggggtccgtgtacgtgtttctagggattttctggagcttgtcgaaaagaatgttcttagcagccgtcctgctgggagagtaaatgcaagttcaattgataacactgctgatgccgctcttctaatagcagaccactctttattttctggcaatcctaagggtagcagctgcatagctgtagagataaaggccaaatgtgggtttctgccatcatcagaatatatatcagaagataatactatcaagaaacaagtaacgagatataagatgcatcagcacctcaaattttatcagggtgagatatcgaagactagtgagtacaatcctcttgatctattttctgggtcaaaagagagaatatgcatggccatcaagtcccttttctcaactcctcagaacaacttaaggatttttgtcaatggatctttagcttttggtggcatgggaggtggtgcagatagtgttcatcctgctgacactcttaagtgtcttgaagatctcagcaagattagtggcctaaaactccctgacttcactgagctcctgtcagagacaatttttaggtctgaggtattaggcaacctgttggccactcaaaagctggatgatcatgacattgaaggggtaattcatctgtactacaacataatttctcagccttgtttagtctgcaaaaacctaactgatgtagagctattgcggaagtacactttcttgcattctcttccgttggacaaaagcctgaagatcgttagggacttcctcatttctgctaccgcaaaggactgtagcctgatgatcagctttcggccaagagagaatggtagtacagattctgagtatgattcagtgtttcttgaatcagcgaagcgaacctatgagtacaaggcatatttccttgatctggatgtgaaacctctggataagatggagcattattttaaactggatcagaggatagtcaatttctacacaagaaatgggggaggtcttgccatctccaaagggcagtaataccaaagacacttcgaggattcagctccaagaatggggagcctctcttcctgtatacatctggagaagggtgcatcagggagtgttggttgttgttcctgctgcttggtgctgctgttgtaacttcatgagtacagtcccaaggttgggaggctcgacccttaacgcctggaaagggcacagggagctgtgttgtccgtcagtcgctgttgtaactaagtagtgcatacaccgtggcttgtcacagtaatttccgaagatgtccaacgttagttgagacaactgaacttcttaccgtggcaatcactcattgtaacatcaagttgaaaatgagggctgaagtttccctcacaggctaccatatgtgagatatgtccttcctttgtaccactaagtggccctgtgtcatgtatgaatgtatctcaatttgctattgcagaaatgtttgggggaactttcctcctccaaaaaaaaaaaaaaaaaaaaaaaaaaaaaaaaaaactcgagggggg

SEQ ID NO: 3090 - DNA, 3652 bp, Zea mays
  misc_feature (840)..(840): n is a, c, g, or t
  misc_feature (846)..(846): n is a, c, g, or t
  misc_feature (1432)..(1432): n is a, c, g, or t
  misc_feature (1605)..(1605): n is a, c, g, or t
  misc_feature (1703)..(1703): n is a, c, g, or t
  misc_feature (1747)..(1747): n is a, c, g, or t
tgcggatgggtgggagagagtggagcgtcggcagctttgtgggtcaacctccgtggtgtcttagatcaatcataatatgattgcagtgctaggaccatatgatgttgattcgcgcggcctgtgtgtgtgtggggcttggtcttgagttggacatcgagctactgtactggatgggatagcacggttactagctgagttgttcattcgtattcgcggtgacaatagatttccttgctattatactttctccattctttttatttatcacattttagtttaaaaataaattagcggtcgataaatattttaggacggaccagtaattggtaatgggacacctttacatgtcgcctgctttggagattcagaattgttgcatgtgacacagtgacccatgaaggaagagaaacttggtgcaggttgcacgttctctaatgatggaactgttggcttgcttggtcgtaaagcgacctgattgtgacgggatctcccccaccctccacaacttccttgacagcatctaaacgcgagcggatctggaggatggcgacagtctcggtgcacgagtactcaaactcatccacggatccacaactccgcaaggctaaagcctaaaggcatattcatgttttaggtcggcatgcagatagttcgtgggcatgttgtatggacttttttttaagtatggagcagcacataaataccacgctctttgtacggttccatcgttctgcttatcttggctggtagggctacggaattcattattaaacggacatggtggaaggttactacattctacagctaccttttcgccgctcacggcgcacggcggcaccncacctncagatgcagctggaacttttataatccggccagaggaacgttttcgttcgtgtagcaaagagacaggcggaccgcagacctggtccagtacgaatcaatcaaagctgccgcgcgtactcaggagatactatatagccaccttctgtccgcaaaaccctactaccacttcatgtgttctcgtaaatcatcatcgctagtgttagagcaatcttcaaaagactctttatttttagttttttatttagctatttatttatcttttgatagagattacattttaaatgtagcatctcacttcaatagactatctatctagtttgaccagtcaggtggctagctaagtttggttagtgagaaagtcaatttatagagtctgatagctttacgaattagattgctagtatgttggagagttttttttactgttgaataaacaaaatttggcttgatgaaccagtttgttggagatactcttaagccttaagccgtgaagactaagggcctatttggttcagtttttttctgaccagcttttccgagaatctagctgtggggagaatctgtctgtgtagagaatctaagtatnattaggattacgtgcggaggaagataaagttgtctatggggctcaggatctatagagtgacagattactactattacgacgacttaaccgattatatgtttatgttgattttgaatgatttttaatcaaacgaattttatagaagctggctgaaaaactgagtgtttggcggnccgcatcagcttttagtggccagaagctgcgaaaagccgaaacaaacaggcactaaggctaggcattgtttcataggaaaaataaaataaaataacancgtaataaatacatgtacaacctaattaatatatgatgtatctngacagatctctaagaggttaagtgaactttttgtaaaaatcggtctctacacgactctctaaacacactatattttaattatatttatagttatagacttagagttatataataaatctcttaactgtatcttatatttttaaaaaccgaaccggagtcttacaagtaaggtccctaacaaacaaagagtgtagtaaaatattcgagcagcaaatttggtgtccacaagaaaatgcgcacgggcaaatgttcatttacggatttacccgtctttggcttgcgggacaacagtggagtactcgagaaaaaacatgtcatttgactcgagatacccaaacaaaggttccttccccttctatgcacaaaccaacgccaccgagcacttgacttacccgcaggatgcctcttgggtcccaatatgctccggacccacctgccacgacaaaatccgcagacagtaacaggatttgcctacgcggcttattacggagcccgaaacggcgtgaacccatccccacccgccgacccgcttctcgaaacacgcggccccatgctccgcgcgtgggagcgccgtcttggaccgtccgacctccatccgacgctcccccgcgcgcgcgcgtgccctgctccgtgcctccgtcgtcctcggcccctctctccttctctggtccttggcccttcctctctctcctccccagctcaacgaaacgcaaggcctcgcggcggaaatacttgtagactagtatactagacgctcacgagtcttagcacagtcgcatcactgccaatccattgctctcgcctagtacacgaccaatcgatgatggccttggaaccctaggagcggccgcgcggctcagcttcgccatgggctccctcgacaagggaggagcggcggcggcggcggggaggtacaagcgcgttccgggcccagcgctgcgggctggcttcgtcggcggcgcgcggaaggtgcgggcgagatccaggctcgcgcgcttcctgctgtccgagaaggtggactatctccagtggatagtcggcgccaccgcttcttcttcgtcgtcatcgtcttcgtcgcgtttctcccggagttgggcgtcttcgagcggcccaggctgacgctcccctcgcgccgcgcgggagagggacgcgtcggaggcggaggcgggattgagggccgcagcggcctcgtcatgtgggaggcgggcatggcgtccagttccagccgaccaggctgagggagaaatgggcgagtgagcggagggaggaggccaagagcttggcggagctcgggacgcccgtaacgaggctcggggcacggaagccgcggcttgccatggtgagtactgaggattgctggcgtggcgttggggaggatttgtatgggctggggatgggcttttcgccatgtgctttctgatttttctcgctgctcgcgttcgaactttctgcaggtgttcggtgacctgtatcccagcgcaatgcagcttcagatggtcagcgtcgcttcggttctggaggccatgggctacgaaatgaaggtgcgtccctgaacctgaaatgctgtctcgcgaaccataggctagaagtttacttgttggtcgtcagacaagttcgtggaggtagtactgatttgagtggaacacgcgcccttgtgtttgttttgtgacattttgcttctagcagattgttcatggctaaactaggctgttgtcattaatcgtcaatattttggagcaagttgggttgtcttgtcatgtctgatgtatgcacctattcagtaatgcatgagccttgttgttggtctctatgttctagtttctactttctaaggagtagaaggaagatacacaaagttaactgcgaggttacttcagttgactcgtggcagttaaatgctctgca

SEQ ID NO: 3091 - DNA, 1439 bp, Zea mays
  misc_feature (1429)..(1435): n is a, c, g, or t
agctcggaattcggctcgagataaggtctggccaggctgctcgtcccgtcctcctctcgtggtcttccagaagccatggccgccgccgccgtccactgttccagggcatacgttcctttgagctctggcgcttactcaaggaaaaaaccaacttgccacaagtattgtgcatcggtggagcttacttggaaaccatgccgactagttggatatcgggattttcgactgaaagagctagcttgccaacaattggcccatggagtggatgaacaatatcctgtgaaaagtagcactgtggagcaaactcaggaccgccagccctgtctgccacaaggtgatgcttacttcgctggcctgtcgaagaaagaaatcgagagaaggcggaagattggcgctgccaacaaggggaaggttccctggacaaaaggcaggaaatggagtgaagagcacacgaaggtcatcaggcaacggactgctgaagctctgagagatcccaaggtgatgtcatatcaggaagaaaatgttagggcaccgtcagctacatagacaaacaagcaaagacaagataagtgcggcgctgaggacggtctgggagaggcggatcgtttctgtccgatccagacagaaggttctgcagatctggtccaacagtatagctgaagcagcaaagaacggtggtcacggccaagatatgcttggctgggacagctacgagaggatgaagtcagagatggtatctacgttcctgtggatcaaggagaggggacgtatggtgaagaagcttgaaagggccgtggcaaaaatagctgccaagaggcttcaagtggtacggagaagggaagaacaggccacaaggatgaagaagctgaaacctgactgtcagacgttgctgcaaaacgcggaccgtcaaccagcaagagtggtagtatctgcaaggccaaagcttaaggagaggctagctaagtggcacggtcgaaagaaagagctcgagacagtgataagttcacgggcaaggaaaagaggattgcgaaatccaccacgaaggcaaatggcagcagaaagcctcgaggctctgtcaacttcggctgcaggagcaccataggaaggatgggcatgtaccctagctactgagcagctgggagctcgtagtcgccttatagagaagcagaagcccatgcctaatgaccaattcattaggcaggcacggggttttttgtttgcgttgctgaaactacgtgtagtaatttttgttttatagccttattaggctttctgtcaaaggaacatgtttatgctccctccaatgaaactacgtgtaacatgatttatgggtacaaaaaataaatgtactagaaaaatacagttaaaaaacatttgaatcccactactcgtccggggggaaaaggggatatttttaaaaaaaaacaannnnnnngagg

SEQ ID NO: 3092 - DNA, 1338 bp, Zea mays
  misc_feature (22)..(22): n is a, c, g, or t
  misc_feature (195)..(195): n is a, c, g, or t
  misc_feature (217)..(217): n is a, c, g, or t
tttcgttgccgctcgcggcggnataaagcggcgtggggggaggggcggcaatgctggtgccgccgcccgacgtgcacctcgtctggctctgccactgcttccaccatgagagctactccgcatactgcacgtcgaggtttggacgcctcatcaaccgtccatcaatttttgatatggagaggggggggggggctnaggatctttgtcgagatgtctnggctactcatttcccatccgagccatttgaccttgactcgaatgagattggtggaaacagtgttgataatataacatgtgccaatgtcaatggtgaaattgtcaaaatggtgagacagtacgctggcctagcagaccgttttgcctcactctttgtgcaggaaggtgtctaccatgttgctgctaggcggcgatatgtgcgtttcctggaccttatgaagaaggttgcgtgtgcaacccaagagtgcacacggcttgtgcctagcctagacatattactgatgtggcttgctcaccagagttttcctgtgtgttatgccacggatatggtagcgatgggcatcagtgacaatgttgcaaaagtgggtgtttgttatggcgaagtggtgagcaatgaggcggtaaggaggacaaaggaactgtgggaggatgcatatgatgaaccatatgatatggctggatcagaggttgatgtgggagcagttagcacagcaagggaggcattttactgggtgccagcagcatcagaggaggatgccaaccggctatacaagagtttgcagccaagattccttattgaggtatatgtgttcttgaagggagaatttgataaggagcccaccagcaaggagttcctacgattgcgaacacagaggtgtcacagatcactaaagctcaacatatcaatgtccaatttatcctgcaaaagctggcagaaagtatggcacttgtattgtgaatttgcaactcggggcctcttcattgagttcaggcgcacccttagtgggtgcttcaggaaaagcaagttcctcaagaacatctcattctcatggagcgatgggttgcatgagaaagcacttgctctcacagaaacaccttgatgtcaggaagaacagcccacggcctccaattccccctccagttcaagaaccatacttgcatcaagtgggcggctgaactccattccctgcatgatggtgggggcccctgatttcctgaagtcaatttggggcatctggaaaattaccgctccccaacaaacaccgtttgcttgaaaccgcccctggtacttgaatccaagcgagcaacacaaatgttcttggccctccccgcatgtgaagc

SEQ ID NO: 3093 - DNA, 2134 bp, Zea mays
aggctgcggtgtttgcatcgtccaaaactccaaatacatacatacaacatgctagcctagtcctcttctagtcgcctctacccagttacttgcatcgccccgtcaagcacgccgccggcacgcggccctcggtctccccgccgcgccctctgcctccgcccgaacaaagccgtctcgccgtcgcgttgccttccttaccgtccaccgcgggcagccgtcctagtactcggttggtcctcccctgctgcccttctacggtggaggagcggagatcctgccgttttccggctgatttcttctaattgcggggcaagttccgtggatagtcaatactgcttgtgctgttgagctaatattaagttcctgctgggagaacttctgcagttcctatggcaaagcctctcaatggcagtggccgtagcatgccaagatcgaatgagggaatgcggctcatattttcggcagttgtaggtgtcatgctgggttacctgtttgggatctccttccctacagtcaacataaccaagcttcacttcccttcgagtatcatctcttatatcgaagataggaactctggcatcacaacccagacattgttgaaccatgcttgggcatctgcaaacaatcataaaaagaatagttctgaatctaacactgatgaaattcccgagatttatgttcctacaaacccaaaaggtgctgagagacttccaccaggcattgtagtgtctgaaacagatctttatccccgaagactatggggtgatcctagtgaggaccttactagcgagccgaggtatcttgttacttttactggtggtattgggcaaaaggcaaatattgatgcagcggtcagaaggtttcagacaaattcccattatgatgtccccttttggttgttccattatgatggtcggactacagagtgggatgaatttgagtggtctaaaagagcaatccatgtgagtgccaggaagcagacaaaatggtggtatgcaaaacgatttttgcatcccgatgttgttgccagatatgattacattttcatctgggatgaggatctaggtgtagagcatttcaacgcagagaagtacattgagcttgttagaaagcatgggttggaaatctctcagcctggtttgcaacctgatagaggactaacatggcaaatgactaaacggcgtggtgaccaggaagttcacaaagtaactgaggagagaccaggctggtgcactgatccacatctaccaccatgtgcagcatttgttgagattatggcaacagtgttctccagaaatgcatggcgctgtgtatggcatatgattcaggtgaggtaacatggcatgcaagtcatgtgttcgtctgaagtgcatcgcgctgtgtatggcatatgattcagaatgacttggtccatggatggggtcttgactttgctcttagaaaatgtgtggagccggctcatgagaaaattggagttgttgatgctcaatggattgttcatcaatcagttccttcacttggcaaccagggcaagtcagataatggaagaccaccatgggaaggggtaagagcacgctgcagaaaagaatgggggatatttcagacaaggctggctgatgcggagaaggcttattacttggagcgaggcatcacacccccgaactcaacatcagtttagatgaacacatgctcctcagatgccacggcaaggtttctgttgggggaacctgctgcaaactggcatgttcatcgaagctgctgcagcccagggcaaatccatatatttgtacattagaggtcccacgaatcgccatgattaatctttagtgtcgctcacctggttttaatgtcatttcttttgttagtgatactagctgcgatgtaagtaggaggatacagcagagaccgtgatgatacccatttgtgtattaatgacctgatgcaatatggatgttgataatcctttcctcagtttcagcatgtaaattgtttgttctagaccagctgtatgcaactgggtcaaatactacattgatgtaaggcccaaaatttgtataagaaaaaaataataaaataaatatatgaagaaataaaataataaattcagatcaaaaaaaaaaaaaaaaaagcggcc

SEQ ID NO: 3094 - DNA, 1926 bp, Zea mays
ggttcaacaccctagactagtcctcttctagtcaccttaccccgtcgcttgcatctccccgccgccgccacgcgcccacgcttccttccgaacaaagctgtcgtgctgcctttcttgccgtccaactcaggcagccgtcctagtcctcgttggtcctcatctgctgcccttctacggtggaggagagaagaggagaggagcggagcggagatccagccgctttccggctgctttcttcttctaattgcggagcaagttccgtcaatactgcttgtgctgttgcgccaatttaagttcctgctgtccgcaaaaggagagcttccgcagctcctatggcaaagcctcccaatagcattggccgtagcagcatgccaagatcgaatgagggtttgaggctcatattttcggcagttataggtatcatgctgggttacctgtttgggatctccttccctacagtcaacataaccaagcttcacttcccttcgagtatcatatcctatattgaagacaggaactctggcatcacaacccagacattgttgaaccatgcttgggcatctgcaaacaatcgtaaaaagaatagctctgaatctaacactgatgaaattcccaagatttatgttcctacaaacccaaaaggtgctgagagacttccaccaggcattgtagtgtctgaaacagatctttatccccgaagactatggggtgatcctagtgaggaccttactagcgagccgaggtatcttgttacatttactgttggtattgggcaaaaggcaaatattgatgcagcagtcaaaaagttttcagacaaattcactattatgctgttccattatgatggtcggactactgagtgggatgaatttgagtggtctaaaagagcaatccatgtgagtgtcaggaagcaaacaaaatggtggtacgcaaaacgatttttgcatcccgacgttgttgccagatatgattacattttcatctgggatgaggatctaggtgtagaacatttcaatgcagagaagtacattgagcttgttcgaaagcatgggttggaaatctctcagcctggtttacaacctgataaaggactaacatggcaaatgactaaacggcgtggtgaccaagaagttcacaaagtaactgaggagagaccaggctggtgcactgatccacatctaccaccatgtgcagcatttgttgaaattatggcaacggtgttctctagaaatgcatggcgctgtgtatggcatatgattcagaatgacttggtccatggatggggtcttgactttgctcttaggaaatgtgtggagccggctcatgagaagattggagttgttgatgctcaatggattgttcatcaagcagttccttcacttgggaaccagggcaagtcagataatggaagagcaccatgggaaggggtaagagcacgctgcagaaaagaatgggggatatttcagacaaggctggctgatgcagagaaggcttattacttggagagaggcatcacgcccccgaattcaacagtagtttagatgaatacatgctcctcacatgccacggcaaggtttctgttgcgggaatctgctgcaaactggcatgttcatcgaagctgctgcaacccagggctacattaggggtcccacgaatcgccatgattgatcttagtgtcattcactttgttttaatgtcatttttttggttagtgagactagatgggatgtaagtaggagatataacagggactgtgatgacacccatttgtgtattgatgacctgatgcaatatggatgctgatagtccgtttctcagtaatcagtatgtaaattgtttgctgtataccagctgtgtgcaactgggtcaaatgatgtgttgtgctagtccatatgaagaaatatcaaggctagtttgggagcaagg

SEQ ID NO: 3095 - DNA, 2931 bp, Zea mays
ctcggggccccccgggcccgtcacagcgtcgtgacgtcgtcctctgcttcgcaagcgcccgagccgcgcgccgccgaacccgccgcctcctccagcctccgggcacatcggagcacccagccaatcgcaccccgacacggcggcaccggaggaacccctccttcttggtcgtagcctccgtggcctccctcccctcaccccttccggtgttggattgagggtggagcggagatccgccacggcttggattgatccctggatcgatacgccatataatttgggattctaaggtcccggtgcagcttcttctcgcagaagtttaccctctatgcccctctctaagcccacccctgtgattccgccgtgacgcctcatccacgggagaaacgccatgatgtcaaggtttgcccacttggggaagagcagaaaactcgctgaaacccttttggttgcctcaaagcccaatactgctagtggccaaaacattgcttcaagctttgcattcggcttgggttattccagcagggcatttttgcatgggaaggttcataatggtccaaacacctcctacatgctgggaagagcaaatgatagcttacattggagcactggtgtgaggaaattctcaattctttcatcttgtagccagaatgcatttcagaatcagcttgcttggaagcgacttgtagcactgggttctcgtgcaccaaaagcatctccaatttttagtaaggttgcttgtgccattggcttggctgtgagtaggtctaatataactccttaccttgtcgcttttattgcgggagaggtaatgctagctcagaagacatctgcagatggagaatactacccaatacgtgagcgagctcaggatggccgtatttacgttacctctctaatatattcggcagtagaattggtaattataatcttcagatcaatatatttggcattgctgttcactccaagtatactgatggccccatttgcagagactcttggcagtaagtataggaaaacatggcttcgacttgtccatcgtactttggagcttgcaggtcctgcgtttatcaaatggggccaatgggctgcaacacgccctgatctgtttccaagtgacctttgtactgaattgtcaaagctgcacacaaaagcaccagctcacagctttacctatactaagaaaactgttgagaaagcttttggtcgaaagctatcagacatttttgaaaattttgaagaggaccctgttgcatctggaagtgttgctcaagtgcatcgggctgttctacgattccggtatcctaatcggcagacaaagcgtgtaactgttgcagtaaaagtaaggcatcctggtgtaggggactcgataagaagagatttcaatatcatcaatgccgtagcaaaaatatctagatatatccccacgctgaattggttgcgcctagatgagagtgtacaacagtttgctgtcttcatgatgtctcaagttgaccttgcaagggaagctgctcatctgagccggtttatctacaacttccgaaggtggaaggatgtatctttcccaagacctctctatccacttgttcatcctgctgttttagttgagacttacgagcatggggagagtgtttcacactatgttgatgaccttgaaggacatgatcgaattaaaagtgctctggcccatattggtactcacgcgctcttgaaaatgctactggtaatgtatttttagaataaacatcctcattcatgattaccatttgaacaactgaagaaattagtaccatgcaaaatctggattatatgctgtaaatatcgtagagtcttcaatattttatttatgcatcaaaatggtactttttgctgctttgtactggaaaataattgctataagatattaccatattactagttctggactaaagattgtgagcctgccgataaagtttctgttgcaaacatacctgttgcaggctttgcagcatagttattcataggtactaatttaagtgcttgtatttgaagataacataacatttttcgtcattttgtgttctttacttcttttacaggttgataatttcgtccatgcagatatgcacccaggaaatattttagttcgtgttgcacaaccaaagaactcaaataacacccttaaaaagtcaaggccacatgtagtcttcctggatgtaggaatgactgctgaactttcaagtaatgaccgtgtgaatttacttgagttcttcaaggctgttgctcgccgagatggtcgtacagctgcagaaagtactctaaagttgtcaaaacaacagaattgtccaaatccaaaagcttttattgaggtaatttatcgctaccttacaactagtcttttcgttggttatagaagcttggattttattggcgagacttctctccctctttccatgataaagaaggctatgctacagtaataggtgccctgtagcatttaccttcattttcacataatgtatctgcataatattgattgccagcagaaaccggagatgtcaatttttttcttgagtactcaattttttttgaatttataggttgctgagacttggtttagggttaggagagtgccaattttggtgctcgctctgttttgttacatgtttatttctggataatactgctgttctcaaatgtaactccaatttatccacactcaatctccttaattaatgctacgaaagaggttcagcggtcagagtcatttactgggcgaacatttggtccaatctcattagctgcattgtatatttgcccatttggtgtctccttgatctggtcctggcatgggattggtctcattacaaaagaatattatcaaagggggtggcataaagactgaaggtctaggattataataaaaatttgaaagctgatttattgatttct

SEQ ID NO: 3096 - DNA, 1408 bp, Zea mays
ttgggaccctcgaggccggccgggtatctagatacataacacgctgaattggttgcgcctttatcgagagtgtacaacagtttgctgccgtcgcgatgtctcaagttgaccttgcaagggaagctgctcatctgagccggtttatctacaacttccgaaggtggaaggatgtatctttcccaagacctctctatccacttgttcatcctgctgttttagttgagacttacgagcatggggagagtgtttcacactatgttgatgaccttgaaggacatgatcgaattaaaagtgctctggcccatattggtactcacgcgctcttgaaaatgctactggttgataatttcgtccatgcagatatgcacccaggaaatattttagttcgtgttgcacaaccaaagaactcaaataacacccttaaaaagtcaaggccacatgtagtcttcctggatgtaggaatgactgctgaactttcaagtaatgaccgtgtgaatttacttgagttcttcaaggctgttgctcgccgagatggtcgtacagctgcagaaagtactctaaagttgtcaaaacaacagaattgtccaaatccaaaagcttttattgaggaagttgaacgatcattctctttttggggcactgctgaaggtgatgctatccacccagctgagtgtatgcaccaactgcttgagcaagttcgatgtcataaagtgaatatcgatggcaatgtttgtactgtcatggtgactacattagttcttgagggctggcaacgtaagttggatccagattataatgttatgaagactctgcaaactttactttttaaggaagactgggcgaagtctcttcaatacactatccaagggctcatggcgccttagggtcgtccgcaatcctttctaaagttttgatctggtttgtgttcgaccggaggatcctcttctctcaccatcacgattctggcttcttttctactttatttcacgtttcgtttctctgtacctgtcctggcgttgtgctgctaaagcagccttgatgataaagtaataactgcagtaaaaattttcagaagctaccagagtactatgctgctcagctctgggctgtcttcttatatgttcttgaagggccaaagaattaggtccttttcccccctcctaccaacacttttgacaatagctcttagatgatgtagcaaaaggcgttctgttctgatgatctttttgtaactggagaggttgtatccgtggactggagagttgcttatgtacagacagagatactgttaatctcgaaggaatccacttgtcaactgacaatcaaaaaaaaaaaaaaaaaaaaaaaaaaaaaaaaaaaaaaaaaaaaaaaaaaaggaggggggggggccgttaaaaaaaggccccta

SEQ ID NO: 3097 - DNA, 785 bp, Zea mays
  misc_feature (752)..(752): n is a, c, g, or t
  misc_feature (768)..(768): n is a, c, g, or t
ggtacgcctgcaggttccggtccggaattcccgggtcgacccacgcgtccgggcagctgccgggcattcgtgtggtctcgtcgtcagcgcagctgggcctacacacaagcaaccatgtctaagggacctgcagttggcattgatctcggcaccacctactcctgtgtgggtgtcttccagcatggaaaggtggaaattattgccaatgaccagggtaaccgcaccacaccaagctatgttgctttcacggacacagagagattaattggggatgcggccaagaatcaggttgcaatgaaccccaccaacacagtttttgatgccaaacgtctgatcgggcgtaggtttgatgatgctgttgttcagtctgatatgaagcactggcccttcatggtggtgaatgatgcaggcaggcccaaggtccaagtggaatacaaaggggagacaaaaagtttctacccagaggaagtgtcctccatggttctgacaaagatgaaggaaattgcagaagcgtacctcggaaagactgttaccaacgctgtggtcacagtgcccgcttacttcaatgactctcagcgacaggcaacaaaagatgctggaactattgctggcctcaatgtacttcgaatcatcaatgaaccaactgctgctgctattgcttatggcttaaataagaaggtcggagctgaaaggaatgtgctcatttttgacttgggaggtggcacttttgatgtgtcaatcctcactattgnagatggaatttttgangtcaaatcaacagctgg

SEQ ID NO: 3098 - DNA, 624 bp, Zea mays
gcgtggtcccggccgaggtacattacaatagaataggcaaagatggactgttcagtcataaagaaattactgttctgtttgtgccaaacttgtttgaatgcttgccttcagtggatatatggaagaataactggattctgtacaaaaaatcaaaggcagaaagggaagaactcactgttaaaaaggaaaagagtcctggtgattcgaaagagcagatgcaagtttcaggggagctgaataagggtaaaagtttagatgctgatcaattaaaagagggtggtgttggttgcagtgatatgaaaaatgagaaatgtgatgctgatataaagcagcaaggtaatgatggagacagtaaagttaaagttgaggaacctgttcagaagatgggtgaggatgttgaagtaaaaactacaggtgactcctctattgaccgtgcagctggggataagaagcccacaaaaaagaaaataataaaaaaggttgtgaaagttgttcggaaaaaaacaacaggaccttcaattgataaatcttgttccgaggacaagaatgttgtagcagaatctgcaaataaaactgcagaaggggggcagagtcaacaaaagaatgaggacgctggaaaacaac

SEQ ID NO: 3099 - DNA, 3433 bp, Zea mays
tccctgatatttctgttatttttacttattaaggaatttgtgctaactatgatacttttttatttgtgctgtgtttggcctctgttttagttactcaagtgaccttttcttcatgtcaattcctgccagtcatatgtttccgttgtttcagtcacttcttatggttagggttcacttcttgtgacctttaacttgtaccattacagttgcatgtggttcccacaattttgttgccaagtatcgtaactgaacattctcattcttttcaacaggttggcggacttggtggcaaaggtccagcttcttcaagtcttcctagtttcccaactcgtccaacttctctccctgagtcgtccaacttctcatctgcacctgtggggtctggcctggcaaggccaaatgatgactatatggctgtgcgtggttatgcacagaagctagaccaatatagcactgattatccactagagaggcgtatgtatggtgaacactcagccaatcttggtaggagagatggtctcagtgatttggatagaagatatactgatcagacagctactggtcatcaggtttctttctctgtttttctttttgcctttctcctagattgcaaataatcagtgcactgttgtaaccatcttgttctttcacaggttcatgatcatatggagcaggtagatttttgtttccctacttagaaaccactgttttgttctttctgatagcatgttgtttaacgaatccttttaattttctagagttcatcaatgcgccaccagcagctcctgaaaggtcagctgcagcccggatctgatacaaggtacaccctcaggcctcagtcaggttatatgaaatgaatctagaaggttgttgattattgttagaattttattgtcacacaagatataacagtgcattaattgaatgatcatgtgtttactaaactatttctgcgtagcctttgtttccgttagttgtttcggtacttctcattgatattcttggaagactaatcagtaacagccatttgtgtgtttatcactgcaatagaacatagcacatacactgagtatagtatgcatttctggcagacaagccgattactttgcaggaagatctgctccagcccatcaagcatcccaggaaattggtgtatatggaagagttgaagctgataatcgcaacatatccattcttgggaatgctccatatggaagacagcaatcagcctcattgttggaaggagctccaaggacaaacatcgacagcctctatggacaaggatcgtcaggcactggttttggtgcaggtcttcctcctggacgtgattatgcctcagtgaaaggcctgccccatccatcttcagaccctgatcaccgagatagcatcttaccccgtgtacatccagccgtctcaatggttgatgatcgtagagttgatcgaattggttatcgtcgtgaactggatctaagagatgaggaacgcagaagggacctaatactggaaagagagaaggaacttgaacgggaacgggaacgagaacgggaacgtgagttacgggactttcgagatcgtgaaagggaaagagaacgtgaaagggaaagggatcatgaaagactactaagagaacgtgaaagagaaagggaacgcgaacgcgaacgtgaaagagagcgcgaaagagaacgccttcgtgagcgccgggagaaggagagagagcgggataggaagcacagaactgatccaaggcgggagcacactccacctagaggccctggtgatcggcggcggtcttcttctgttagatctgagaagcctgtacggcgaatttcccctcgacgtgatgctgtgcataggcggccttccccggctcttctgctaaagagagaatatatttgcaaggtttttccatttcgcttcgtggatgatgagagggattatctgtgcttgacaaaacggtatcccagacttgcagttactccagaatttttctaagattgtcttgaactgggcttaagaaaaactaaatcttcctctcgatacaccagtgtgtttggagcatgatatccatgattcagatgatggtgctgatgaaggagcaattatctctactgagaaaacatcaagcttcaatactccggccaccatttggaatgcaaaggtactattgatgagtggcatgagcaaaggtgcctttgctaacataacttcattgagaagtactgaggaacgagttgtgcacttgaacaatatcttaaaatttgctgtattcaagaaggatcgttctctttttgcaattggaggcccttggaatgcagatatagatggtggtgacccatcagctgactgttcttgcttgattcgaactgccatcagatgcgttaaggaaacggttcacgttgatctatctagttgcacccactggaaccggtttgtcgaggtacattacaatagaataggcaaagatggactgttcagtcataaagaaattactgttctgtttgtgccaaacttgttggaatgcttgccttcagtggatatatggaagaataactggattctgtacaaaaaatcaaaggcagaaagggagcagctcactgttaaaaagagccctggtgatccaaaagagcagatgcaaggggagctgaacgatggtaaaaatttagatgctgatcaattaaaagaggctgatgttggttgcagtgatatgaaaaatgagaaagacgatgttgatatcaaacagcaaggcaatgatggagagggtacgggtaaagttgaggaacctgttcagaagatgggtggggatgttgaaggaaaaagtacgggtgactcctctattgaccatgcaacaactggggataaaaagcccacaaaaaagaaaataataaaaaaggttgtgaaagttgttcgaaaaaaaaataactggaccttcagttgataaatcttctgaggacaagattgttgtagcagaatctgcaaacaaaactgcagaaggggggcaaagtcaacaaaagaatgatgatgctggaaaacaacaggagggagctggtataagtcaacaaccagaagcaaagaaaactgtgaagaagaaaataattcgaaggattgttaaaaggaaagtttctggttcaggttctcagttgaatacccctactacacctgctgaaactagtaggcaagaagcagaagttcagccagaaaaaaatgttgagagttcggccgacgttggaaactctcagactaagctacaagaagggtccaaaattccatctgaagatatctcaaatcagaagaaagaggagaaaccagcggaaaaggaacacccattgactgatctcagtttaaatgcagataagggcaatcacaaggaagcttttgaacaaaaagacatgaaaacacgatggaaagaaggataaaaacaaacgcgacagcaacg

SEQ ID NO: 3100 - DNA, 1581 bp, Zea mays
gccacattggcccctcaaccatcctccctccacagatctctccggggaggcagcaacagttatgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggtaaccgatccaatttcgctagcctagacgccccggatgctgttgcaaaactaacagcctctgtctgtctgaccccgtcggctggcgtggcgtggcgagcaggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacaaggaccagatgaaggcggcgacggggaccatggacggcatcatcgacacggtgtcggcgtggcacccgatcacgccgctgctggcgctgctgaagccgctggggcagatggtggtcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctaggcatggctgcaaaggtttcaatcagagcccagccgcaataatttgttagctaccgaatgaatgatggtctacgcttgttgatgagttggtgctttgtcgtggttttgtggatgtaataattcgatgtacaaataaaaaaaggggagacaaggtgcttgttcccttggtttggtg

SEQ ID NO: 3101 - DNA, 3458 bp, Zea mays
ctttcagcgcaggagagccacacggcagcagaaatatcaaggtgtgaatcacggttcataacataaaacaacacaacgagcaaagcaatatatttacatagcggcatcaatcatagccgacacgtgattttggttgctgctactttggcatgtgcgtgggccctacgttgttgctaggatacccccggcctcactcatccattttgtgtatgtttggtttgtagagtcatccaatgcattatgaggtgatgtatcataagtttattttattaattttgttgaaatcaactcactcttaatatatatattaattattagcttatgagaaatagagtgatgatggatcaactcattttatttaacaaactaaataaaaatatgcgaagtgagaagaaaatggatcacttcatttatcaaaccaaacacactctttatagagctttatttattacgtggctccttttccttttgcagccactctacaatttcccgtttgacaacggagccacgtgactagaagtggggtattttatcttactatcctaggtttagttcaccttcattccaaatcagcaggttgtgcacaaattcagtctaatatcatgtcaaatcttttttctcgttaacgacgggattttggagaagtttgtaggaagtctgtctccggaccatatcctagcgttagcgtccatggattatatgctgactcattgccacattggcccctcaaccatcctccctccacagatctctccggggaggcagcaacagttatgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaaggtggtagcatctgtcacggtcgcccagcactgctctgctctgctctgctctgccatattttattgtgttgttgcagctcctggaagatgtctaattaccttctctgcagtctgcacagttttggggtctctagatttttggttaatccttggtcagaggcttacctaatatagagtattcttgttcatggaatccattactaatttcagggttcctaaagacgacgatgtcacgatcaaggtgctctactgcgggatctgccacaccgacctgcacgtcatcaagaacgactggcgaaacgccatgtacccagtcgtcccggggtaaccgatccaatttcgctagcctagacgccccggatgctgttgcaaaactaacagcctctgtctgtctgaccccgtcggctggcgtggcgtggcgagcaggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggcagatggtgatcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctaggcatggctgcaaaggtttcaatcagagcccagccgcaataatttgttagctaccgaatgaatgatggtctacgcttgttgatgagttggtgctttgtcgtggttttgtggatgtaataattcgatgtacaaataaaaaaaggggagacaaggtgcttgttcccttggtttggtgacaacaaaaacaaaaaaacacgccggcccctcaccgcgtatgaattaaaattaaatttatgtcacaatctatattccaaaataatccaaacataattaaattttttaattcgattaaacccatcttgaattataacctaaggtttagaaattttttaaactatgaaaggcatggattctatccatagctcattagatatagaacaaatccatgaagatattgcacaagtttatattagaatttatggattaaatgatgaatttaatcccaccatgagattaggtgtgaggtataaattcacctaatttagaccaggattaaatctatggtaggattttatcccttataaacgaaatccattacctaatgggtttgtgtacgtatttgttaattaatttgagagtaggggagggcaaaataaaaccaaatttaaaaaactaaaccgagctgaataaaccgaaaattttgatttttttgaatttcggtttttggatcggttttatttcctgcgctattcgatcaattggttttggtcttttttttcgaattttggttttttggattggttttatttcctgtgctatttggtcaattggttttggtccggttttttatccgtggacgaatacaccaaaattctacaattctacttctataatccatggaaatcgaatcaatatgtggttatacttctataattttgtagttaactatatgatacatttaaagtatatgttttattgcttaattgtgttgatataatatccactcaccattcatgatattgcggaaatgagacgattctataatttcggtttaaaatcgaaaatcg

SEQ ID NO: 3102 - DNA, 1553 bp, Zea mays
ccacgcgtccgaaaccatcctccctccacagatctctccggggaggcagcaacagttatgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggcagatggtggtcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctaggcatggctgcaaaggtttcaatcagagcccagccgcaataatttgttagctaccgaatgaatgatggtctacgcttgttgatgagttggtgctttgtcgtggttttgtggatgtaataattcgatgtacaaataaaaaaaggggagacaaggtgcttgttcccttggtttggtgacaacttgttcgtttacaccgatctatctctaaattagtatgaattaaaattaaatttatgtcacaatctatattcc

SEQ ID NO: 3103 - DNA, 844 bp, Zea mays
ggccgcccgcctccggtcaaccgcaacgttatccgcatctcccccttccgtaggagaaacggactgaggtgctcagctgacgccggtcgcctcgcagtggcaagtgcccgagcgatgcagcagataatcagcgcctgcaagctgcctcacacgcaacgggccgccgcgctcctgccgcagaggccatcgctcaggcgccttccagtcccaggaggtgcgccgccgccgcggcgattggtagtcaggaggagatgccaggaagaggataagcagcagcaagaggccgaggagggaagcggccctgacgagcaggagcaggagcagcagaagcgaacgttcctgagcctggaggaggccgggctggtggagatgtccggcctcagcacgcacgagcgtttcctctgccgcctcaccatatcgtctctgaacctgctgagagtgatctcggagcaggagggcgtcccgatagaggagctcaacgccgggcgcgtctgcgactggttcctcaaggacaagctcaagagagagcagaacgtcggcaccgccgtcttgcagtgggacgaccctggcttctagctagttccagcttcgttctgagccaatgatcatgctattctacactgcagcgcacgcaggggctatatatttcagggcttcaggcccttcacgggatgagcaaccaatgccacattccatttatatatatctttcggtttggtttcatctttacaaattttctgtagcgacgaacatttttcctgtgcggaaaatgggaaaggaatttacgggcaaaaaaaaaaaaaaaaatagatcgagtttcttgccaataaattctgtcagctcc

SEQ ID NO: 3104 - DNA, 2303 bp, Zea mays
  misc_feature (2057)..(2057): n is a, c, g, or t
gtatcgggtgtcgagttgcagaatacagtttaaaatatcagtctcgatctcgtttgggttcattctgtttgcatcttatctgaaccatatattatccgagacaaagagattaacatttgattttatagcagataatactaggtctgaaagtatactccagatcgcttgcgttaccaagaaaccatgcgcaagattaataattgggattattctttagtatgctattctaggtagagaaatcaaatagggttggaaaatagataaattttttatctgggatcaactaaattaatgatgtctcaagtattgtatcctgatagtgttttggtctggtccatttatttctcgcccaaactctaatcctataatcaggatcccagaaaaatctcctcactgtcgtactctctcagcctcatctgattcccaggcaatcggccttatccactgtctttgttttttctacgcacatcaccgcaactatctcttttttatcttctctgtaggctgaaatccttatcctcctggttggcctcatcttcaagctgccactctcagctgatccctatcctctaccgctctctctctcccttccgatattttgcaccgtcgtgctcaggtttctggtgttttctccattgcgttcatctccctctgtgctcctccctgtcgcgccctccctggtggacacgtgcagctccctctgccttccatgagttttttgaaccaagatatcactgagactggactttaaaaaatagtatcctgaacaccgtaattgaagttttagtattataaaccgtttagctttggttttttctatccggggggactgtgatttagccgatgttcagctactagtaccgggtgctacggcgacgcccgccactgccccgttcttagaacggatatgtgctggagctcctctcgtgacgctcttctctcccggcgctggagctcccctatcaagtcttgtccgacggcgctccggggcgctcctctccctggtcccggcggtgctcctcttcctgatgttgatgattactcggcccagccagcagtgcttccccgccagcagtgcttccccgccagtgcttcctcgctcctggctgtgcttccccgcgaccggttatcgttccctgagacgctcggtctcgctcccgacctcaacaatggagaccccgccaggagcgatgacgtcggcaccggctgttgtcatccccgatgacaaccatggttcattcttagttgaacagttaccttgttgttgtgctaaaccctatacattattcattactacacattgtgttagatgcgtataggtccgtcactattgaagatgttgaccactcattgattgaggcaccaacaacgcttgaggagatcggtgctctgcctcctatggatgttgtaaagcttcgttaatggtcaatggccaatgagagtgttatgtacccaatgagagtgttatgtaccttaaacttgtatttctaagtactataagtgaactttcagtgaacttgttgttttcagtgagaaaaaaaaaaaaaaaaaccgggcattagaatcaatgaactttcattgaactgtgaactaggctattgttgtttccatatgttcacgatgtgcttcttgcaatggttccatattttctttaacaactgtttgatgaattgttcaggaacttctctccctcgcttggctacctgtacaagttaaaaattctgaaaattgcagccctctgtgaactacaggcgaggtgctataccagaaaagaaaatgtttgtgtttttaaccacaccgtttctccctaggtgcaaatatggtacaaactggcatataaggagcaaatttaatacgttagagcgtatagcaaactgggatccccaagattagtccttttgagcctctcagccatcttctagtgcctcattatgcaacacaacttcaacagaacagagcccaagattgagtcccaatagccatctgggggaggctgttaagcaacttgagtttcagttaccttgtgggggcactagagaggatagagcgctcgagangatacaggcagggaaggagaaagggccgaggactagggagaggagcgccgagaagcgccgtcggacaagacttgacagaggagctccagcgccgggagagaagagcgtcgggagaggagctccagcgccgatcggttctaagaaacggggcagtgagatggattgccgtaacaacgcgtactagtagcaggacattggttaaatcacactctgatagcaaaaaaacaatgttgaacggattataat

SEQ ID NO: 3105 - DNA, 1835 bp, Zea mays
ctcgagccgctctcccccacccgtcgtctccttgtcatccttgcctgcggattggggcggcacggcagtcggcacagcctctcgcttctcccgcgcgcgagccctttctccacggccgcggcatgacgttgccggaggtgaatgccggtgcgacggcgcagaggaagaagaactcaccagagatggagttcttcagcgagtacggcgatgccaacaggtacaagatccaggagatcattggcaaagggagctacggggtcgtctgttcggctattgaccaacatacgggcgagaaggtagccatcaagaagatacagaacatcttcgagcacctgtccgacgctgccaggatcctccgcgagatcaagcttctccggctgctgaggcaccccgatatcgtcgagatcaaacacgttatgctgcctccgtcgaggagggactacagagatatttacgttgtgtttgagctgatggataccgatcttcaccaagttattaaggctaacgatgacttgacgaaggaacaccaccagttctttctctatcagatgctgcgtgcattgaaatatattcatactgctaacgtttatcatcgtgatttaaagccaaaaaatatattagcaaatgctaactgcaaactcaagatatgtgattttgggctagcaagggttgcatttaatgactctcataccacagttttctggacggactatgttgctactagatggtacagggctcctgagctgtgtggatctttctttagtaagtattcaccggctatcgatatgtggagcatcggttgcatttttgcggagattttgactgggaagcctttattccctggtaaaaatgtggttcaccagctggatttgatgactgatctcctgggtacaccatcagcagatactatttcacagattcggaatgagaaagcaaggaggtatctaagcagcatgaggaggaaacagccaatacccttctcagagaagttccccaatgcagatcattcggcgctcaagctcttacaaaggcttcttgcatttgatcctaaggatcgaccaacggccgaagaggcattggctgatccctactttaaaggcattgcaaaagtggagagggaaccatcctgtcagccaatttcgaaaatggaatttgagtttgaacagaagtttaccaaagaggatgtcaaggaacttatattccaggagatactgcagtaccatcctcaacttctgaaggattacaagaacggctctgaaaagacgagttttctatatcccagcgccgttgacaggttccgtaggcaatttgctagcttagaagaaaatggagagaggaatgccgcgcttgacaggaaacatgtttctctcccaaggacaacaaccgttcactccactccaattcctgcaaaggaaggtccagcagcaacctcccaggttgctcaaaggattccagcagctagaccaggaagagtggtaggcccagtattgccattcgagagcgcaagcgtcaccgatcaacacatcgctcgacgggtggcaaggaacccagctgttcctccagcaacgaacacctcgtcagtctactgctaccacctcaagtcggacagctccgacaggcaggagcatcatctagagcgtgagaaagatcgaaggcagtataggccagggcagcatttcatggatgccaaggtagcccctgagatgggccgggatatacgcccgtcacagtactatgtctcaaggggcttgcccaaagctgatctaacagacagggccaccctccataggagcgctcttcatggcgttgctcccttcaatggcatcgcagcggcc

SEQ ID NO: 3106 - DNA, 4419 bp, Zea mays
gccccccccgggcccgccgggcacacgcgagaaaccagaagcgctcgcgagaagtaagggagagagaggggggacgacgacagccttgggacccgcggactgcatcgctcgccggtagctgacgtcactcggccccgtggaattttcaagctttggtggtggctcgtctgtctgatccgcgctctgctgctttttcttcgcccgccgcactgtatcacaactataacagtacctacgtgttcacaggtctaggcatttgtcctaccagtacagtacattggactagtaataactagtatgtatccagcaaaccgccacatggatccatactactcgcactatagaaaccatgttccttacccatactatcctcctgccagatgggaaatcccatccggtcatccacaggcaatggactcatcttattattatcggccaccaaactgtggaacttggccatatcatgatatctcacatccttctgagttccattgttgctgcaaccgggcatatcttcctgattactacagtttcagacccccattccctcaagagcttccaccccctcatttatactatcacgtgccatctccacatcatccaaatgcatgtccttcttactttgtcccatcacatccttacccttttgatcagacaccatatggttatgaaaagttcaagagccactgctgtggatgtccaactcatgtgtgccctggggctgagaagaacaatgtgaaaatcgaggaacaaaggcctgatgtcaagcttgagagcggtgagcacaagaatgctgatagtgacagtataattcaacacccaaacaagaagtatccattcatatggctgccatcaggcaatatgaaaggcaaggagaatggagagcattatgaattgtcacctcaggttttaaatgaatgggctcctgtgagtgggaagtggttaggggatgtgaagcaacaagggcaggataatgagaaggggaaacaattccagtggccaatagtttggatgccagcaggatatgatgcaccaaaccaaaaggctaaagatatgaatgacacagaagagaccccaaaatccccaaagatttctgaagtgtctcctcaatcacccaagatcattcctctgtcttggtttgggaatggtcatcatcatgatcagaaatcggctgccagaaatggttctggagaccacaacaacggatcagcagtgaagaaccaacctgtggttactgaccatcaagacagcatgatactggaaggaaaccctaaaatcactccagctgtgcccaagagcatacacgttgggaagaaacctccaagggaaaactgcaagaccattccagttgtgccagagaaagagattaatgaaaagaaggccagtacttacagaaccattccggtcataaaagaaagtgatgagaagaagattggcatgagggaaaagagggagtcaaaggaggccaacagtgctgaaatggttgaagagaacaggaaaacaaaacacaatgactcatcagtagttaagcattcaaaattgcccccagtatgcttacgtgtggatcccttgccaagaaagaaacctggaaatggttcttctaggtctcctagtccaccaaggaaggatactgacaacacgaagaaggacgtggatgaggcccagagccagatcctggagcctaaacagtctagtacaagtaaggatatcactgtgtctgaagtgaaagaaaaatcgccttatgaaatgaagaaggaagttgggtttagaaatgaaacagtggaagctgcttctgttgaacatctgcaggaggaagaagctcccacaagtaaagatggccaaaaggtccaagctgctagcactacagttggtgatcaagaaaatgcagccctgaatagcatagaggaagatcatgtgcaagaaaatgctggtgcaggaagcttgaatggatgtgacaaaagaaaaaatgaagatgggacagtgattgaaagtgaaactgcgaaagatgatgccagaacatatggagttaatttgtcagaatcagatgctgcagttcgtattcagtctgcctacagagggtatgatgttcgaaaatggcaacctttggataaactctggaagatcaagcatgtgcatgaacagatgcaagttgtgaggaagcagattcaatgccttttagattcttgcagtaagccaacacaaaaagagcaagtggccataggtgaaactattatgaatttactcctgaagcttgacgcaatccagggcttgcatccaagtgtaagggaagctaggaagtctgttgctcgagaactgatttgcttgcaggagaagcttgatactttatgcaaagcagcatctggagacttgaatcacacagatagtaatgatgatgaatctgaggggaccaagaacattatccaaactgaagctcctactgtaataactgaagcttctgatagaaagagaactattgaactgggtaaggtacaagaaccatgttcagtggactccatggagccatgcaacacagttccatctggagtttcctgggaggtgaggccagatgtagacgctagcgaggagaagaatgaaaaacaagagtcatgtagcaccacagtggacgaagcgcacgaacaagtagcatcatcgatggatatgataagtgatgaagcttttacagctgacaaccaggagcatggaattggagaatcaaatgttacttcagtggaacaagtgactgaagaagagaaaccagcatctgaggatgaagtaaaagagccaccattggtgaactccacggcactattgtatgatactacttcatcaggggattccagtggactgaaacaatacacagcttcgaccgatcagaatctctatgctgaatcaaatacagggtcgtctcctgcatccactgaggacattgacataagtactctggctgtggaaagtgaagtggcggctgagaatgatggcccaattaacagtcaggtgcatgaaactgtagctctagaaaatgtggaaatgaaagatgatgtttcttctgctgaaaatgagcataacagatcgagcagccctgttattcatttagaggacccactagtgtctttgaaggatgttgagcagcatggtccaactcctactaaggactttgttgtacctaacacagaagaccaacaagaagccagagatatcagcttgcaggtacaagctgtggattccatgaaagattgtggcgaagtaccagatggaacaatagaggcttcgacgaatgatgatgaattagaactgggtacttctgcagatgtagaaaagaatgatcaacctaccttgctggaaccaagatcggagtctgtctctgtcccagaactgtccgtcttggatgaatctgacgataaaatgcaatgtggtgtttctggcaaggatgaggaagcacatgtggaggagaaaactgtaactattgctgttgacaaggtaacaggaggttctgcaaatttcgaggatcctctttgtgaggcatcgaggaaggaacctgacattgagaagagtcacccaagcctcggagaagaggaagacgatacaataggtggaacagtcttccctggttcaggtagctgtgaattatcatgtccacaggatggtggcatcgcagtctacgaggggcctgagatggtgtcaccagagagccaaactgatgctcggaaagaaaacatccattcagatgtcgctgagacagatgaatgcaccaagactcagaaggccgctctagcaggcacagagggagaaaattctgctgaagattctggtgtgccggtgtctgagatggacaaatgcaacgagatgccgaaggatgctccgacacttacagcagcaggtgcaaatcctgctgaagacgaagcttccctgaaagacctctctgtgcagacagagaacaaggcttcttctgcctccccagctcctgatgatccgaaggccagcgacgagaagacgctggcagaagagaaccagaagctgaaagagcttctgcaaaagcttctggcgtccggcaacgatcagatgggggtcatcacggacctaagtgagaaggtcaaggtgctggagcggaggctggcacgcaagaagagaccaaaggtgagggtgcacaagccatccaggcatgcttcctgtgtccactgaaaggataagtctgtaaggttttgaggttttatgttgtatggatccccatgttgcttcctgtgtccagctattgtgcactgtgtaggtatagccatgctgtggcactgtgcttcgtcttggacaacacaaggtgtggcatgttctgtattttatgtctgtataatgcatccaactacatctagtgttctgtgagcaattgattgggacaaatcgatatgacaaaaaaaaaaaaaatgtgct

SEQ ID NO: 3107 - DNA, 4886 bp, Zea mays
  misc_feature (2890)..(2890): n is a, c, g, or t
  misc_feature (3310)..(3310): n is a, c, g, or t
  misc_feature (4074)..(4074): n is a, c, g, or t
  misc_feature (4223)..(4223): n is a, c, g, or t
  misc_feature (4692)..(4692): n is a, c, g, or t
ggatcctctacccccgacctgcagttcgtattcagtctgcctacagagggtatgatgttcgaaaatggcaacctttggataagctctggaagatcaagcatgtgcatgaacagatgcaagttgtgaggaagcagattcaatgccttttagattcttgcagtaagccaacacaaaaagagcaagtggccataggtgaaactattatgaatttactcctgaagcttgacgcaatccaggtatatttttcattccagcctgtttttctctgagtggcataggcttatttcttctttggtaaacttttttggtacttgttgggttgtttctaagaccttgataatattgacacagggtttgcatccaagtgtaagggaagctaggaagtctgttgctcgagaactgatttgcttgcaggagaagcttgatactttatgcaaagcagcatctggagacttgaatcagacagatagtaatgatgatgaatctgaggggaccaagaacattatccaaactgcagctcctactgtaataactgaagcttctgatagagtacgtgttgcttgtattaacgatgttctctaaccttattttgcaattgttcaattaaatataatttatgcatgataacgccacaaattaatctcagcagaagagaactgttgaactgggtaaggtacaagaaccatgttcagtggactccatggagccatgcaacgcagttccatctggagtttcctgggaggtgaggccactcgtgcacgctagcgaggagaagaatgaaaaacaagagtcatgtagcaccacagtggacgaagcgcacgaacaagtaagtcgattttgatttccattgtttggcactctgctgttgcaaccatggtaatattttggattgttttgttaagcatgagagtatgtgcttacattttaccattgaaagtaatttgcataggcgttcagggggcttcaatgcttgctagagaagatgcaccgctgtggggattggctggtgccaagcggattcagctgcttgttgtatgatctagggccagcttgtggtagggtcgctttagtgtataactagtgctaacctaactatttcgttctagtgtaatggcatgcagactgtgtcgaataaaagaaacgtgcattagttatgaagttttatataggcatatccactatgtttgaagaagtaatgctaccttcaaagtagtactaacccagaagaaaaatgaaagtaatcatcattgctttagttttttgcatctgatttattcacgagattaactttaaattactagtaggacttaactatttatgttcaataggggaaaactgagggacagattgaaattcaggtagcatcatcgatggatatgataagtgatgaagcttttacagctgacaaccaggagcatggaattggagaatcaaatgttacttcagtggaacaagtgactgaagaagtaagtctttcccattcactcatagtttaagttgcaaaaggtgatactgatagcatttctgttgtcaacaggagaaaccagcatctgaggatgaagtaaaagagccaccattggtgaactccacggcactattgtatgatactacttcatcaggggattccagtggactgaaacaatacacagcttcgaccgatcagaatctctatgctgaatcaaatacagggtcgtctcctgcatccactgaggacattgacataagtactctggctgtggaaagtgaagtggcggctgagaatgtaagttatcatttattttgatgacaagctatagagtgatcatatttttttgaacaataattaatgctgcatgtatgaaaacaggatggcccaattaacagtcaggtgcatgaaactgtagctctagaaaatgtggaaatgaaagatgatgtttcttctgctgaaaatgagcataacagatcgagcagccctgttattcatttagaggacccactagtgtctttgaaggatgttgagcagcatggtccaactcctactaaggactttgttgtacctaacacagaagaccaacaagaagccagagatatcagcttgcaggtacaagctgtggattccatgaaagattgtggcgaagtaccagatggaacaatagaggcttcgacgaatgatgatgaattagaactgggtacttctgcaggtcgactctagagggatcaacctaccttgctggaaccaagatcggagtctgtctctgtcccagaactgtccgtcttggatgaatctgacgataaaatgcaatgtggtgtttctggcaaggatgaggaagcacatgtggaggagaaaactgtaactattgctgttgacaaggtaacaggaggttctgcaaatttcgaggatcctctttgtgaggcatcgaggaaggaacctgacattgagaagagtcacccaagcctcggagaagaggaagacgatacaataggtggaacagtcttccctggttcaggtagctgtgaattatcatgtccacaggatggtggcatcgcagtctacgaggggcctgagatggtgtcaccagagagccaaactgatgctcggaaagaaaacatccattcagatgtcgctgagacagatgaatgcaccaagactcagaaggccgctctagcaggcacagagggagaaaattctgctgaagattctggtgtgccggtgtctgagatggacaaatgcaacgagatgccgaaggatgctccgacacttacagcagcaggtgcaaatcctgctgaagacgaagcttccctgaaagacctctctgtgcagacagagaacaaggcttcttctgcctccccagctcctgatgatccgaaggccagcgacgagaagacgctggcagaagagaaccagaagctnaaagagcttctgcaaaagcttctggcgtccggcaacgatcagatgggggtcatcacggacctaagtgagaaggtcaaggtgctggagcggaggctggcacgcaagaagagaccaaaggtgagggtgcacaagccatccaggcatgcttcctgtgtccactgaaaggataagtctgtaaggttttgaggttttatgttgtatggatccccatgttgcttcctgtgtccagctattgtgcactgtgtaggtatagccatgctgtggcactgtgcttcgtcttggacaacacaaggtgtggcatgttctgtattttatgtctgtataatgcatccaactacatctagtgttctgtgagcaattgattgggacaaatcgatatgacatatgcgtctgtgttgtgctatatataattcgaaaaanacatacgccagtgaaacctactgatgaataacaacgacaaataaaaatatttttgaactaaaccacgacaaataaaaaagattggagagagtatcaaattactggttcaggcaagcatatctacatcataagatatcctacactcatgaccacatcgtcagcaattcatgtcgtccctgcgtgctctcgctacaaacgtaaaatacccaaactaccgaaccctgtcatccgtggtccccaaaagtctccagtcagcatgggcgctagtaccgctccaatacgtgtttagctatgggaattcatcttatgctgataataatattcccgagaaaagaacactggagggcttctccacgcagacacaaggctaattccagtactcccttcctcataaggctaattccggtctttccccattatatcaatcgttacatcacttaacgccgttatcgatcggtctacatggatcacgatcgctctttacctatcgcagactctatctaatatccaacttttatcatcatcttatcgtcacactaaattttttatcgactttttttgtgacataagacacggcgttttgctgaatttctaatacatataattacataatttataacaataattaaaaattgtataactcaaacataaaaataaaaatacataatttataaataagtcacataacttaaacataaaaataaataatgaataatatagagttttggaatctgaatggttaaaaacagctagctaacatacgngtggaccaatcagaacacgtcacatcattaaagtaggtccttaatgatcgattcatccaatgtcgtgatcaataccgaccaattagtatcgaccagttcgactccaacatggtcagtatctacgggttcaggcgattagtacagccttngagtggccaaaccaacacgtaatggaaccgtagcgatcagtagcacccgtgagttggatccagtatattccgttcgtaccgtccaccacgtcatctagcgaccacactaccaaccatgctattgagcattgttggccgttatcttcagtgcatagtatctaccatcatgctataacaacctcaacgccacatcaacttttttacactcatatttaaaatgaaacatgacattttattttaaaaacattcgttcacgtaattaaggaaagatataattctaataaaataaaataaaatgtaaaatattgaaaataaaaaaatatagtactaatcataatcatcatccttcttggtcttttttctctcatcttgtttaaattgtttgatcattttttacggcgaacatacgagtcctttttatatcatcgtccatatcggtgatggattgatccaacaagttggtgaaatncttaaacaattattattaagttatcatctatcgggccttgtagatcttatttaccatacttttatttatggcagggactcactgatactcattgaacattgagataagattgtttgctccaattattggagttatcgtcatcgtgttgtgcgcaccacttggactgatggcgaaaaacacgccacatgagctcc

SEQ ID NO: 3108 - DNA, 2795 bp, Zea mays
gcaaattctctgtatcctctattcctctccgggactcctctctgctcacgagtaaagcctgccgctcgcccgcgctctggacgtcgcctcctcccccatcggctgtcgccgcccccgccggcgttacctccttacccgccgccgcccccacgcgtccttgccttggcggatctgcctgcctccaccgcctggcgctgccccttatcccgcctgccgcctgccgccgctgcctcacgttagctcctcccccatcgtctccggatctccgcgccgcccccacgcctccctgacttggtggatctgtccaccattcaccggaaacagttggtcgccgcctaggtacccacctaccccctaggcgaggcggtaccccgtcgcccagcgcataagtgcccaggcgagcgcggaatagctccttttcgaatacactcgggcgaagcttagatctgatctcaacgaacctgcagcttgctgcagccactcctcgccggcgatggatttcatgaaggttttcgatcagactgtgcgtgagataaagagggaggtcaatctgaaggtactcaaggtccccgagatcgagcagaaggtacttgatgcaacaagtgatgaaccgtggggcccccatggaagtgctctttcagaacttgcacacgctaccaagaagttcgctgagtgccagatggtaatgaatgtcctatggactaggttgtctgagagaggcgcgaattggcgtcatgtgtataaggcattaactattatcgagtactttatagccaatggttctgagagggcagttgatgacattcttgatcattattctaagatctcggttctttcaagttttgagtatgttgagcctaatggtaaagacgctggaataaatgtgaggaaaaaagtagaaaccattgtgggcatcataaatgacaaggagaaaataaaggccgtgagagataaagcagccagtaatcgtgataagtacattggactatcatccacaggcataacatataaatcaagctcagcctcatttggtagcaactacagttcaggcgaacgttatgggagtttcagtggtacaaaggaagctgactcatacggtgatagttacagggacaaagaatctgttaaaacttccacaagcaatagcggcagtcggaaatttggcagcaagctgaggaaggatgcgaagcctgataggaggaatgaggattatagttcacccagctctttgagacccccatctaatacaaataacactgaggacgactttgatgacttcgatcctcgtggatcaaatggcaaaacaactgctaagtcaaatgaggtggatctgtttggcccaaacttgatggacgatttaattgatgcatctgcagcaactccagctacagacaatgctgcagaaccacaggttgatctgtttgctgatgcagattttcaatcggcaaccgcaagtacagagacagctgcaaatacagatgtcaaggtcaatgttgacctttttgcggaaaaggcatcttttcctgcagcatttccaccacaggctgggtttattccaccaccaagtgccgggacatcttctgaagtaaatacttccgtatccaagaaggcagctccggaaccttttgatccttttggcgctattcctttgaacagttttgatggacctgacccatttggtggcttcagctcaaatgctggatcatctaccgcagcagcacccacccacggttctactggaaatatcagcacatcgaaccagaaccttcatgctgcatccgactttgctgcctttgtatcaaacaacgagggagcagcgaaagacccattcgatctttcttcgagtgccaatgtcggaaaaacacctttggcagctcccaagatcgacgcatctgatttcggtgcatttgtatctagcaccgaggaagcagccaaggaccctctcgatctttcttcgggtagcaaccttggaaagacaggccaagcacccgcggcagcctccaagcctagcgcaaagaaagacaattttcaggtcaagtccggcatatgggcagactcgctgagccggggattgattgatctgaacataactgcaccgaagaaggtgaacctagctgatattggcatcgtcggtggccttggcgatgggtccgatgagaaggccctgccctcttggaccatgggcgccggatccggcctaggaatgtctggtattccaccgtcaacacaacaagctggtggcatcgagagcttggccaactacaacaagcatcatttcggcttcaaataggcctcgatctttcatactggaaaatacccgtcatctgcggtttcctcctctgtcggcctgcttcttacacgtgctgccctattgatttaatcacttttttgtttttggttttggtgatcacattacatggtgtcgaccaatcttggccccgtcttgtcacacgtgtatgttatttgtcgggtttgtgggtaagcatgcaactacatacacatcacaccccctgtgttccagctcgatgataggtggtatgttggccatgcagtttgtgtaaattccgtggcctgccttttctacttgatacagtactctacgcagcgatttgcagtgcttgagtttatattcaataataagagaacctatgccctttatgtcttgaaaaaaaaaaaaaaaaaaaaacccctaaaaaaaaaaaaaaaaaaaaaaaaaaaaaaaaaaaaaaaaaaaaaaaaaaaaaaaaaaaaaaatatagggacacacaaaatgcaagtcactggcacgagctcca

SEQ ID NO: 3109 - DNA, 1090 bp, Zea mays
  misc_feature (1065)..(1065): n is a, c, g, or t
cccgcccggcgcctcgccatctacctctccaccaccgtccacacacccacgcacaccccgagacccttgcattggggccgatcgaactcgccggtgattccttcgtctactcgactcgttggtattcggcctcggcagaaagtttgcgcaaacatgcagcccaccaccatcacggagatttggcagtggcagtgtggcacgtgcagagctgactggaagatgatgcgccagctgaccacctgctgcccgcacgtcggccgctgctgtcagggtcagggtgctccgcctccgcagtctgaacggaaccctcctcactgccactgccatcaccatcaccaccacggccatcgccatcaccaggagcagggtaccaccgccgccgccatcaccaccaccggccgggctttggcggcgggtgccgagggttccaacgccgggtctgctgggcgtcacaccaccatcgctacactgaatcctgttgcccctcccgccgtcacagaggtctgctgggtcccggacccctacctgatggtgcagcagctcagggagttcgagaccctgaacgacgggctggtggcgctcagggtgcagctgcaggagtacgcgggggaaatcagcaagagcaaggacaccaacgccgggatggactggctcctcgctctcccggccagcgtcagggacgtcgtcatcatggccagggacgtcatcgagtctttctttgtcatctccactggcgctgcaccgccataagctagcagctcagcaactgtagtcatatggatattattatatcattatacagtgtgaaagagtcagttcgtctattttctcctgtcatgtactcatgtgtgagaagtttatattactgtgcagttttcgtgcttgttttctggtattatatttgcgggttatatattatgtaagtctggtatataaaattataatcaatacattatgaggaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaggggaanaaaaaaaaaaaaaaaaaaaaaaaaa

SEQ ID NO: 3110 - DNA, 1051 bp, Zea mays
cattgggtacctcgaggccggccgggatcggcctcgcctacgggggagaagacagcaacacaagcttagtcgtcctcgtccccccaatcttcagcccttgttcatcaacaaaccacatggccgcgctcggtcctgcttctgttacctccacgggcttggcgctgcacacccctgcgattcctcatcgtcggcgtcgccacgggaatgcagtggcctgtgcgtcgtcgtctcaacaccagcgaagccttaatggcttggcgatgagttcttcaggcacgaacaatgccttgcccatcaaaggaattaccactacacgggttcctgcagtcggtcgttcggtccctgcagcgaatccgtcgccgtcaggagggaacaacctcccggtgcccaagattcctccgtgggtcaagtgggtggctggcgccgtcatatttgcagtgcccatgtacaggaggttcagagctttagaagacaagatagagaagacggcggaggtggcgatcgaggtgatcgacaaggtggcggaggcgacggagaaggtcgccggcgaggtcgccgacgagttccccggcaacgagagcatcaaggaagcagcctccaggatcaagaaggtcatgcacgtggtcgaggaagacgccgacaaggctgaggccctgatcgagaaggtcgacgagataaagaaagatgtggattcgattgtcgatcctataatcggcaaggttgccaaggataaatcgcggagaatgaaccaaaaaggatgacagcagtcggtgaattgaaaggagcgcaaacattgctcggacggaaagggaagcaacaggacgcgtctcgtttcgtctcatgtttatctcgtgccatggcttcctacgtacaaacaggagatgaggcatatgatggtgtaaaacactcttttatattgtagattgtactaagagagaagttcgaaataagagatgagataagatgagagatgtcatgaataagttgttgcactaccggaataaacgaactaaatctaccagctatagaaaacactgttataattgtcccc

SEQ ID NO: 3111 - DNA, 1010 bp, Zea mays
ggaccctcgaggccggccgggccgggacggcttccgccgccgccattagaagacagaacacaagcttagtcgtcctcgtccccccccccccaatcttcagcccttgttcatcaacaaaccacatggccgcgctcggtcctgcttctgttacctccacgggcttggcgctgcacacccctgcgattcttcatcgtcggcgtcgccacgggaatgcagtggcctgtgcgtcgtcgtcgtcgtcgtcgtctcaacaccagcgaagccttaatggcttggcgatgagttcttcaggcacgaacaatgccttgcccatcaaaggaactaccactacacgggttcctgcagtcggtcgttcggtccctgcagcgaatccgtcgccgtcaggagggaacaacctcccagtgcccaagattcctccgtgggtcaagtgggtggctggcgccgtcatatttgcagtgcccatgtacaggaggttcagagctttagaagacaagatagagaagacggcggaggtggcgatcgaggtgatcgacaaggtggcggaggcgacggagaaggtcgccggcgaggtcgccgacgagttccccggcaacgagagcatcaaggaagcagcctccaggatcaagaaggtcatgcacgtggtcgaggaagacgccgacaaggctgaggccctgatcgagaaggtcgacgagataaagaaagatgtggattcgattgtcgatcctataatcggcaaggttgccaaggataaatcgcggagaatgaccaaaaaggatgacagcagtcggtgaattgaaaggagcgcaaacattgctcggacggaaagggaagcaacaggacgcgtctcgtttcgtctcatgtttatctcgtgccatggcctcctacgtacaaactacgagatgaggcataagactattcatatgttcgtgtaaaacactattttaattgtagattgtactgagagagaagttcaaaataagagatgagatgatatgagagatgccatgaat

SEQ ID NO: 3112 - DNA, 1110 bp, Zea mays
cattgggacctcgagccggcgcattgggtacctcgaggccggccggaaccgcaaggatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaacccgaaaaaaaaaaaaaaaaaagc

SEQ ID NO: 3113 - DNA, 4023 bp, Zea mays
  misc_feature (3808)..(3808): n is a, c, g, or t
gattcacttttttctctagatagtattgcctgtagtcttggaaaaattcagagaacctaagtcaagggacattggagcaactttgcaaaattattttctaagctttttaatgattttgtgggaaattgagggtggggatatgcgtgcacaacaagagcatctcctttcaggtctttgaacaattcttgaagaccttcgccttttctcgaagccgtatgcttcttctaacttctgtttcaaatataattggctctttttgcttggaggcagcttctaatgcagaaggcgattgttgctccacatgcagctcttgactagggggtggcaggcactttggagggattagaagagaaacagtttccatgctgagctccacaagagcagatattgcatctaacgttaagaattttttggaccattcaaaggaatccgacctcaaaagcaagcctatgaaaaattcagcccacacttttggaacagtgactaggtctgagttgcctgggagagtaccagcccaggagttgaaacgctttctagccaggaagttctcatatgctgggtcagggttggagtgttccaggtgttgcataaggcccacattgatattctctttgatttacatgtttacatcctcctgatcttgatttccctccatttgcatgccatccggagggaaggctggaatggctagcaccgcttcaactggtcagggaattatacatgattgagttattatttaggtttacactaaattatatcatatattcaggatatagattagataattagaatttattaaattagtttttttacattaatttacagttttgattaagttaaataagaagaacaaatgaaaaagtcttttaggtatgagtttaaaaataaagaaagttatgtatgatttataagtttgttacgggtagagtccaagagactagagcaaatgaactcggctatatattaatatatattattaagttggacccactgtaaaacgagagcgacagcatcgacattcgacagactggactcggccactcgggtggcttctggagtgttcggctgccgcaggatcttcgtgaaccttctgaattcttccccaagccgtgccccgccgcgccgctgtataaagctcgggccacttcctccggtcgtctcaccgcaaggatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcaggtagtcgtcatcttcgcttcatgccagacccatttgctttgctctctcaactctcaaatgagatggtggtgagactacatcgcttcgaaatggctgtgctgagtgctgacttcgtcttgttggtccctgtccagatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcatttttctcgtctatcttctatcagtatgaaataagcaacgtcgcttcagttttcgtgccaaggccggtggagtcgcctatgttttattttattttctttgtatttcccccctggacacacgttctctatgccgtgtttggtttccgcagatttttaaaatatgcatgttcaaacccaactctcacttattcttcagattttgtttctgctagcgctccaaggcatagaataaactcactttggatccgatccataatatatttagggactcaaaaaggacgtgtaaactaaccctaaaacatatattaataacgaatacatcccaaaacacatattagtaacgaatagtggttaaacatattaataacgaatacatcccaaaacacatatttagtaacgaatagtggtttttttactttcccgttcttcccaaaaatttgcgtctggcatctttctcaatccattcgttcttcccaaaattttgcctcttgcatctttcccaatccattccttcacgtattggttttagagaaaccgttgagtacataattcattcttaaaaccttttaacctactcttaataatattttttggtaaaatttttaacctacttttagagttgctattaaaatcagctcctcaaaatctaccctaaaccaaacacgccctatgcaaaactgaggaaggcgcagccgtcggacacgttcggatgttcccattattcgacttcctctgcaaaagatccatgacgtattatccagacaacagagatgcgttaatcgccctcttcatgtgaccttgatcctaaatcgatcgctgggaaaaattaactatttgccacaatttagaggtgagtggcaaagaactgagtgaaccaactgaacctattttttagaacccaagcttggtgagcattaacaatatatcactgtgttcaactgtgtcaaaatctttttttatcttcaaaaatctagcttaagactcatcactccctcttggaatgtttacactgatgcaagtattcatagcccaagcaagacaatcttggatagtacgatttttaatgaaaccatactgttttttatgaactgtcagctatgagttctgtgattaacttgatagctatgctaagatgagaaattgacctgaagtcagaaaccttaaccgggttattcaccttaggaattaatgcaatgaatgaaatatatttataaagtttggattgaaatatatttataaagtttttaaaactaaataagttagaagttttttttgagatatccgaccttgtgtttgagggtcgtcgtaaaccgcttcttggtgcgcttcgtggtggacggcggagatgcaaccttggcgtgcgtgccagtacgctttccgaactccaccgaacgatcctgtttggtccatcgtcaccttcctcttccttcttcggttcttcgccagccgtgcgcgcttctccactgccctggagacaaaggagcaccccgcgatctcccggcgggacccggccccacctccccgcccgcgtgcctctgaaacggagaagctgccggttcccagccggccaggctactccgactcttcctttccctccagccggcgaggcgtccaagcggattagcggagagcgtcggggcggcganatgtgggtgttctacctgatatcgctgcctctgacgctgggcatggtcgtcgtcacgctccgctacttcgccggccctgccgtgccgcgctacgttgtcgccaccgtaggatacgcatggttctgctccctctccatcatcatcctcgtccccgccgacatctggcaggtcagatcccttgccgcgtccctctcccaccttttcatccaccgtcc

SEQ ID NO: 3114 - DNA, 1758 bp, Zea mays
cggtgcgcagtgctggcgatccaatccaacgagccctgttcctccgccgcggttcggtaagcggtaagccacgtccgcgttctatgaaccaccagaagaacaggcggaccctcgaagctgatcgcggttcgcttctgttctcttccgcgaaaggcgaacccgtccgtctcgcgtgctgaccccatcccgttcgcgttctcggacttctagaaccgccaccgccgctacccgcctcattcttctggcttggcttggcctggcctcggaacggctcaccagccccactgccccagcacggcgcgccacaccctcggaacggctcacctcaccggtgcgccccaaacgagacagcacctccgcgggctgggcggctcagcccaccgctccccaactaccctcgctgtttcccactgagtcgtggtcccggtttcgtgacgcggcccaccggccagcgtcacggaagctccccgtgccgtatccgtcgcgcctcacgccttggttcggctcatcccacaccgtgagcgtgacacggccggaccggcctccttctctgttggcgccaccactcccctgacaaccgaaaaagaaattagaaaaccgcagccaatccagccgagtctgcaaaaaatcttggaagccgcgggagcgagagccatggaggacatcggcgagggacccgccgagaaccttccggagcccctgtctccagccgtggaggccgaggacgaggacggcgacgagttcagcttccccgttcctccggtcgccgccggcgcgtgcatcgtgcccgtgtacccgatcttcggccggcccccgtccccgctgcgggaggaggaggaggaggagccggagacggccaccttgcgggtgccgctgggccggctcctgctggaggagcgggagttccgcgcgcgggagccggacgggcgatcgtcgagtgcgcaggcgtggcaggacgaggacgaggacgacgcctccggcggcggcggcggcgccggggacgaggacctgcagggcgtgccggcggagagctactgcctgtgggcgcccggcgggcagtcgccggcgcccgcgtccccgcgccggtgccggaagagcggctccacgggctccgtcctccgctggcgccgcatcagcgaccgcctcgtcggccgcagccacagcgacggcaaggagaagttcgtgttcctcaccgccgttccggatccgcctcgtcctagtaggagtaacaaggaagtggatgaaggaggcggcgacggcgaggcaggcagcgtggcgcatcagatgagatattacggtagaggcggcggcggcggcggcggcagccggaggcgttcgtacctaccgtacaagcaagagctcgtcgggctgttcgccaacgtcagtgggctgcgccggagctaccacccgttctaaaacgcgatctgtccatgccttccgacctccgtcagtgggccaaaaagtaaaaaaagatgatatcttgctcgtttttctgtggataatactgcctatagtactgtgcactgtttttttacagtacggcggaagcagtagatctgcgtattttctctctaagttatcggcttggataaaatagggttttagttttaattaaaaaaatagcagaacctcagcaaggggaaaagaggtaacgtagcgtgtgtactgctgctagtctgctactcatttgttcacaacttcacatacttgacttcacttgagaaaaataacctgaggtttccttaatatacatacgcc

SEQ ID NO: 3115 - DNA, 1218 bp, Zea mays
  misc_feature (833)..(833): n is a, c, g, or t
gcacgagaccattacctagaacatcctaatcgaaaagaaaaagaaaattagaaaaccgcagccaatccagccgaggctgcaaaaaatcttggaagccgcgggagcgagagccatggaggacatcggcgagggccccgccgagaaccttccggagcccctgtctccagccgtggaggccgaggacgaggacggcgacgagttcagcttccccgttcctccggtcgccgccgacgcgtgcatcgtgcccgtgtacccgatcttcggccggcccccgtccccgcctcggggggaggaggaggagccggagacggccaccgtgcgggtgccgctgggccggctcctgctggaggagcgggagttccgcgcgcgggagccggacgggcgatcggcgagtgcgcaggcgtggcaggacgaggacgaggacgacgcctcgggcggcgccggggacgaggatctgcagggtgtgccggcggagagctactgcctgtgggcgcccggcgggcagtcgccggcgcccgcgtccccgcgccggtgccggaagagcggctccacgggctccgtcctccgctggcgccgcatcagcgaccgcctcgtcggccgcagccacagcgacggcaaggagaagttcgtgttcctcaccgccgttccggatccgcttcgtcctagtaggagtaacaaggaagtggatgaaggaggcggcgacggcgaggcaggcagcgtggcgcatcagctgagatattacggtagaggccgcggcggcggcggcggcagccggaggcgttcgtacctgccgtacaagcaagagctcgtcgggctgttcgccaacgtcagtngggctgcgccggagctaccacccgttctaaaacgcgatctgtccatgccttccgacctccgtcagtgggccaaaaagtaaaaaaaaaagatgatatcttgctcgtttttctgtggataatactgcctatagtactgtgcactgtttttttacagtacggcggaagcagtagatctgcgtattttctctctaagttatcggcttggataaaatagggttttagtttttaattaaaaaaatagcagaacctcagcaaggggaaaagaggtaacgtagcgtgtgtactgctgctactcatttgttcacatacttgacttcacttgagaaaaataacctgaggtttccttaatatacatacgccatgcagtgcaaaaaaaaaaaaaaaa

SEQ ID NO: 3116 - DNA, 1708 bp, Zea mays
cttgatttgctacgaaatagaattcatctcaaggtggagtttattggaatatgattctaagcataaggtgagtctttaaggggcacgtggtttgggttatgttaattagcacatttattttcacattggactgcagtagtctctcatgtgttatatttggtggttgtgctatttggtaccgggccccccctcgagttttttttttttttttttttctgtaaaaagaagaatattctatttgagtaccatcatcaaaggatgctaaatcatcatcgtcaaagcaaaggatgttatgcatagtaaggacatgtgcagaacaaaattaaagtagaacggcgtagcgttgcttgctgcttgctggctcaattactgagtagtcaagtagaattgattaagaatcgaggtagtagatggctcagtcagtgcgtgtgtgtcgctgccatgtaggcggcggcgagcatgttgccgagcttgacctgcgccggcgtggtcagatgcgtgtagtcgttggcgacgggcaggcccttggcgtccacgtacctgacgttgcggaggctgaccctcctctgcgcctccctgacgatgtccacaaacctgccctgccccgtggccagccccacctggatgaccagcaggtccggcatgcccaggtcccggcggacgtcgcggaccaaggcctccatgcggggcgtgtaggcgtcggcgtcctggcgcctgatggtgtcggcctcgccctggtaccagagcagcgcggccagcctggtggcgggcccgcgggcgacggcggcccttgcgcgcgcgagcatgcggtcgtacagcggcgtgccgcgggaccagctggcgatgggcgtggcgccctgcgcgcaggggaccagccccaccacggcggggcggcggccggagcggcgccaggagcggaggagcgcgtgcgcgaagggcatcccggggcccacgccgagcacgttgtgcaggtcaatgccggcgtgcagcggctcccgggcctcctcccagcgcagggacggggagaggcggaggatgcgcggggaaggcgcgcacgcgggcggcaccacgccgtcccaggtgccgttggtggcgccgccgcggccgcccatgttggactgcccggccaggaggaacacgagcgtcggagtggaggcggtggctgctgcctccgctggcactgtgggtgcggcaaggaggaggaaaggcggcggcaggaggagcaggaggagcatctgcgccattgccgctccgctgctgtcactctcagctcagctcagctgctctagtagaagggtgtggagtggaagtgagatcttaattaaagacagcagatgaagcaaacatgctcatcaaagctgccaacggccaatggaattcgcatgggtcacggtgatactcatactgctggcggctggccccactcaccgccaaaaataaaagaaaccaagcacatggaggatctcatgtccgttaaagcctcaattggcggaaggaccacgtcacgtcagtgtgaacgacggaaacttcaaaatctttgtcggccacgctcaagtttgaaaacgaggctgttctcttccgattaaaagctagtttctgtaattcaaaatctttttcggcttgagcttaactccacatatagctagtccacttcaaccaaacggggcattagctgagtacgttgatgtgtactcactcttgctataac

SEQ ID NO: 3117 - DNA, 1539 bp, Zea mays
acatcacctcgtgcattttttgggccaaacaatctaagtacattttatgatttgctgtggaggaatgaagtaaggagctacaattcatcgtctcaacattcagtgtcaaactctgttttatcacttgaagtatgttgagtttttttttcttcagcctgaaaatcatcagcattcagtatcaaactatttttttttttttttttggaactttgaagttgtgttgaaagcacgttttcctacaattttgccacccgatcaatttagacattcttgtttgaaaacagaacagctactcagcatcatttcaatttagacattctgaaagcttaatgtgcacttttgacactgtttagcatctaaacttgatgtctgttaacaatgatcagctcgcgctcccaacacgccggtggactgggcgacgcggatgacgatcgccaagggcacggcgcgtggcttggcctacctccacgacgacatgagcatcgtgcacggcaacctgacggccagcaacgtgctcctggacgagcagcacagccccaggatctccgacttcgggctgtcgcggctgatgacgacggcggcaaactcaaacgtgctggcggcggcgggcgcgctggggtaccgcgcgccggagctgtcgaagctgaagaaggcgagcggcaagacggacgtgtacagcctaggcgtcatcatcctggagctgctgacgggcaagtcccccgcggacagcaccaacggcatggacctgccgcagtgggtggcgtccatcgtgaaggaggagtggaccagcgaggtgttcgacctggagctggtgcgcgacgccgccgcggggacggccgcggacgagcagctcatggacacgctgaagctcgcgctgcactgcgtcgacccggcgccggcggtcaggcccgaggcgcacgaggtgctgcggcagctcgagcagatcaggcctggtggcagcgagggcggcgctgggccaagcgaagaaggtggtggtggcgccgccgccgcccatgtgccggcggcttctgcttctgcgggagacgacgacgagtagcaagcaagcagcgccagacaggaatttaccagacagaaaaagtttttgattaggatgttctaggtaatggtctcgtgcgaattctttcatttgtttgtttcactggacggatcggattgatcattttcttgcgttcctaggtaatttccagtttgtataggcaaatattatttgctctagaatcatcgctgtagtgccctacgacggatggaagagaggagaatactcctagtattaataatgcattgttattattttttctatttgatttactcctagtatacagcacgagtagctgatctgtttctgctgtagagcaatcagcagtagcctgaattcacggattggcaatttggcaagggaaaaggcaatttgccaactgaatacgcatgcaaacatttcactgcaacaagctgagggaactaaggagacaatttgccagcatgaagaagcagttggactgaaaatgaccatccctgtac

SEQ ID NO: 3118 - DNA, 1580 bp, Zea mays
aggagacttggcttgtactgcatcgcaaaccgcaatcgcacgcggcacttgcccccgcgatcataacctcacaccgcccgccaccagctgcgcagcgctcgacagcctcaccagccgccatcactcgcggcagtacacggccgctgggactgggagagtgggagtgagacgctgctgttgccgagtgcgaggagacactactactcactctcaagactcgagagcagcaggggcgaccgagctctgcgtgcgtggggagaaccggagaaggcagcagaggagggagggagcgcgtggacgggctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagcccgtcgccgtgggcgccaccatccgcctcttcttccacgactgcttcgtcgagggctgcgacgcgtcggtgatcctggtgtccacggggaacaacacggcggagaaggaccacccgagcaacctctccctggccggcgacggcttcgacaccgtcatccaggccaaggcggccgtggacgccgtgccggcgtgcgccaaccaggtgtcgtgcgccgacatcctggcgctggccacccgggacgtcattgagctggctggcgggccgtcgtacgcggtggagctggggaggctggacgggctggtgtccatgtccaccaacgtcgacggcaagctgccgccgccgtccttcaacctggaccagctcacgagcattttcgccctcaacaacctgtcgcaggccgacatgattgctttatctgcggcgcacacggtggggttcgcgcactgcagcacgttctcggaccggatccagccgcagtcggtggacccgacgatgaacgcgacgtacgcggaggacctgcaggcggcgtgcccggcgggggtggaccccaacatcgcgctgcagctggaccccgtgacgccgcaggccttcgacaaccagtacttcgccaacctggtggacggccgggggctgttcgcctccgaccaggtgctcttctccgacgcgcggtcgcagcccaccgtggtggcgtgggcgcagaacgccaccgccttcgagcaggccttcgtcgacgccatcaccaggctcggccgcgtcggcgtcaagaccgacccgtcgctgggggacgtccgccgcgactgcgccttcctcaactgaaaaggatggacatggagagctggtttatatctcacacaagtgttcatacacaatctagagtaaagtttttttgttgttgttattattatcatgtcaggtatgagcacaaggttgaattaatggttaatgcgattgatatactgtaagtggcacttgcattggtaggccaagaccgagatgtattccttttccttgttgattttgttcggtctcggagcaatatttgtttcagtgtttttcttcaaaaaaaaaaaaaaaaaaagcggccgggggggcccggtaccca

SEQ ID NO: 3119 - DNA, 832 bp, Zea mays
attggtacctcgaggcggcgggaggggtgttgcgcgggggtcgcccgggccggctcgggattctcttcatcttcactctcctggtttattcctccgtgccgatctcgtcttctccggcgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtggtgagggaccgcctcttctacggcgtcctcgccggcgcattcgcccacggcgcctacctcatatcggaactgtatgatgtggagagcaaatgatgggcatccctcgaaggatgaggggataagttttcaggtagcaaaatttgattccatcgggattccagattgttggatgagagctgacatggcaattcagactaactagtgtgctatgtacccatatgttttctttggtcttgctattatgtttggcaaaaggatggaatggttgagcaaataaagtaattccagattgagaaatatttccaaaaaaaaaaaaacaaaaagcccttgtttgggggagccgaaggattgggagaggattgaaagggttaatatcatccgaggatttgtctcctcaatcctgttcaatcctctagcttccaaacgagtccttacatgctcgtgttggctaattttgtaattttgattgtatccatgatatagtatactactccctccgtcctaaattaaaatgtcctttagacaacaaaaaaacaaaataaaaaaaaaaaaaaaaaa

SEQ ID NO: 3120 - DNA, 1158 bp, Zea mays
cattgggtacctcgaggccggccgtataatagcaaaaagctcctcccagcagtgcacgcgtgaagctcggcggcggccggcacggtgcatcctccgctcttgcctcacctcccggtccatcctcgctgctcacgcgtgcctcacctcgacagcagccttccctcgcgacagggataaggacttaaggaggcgtcgctcggtgcaaagaatccatggcatggggaggtctgttcttgtgcatgggccgccccacgcaggagcaacagaagtcctgccttgcagccgctggtggcttcaactacgacacagctctccaaggcgccacacgcccaaagtcagtgtctaccttgacctctgacgaagctggtggcgaaataggtgacaaggatcttaccgagcgtggattctttgtgaaccgatcgcgtgttctggtcggctcaggttctgacgcctttgtccatgccaaatctgccctcctctcatggaggcacttggctttagggtgggcgaacgtggaaccggacaccccggtgaaggtaggtacaaggttctgcatctgctacaaggagttgatcccctgggtgacgctgccgcttcagatagcgtatgtgaccgacgtcgattcagacacgtccaaagggtgctcccggtccaagatgtttgccttcggcagcggcactctacagggccatctgctggccggagaggagcggttctcggtacaggtggacgaggaggagagggtgtggtacgaggtgctttctttctcgaagccggcgcacgtcctggcgacgctgtgctacccgtatgtgcagctgaggcagaagcatttcgcgcagcagtcgggacaggcgctcgtcaggcatgtgtccacctgctcttccaagcagaagcagtagtagagctttgtggagatgcactgcacagagaatgctgtatgtattccccctttgaattctattccgacatggcctggtttggcggcgctggggcctgggtgggatgatatatgttcgggcattccgagtggagtttgcccatcccatattttaatttcttcatgatggtggtggatctgttgcagctgaatgaattaagacaggaagatatataaaattcatgcgcacacagaatggcccaaaaaaaaaaaaaaaaaaa

SEQ ID NO: 3121 - DNA, 1467 bp, Zea mays
agcttctggagccttcgcgtttagtggaaccgcaagccagccaagcaacttgcgccactcgcctcgcctcgcctcgcctcgcccctgtttgtttgcttctggccggaccccttccccttctccggtgcacgccactctgcaacccccctcctctcgagcagagcagtcgagcagagcggcagcctcggcgcgcgccggcgccagccgacatgactgccggtcagtgcggcaacatccaggaccaggaggcagctcctggcgccgacctctacgccgtgctcgggctcaacagggagtgcaccgacgccgagctcagggtcgcgtaccggaggctcgccatgatatggcatccggacaggtgctcggcgtccggcagctcggcgcgcgtggaggaggccaaggagcggttccaggagatccagggcgcctactccgtgctctccgactccaacaagcggctcctctacgacgtcggcgtctacgacagcgaggacgacgacgctgacctgtcggggatgggcgacttcctcggagagatggccgacatgatgagccaggccacgccaacggagagcttcgaggagctgcagcagctgttcgtggacatgttccaggacgacctggacggcgccgggttcttcggcgggcttccgacgagccgcagtgcccagggtcctagcagcacctcgttgccaccgtcgacgtcgccattgcggccgacgcctcctgcaagaagtaagggtgcgcaaacaccgtcgtcgtttaacggcgctgggaggcggggttcgacggcgaagcggccgaggaccggttgggctggcctggaaccggatctgggcctctctggattctgtttcatggtgagcaagtcgaaggagaggccggcggcatgggcgtgcgacggcggtgacgagaggagcggcagcaagcagaggctgtcaacgagccgcgacgtctccggctccggtggtgggatgtcgcgctcgcgcggcagagccaaagcagtagaaacttgtgggcagtgaacggcctctagtcttgaatcttgattagagcaccgtttattcacttactggctcgcgtcagtcgtagtagctcgaggcacgttgaaaaggagagagaaaagatctgtttcattcttcaatctattccaagctagccataaatagccaatctcttgctgcattgtttcgatgaatttttatttgggagaaattgagagtggttggtagtaaactagtaacaactttacgaagagatgcggccatcgtgccgaattaattgggcggaggtacggtacggataaatagcgggtcgtgtcgtattcgtggatcaaagtctaagcttaaacacggactaattagtttttaaacggtcatgtcgggctattatatcgtatcgtgctaaatctaaggcctgacttgtaacagagttcaaaaataacatgttttttcttgttttttttct

SEQ ID NO: 3122 - DNA, 1190 bp, Zea mays
gaaagaattatattttggggagtacaatagtttactcggaagtgtactacaagtatgttatttgtttctccgtttcgatacatttccttttttagataaagacttcgatacacttctacagttgtactaccggcctccttttgcgctccactcaaatgtaaatgagaggacaaccactgaagaacataaaaaatcttaaaaagctcatcttctcttaagaacaaaattctccttttctaaataaaatacaatcccacatcgagcacatcaacctcgttcgctgtccgttgtcctctccctgccccaagggtcctggcgcggcaagatcaaagcctcccaacagccaacaagtcgatcgcaaatcgcaagaacaagagaagaaccaatccgacaacgtctccattctccctcacatctccttgctcgcccagcagctggcactccccgtctcccctcgcatccgcatcgaatcgaggcatatcgccctatatatcccattccgctcggttggattcagcttcccctccctctcccccatcgataaaaccgatgcgtcgcccggcctcgcgtaccctaccggcgacgggacgaggggaaggttacaggcacggcgcgtgaagggtcctgcccagtcctgcccggtccgccgcgatgccgtggtttgagatgtggctgcctcctgtgcctggcgagggggctgtggcggcggcgggggggctgttcctcgacggcgccgatgcggcggcgcacggcgcgctcctcgcggccatgcctggttgctccttgtcgttcgtgctccggcaccagcttgccgggggtcgccgccggggttcctgtcgctgacgatgtcggtaaaggggggcaggggctttgtgccggccccggtggggttgctcgctggtgcggaggagaagagcggggcggaggagtcggacgcgctggtcgcggggaagagggccgtggaagcggaggcggaggcggaggcggagggagtgattctgctgcaggagaaggagaaaaagaagaagaagctggacgattgtgctggagctggcgcgatgaacatgaccaaacacctatgggccggagccgttgctgccatgatatcgaggtatagccgcattgtctgtggttcacattgataatattgtcagcaacgaactctttattcatcctctatatttgtccag

SEQ ID NO: 3123 - DNA, 6305 bp, Zea mays
ctgaatacgaatctgttcatataacttttgtatgctaacttgctaagcagtaaatagtatgcatgcatatacttcgactaattattggtcacattcatgacgtgtgacttttttgaatcctaagctatgaagatagtgtatatacttcatttgttaatgtatcaagttagcaataaggaaacatattagcagactgcatgaacttagagatctgcatgtatcattttgatcctactattcagtgtgataagtgtatgctagtctgtttcagaccgcctctggttgccggtcttctccccaccttggttcaggttctaccatcagcatcgatcagctattttgtttatgagttaatgaagatagttctgaaagtggagtgaatacaaattcattggtgagcctacaagcaagttcaaatggcgaccacgtatcttgatgaaattgccgggcatccccagtaacttatgctgtgagggtagtttcaggttggtaaaatggttgttcagctgaagctttgcacactagttgactaaattgcacacgcggtcctattcgagacccgattcagtggcttaatagaagattgttctcttcgactccgtcctagggaaaacatctcggccctgcccaatttccgttgacaaattttacatactttatcgttgatgtatgtgacacattgacagcaagccagagtgacatttgagtgatttcagttgtgactttctaattcacagttgagatagggattgggccatatatacaggtattagatgtgattgtcgttgacgcacgttgggtctatctgcagtttcgtgatcttgacctgtgagcgtcgggtacttaacgctgccacgctttgcagttggcggatagagaggcacggccgacgggtgattatggacttgtttgaaacctctaaaactaataattgactctaaaaattaattgttgggtttcaaacacggttaacatcacagctaattgattgttagctatcttacaactaattgttatctatcttacggctaacaattagtttattagccgattcaactcagctaataatttagctctatagaagctctataggttcaaacgcccatgtcctgtccgcggtgtttttttatgatcttaccaaaatgtataaaaaagaagaaaatggtatagtcgataatatttttataactttggtactggttagttgtacatcattgaaaatatatatgttgcaatgattagttatctttaggaagcatagttgtaataaatagtcattctagtcaagaagaaatattgtgacaaattctaaggattcaaataaagggaccctattgaggagatcagctttatcagatagcttgagaagggtaaatgttgtagcaggtataagaaacaccattgaaattgcaaaaaatgctggttaaaaaaaaggtcaaccataatgagataagtgcttattattttattctagttagttaaaaatgatacattatctggcatgcattgtactgcatttagttacaaaacgctaatacatgtggtcttgatgccacatctaattttgtgcatagctttaataatattataacataatgtcgtaccaccaatttaaacagaatcgacataatgcgtggtattgatgccgcaccagtttaaaaatagctgaaatagcaaataagttagttccaatttccaaacaagggggaacatccgagcaccgtgagcgtgagtgactgcatagtgcgtagccgggtccagttagttgtctgtagtaagcctgctacgatttgtacgtacagtgagattcagaagtgaggtgagtgctggcaacgcacacgtgtaacatgtttctgggccaaagatcggcttcggacgacacgttccgtgtggtgaataaagaaaaaaaatgtgcttagcgtaggtccgcgtcgtggggacggacggtgctcagaaagtaccgtcgctaattaaccaaggcgtgcttgagctggaaggatgaggttatgaggtgcaaggtcactgtctgatgcactgctactatcctacgattgttaccttgcacgaattttcaagacggaagagcagcgggacctgcttgctgcagaacggtgactgaactgcaaagcgatgtgaatctcttcaactgcgactgcgagcgagcgcagatcgactgcgccgcgccgcgggttcatcacacgtagcgggtgtttattacgtcagccatgtatcagactgggtggggccgctgtagactgactgttgcagattcatgagaaattgagaatatactggaagcatgcatccgatacttgtaaagtactcccaagtcccaagtcccgaaatctgaagtcaaattcgcagcaggagaaacactgtggccagctggatttggacgctcggttggaatataaccgaagactctactcgctactacctgtcgatcctggggtgccggctttgttaaaagcgtgctcagtagtgctactactgtacttgaattgacgacgaataataaccaaaaaaaaaacgtaactaggacggcgacagctagccgacagataacgactgcacgctgcagctgatggcctggcccgttacccgccaaatgcgcccggcgtaccgtccgcgcgagatcaacatcgttctcggatttcttggactcgttcgaattttgaatagtatatgcctttcatttcaaaggttgcctttcctatcctaggcgcaaggacgctgaagaggagatagctagagtacgttcagaccaagctctgttaggatcaggaccttcttttcttgtgtatagtacagagacaagaacaagagtacaaaaaaccgtcgttcttgttttttttttcaaaaatccaaacacatccaactttaccaaaatatataaaaaacagtaatatttataacacataattagtactatcagacatatcattaaatttatttttgtagtaaattaaattaaacatacgaaatgcccgtaatgtttcctatatatttatttaaatttcgaagggaaaaaatgaccaacatattcatattctttatggtgacaattaataaggaactgacagagtagagaagaggcaaacaaaaggggacatttcgtagtcctagcatgcttcacgttggggctcctcggtctcagcgagagcgacacgtgcattcattcattcattcattctttcaccaaagaaacgtgacagcaagttagcagggcacaagtcgtcacccgcaaactcaagcgccgggcatggcacggctctcgctcgcacggctattgtggcctctacctctacgcctacgcttggcgcgaccgccaaccgcccgccaggcgcccacggccccacgccacgccttccgcggcggcaccccgccaacctctccggaacccggaaaaggccaagcggcaagggcccctcttcccatttcgcagtttccacgatgacccagctccaacggaccgcccccttccaatgcccagttgcccacaccctcgctgagcccgccctctcctgactcgtcgtcaccccacctcgtcgacggttggctcgtccagttctttcctcctctctccccgcttcaccaccaaaaccccgggatcaagcagaggacgccactcacaggcccccccagcacctctccactcctccacaaaaccctgcgacaaatccgggcgaccgactcacggagcgatcgccatcggaacggtagccactagggccggaggggctcgcgccttgtggtgccgtggtggtggcctcactccgcggcggcgcctggtcttgttccgcttcgttgcgcgcggcgatggcggaggcgcggcgccacgcggtcgcgccgcagctaggtgagcgcactgagccggctttctcctctctcaggcaggccgcaggcgtctgtttcgctctcaagtctcaactcctgatccacctgatggagttggcggtcatgttcggtcaacgctcaatacgtcggcccttctttttttatatatatttgtctcacgaccggcgcgttccggagcccttggtttcgtcgctggatccgtgatttggccccgtgtaatcgtgcgcgtgggttggtggcgacgggcgtgtgcgattggtgcaaacttggcattcgcgaggaaacatctttctggagtaattgatgtggatatggagccttggtcagtatgcagcccatcatgcgttgcgtttgcgagaatatttcgctcaggtcttgcgtccactgtgttctcagggtggaattgaaattttctcgagacgtggcacctatcgccaacgcctggtgtgtgtgtttttttggtggtggtggtgggtcgtgatgtgaggaagttcagtgttcaaggcggaatttcagtaccctgcttttgtgggacttgtgatgtacctgtgtcaaattgatcagtgcttgggtttggactggaaaaaaaaaaaaaaaataccagtgactgggttgccaacccagaacttttgaagagcttagcaagaggatttctttgtaagaatctcgtgttcaagtggctgttgtagcatgaactgaggtctgatggagctgcctttcggcttctggttgggttataagactttccagatctgttgaggtgtgcatgcatcggggatatcacatgacagattaactaagtttttattttttattttttattttttatagggtcacagtttcagaagtttaacaatttttgagttgtcgggtcctaaggccctgtttggagcctctagagctaataattagctgataaaattagctatagaggtttcaaacaccttcagataataccctggttaattgttagctaactcacggctaataaatcctagctaacaatttattagctgactaactattagctctagaggttccaaacaatacctaagtggtaaagtacacttgaaagagattttgaggctccaaaccaaggtatgatgaactgttttttgtgtccacctccactttcaaagttattttctgtagatacatcttacgaactgtttggttactaaattggtaagaaaggcaaaggggatatgattgcaggagacaacgacgaattacatcggcttttgagctgtatgagttttatatagaatggtatcccatgctagtaggaatcgattgcatgagtgtgggaataaacattgaataatgggacctattagctgccgcaagtcacgttgcatctacgtgaatcaaacactatcttagtccttagggtttcacttccaatgaaagccagttgatttgcttggactcctatattaagttttagttgatttgcttggactcctatattaagttttattgtacacgtgagtcaaatggtcaggcaactccattttgtgaaagctacttatcatttattacttcaatctaatttaaatatttttgagaccatgttcctatgaatccttttaaccatgccattatattcaattatctaacccttgctttcatgaacttggaacagatattgagcagatattgaaggaagcacaacaccgatggctacgacccgctgagatatgtgaaatacttaaaaattacagaaatttccacattgccccagaaccaccaaatagacctccaagtatggcactcatttctgctgaacactgtttatgttttattgttgttcctccaaaaggtgctagtttctttttgatagaggaaagagaatgcaatacactacagtgataggagataggattacataacctagtgttacaaccttaatgggtctcttgggctaggttctaggtcgaagacacactaacagtctaacaaccctcgttgtcgaaactctagcctatacaaaatttgaggccagatcaaaacttcgagaataccaaggaggataggtccttggtgaagatgtcgacaaactgcaaaatcatcagaacctagaggacttgaacaccttcgatggcgacgcacttgcgaacgaagtggagatcaatctcgacatgcttcatatgttggtgctagatggggtcaatggagaggtagatcgccctgaccttgtcgcggtagacaagggcactcctggtgagaggactttggagctcatgcagtagcaagcaaagccaggacatctcagccacaccattcgccaccattcgatatcctgcctcgatgctcgagcaggagaccacatgctactacttccgcgatcataagacgaggttgcccccaaggaatacgatgtagatggaggtggacctatgcgtgttcgcgtaacctgcccaatcagcgttggtgtagagatgagc

SEQ ID NO: 3124 - DNA, 2275 bp, Zea mays
gcgtggtcgcggccgaggtacttggggtccctagccttcttcagggtcttggggcggtgaaatgtcacggacgtgtgaatcttcttggtcttcttctttcctggcccagacttcacagccttgacaaccttcaaggcctggtcttggcatcacccttcttggcaggagcagctgatttgagttgttggtttcagatcaggacaaagatggttgctcctggtggtgaagctttaggtggggtcattggtgttgcccgccacatgatccaaactgaaggattcttctcgctgtataagggattggtgccttctcttatcagcatggcaccctctggcgctgtattctatggagtgtatggcatactgaagatggcttatctgcattctctctatggggccattgctggttgctgtgctgaagctgctacatacccatttgaagtggtccgtaggcagctacagatgcaagtaaaagcaaccagaatgaatgcgcttgcaacatgccttaagattgtcgaccaaggtggggtaccagcactgtatgccggtctaatccccagtttgttacaggtatgtattctttcagcagagaacctacttccacatatatgtcaatggtgatccaacacacatagcagggacaaacaccgacatcgaagggagaaatggatgaacagctgcacagagccttggaaggaatctagacgtcgagatcgaagttgtcagccttgaagatcttaaggttgtcggcgagctgcaccccgccatcgccattgccgcctcccccatccccgatccccaccgcagtggtgctactcaccaggaacaccctcgagtggatcgccggccgtgaccgcgacgacttggctgtcgcctccttggcaaggagaatcgaggatggccacggggatgcgttgttggtgtcgccagagggattgaaggagacgctatctctgatccggattccaccagctttttagattttgtccaggtgttgggaagtgacagtgaaactcaaaaggaatttgcccgggcggttacctctcctctgcttgtcatcatctcgaaggaacttgaacgcctaaaaaaggggcgattggaaactggcggagtcgttgagatgactcggttggattcggttcgggcttccgctgctcctcctgtgagacatcctggcctgaatcagacacgtcgcgggaggattgtgtggcgcagcggtggttgaggagacgccgagcagcagtggagaagtagtggccgattacactggcaggaagaagccggggtgggggcatggtatcgcccggcgctgtctgccagcgcggaggcatggtgcggagccgtggtagcgcccgcgcccacattttagggatggggcggctgcagcccgcgtgctacggatggggcggacgcggatggggtggagggtggtgtggggaacgcgagtgggagttggtgagggccggtggtgagcgcgtgtcggggcgagggcgcgagaatggcggatcggcgcgatctcggggctcggcggcgcggcggacggggttgacgaaggagcacgagggagaggccgtcgacagtagaccaccttccatggagatcatgggcgagcaggtccctgaccttcccatggagagcatatcggttgtgtggtgggggcagcgggctcagccgttgatcgcgccgaggagatctaggtgccgaggaggagatctgccacgccggcagcagttctgtggggtagatggattgcgtcgaggagtggatcgcgatggcggatgaggagggcgatggtgggggcggccccgtcgagggagcactctgccgcgggagggaaggtgagcgcggcggggcggcgggaatcgcggctgtggctgcgcagaggatggaaggtgcggggagcagggaatcgcagctgtggctgcgcggaggatggaaggtgcgggggagcgttcggccgcgggcgtgagcggagcggcagaacgtgcaccgcgcgatagtggacgcctacagtgctcacataatagtagtagagatatagccttttggcagaccaaatggctttaaaagacctaggctaagtaatgtgagcaacactatccctcacgaaaagtgggtccaagggtaacgttctctttcttggactctctggtcttcctcctcaactgtaaatatatataaactaggtgagtgctcgtgcgttgcgacggcaaaccaattaggagaggccacgataggtgaaatggaagtgaggggatacttgacaggttctaatg

SEQ ID NO: 3125 - DNA, 2385 bp, Zea mays
  misc_feature (2345)..(2345): n is a, c, g, or t
  misc_feature (2348)..(2348): n is a, c, g, or t
  misc_feature (2355)..(2355): n is a, c, g, or t
attctaaaataaaagaatgtacccttctatccaaatccaatttgcatcgataaaataaatccaaattccagattccagcagtagatgaataattgcaaatttttgtgtgtacgagattagaataacttaaaaataactgacataattttttatttttcctgatcagaaaaatacatgaaaaagaaaggaggtagaaaaatttgttgatttatggttaaagaagaaaaacaagaaaacaggggttctgttgaatttcaagtattcagtttcaccaataagatacggagacttgcttcacatttagaattacacaaaaaagatttttcatcggaaagaggtctacgaagacttttgggaaaacgtcaacgtttgctggcttatttggcaaagaaaaatagagtacgttataagaaattaataagtcagttggatattcgggagaagtaatttaatcgttctcatttttttcttattttattagtagtcttatagtagtcttagattttgcattttgatgagcctcgttttgaggaattcatggaataatccattttcatggaataaagaataagaacaaggatacataacataaaaaaaagaatagataagacgatattcgccctccccctacatatttgatttcttctcctatacaaaaaccagcaagacctactccattggtaattccatcaatgacacctttatcaaaaaaatgcgttagttcggctaatcttcttatacctaggataaaaaccctagtatagaaaaaatctatataaccacgattatatgaccagctgtatatctttttttttacttcatccaaaaagctcttttttggattcttttttacaagggaattttgaaaattcaaattctgaaaaaaagaataagcagatccataaaagatatatgctatgaatagaccaaaaattgctaaacttacagaagaaattgcattagtgagaaattcatatgaatttatggaagaattagaattttcctggaacaagtttattgaaggagttagccactttgataatatggttaactccaatattctattatcttttactccattatcaaaatggattcctatggatccaatgaacaaagtaaaaagtagtaatataagaagaggaaatagcatagtatttcccgtttcatgaggatagacaaaagtatttttagccccaaagggagtactaaaggatcctatccttatttcttgtattagcaggaatttttggtatattttgtgaaaaaaaagaaactccactcttcattgttgataaaacaaaatccctattgactcctttggatatactttttccccataaggatattgaatacaacgaaccttctttagtactactgtaattttgaaaatgaacacgcaaatacccatcaaaagtaagtaaatatatccgaaacatataaaatgcagttaatcctgcagtaaaagaggctattattccaaaaaagggtgaatacaaccaactattactaaggatttcatctttggaccagaagcaagcaagaggtggaataccacaaagagaaagtgtaccacataaaaaagtagttcttgtaattggaacgtattttcttaaaccacccataagaaccatattctgacttttatctggtgaatatccaacaagaggttccattgaatgaataacggatccggatcctaagaacaataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaagagtgttattggacctcgggggggaatgaaactcattatccagggtagggatatgaaaagaggaagaagtctagctagaagaaaaatccccgcagcaaccatagttgctgcgtgtataagagccgaaataggagtgggtccttccatagcatcaggtaaccatacgtgaagaggaaattgtgcagattttgcaactgcaccaaggaataataaaaaagcacacaaagtagtaagtaaggaattaatcccattattaggaatccagttattagctattttgaacaaatcccgaaactccaaactacccgttatccaaaaaaaacctaaaattcctaataacagaccaaaatcccctacacgattagttacaaaagctttttgacaagcactcgctgcaattggccgcgtaaaccaaaagcctatcaataaataggaacacattccgacaagttcccaaaaaaaataaatttgtatcaaatnggnactagtnaccaatcctaacatggaagtattaaaaaac

SEQ ID NO: 3126 - DNA, 3391 bp, Zea mays
cgtaagctattgaacttgggtatgctctttccttttgtcgaagtggaatcgtagaacagaatgtgatacgatgagacagaatgcaatagaaacaaggatagcgaacgggttacctactcctaagggtcaaagcaagccttttaattcaattctttattcttacattaaagaatgaatcaaatctccccaagtaggattcgaacctacgaccagtcagttaacagccgaccgctctaccactgagctactgaggaacaaggggagattcgacctcctagagttcaactcccgctctcaacccgtgaacaatatgagtccgaagcttctttcgtaactcccggaatttcttcgtagtggctccgttccatgcctcatttcatagggaagcccaaagtggctctagcgggttctatttcacttcttagcacttcctatcatttaatatccattcctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttaagtagtctaaagtagtctaagtttctcgatgaggataattaattcggtcgttgtggtcggactctattatggatttctgaccacattctccataggtccctcttagatcttctttctccaatcttgggttagggaagaaggagatattcgcgactactagcggtttcattatggggcagctcatgatcttcatatcgatctattatccacctctgcatctattctttcttagctaaacgggtggaagatccatccaatttggttatatcatggactcgaaaaacggatctgaatgtgactgaaatgcacgatcttcacaggtatcacttttcacgatacctaaacctaaaaggtggaatagcgattttcgaaccatttcctataagagaatggtttccattactttgagaaatggattctatatcaaactatagctattgcattaaagaagaaaagaaactaatagaagtcgaagacgcggaatggtagtgaatagagaaaaagattcttctgattttcttgttcctgaaaatattcgatccatctcctagacgccgtagagaattgagaattttcatgtctttcaattctcgtactcgtaattggaaagttacggaaggagatccatcattttgcaatgaaaacaacataaaaaactctggacaatttcgaaatcagaccaagcgtcttaatacatatgcaaaaaaattcattattggcccaccattgattacaagatttagcttttatgaatcgctattggtttgatacgaataatggcagtcgtttcagtatgttaaggatacagatgtatccacaattcatttagagttacttaatagcctatttcttatactatatctctatcccgtgaaattctcgagcccaaagatggatgcatatgctgtgtttcattttgctaaatgatatcaattaaatggtatatcaattctataaattggatatagcaataaataaatcagcaaaattcttttattttagatagaagaaatgtttcttctatctaaaataaaagaatgtacccttctatccaaatccaatttgcatcgataaaataaatccaaattccagattccagcagtagatgaataattgcaaatttttgtgtgtacgagattagaataacttaaaaataactgacataattttttatttttcctgatcagaaaaatacatgaaaaagaaaggaggtagaaaaatttgttgatttatggttaaagaagaaaaacaagaaaacaggggttctgttgaatttcaagtattcagtttcaccaataagatacggagacttgcttcacatttagaattacacaaaaaagatttttcatcggaaagaggtctacgaagacttttgggaaaacgtcaacgtttgctggcttatttggcaaagaaaaatagagtacgttataagaaattaataagtcagttggatattcgggagaagtaatttaatcgttctcatttttttcttattttattagtagtcttatagtagtcttagattttgcattttgatgagcctcgttttgaggaattcatggaataatccattttcatggaataaagaataagaacaaggatatgagtctatcgcttaaacgaaaagatctcctgatagtcaatatgggccctcaacacccatcaatgcatggtgttcttcgactgattgttactctcgatggtgaagatgttattgattgcgaacccatattagggtatttacacagaggaatggaaaaaatcgcggaaaacagaagtattatacaatacttgccttatgtaacacgatgggattatttagctactatgtttacagaagcaataacggtaaatgcaccagaattcttagagaatattcaaatacccaaaagagccagctatattagagtaattatgttagaattgagccgtatagcttctcatttgttatggcttggaccttttatggcggatctcggggcacagactccctttttctacatttttagagagagagaattgatatatgatctatttgaagctgctacaggtatgcgaatgatgcataattactttcgcatcggaggagtcgctgccgatctcccttatggatggatggataaatgtttagatttctgtgattattttttacaaggagttgttgaatatcaagaacttattacacagaatcccatttttttagaacgagttgaaggagtcggttttattagcggagaagaagctgtaaattggggcttatcgggaccaatgttacgagcttctggaatacaatgggatcttcgtaaaattgatccttatgagtcttacaatcaattcgattggaaagtccaatggcaaaaagaaggagattcgttagctcgctatttagtacgagtcggtgaaatgagggaatccataaaaattattcaacaggctgtagagaaaattcctggaggaccttatgagaatttagaagcccgacgctttaagaaagcaaagaatcccgaatggaatgattttgaatatcgatttcttggtaaaaaaccttcgcccaattttgaattaccccccccacagctttatgtaagagtagaagctccaaaaggcgaattaggaatttatctggtaggagatgatagtcttttccccctggagatggaaaattcgtccaccgggttttattaatttgcaaattcttcctcagctagttaaaaaactcacaccccccgcgctcatgacaatattaggtagtatagatatcattatgggggaagtt

SEQ ID NO: 3127 - DNA, 1967 bp, Zea mays
  misc_feature (244)..(244): n is a, c, g, or t
gggtacctcgaggccggccgggaatccaagaacagagaagatcaatccgacagcacccctctccctcgcatctacttgctcgcccagcagccgccccaaccctcgcgtccgcatcgattcgaggcagctcgctcttatatatcccattccgctcggttggattcagcttcccctcgccctccctcgtcgataaaaccccggcgccgtcccgccccgcccgccctcgcggccgcgggacgagggngaagaaggttacaggcacggcgcgtgaagggtcctgtcctgcccagtcccgtctggtccgccgcgatgccgtggcccgagatgtggctgcctcccgcggccggggagggggcggtggcggcggggctgtttctcgacggcgtcgatggggcggcgcacggcgcgctcctcgcggccatgcccgggtgctccctgtcgttcgggcaccagcatcggcgccgacggggggcgccgctggggtttctgtcgctgacaatgtcggtgaaggggggtaagggggttcgcgccggcccccggttgggttgctccccgacgcggaggagaaggccagggcggaggagtcggacgcgctggtcgcggggaagagggctgtggaagtggccgcggaggcggaggcggagggagtgattctgctgcaggagaaggagaaagaaggacggtcgtgctggagctggagcgatgaacgtgagcaagcatctctggggctggagcagttgctgccatgatctcgagaacagttgttgctcctcttgagagttaaagttggagtatatagttcgtggtgagcagaggaatctatttgagcttatgcatgctattgcaacaacacaagggttgaaaggcttttggaaagggaactttgtcaacatcctccgcactgctccattcaaggcagtcaacttctacgcatatgacagttacagaaagcaactgctcaaatggtctggtaacgaagaatctgcaaactttgagagatttattgctggtgcttttgctggtgttacagcaacgattatgtgcatacctatggatacaatcaggacaaagatggtagctcctggtggtgaagctttaggcggggtcattggtgttgcccgccacatgatccaaactgaaggattcttctcgctgtataagggattggtgccttctcttatcagcatggcaccctctggcgctgtattctatggagtgtatgacatactgaagatggcttatctgcattctcctgaaggaaagaaaagggtatcgatgatgaagcaacaacaacaagagacaaatgcattggatcaacttgaactgggtactgtgaggactttactctatggggccattgccggttgctgtgctgaagctgctacatacccatttgaagtggtccgtaggcagctacagatgcaagtaaaagcaaccagaatgaatgcgcttgcaacatgccttaagattgtcgaccaaggtggggtaccagcactgtatgccggtctaatccccagcttgttacaggttctaccatcagcatcgatcagctattttgtttatgagttaatgaagatagttctgaaagtggagtgaatacaaattcattggtgagcctacaagcaagttcaaatggcgaccacgtatcttgatgaaattgccgggcatccccagtaacttatgctgtgagggtagtttcaggttggtaaaatggttgttcagctgatgctttgcacactagttgaccaaattgcacacgcggtcctattcgagacccgattcagtggcttaatagaagattgttctcttcgactcccgtcctagggaaaacatctcggccctgcccaatttccgttgacaaattttacatactttatcgttgatgtatgtgacacattgacagcaagccagagtgacatttgagtgattccgcccgggactttctaattcacagttgagatagggat

SEQ ID NO: 3128 - DNA, 1586 bp, Zea mays
ttggatatatttatactttcttctatccaaaatatttagtgttcttgttttgtgagaagccaaacacgttttattttaacgatatataaaactaaagtattagtatttttactatacttatgtaaatagtatatttatttatagatatgaatgttaactaacaatttttttaaaaacctagttaaatttaagaacgtttgatgtatataaaaatggcataccgttctgctgcaaaataccgtacctcctgcccttcattcaaatgagaggataaaagctaaagaacaggaaaatcttaaaaaagatcgtcttctctaaaagtttaaaaattaaactccgttctaaataaaatacaactccacatcgagcaatctcgttcgcggttcgttggcctttcctgccccaagggtgcaccggtgcggtgcaggcagggcggcaagatcaaccaccagcaaatcacaagaacaagagaagaatcaatccgacagcacccctctccctcgcatctacttgctcgcccagcagccgccccaaccctcgcgtccgcatcgattcgaggcagctcgctcttatatatcccattccgctcggttggattcagcttcccctcgccctccctcgtcgataaaaccgatgcaccgtgccgcctcgcgaaccctagcggcggcgggacgaggggaagaaggttacaggcacggcgcgtgaagggtcctgtcctgcccagtcccgtctggtccgccgcgatgccgtggcccgagatgtggctgcctcccgcggccggggagggggcggtggcggcggggctgtttctcgatggcgtcgatgggacggcgcacggcgcgctcctcgcggccatgcccgggtgctccctgtcgttcgggcaccagcatcggcgccgacgtggggcgccgctggggtttctgtcgctgacaatgtcggtgaaggggggtagggggttcgcgccggccccggttgggttgctccccgacgcggaggagaaggccagggcggaggagtcggacgcgctggtcgcggggaagagggctgtggaagtggccgcggaggcggagggagtgattctgctgcaggagaaggagaagaaggacggtcgtgctggagctggagcgatgaacgtgagcaagcatctctgggctggagcagttgctgccatgatctcgaggtatagcttgttgtagtctacaacccagattgcatacgcgagttagcaatttagcatgattgcttatctagtgaaaaatggatgagtcttcttttgacattgaaccatagctgttacttttgattggaatgttgaagaatttgttttgtttgctagtttctacttctcaggctctatgaggcatcgagtatgttgacctttaggcccagttcagtaaagttgtcttctacatgtcatagttagtagtccatttaattagtatttgaacagatgagtttttgtgaaacaggttaggtgaagtacttaagtagttactagcctgttgcccgtgctttgctacggttgttatatatcataataggtattgagatatttattcaaatataatattgtttatttctgaaca

SEQ ID NO: 3129 - DNA, 996 bp, Zea mays
atcagctaaaagatccctcccctcaccctctcccatctctcgcctcgcctcgccacgcgagcgagcccaacacgcaaacggaacgcttccgcgcccctccgccttatccgatggcgtccctcaccaccacaacatcctcaccggccgccctcccggcggccaccaccgcccccgcggcttcgtccatatctccccacgccggatcgaagcggccgctcctcgcgggcgacgacgcgccctggcgggccaccgcggccacctccgcggggcaggggatccgacccgtcccgcgcatcaaccacgcctccgtcctccgcgtttccacgcaggaagactccgccgcctacgccctcgccatcatgaagcatccggatccgatcggcgaggggctggctatggaggcgttcgcggaggcagccgggccggagtgcatcgtgcccggacagcaagcgcctctaaggcttatggggctcaaggtctggcccgttgatatagatatgaagttcctagagccatttggacgggaactacattcaatgaaaaaattcatggacaaatcgtgcagtgttatggactcatctatggcaaacaagtaggcacatgacacatcagttccgtccaatacagctgttgttgtatccacctgcttcctgaagttacaagacccgaaaaatagaagagacattggagagaagccacattcttttgcgtatcttgctcaccgtcacctgacgaacaaaatatgacatcgggagtgcagtaacgattagtgagtggtcctgtattgagcctgggtgcagcctctgccagtataagtgctctacgtgttatacatttttttatgtccatgaaacattgatccactgagaaaatatatcttcaggtgccaatctacgacaataccttctgttctgttgctagatcaattttatttgttctcaggctcaggtcaaaaaaaaaaaaaaaaaaaaaactcgagactagttctcctcgtgc

SEQ ID NO: 3130 - DNA, 1001 bp, Zea mays
tccgaaactgtctcccgtctctcgcctcgcctccccgacgcgagcgagcccaacacgcaaaacggaacgcttcctcctcgcacctccgccttatccgatggcgtccctcaccaccaccacgtcctcaccggccgccctcccggcggctaccaccgccacagcggcatcgtccatatccccccacgccggttcgaagcggccgctcctcgcgggggacgacgcgccctggcgcgccaccgctgccaccgccgcggggcaggggatccgacccgtcccgcgcatccaccatgcccccgtcctcagcgttgctacgcaggaagactacgccgcctacgccctcgacatcatgaagcatccgaatccgataggggaggggctggccatggaggcgttcgcggaagccgccgggccggagtgcatcgtgcccggacagcaagcgcctctaaggctcatggggctcaaggtttggccccttgatatagatatgaagttcctagagccatttggacgggagttacattcaatgaaaaaattcatggacaagtcgtgcagtgttatggactcatctatggctaacaagtaggcacatggcacatcatcagttccgtccaatacagctattgttgtatccacctgcttgctgaagttacaagacccgaaaaataggaaattggaagaaggtccatggagggaagccgcagtgttttgcatatattgcccaccttcacctgagagaagatatcgggcgcgcaataatgattagtgagcagtcctgtatggagcctgggtgcagcctctgccagtataagtgatctacgtgttatacattttttatgttcatgcaacattgatccactgataaaatatatcgtcaggtggcaaggggtcgatttgggggaaaatatcttacgcaatttatttatttaaaaaaaaaaaaaaaaaaaaaaataaaaaaaaaaaaaaaaaaaaaaaaaaaagtcctctgcgttgttaccactgct

SEQ ID NO: 3131 - DNA, 482 bp, Zea mays
gggggtatagggccatacatttataaaaaaggcacccaagcccaaaggacgggggaggtttctcgagggctttagttttgacaaccttgggggagctatatttccctggattagattacatgcatacatacatatatacccccccgacagaaaaaccaaccaggggaattcccccctgatttctggggcatcggggcataaacataaacaggtgggggcgaaaaactatgcaatgggtcccagcaggggaacgagcaaattttttgactggtttccgaattttgaccagtatacacattcagatgcgaagcctaacaaaaatgggcgggtaaagacctgggctggcaagaaagctaggcttttattctgactggggaccattcgggggactgggggcgaagatcctccgaagcaaatatccatagcaaagggagaggggggggctttaacttgggagcgggatttaaggggggcattcccct

SEQ ID NO: 3132 - DNA, 2906 bp, Zea mays
aatttatgtagtccctggacctgggggagaaccaaaggtggggatggtttttctgaatgaggataaggcatatgaattctatgccaactatgctgaaactgcagggttcagtgtccgaaaaggctggttggacaaaacagcaaagaatgttacaaaatctcgagcatatgtttgttccaaggagggatttcgtccaagaagtgcttctatcgaatcaaagaaaccaagcctagaagcaagaactggttgccaggcacacatgactattaagattacagcaagcacaaaatatgtagtgactgagtttgtggccgatcataatcatgatcttgaaactcccttggttgacattcagattttgaagtcagaaaagttattagcaaaggtacaacagcctcctgatccaccaaaagttgttctgataccaaatgagtataaaaattacacaaggacaaaacgtacaaaaaatatgcaattaggtgatacccaggccatctgtgaatatttgcaaaggatgaaaggcgagaatccttctttcttttatgctattcaagtagatgaagatgatatgtttacaaatgtgttttgggctgatgctaaatcaataatggattataactactttggtgatgtagtgtgtgttgacacaagatattgcacaagtgactatgggagacctctactattatttactggtgttaaccatcacaatcagctgataatatttggttcagcgttgatttatgatgactcagcacaatcctttagatggttgtttgagaccttcaaatctgctatgagtggaaaacaaccaaaaacagttttgactgaccagtctgctgcacttagcgatgcagtttcttcttggcctggaaccatccaccgcttctcactactgcatttgtatctgaatgctactaagataagcagggataccttacaaggcttggagacttttgcatcagattttagtaggtggctgtatgaatatgaggaggacaacttctattcaagctgggaaatcctttcagagaaatacaatataaaggataatgagtggttctgtaaattgtatgaggatagagaaagatgggctttgccttatgggcgtgacacattctgtgctgatattgcaaccacactaagaagggataacacaaatacaatcctcacagatctaattaaaccagaaatagatcttcagaacttcttcaacaattatgataagtttttggaggagaaacgcctagctgagcaacaagctgactaccttggggctcaaataacgcaaagggtagcaccactgcatctgctttggcaagctgccaatttatatactccaacactttttgagatgttcagaatggaatatgaacagatctcaaagtgtgtggtctatagttgtggtgagattggaccaatatctgagtaccaggtcactgtcaaagacaggcctcagggtcaatttgttagatttgattcaacagaatgtatggttgtttgtagttgtaagaagtttgaattcatgggtcttctttgttgccatgtattgaaaattcttgatctcagaaatattaaagaacttccacgacactatatcctgaaaagatggagaaaagacgctcaaagtgaatctccagagaactatggttttgctgccatagatgaagatcctaagttttcattgtcaaaacggtacaacgcattataccggaatttgtataaaattgcagcaaaagcttcagaaagcgttgaagcttatgcattcctggagaaccaatatgaacagcttgttgaacaagtggaagtacttctgcaagcaaagttgcatgataaatcttccttaagtaccatcctgaaaggcaatcagccaaatatgcttaatagtgaggtcagcagcagtgaacatcgcagagcaattggtaagaaaattaaaaatgtagaggtgcgccgtcagcaacaaagtcttgatccaaacaaaaagaagaagggtagacaagttctgctggaacctgagattgaaattccactcagggttgaacctcccacggtatcaaatgatatccaaaatcatttaagaacaacaaatcagtttcttgcaccaagccatatgatgcaggcaccttatgttgcacagcagtttggtcttggttctttacaaggattcccaggcatgtcaccatttgggcagattcaagaaccaacacctcttcagcagccccatttacaaccaccatcgtttcatagtggtcctcaaattacacaggctccacctccagacattcaatcactacagtttcttagcagcaatcctcagcttggccaccagaccacggatcaaggccagtacaccattccagtctgggatttcctgtgacatacagtatcctcctgtttggttgctagcagcttggtgcctgactcgcccagcatcagttgaaactaacgattcttacttcctcacgcatctccacgcatgcaagtcaacgagggtaaaaaagcctagcttgcacctgcgcgcacatgcgtccactatatttttacttccccaagcacgtgcctgggcgcggtcaacgcatgcacggggccaggcgcgggagcagagccaaccaatcatgcagtatgtgatgtatggcgaagtagcaatgtagttgtaaattatgtaatgacactgcccctccccgaagggttaatgtcaatgaaatcctttagcatggtgcattggattagattttggaactgaatgcaattctaatgcacacgttaaagccaaccgggaatggggactgtttgttccaggcaaggtggcatggttgggcacagttatcatacaaaaaaaaaaaaaaaagtttgtttccttttattttgaggaattagaatcttactattggaatagactatttttt

SEQ ID NO: 3133 - DNA, 1945 bp, Zea mays
  misc_feature (159)..(159): n is a, c, g, or t
  misc_feature (1601)..(1601): n is a, c, g, or t
tcgaatgggggtcaagtttttagtccttctcggtgttgtcctggcctctcttgtcttccaggacgtggcatttgctagagagctcactgaggccaataatggtttgtacctactatctctctgcctgtgtgtatgaattacataagcatttctaaagcntaggataatagcacacgctcatcagtgagacaagcacacttaaaattaacttaggtttgcaatttatgtaatttaaagtatgagtcatacctgtaaaatgattgtacagtgataaaagcttcttcttgcacatgcagaggatgagggaaagaacatgaaacaaggaggaatgactgaattaaaggatgagaaatggggaggtggatataatggaggatatggatatggaggtgggtatggtggtggatatggaaaaccgggctatggtggtggatatggtggaggatacaggcccaaatatggcaggggctacaggtccggatatggatacggtggcgggtatggtggaggatacggtggcggttatggtgggggatatggtggcggtggtggctatggagaaggtggaggctttggaggtgggcatggtggtggtcgctatcctggtggtggagggcaccatggtggtggagggcaccatggtggatggaattaagaagcattgctacataaagtttctctatgtccgataacaataaatggcgacgataaatttgaatgctacatgtagttccgtgatggaaatcttatgtattttgtataaaacatggtacatggactgttacgtatgttgcatgaaatactgtactagaataagatctttgtatgccatgtatggtattagtgtgcatgtgtctggcttttgaaaggtgtacctcgtcatttatggacttatatgtatgtatagataaaaataatatttttatcacggcaaaaaacaaagggcgacgcatcgggcgactcatggttcttccatcgttgtgtttttatttcattttcactacatatttctggctccactgcttgtgaaatgattattacactgcttttggtgccatttgcattgatctacttcaagaacatctcaagatatgtggtagtcattgagcttgctagaaaaatgcaaatttaaaattaagatttgtgttaataataacatgtttcagttactactgctaggtttcattgttgcaaatttagttgtgcaagcttatgattttcactagacccaaaaaatttcaaaccatagcatacaaataaaaaatgcaaataaatataattatgattgagccggtccggtcgttattatgcttcactgccaaataaaagtgcatctatctttgatatattttagtgaattgaatgacaacaagatgaaataaataacatggttgacaagtgttgggaaagttattgttatcttatatacatttgcaatctacatatctcattatgaatcaaggccctatttgaatgaaaaacatgcagggtatttcatatgtgactaattgtcgaaatattggaatgtcattgatcaaaagagacatgttggttgatggatatcaaatgaagtctcaaatgtgaatcttgatcaagtagtncaatagaaaatcaaaatggacatttttgaaaggaagatcacagaaacaatctactttgaaaatataacaatataaatgatgttagatttcattgaaggtttagtgttgaaacactgaagttagtgttggtcacctgttaaagctcctggaagaaccataacatgacaacacagttaaaggtaaatctatctcccttctccttaggcattcagaaaagaagggagaaggggaataacacgaagttatctattagaataaataatgcaagactcggtatattaggtctcctcatttttctccctccatttgtattccatcagaaacagttcatagaacaaattaca

SEQ ID NO: 3134 - DNA, 1751 bp, Zea mays
ccggccggggtagggtacgtagcgggagtgtaagttgtgagtctgtgactgttgtgagctgctgaatccaggatgggcagatatttgcgccaccgtggctataaagcctcttttgaccaaacccttctccctctcacaaaaccctagctttccctcctcccctgttttgcggcgcgccacgaactcgcgacgctctcgagagatccatggatcggcgcaagggcggcaaccgcgacaccaacggcagcctggtcgaggccacggcgtcgcggctgagggtcgaatccgacgaggaggcggaagaggtggggatggaggtggaagagagcttcgacgcgggggtggaagacgagcaggcggcggcggaggtgattggaagcgaaaagaccagcgccgactactacttcgactcctactcccacttcggtattcatgaagaaatgctaaaagatgtcgttcggacaaaaacatatcaaaatgttatcacccagagtagctttcttatcaagaacaaagtagtccttgatgttggtgctggaactggaattctttctcttttctgtgcaaaagcaggagctaaacatgtctatgcgattgaatgttcccagatggcagacatggcacaggaaattgtaaaatcaaatggatattcagatgtcataactgtaataaaagggaaagtggaagaaatagaacttccagtcccaaaagtagatgtcatcatctcagagtggatgggctatttcctcctgttcgagaatatgttgaacactgtcctatatgcacgtgataaatggcttgctgatggtggtgtggtcctgccagacaggacttctttgcgtcttactgcgattgaagacgcagaatataaggaagacaaaattgaattttggaataatgtatatggatttgatatgagctgcataaagaaacaggcgatgatggagccactggtagatacagtggatgcaaatcagattgtcactaactgccagttactgaagacaatggatatctccaaaatgaccccaggtgacgcgtcctttactgtaccattcaagctggtagcagagcggaatgattacattcatgctcttgtcgcatacttcgacgtgtcgttcaccaaatgccataagctgatgggcttctcaacaggcccgagatcgaaagccactcactggaagcaaactgttctctacctggaggatgttataactatctgtcagggggaaagcctgagtggttccatgacagtcacacccaataagagtaaccctcgagatatcgacattaagctcaagtactccataaatgggcataggtgtcaggtatcaagaacacagttctacaagatgcggtgacaatggaacaaacaagagttgcttcaaagctcattaaattttgtttaacgagtatcttgtttgacagaaattgtgctatttttattgttcatgtactatgcatcaaatattagattctttggaatctagcaaaagtagggagtagattaaactggtctgctgatatgagattgatgtagtgcaaaactgtcatattgccacaaggccgttggtggttgtatgcatttgaagtcggttgcaaattattgctttacgcattccaccattaatccttgccttagatttttgtgtgtatgtgctcattgtttcaattgcttggacagtcaaaactttcctttgcgtaataaaatataatatgtaatgtttaaacaataaaataataaatagttg

SEQ ID NO: 3135 - DNA, 1294 bp, Zea mays
agaaagctcaatatgttgttttgcttagtggaactcctccctccgcgcccccggccgggctctttactcagatccaggccttgtatcctacagtgtacaagagtgttagtgagtatggcaatagatattgcaagggtggttttttcgggttgtatcaaggtgctagcaatcatgaggagctgcataatttgatgaaagcaactgtcatgattcgtaggttgaagaaagatgtcctttcacagttgcctgttaaacgtagacaacaggtctttctagatttaagtgagaaagatgtgaaaaatgtccgcgctctgtttattgagttggagactttgaaggtcaaaattgagtcctctgactccaaagagatgatcgactctctcagatttgcttaccagaatattgtcaataagatctatactgattcagctgtagccaaaattccagctgtgttggatttcctgggtactatgattgaggaaggttgcaagttcttaatatttgctcatcaccaacccatgattgatgccattgagaaacatctcttgaagaagaaagtaaagtgtatcaaaattgacggcaagacacctttaactacaagacaaaccttagtcacagatttccaaaacaatgatgacgtcaaggcagcagtgttatccatcaaagccggaggctacgggataactttgacagcagcgagcacggtaatctttgccgagttatcatggactcctggggacatcattcaagctgaagatcgcgcgcacaggatcggtcaggtctcgtccgtgaacgtgtattatcttctctcgaacggtactatagatgatcttatgtgggacgttgttcagggcaaacttgagaacctggggcagatgctggacgggcaggagaagacgctggaggtttcccagagggactgcaggccaagcccctcgaagaagcagaagacactggtcggcttcctcaagcggcccagcgcgtccacgtccgcggaggagggtatgcccagcacttaatgaagcagcctcggatctgaggcgcggtcgtggcttgtgagcgaaccagatcaggtcataggctgccagcagccacaatggtgttcaggctctatcacgttgtaacacttctccctccgcatttgctcgctctttcgagatgacagatgtattcatacttggaggatgtatcctgagaattctaaccaggttcgggactcgtggagtaattgcgtttggctgacgaagggaagaaaaggagcaaaacttgaagtcctcaaaaaaaaaaagaaagg

SEQ ID NO: 3136 - DNA, 2224 bp, Zea mays
agatatctgttcatcttttcctccattctagcggtatgatcgctgcaagattcccatacagccagttacttgtcgatgcatttcggaagataccaaaagccagttggaatgctaaagaaagggtatggatgtttcccccctcgtctttagcaatagtagaggaggttcctcgctcagtacctggattaactgtggaggttcacaaattggatccgctagttcagcgtgctttagctgctgctttacgatccaaagatcttcgaggtttgtatgacaggattccccctcatctcgagtcaaagcttatgccatttcagcgtgaaagcatcaggtttgttttacagcatggtggcagagccctgattgcagatgaaatgggtcttggagacactacaggcaattgctgttgcttcttgccttcgtgatgcctggccagtccttgcgattcagagttggcttaacatccctgtggaagatatcttggtggtattgccacatactggaggatcacataaagcaggattcagagtggcttactcaaactcgaaaggagattttcacttggatggggtgttcaatgtgatatcttatgatgtagttcccaagatacaaagcacacttctggatttggatttcaagattgttatagctgatgaatcacattttatgaagaatggccaagcaaagagaacagttgcttcacttcctgttttgcagaaagctcaatatgttgttttgcttagtggaactcctgctttgtctcgcccgattgagctctttactcagatccaggccttgtatcctacagtgtacaagagtgttagtgagtatggcaatagatattgcaagggtggttttttcgggttgtatcaaggtgctagcaatcatgaggagctgcataatttgatgaaagcaactgtcatgattcgtaggttgaagaaagatgtcctttcacagttgcctgttaaacgtagacaacaggtctttctagatttaagtgagaaagatgtgaaaaatgtccgcgctctgtttattgagttggagactttgaaggtcaaaattgagtcctctgactccaaagagatgatcgactctctcatttgcttaccagaatattgtcaataagatctatactgattcagctgtagccaaaattccagctgtgttggatttcctgggtactatgattgaggaaggttgcaagttcttaatatttgctcatcaccaacccatgattgatgccattgagaaacatctcttgttatccatcaaagccggaggctacgggataactttgacagcagcgagcactgtaatctttgccgagttatcatggactcctggggacatcattcaagctgaagatcgcgcgcacaggatcggtcaggtctcgtccgtgaacgtgtattatcttctctcgaacggtactatagatgatcttatgtgggacgttgttcagggcaaacttgagaacctggggcagatgctggacgggcaggagaagacgctggaggtttcccagagggactgcaggccaagcccctcgaagaagcagaagacactggtcggcttcctcaagcggcccagcgcgtccacgtccgcggaggagggtatgcccagcacttaagcagcctcggatctgaggcgcggtcgtggcttgtgagcgaaccagatcaggtcataggcagccagcagccacaatggtgttcggctctatcacgttgtaacacttctccctccgcatttgctcgctttttcgtttcctgagagatgacagatgtattcatacttggaggatgtatcctgagaattctaacccaggttcgggactcgtggagtaattgcgtttggctgacgaagggaagccccggaccaacccttcaagtatttgttaggtaaggatcctaaacactgagttatatgataaatttaacataattgcgtttgctaaatcagaatttggtggaagccagacaattcatccattagctagttgatcaaacaccgggtctagaaactttgatttagctgtcagagcatcgagctgacgggaatcaacacaggaacgacaagaactccttgcgtcctgcctcctgtggtcctgcgtcctgacgggaatcaacatgtggacccagacatggccgcatcctagattccagtgccagcgccaggccccagcagcccagcccccaacggcccagcgtggcagctcccaggcctcctg

SEQ ID NO: 3137 - DNA, 2102 bp, Zea mays
cctcgaggccgtccgggatgaaggacacaaatgcaaaaaaactcgggccacctcgccgccccgcagcacacactcgcacgcacgagaaggccggagaggcggcgcacccggagaggcaaggcaagcgatccctctccctccctccctcgtatccaggacaacagcccgtgcgatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgtcgtcgcgctcgtcgacgctgccacgggccaccgggtcacgttccaggaactctggcgcgcggtggaaggggcggccaccgcgctcgccgcgccgccgctgtcgctccgcaagggccaggtcgcgctcatcctctccccgaactccgtccacttccccgtcgccgccctcgcagccatgtccctcggcgccgtcctcaccaccgccaacccgctcaacacgcccgccgagatcgccaagcaggtcgccgacgcgcgccccgtcgtcgccttcaccacccgcgacctcctccccaagctcccgcgcgccggcgccggcgccggcatccgcgtcgtcctcctcgagcccgaccgcctcccctccgaccctagccccgtcgtcgccaccatcggggagatctccgccacgccgcccgaccccacgcgccgccgggaccgcgtcacgcaggacgacccggccacgctgctctactcctcgggcaccacggggcccagcaagggcgtcgtcgccacgcaccggagcctcatctccatggtgcagatcatcatgtcgcgcttccgcctcgaggcctccgacaggaccgagaccttcctctgcacggtgcccatgttccacgtctacggcctcgtcgccttcgccacggggctgctcggctgcggcgccaccatcgtcgtgctctccaagtacgagctccccgagatgctgcgcgccatcaacgaatacggggtcacctacctcccactcgtgccgcccatcctcgtcgccatgctggcgcaccccaaccgcctgccgctcgggggcctgcgcaaggtgctctccggcggagcgccgctcagcaaggagctgatcgaggggtttaaggagaaatacccgcaggtggagatccttcaggggtacgggctgacggagagcacggctatcggcgcgtccacggactctgccgaggagagcagccggtacggcacggctgggctgctgtcgccaagcaccgaggctaagatcgtcgacccagagaccggcgaggcgctgccggtgaaccgcaccggcgagctctggatccgggggccatacgtcatgaaagggtatttcaagaacgcggaggcaacacaatcaacattgacacctgatggatggctcaagactggggatctctgctacatagatgaggatggttatctcttcgttgtggatcgtctgaaggagttgatcaaatacaaagggtaccaggtgcctccggcagagttggaagctcttttgctaacacatccagaaatcgaagatgtcgccgttataccgtttcccgaccgtgaggtcggccagttcccaatggcctacgtagtgaggaagaaagggagcaatttgtcagagcgcgaggtgatggagttcgttgcgaaacaggtagcgccttacaagaaggttaggaaggtggcgtttgtggcggagattcccaagaacgcgtccggcaagattctgaggaaggatctcatcaagctcgccacatccaaatccaaactatgaaaattgtttttcgtgtttacagtgctggaatacgcttgtcgtccacgagcggcgagccattctctacgctgccccggtagtttggttgtagaatgcttgtataactgaagatcccgtcggctatgtgcttgcttgtgtacagtgctctgttctcgtacaatacaatattgggagggaatactaggcgtctgtacgtaggcttggatggaaataatatccggtaatttcagtgttggtatcactataactaaaaaaaaaaaaaa

SEQ ID NO: 3138 - DNA, 1676 bp, Zea mays
  misc_feature (769)..(769): n is a, c, g, or t
gtactagtcagccagacggccagaccccaaactgggcaggccccccggttgcagtcgagctagcacacccgcactgcgtctccgcagcacacactcgcacgcacgagaaggccggagaggcggcgcacccggagaggcaaaggtaagcgatccctctccccccctccctccctccctcgtatcgtatccaggacaacagcccgtgcaatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgttgtcgcgctcgtcgacgctgccacgggccaccgggtcacgttccaggaactctggcgcgcggtggaaggggcggccaccgcgctcgccgcgccgccgctgtcgctccgcaagggccaggtcgcgctcatcctctccccgaactccgtccacttccccgtcgccgccctcgcagccatgtccctcggcgccgtcctcaccaccgccaacccgctcaacacgcccgccgagatcgccaagcaggtcgccgacgcgcgccccgtcgtcgccttcaccacccgcgacctcctccccaagctcccgcgcgccggcgccggcgccggcatccgcgtcgtcctcctcgagcccgaccgcctcccctccgaccctagccccgtcgtcgccaccatcgggggagatctccgccacgccgncccgaccccacgcgccgccgggaccgcgtcacacaggacgacccggccacgctgctctactcctcgggcaccacggggcccagcaagggcgtcgtcgccacgcaccggagcctcatctccatggtgcagatcatcatgtcgcgcttccgcctcgaggcctccaacaggaccgagaccttcctctgcacggtgcccatgttccacgtctacggcctcgtcgccttcgccacggggctgctcggctgcggcgccaccatcgtcgtgctctccaagtacgagctccccgagatgctgcgcgccatcaacgaatacggggtcacctacctcccactcgtgccgcccatcctcgtcgccatgctggcgcaccccaaccgcctgccgctcgggggcctgcgcaaggtgctctccggcggagcgccgctcagcaaggagctgatcgaggggtttaaggagaaatacccgcaggtggagatccttcaggggtacgggctgacggagagcacggctatcggcgcgtccacggactctgccgaggagagcagccggtacggtacggctgggctgctgtcgccaagcaccgaggctaagatcgtcgacccagagaccggcgaggcgctgccggtgaaccgcaccggcgagctctggatccgggggccatacgtcatgaaaggtaacaatctccggaatcacgtgtagtgtgcattatttacattttatttcagatcagatgactagacacatgccttcagctccaaatgtctttgattggggcgtggggtcaaaataataatacgactaaccatgtgctgatactacttgcatagtatcttgcaagaaaacaaatcagcgttaccaagtaaccaataagtatctttgtagatctactatgctgaggtctatatttgaa

SEQ ID NO: 3139 - DNA, 3517 bp, Zea mays
cattgggtacctcgaggccggccgggacacttcccatccccggacgcccactccagtactccactacgcctctgatcccgtgccgtcggccgccatttcccgtgccccccaccgccgccccgccgccgacgcgatccccatcacgcgccgcccatggcgccccacctactcaccccaccagccctcaccgttacgggcgccgccgccccaggtcgcctcggcagcgccggatcggcggacccgcggacgcccaggccacgcgcgccgtggcccaccttctgctcctcccccagcagagggcggcgggagctgaggaagaggaagggcttgagcgtcgcggcggcggcggaagtagcggagccgggtgggcccgctggggcgatgcggctcaacgagtacatggtcgctgtggaccggcccctcggcgtccgcttcgcgcttggtgtcgacggacgcgtcttcgtccattcccttagaaaagggggaaacgccgagaagtccaggatcatcatggtcggcgacacgcttaagaaggcaggcgccgacggcgaaggcctcgtcaccatcaaagacctaggtgacacggagactgcgctgagggacaagtcaggaccatgcagccttgtccttgagagaccatttgctccttttccaatccatcagttgcatcaaaatgaagattaccacattctatttaacagaggacgagctgctgtggcctcttggaacagtgctgtttggtctacaaagatgaacgaatcttctactggggatggaaaattaggttttgctgtattctccccaaggttgctaagttctcaaggatgggctcttctgtccaatgagaaaggtggactcaatcagagtagcactaaccttgccaatcgcgtaagtgagattgttggtttatattctgatgaagacgatgacaatgctgagtgggcacatcgtagctttcctttggaagagtacattaaagcactagaccgtgctaaaggtgaactgtactataatcattcactgggtatgcagtacagcaagataacagaacaaatatttgttgggtcatgtatacaaacagagaaagatgtgaagatgttatcagaaactatgggtattactgctgttctgaatttccaaagtgaaagcgagcgcattaactggggaatcaattctgagataatcaacagttcctgtcgtgagaataacatcttgatggttaactatcctatacgagaggttgattcattggacctaagaaagaagcttcctttttgtgttggtcttctgttgcgtcttataaggaagaactaccgcatatatgtgacttgtaccactggatatgatagatcaccagcatgtgtgatatcatacttacactgggttcaagatacacctctccatattgctcacaagttcatcactggtttgcactcttgtagacctgacagagctgcaattgtttgggcaacttgggatcttattgctttagttgaaaatggaaggcatgatggtagtcccacacattcagtttgtttcatttggaacagtggtagggagggcgaggatgtagagttagttggagattttacaagtaactggaaagacaaaataaggtgcagccacaagggtggctcaagatatgaggctgaagttcgacttcgacatggaaagtactattacaaatttatagttgggggccaatggaggcattcgacttcgttgcctacagaaacagatgaacatgggaatgtcaacaatgtgatcagagttggcgacattgctcggattcgtcctgctccaagccagctacatataaaagacccatctgttgttaaggtcatagaaagggcgctaactgaggacgagcggtttttattggcgtttgcagcacgccgcatggcatttgcaatctgcccaatcagactgtccccaaagcagtagacgtgtcggtcgtccttctccgagcggaaccaggcgtcatcgaggatcagcgattttcgaagctacagaaaactcatgtatgtaacaacagaggggcttcttactgtatgtacccgttcacacaaaacctggaacgtggctaagtgtctcagcaatgggcacaatgtacacctctttgtaattccatggactgtatacctgaaatgaactccattttagactgacactcttgatataatcggaggccggctcgcaaatggccagtgaacaggctctgcaatctacagctctcatgggatgggagagatgactactttgccggttgccctcccggtctcaaggtaggagaacgcctccacaacctgcgagaaggagaagggcccctccgggtcgatgagtggcttcagcttccctgactcgaggtacgggttgagcttctccaagacggagccgttggaggtgacgacgaaccggaaccctggagggctgacggcgccggtgagaaccaccacgctgccgccttccttcactaccttgacagctttgtcaccctgaccgactccgtcgaagacaatgtcgtatttgtccggtagctcttccaagttctccttagtgtagtcgatggcgacatcggcacctaggctcttgagcagctcgatcttcttggtgctggccgtcgcagctaccttggacgcgccgtagacatgcttcgctagctggatcgcaagggagccgacaccgccggcgccaccgaggatgaggacggacttgccggcggatattcctgccctctccaggccctcgttggcggtctcgacggctagcggcaggctggcggcctgcgcgaagtcgaggcccttgggcttgagcgccagcagcttctcctcgacggcggtgtattccgccagcgagccggactgcttgggcccctgcagcggattctcgctgaccatgccgtacacctcgtcgccttccttcaacttcttcacctggctgcccaccttgacgacgacgccggacaagtcgtaccccggcacggtcgggagaggggagtcggtggcctggaacttgccggcccgccgcttggcatcgacggggttgagcgccgcggcgacgaccttgacgagcacctggtcctcgcccacggccggcacagccgcggcctcgtcgagcttgagcacgccggcgtccccgtacgcgtcgtacacccaggccttcatcaccccgggcacctccgtcgccaccgcggccgtggccggggacgaggacgcggacaccgcgacgacgcaccgtcccgaccgaccagcttccgaagctgttcttctaccggcggcgaccctcggcgctgacgacgggacgacgagcttcacgggagcctgaggcggccgcggcaagaagtatgatctcgagtacgaagtggccgggatcgacgaagagaggaacgcgtgcattttttttttctctctctcgatggctcgtctctgatcaactcagttcagagcctgtgcttatgagcaaacggagcaggatgaacgttgcaggtgttctctgctgctctgcttcactggctgtt

SEQ ID NO: 3140 - DNA, 2790 bp, Zea mays
ggatgtagagttagttggagattttacaagtaactggaaagacaaaataaggtgcagccacaagggtggctcaagatatgaggctgaagttcgacttcgacatggaaagtaagttgccacttgcttgttttcacggctgtggatatttatgaaacaacatctgtctatcccatcatcttctgatctctttgctgctgatggttattgagtttactgaaactaaccctatactcatttaggtactattacaaatttatagttgggggccaatggaggcattcgacttcgttgcctacagaaacagatgaacatgggaatgtcaacaatgtgatcagagttggcgacattgctcggattcgtcctgctccaagccagctacatataaaagtatgttaatccactgccttcagtgtctcgattgaacttcccacctgtgttcttctttgcaatttaggcattctctcatattttcaccaatcaaaccatatatgagtttttaggtaataatttggaatagtagactatgtagctactacagccaacaatagtatcatattataatacgattggcatctctcattggcaggacccatctgttgttaaggtcatagaaagggcgctaactgaggacgagcggtttttattggcgtttgcagcacgccgcatggcatttgcaatctgcccaatcagactgtccccaaagcagtagacgtgtcggtcgtccttctccgagcggaaccaggcgtcatcgaggatcagcgattttcgaagctacagaaaactcatgtatgtaacaacagaggggcttcttactgtatgtacccgttcacacaaaacctggaacgtggctaagtgtctcagcaatgggcacaatgtacacctctttgtaattccatggactgtatacctgaaatgaactccattttagactgacactcttgatatattcggaggccggctcgcaaatggccagtgaacaggctctgcaatctacagctctcatgggatgggagagatgactactttgccggttgccctcccggtctcaaggtaggagaacgcctccacaacctgcgagaaggagaagggcccctccgggtcgatgagtggcttcagcttccctgactcgaggtacgggttgagcttctccaagacggagccgttggaggtgacgacgaaccggaaccctggagggctgacggcgccggtgagaaccaccacgctgccgccttccttcactaccttgacagctttgtcaccctgacctgaatggatcgatggtgcaaagggcagatcatgtcagcccgaggcctgagggtgggtgacggatttttgtttttgtgtgtgctgggcatgtgtttgatgatggtgatcttaccgactccgtcgaagacaatgtcgtatttgtccggtagctcttccaagttctccttagtgtagtcgatggcgacatcggcacctaggctcttgagcagctcgatcttcttggtgctggccgtcgcagctaccttggacgcgccgtagacatgcttcgctagcttcattccacatcaagagcagaggcagcagcattgcaaggttgagttcagtcttcggtacgtacgtacccacaccaacatgcaaacagtacctggatcgcaagggagccgacaccgccggcgccaccgaggatgaggacggacttgccggcggatattcctgccctctccaggccctcgttggcggtctcgacggctagcggcaggctggcggcctgcgcgaagtcgaggcccttgggcttgagcgccagcagcttctcctcgacggcggtgtattccgccagcgagccggactgcttgggcccctgcagcggattctcgctgaccatgccgtacacctcgtcgccttccttcaacttcttcacctggctgcccaccttgacgacgacgccggacaagtcgtaccccggcacggtctgcagtatcacagcagagggttcagcactcccagaagcaataatttgcaagacgatacgagtacgaggatagctgtatcatcagaccgggagaggggagtcggtggcctggaacttgccggcccgccgcttggcatcgacggggttgagcgccgcggcgacgaccttgacgagcacctggtcctcgcccacggccggcacagccgcggcctcgtcgagcttgagcacgccggcgtccccgtacgcgtcgtacacccaggccttcatcaccccgggcacctccgtcgccaccgcggccgtggccggggacgaggacgcggacaccgcgacgacgcaccgtcccgaccgaccagcttccgaagctgttcttctaccggcggcgaccctcggcgctgacgacgggacgacgagcttcacgggagcctgaggcggccgcggcaagaagtatgatctcgagtacgaagtggccgggatcgacgtagagaggaacgcgtgcattttttttttctctctctcgatggctcgtctctgatcaactcagttcagagcctgtgcttatgagcaaacggagcaggatgaacgttgcaggtgttctctgctgctctgcttcactggctgttgttatccgtttgcggccgtcaggagtggcgggtagcgctcggggagacgacacttgtggcttggattggcgcgagtcgcactgccagcgtcgatgggcaaagtgttgggtgtagaaagttcgatagcgctccagatggccgctcctctacacgactacaccgtcaggctcggtggacggacaggggcagaaatggagggggacgcacgtagtttgg

SEQ ID NO: 3141 - DNA, 684 bp, Zea mays
gcaaaaggaggaagcgctgcaatttatgcttcattgaattggagaatgccaaaaataagcttccatctcttacaagaagaaaaggggcagttgcaaatgctgcacaagagcttgcgctcgtcttccaggaaatcatgagctgactgacgacatactagacacacagaattagatgggacgttcttccctctgctggcaccgagattggatatcagctgcccatggagcgctaagagctactcagtcttagcgccgtcatcaagctccaaggccacagcagcggtgaagggcattttgctgctgctattcccgcagtctgtacacatgctaacacataatccgtgtcatttgtgaagagaagctgctgccatggacaatggacttcagccacaatattatgtggatgtcgtttcatgggctgccggcgatgctacaggtcccgatcgaatgatgatcagcagatgggaactcgtagttccttgctgtctgcagcacctttctcatgtaccgttagcatgtgcgtgtttgtggttgggttgggttgtttggccgatttactgatcattggcgaatgaagtgagccatgtacatcattttgaagaattaatatcttttcttcttctgagtgaaaaaaaaaaaaaaaaactgcattgagtgaaaatgatatcatgtggtgttgccttg

SEQ ID NO: 3142 - DNA, 2416 bp, Zea mays
acctgtacgccgtcccgcttcgcttcggagaggtcgctgcctgccatcaacgttccctcgctggtagagtagaggtagacccaccgacccccagtactagtcgggagagagatggggattgatctcaacgccgtgggggaggacgacccggcgggcgcggtgtgcgcggagctgtggcacgcgtgcgcgggggctggagtggcgctgccgcggcggggcagcgccgtggtgtacctgcctcaggcgcacctcgcggcgggcggctgcgacggtggtgggatgtcggcgccggccccgccgcgcgtgccgccgcacgtggtgtgtcgcgtcgtcgacgtcgagctacgcgcggatgcggccacggacgaggtgtacgcgcggcttgcgctggtggcgatggatacgatgtttggccgaaacatcaatgatggtgaaactgaagagaagaatggcgaggaagaggatggcgacggagataagaagcacgcatcacacatgttctgcaagacactcacagcttctgataccagcacacatgggggattctctgttccacggcgagctgcagaggactgctttccacccttggactatgagcagcttaggccttcccaagagcttattgccaaggatttgcatggcatggaaatggaggttccgtcatatctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcaactgaaaaatgaagctctacttgaagctgtcaactgtactgattcgaagctacttatgctgtctgctgtcgccaattctttggacaacagaagtatatttcacatctgtttcaacccaagggttggtgcatcagaatttattgtgccgtattgcaagttcttgaagagcttgaactatcccttttcagttggaaccagatttaaagttggctgcgagaatgaagatgctaacgagaggtcctttggattgatcataggtattagtgaagttgatcccatacactggcctggatcaaaatggaaatctctcctgataaagtgggatggtgctactaagtacagccaccagaatagagtatctccatgggacatcgagggagttggcagctcagtttcagttactcaccgtctttcctcttctgtttcgaagcgaacaaaactgtgcttccctccaagcgatttggacacgccaattctagatggaaatggtcgtccagactccgtggaaactgaacgtttccacagggtcttgcaaggtcaagaattggtgcactctagtattcatggtgctgcatgctctcattcatcagatagccccagatgtcaaggctcttatggcaggagattctctgctgatgcgtggaactgcaagatgaatgatgtaatgagtgggcctcgacacctaaatgccactgggtttgcttaccagcccctaggcttcagtgaatctgtcaaattctcagaggtcttgcaaggtcaagaaatgtctcaggcggttccttccttcatgagatctgctttcaactctggcacgcagaatggcagggttcgaccatttgattatgtgcagagatcagatgcaactcaaggatacgctctccagcagtttaatctgccagcaacagaagtgcattcgccctcttctgttcttatgtttaaccaaaccatggtaccacatgctgagctagatggtgcgaccaaccgtgaagaagtacatggcagcaggtacttgtcatccaatgcaatagggagagaagctgaaccatggccatccatgcagcagcaaagagcgagtgtaaatggaagcgagcctctcgacacaactgaagcctcagctcctgcaaggaacgctgaatctggatcggtcggcaggggcgcggggcgaagcaactgtaagctttttggtttctccctgactgagaagatccttggaacggatggtggtggtgtgaaagaagggaactacgaagtggaccgtcaaactccccgggtgctagacttgtttgggcacggttctacgcctggagctctgcatgctctctgtgctgctcccttgggaatatgatgctgttctgcctagttttacaacagttagatttatgtaatccttcagccattttcatcgcgttgtacttgaccaatatgtccagcgtatgatttccagttttaattgtatgctgatgctacatatcctctcttgagatccatgcatgagaattctggcagaatgaacagaggtaaattgatgtccagctgttttctttatgaacaaataggtaaattgatgtttaatttcagaagtaaaaaccatggcgaatttgatagt

SEQ ID NO: 3143 - DNA, 2026 bp, Zea mays
ctcgaggccggccgggccgggaaccacggccagaccagaccaccagagtgcctccaccctcgaggcctccagtgtccactgcctactcgccccacgccacccaaatcccgtcgggacgacgaagaagccaagccggtgcgccgtataaatctaaccaatcgccatccgcccaccccccaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagagggcgtgtgtcacgtactgcatcacctacatcctcagctgcatcaccaagcactctccccagtacaaagttcttatgattgggcgtgtccttggtggcattgccacttcgctgctcttctcagcgtttgagtcgtggctcgtggcagagcacaacaagaaaggatttgatccacaatggttgtcgataacattctccaaggctatatttcttggcaatggtctagtggccattgttgctggcctatttgcaaattttcttgctgataacatgggttttggtcctgtggctccatttgatgccgctgcttgcttcctagcaataggaatggcaattatcttatcatcatggggtgagaactacggagattcgtctgacagcaaggacttgataacccagttcaagggtgcagctaaagccattgcttcagacgagaagattgcattgcttggagccatacagtcattgtttgagggatcaatgtatactttcgttttcctgtggactcctgctctgagcccaaaggatgaggaaattcctcacggcttcatatttgctaccttcatgctttcctcgatgctgggtagctcaattgcttctcgtttgttagctaggaagctgaaggttgaaggttatatgcaaatcgtgttttcagtatcagcctttactcttttcctccctgttgtcaccaatttcctagtacctccctccggggagaaaggcggcagcatttcgttaggaggctgcttacagcttcttggtttctgtacctttgagtcatgtgttggtatattttggccatcaatcatgaagatgagatctcaatatattcccgaggaggcaagaagcacaatcatgaatttcttccgtataccgctcaacctgtttgtttgcgtggtactatacaatgtgaatgcattcccaataactgtcatgttcggcatgtgctccattttccttctcatggcagcagtcttgcagaggcgcttaatggctgtctctgatcttcacagatcgacaaaggctgtaatgatgactgcggaagatgagcctctaaacccttagagatcatcataaaaaggaatcggaagttaaaatggccccaatcctcgacttattcccatggggttgctgaataagattgatatctaaaagttgtaacgactgtaacagaacacggtttttactgtgttataggattggtgctagtgcagtttccggttgtcatggtagagaacatgatgtggctcctgactattgtgccacacacggcagagtatagctcggcatagcctccccacgttttccccatgtttttcttctcgtgttttctgataggattgatatttgtattcaagtgaagtatcatatggaaacccgcatcgtccattttggatgcaaacgctgagtaaagtgagaaagggctcattagagaccgaaaaaaaaaaaaaaaagcaaaaaaaaagaaaaaaaaaaaaaaaaaagcggcc

SEQ ID NO: 3144 - DNA, 1107 bp, Zea mays
  misc_feature (1091)..(1091): n is a, c, g, or t
  misc_feature (1100)..(1100): n is a, c, g, or t
gtaccgggccccccccccgggccgcctacgtaggcccccccccacttgatcatgtttgtttttgcgcttatccttataataggggaggacattatttagagtacttgtcttttttctgtaaagtagtggccattggtcaacaaaatattacctttgccaaagaattaggagatgcaactgcatgttggtcacttctctctttttccttgaaaacctgaaagttcaatttacttagaaactagatgaaacacaagttgttatttatcctcaagtagattaattaccactaagataactaaacaccatataggtattcaccaaacagtcactgtaagtcgataactctgaagtccaaaataaggcatgttgtagcaagcaatcattcaactatttcactgatattagttcagttctcactagctgatgggcagaggtttgatctatggtgtaaatagctattttttcttgtttattttcgtagtcgtgatcttgttttatgcaatcatatgtacttaccattttgcatcgtttgaggtgcagatcagtggggtgcactcaaaactgagaatttgtttccccaagaagattctttatttgttttaacaaactagattcatccatgttgctttaagattcatccatgttgttttgcatactgaatattacttctaaagaaacatgttacatccataatttttgttttgggctattacacaagagaccgttttcactgcacaggtaatagccattgtttatattttatctgttctatccagatttttatcgactacagttttgtactaaccaattctacctacagaaacaagacctgcctacagtgacgaacttgcttaatataaaacacacgagccctcctcatccaccaccgatggaggatggatggcatatatgattctctaggcatatgttatgtactaattgaattttaatttcagtatacactgtgtaatggtaaaaggagaaaacttgatgaatggagaatgtacaaagatcaaagtatggctaaaaaaaaagaaaaaaaaaaaaaaaaaaatcccccgcgcccgggagcaccacgtctgcgcggccgnaccgcgtgnagctcag

SEQ ID NO: 3145 - DNA, 3996 bp, Zea mays
cctatataggcgacctgcagccaccatgtttcttaaattccactccatatcaagcttttccaatctatcagaatctgagatggctgcaatctctctcattttctcaaggatatcgatgttatccataaggtatttcttgaacttcttatatttcccttcgacatttatattccatcctttcaacatttttttgttcaatcttttttgtttttttcctttccaaacatcgatacatttcctgctcctcacaggtaaggacgagctttcaaaaaaccttctgctttaaagtcaggtctgagcctccagcaaagctcacatatctaaagtccctcttcttagttgggacagagtcagtgctaagacacaggggaacatgaccagaaaaaaaaaatcatatttagcccagagacaacaatattcttgtactgcaagtctcgttatgggctagcaaaggaatctacccaacttctcaaatgtgttgggatgtcaagtatatagactattcatcggttccaactctatcagactgtgcagctcaattatagagttgaataaagtgctccatctatttgttcttatcctcatatttggttaagatattaaaatcacctcccaccaacatttaaagtgcaccatttaaagtggctcgcgagcaccaaaccgctgaaaaccggaaatgtttagcacgttggcagcgggacccttttctatctcatcgtgttcttcgttgtccaccacggcccacgggccaacgctcctccatcctgtagtgtagagtatattccatttgcgaccgagccgagcatcgatccagccacactggccactgccagccagccatgtggcactcctacgtatactacgtgaggtgagattcactcacatgggatgggaccgagatattttactgctgtggttgtgtgagagataataaagcatttatgacgattgctgaacagcacacaccatgcgtccagatagagaaagctttctctctttattcgcatgcatgtttcattatcttttatcatatatatataacacatattaaatgattcttcgttccaatttataattcatttgacttttttatccaccgatgctcgttttattaaaaaaatattataattattgttactttttgttgtaatattgtttagcatataataaactttgatactagtatgtttccgagcaaaaaaaaatattaatatttagattacgagcccattaattaattatattcgagacaagcgaagcaaagcaaagcaagctaatgttgcccctgctgtgcatgcagaggcccgctcttgctataaacgaggcagctagacgcgactcgactcatcagcctcatcaacctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaaggttcgtcgtcgttattttgcgcataggcgcggacacacacacgtgctttagcctttagctagctaacacccagatcatcgtcggtgcgtgtgtggatcccgtcccgcctccgtgcagacggcgttcatcccgtacatcaccgccggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtaaactatagctagctcttccgatcccccttcaattaattaatttatagtagtccattcatgtgatgatttttgtttttctttttactgacaggtcttatagtgcctgatctcccgtacgtggccgcgcactcgctgtggagtgaagccaagaacaacaacctggagctggtaggttgaattaagttgatgcatgtgatgatttatgtagctagatcgagctagctatatataataggagcatatgcaggtgctgctgacaacaccagccataccagaagacaggatgaaggagatcaccaaggcttcagaaggcttcgtctacctggtagttatatgtatatatagatggacgacgtactcattattccagccccatgcatacatggaggcttctgctctgccggcgacgacgacgaccacgacgacgactaacactagctagggcgtaacgttgcaggtgagcgtgaacggagtgacaggtcctcgcgcaaacgtgaacccgcgagtggagtcactcatccaggaggttaagaaggtgactaacaagcccggtgagcgtgaacggagtgacaggtcctcgcgcaaacgtgaacccgcgagtggagtcactcatccaggaggttaagaaggtgactaacaagcccgttgctgttggcttcggcatatccaagccagagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgaccgaccaataaaaataagccaagtggaagtgaagcttagctgtatatacaccgtacgtcgtcgtcgtcgttccggatcgatctcggccggctagctagcagaacgtgtacgtagtagtatgtaatgcatggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgtataaaaaaaaaaaaaaaaaaaaaaaaaaaaaaaaaaaagtataaaaaacgcgcccgctcctactccttcctgttaaatgccttctttgacagacacaccaccaccagcagcagtgacgctctgcacgccgccgctttaagacatgtaagatattttaagaggtataagataccaaggagcacaaatctggagcactgggatattgcaaagacaaaaaaaaaacaaaattaaagccaccaaagtagagatagtaaagaggtggatggattaaaattatctcatgatttttggatctgctcaaatagatcgatatggtattcagatctatgttgtatagccttttcattagctttctgaaaaaaaatggtatgatgagtgcggagtagctagggctgtgaaggagtcggatgggcttccacgtacttgtttgtggcccatgtccggttctatttaggtccgatccgagtccggcatggtccggttccatacgggctaggaccaagctcggcacgtgagttttaggcccgtcgggctagcccgagcacgacccgtttttaaactggctaggactcgcccatttaataagacaaacattgcaaaaaatagctctattttttatttaaaatatattgtttattgga

SEQ ID NO: 3146 - DNA, 1546 bp, Zea mays
gcacgagaccattacctagaacaccctaatcgaaagatcagcctcatcaacctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaggtgactaacaagcccgttgctgttggcttcggcatatccaagcccgagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgaccgaccaataaaaataagccaagtggaagtgaagcttagctgtatatacaccgtacgtcgtcgtcgtcgttccggatcgatctcggccggctagctagcagaacgtgtacgtagtagtatgtaatgcatggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgtataaaaaaaaaaaaaaa

SEQ ID NO: 3147 - DNA, 1599 bp, Zea mays
gacgcgtcggtccatgccgcaccaggctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacataaccgccggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctgagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccacgagtggagtcactcatccaggaggttaagaaggtgactaacaagcccgttgctgttggcttcggcatatccaagcccgagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgacgaccgaccgaccaataaaaataagccaagtggaagtgaagcttatagctgtatatacaccgtacgtcgtcgtcgtcgttccggatcgatctcggccggctagctagcagaacgtgtacgtagtatgtaatgcacggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgtaaaaaaaaaaaaaaaaaaaaaaaaaaaaaaaaaaaaaaaaaaaaaaaaaaaaaaaaaaaaaaaactcgagggagggcccggggtaccca

SEQ ID NO: 3148 - DNA, 927 bp, Zea mays
ctatagggcgagttcctcgccgcatggcggcgtggtcgcggcgcccgttttataaacaccatcacaaatatttaaaaactcaagcttgtacctggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccacgagtggagtcactcatccaggaggttaagaaggtgactaacaagcccgttgctgttggcttcggcatatccaagcccgagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgacgaccgaccgaccaataaaaataagccaagtggaagtgaagcttatagctgtatatacaccgtacgtcgtcgtcgtcgttccggatcgatctcggccggctagctagcagaacgtgtacgtagtatgtaatgcacggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgtatagtttgtgctcaaaacagggcgagcgggtaagttgttt

SEQ ID NO: 3149 - DNA, 1280 bp, Zea mays
tttgtgctactcatgttgcgcactgcacgaggtcattattccatcttaattgtttggaacattatcttcaacagtattttcttgtcacagatctcttttcgaagatgcatttagggctatgtatggattaccagagaatgtcttggcccttccaccaatgcccaatgatggtgatcattggtctactcttcatagctgggtcatgcccaccccatcatttctgaaattcatcatgttctcaaggtaacttctgacctctcattttttccttattatttttaagaggcgattcacttaggtgttcataatattggtttgggttgtgttttgcagaatatttgttgattcacttcatagcttgaatgtgaatagtactgaaacaacgtcttgcttccttggggcatcagaacctgaggtgaccatatcttttccttttccttttgacaactgctgatgatatattttgttccgaatctccgccttgctccttgcgcctgctgtacctcagagaaggcactgttattgtcgaatcctggaagtccttgtaaatgtctgggcttatcacagtggaaggaagatggtctaccttaaccctttcactggggataccagtgagcagcatctgctcgataagagaaatgggatgtgggtaaagttcttcaatttcacccttctgaagagcatggatgaggatctggcagaagaagctgatgatggcatgcatcctggaaacgagcagtggctgtggccattgactggtcaggtgttctggcctggtattgctgatcgggaaagggaggagaaatacattaaaaagctggataaaaagctcaagaacaaggtgaagttacttgaaaggcagaagtctggttacaagcagaagcccctgggacaatgaccatgactgaagagctaacaattcaagatttttttccttgccacgtccggtgcatgcacgtggaagagagttggagcacaaaaggcaccgctgttgtgaatacgcattctttctacgcctcattgatctccctctccaaagatgtttggtgagtctggaggatattgtcaggatggaaaagcaccattttttttcctgttcgtataaacagattagataggatatctgtttggttcgctgtctaatttaccacactttgtctaactttcctgtctaagtttagtttttcgatttaaacgactaaccttatgtaaagtgtgacacagttagccacgaactaaacagacctgtaatgcgccatatagttgaactgattcttttc

SEQ ID NO: 3150 - DNA, 1121 bp, Zea mays
  misc_feature (16)..(16): n is a, c, g, or t
gcacgagaccattacntagaacatcctaatcgaaaaaatctcggaacgcggtaggggttgcggattgggagcaaaggaggagagggagtgctgggccgccgccggctgcgaacgcggaggaggcagcttccaccaatcagtgcaccctcatcctcaaaggctgttccaacagcatggaaaaaatctacgccatcaaaactcctcataagaaaagaaaatcacagtatgagctgagcaatccaaagttgccgccacttaaatgcaagtttggcaaaaggttatcttgccacagcgttgagtctgcaaccacagaaagtttgggatacgattgcattttcatgaacaagacctctgggacggacatggtcagcatacccgaagtattggactcctgtgagagcactataagactatttggtgggtgcatcgaactagtggactcaaaaactggaattcaggaacagtctttgagaaaaacaattgagatccggacatctgcattgagtcgctcgagcaacaacttttcatcagaggcttatcgttcttcccatagcagcggcggcaccagagaaactggcagctggactatgcacgatatagagcgtcctcatccagatgtgatgctgaaaccacatcatgacgacctggaaaggatatacaatgtgcttgaacagtatgacgacctaatggagatggaggacagactaatggccggcgatgtctttggttctgcttctcagatcatggataaaacgcttcactcgaatggcgttgacggcttccagattttgccaacaggccagagccagaccggccatcacagtaagcagcactccgattcacgttccctttctgcatttgcttgcttgattcagatgctgacacggtggatccgggtaatgtgcgtggctatcgatcaggtgagaagctaaccatcgatcaagaattcgagcagtatttttcgaacctgatgctgtaggatcgaaaggatgcctccaaacatggtttgcttgctgagcgaggtgccgaaccgtggctattattggagccatcggtttatatgtacaccgaatcctatcactgaatgtatatatatgtgtgtggtaaaaaaaaaaaaaaaa

SEQ ID NO: 3151 - DNA, 6557 bp, Zea mays
  misc_feature (1649)..(1649): n is a, c, g, or t
  misc_feature (5868)..(5869): n is a, c, g, or t
ggttccattatgtaaaaaagttaaggacttcgctgctatagctaagcgcaggcatattagccgaggtgggcccagggcctctattggtaccttaaatatgggtacctacttctgctgattcaagatgagacctatatgatacccataagttcatcgggaaagccgctgttcagctaggctggtcaggctggaccgctatcaccataagtcccataaagagaggaatcagtgactgcaacagtattgttcggataaactcatttcattccacaaaccaaataataaaataaaaagataatatattaactcatttctcaaaccaaacatgttattagtgtctgcaccggcactgttcggatccttctaacgtgatggggcggtgtatgtaattgccgtggatgcatgcagctagcaatccatagtccatacgcacgcacatgcaaacgacttaactactgcggcatgcgagttattccccggtcctttttttttctcgcctgcattttctcgtttcaggtcccagtcgtggcggcacgttcaggcgttctgcgtggcaatgcttgccaccggcccaccgccattgcgtcctgccttttttttttttaagaaacatgtcaaggtacctgacctcggcctgccttctatctgcaatgcatccacggcccgaaagcctctcggcgggttgctgacgtgtgggggccgccgcgcccagtccgcgtggcggcatcgtgtgaccaacaaacaaaccgcggcaactgtttgtctgtttaggtatgtggatcatacttttgtctagaattggattgtgaacatagattatagtaccgatatttttaactattttaacttacgcaccagattctaagtacaaattatgttgaattacatatggtagaagttggcgagagacaccctacgtccacattgtagtaccactactatacgaggtacgtgaaaccaatgactgagtttacataaagtaggtagagattatgaggtgcaaccacgaaaaaacaggcgagaataggggccggagagaaagatgggtcgtcgaccctaggcgctagaaaaagaaatgcataaatcaacacatgctttgcgatcaaaacgggtaaacaaatttaatattttaaaatacatatatatgaaatttgatgctaatcttttcttatattatcaagcacattattataaataataatgacattttgcataattattcttatacataatttgctccctacaacaaaaaatgtgaaaactatctgtatctgaatttctatcgtttgagaagacatgtgatatgaatctttacaaagtcaatgctaaaaaaagaatacaaatttgaatagccgattctatatcctatttattcacaatcaaagaaaaggacaaaaaacgggtatcgaataagtatccataatcattcctacatactcattagaatactcattagagcaagtttaataatacatcccataggaggctttatgatgttgtcatgtcacatatagccatctaaaaatctatttatataataactcatatgagacaagcagtacatttaatacttgactcacctctctctctcacacagagagccttggagtccatgtagcgagctatgaattggaagaagaaaaaatacntcatcatatctttataatcagaggtaaagaatcaccgtagttacaacatatatcttgtttcctacggtacgtacatctattattctacctaccattgtggctacctcaggatttgtgtgtgatggttttcaagcatcgctagtgatccatgcagtgctggaaccaaagctcatttctacaaagtgtcatctatcttctgtgaccgttcgttcctttcagattttagacttctatatataatttctatgtttaccgtttactaccaatcttattatcatcctatctactcccaccttttttttcctagctacacatatgctctaatctttagagttggctatctctagcagtcttcttatgccactccttatcttacttttattttaaattttactctataaatattatctatttttttggatcagttattcgaattcgtagagacaaaacacttctaaggtaggtaagggttaaagccaaaacagactcaggaggccgtggagatagcctattgtctgccgaatcttctttctgtcttcatggcagtgccggacatagttgcagttggaacttctacggaggaacacacacagtgccggtgcgaatcaatggtggtttcatgacctcttgattcgcttcgtctacctccgtaagagccatcatctactccagtacacccctacaccgttccccctgcctttttcttctcccgccgttcacccacgccacttccctacgcggctacgccaggtgccccggtgtagtagcctcgtcggatccttcgccaggtcttcctcgggccctgcgccggcgaggagcgcctactaggtatgcgcgctcctcctcctcccttcattcctgctgcgcgaaaaccgggcatccgaaccgtaacctgaactgtttgggtttgggtatgtgtattcggatctgatctaattacaagtgagtgtatattatgtactgcgtctgccgattcatctgggctactaggatatgcagagtgattgctgcagctttgagatgcctcattatataactgcttcatcacataagtcgtgtgcaaaaaaaggaagtggagtaatgcagtgccaaaacgcctctgggagtagtttggtgtgaaggggaaatctctatctatagctcaacaaaacagcagctcttgagatgcatgattctgggaaccgcactgacttggtgattgccacagggtgtgagtatatcgtgtctatttcacatagttggttttaccgttatagtgtatttggtgtctggggtgtggtgcaatatttgtttgtatgcttgttgtccacttgtcctagttgtagatggtcgtaataccacgagtagaatgttttcccttttctttttggacttaatttttaattctaacttttgattgttgttgtttttttttaaaaaaaaaactgttactacaatttttgcttctcaggattcaagatgggggttcaccgtaggaattattcagatgatgaattttcagttgctggcgagaggccagaagtagaattcatggacttccagaacgacgacacctttcaggattattcatgtgaagatacccctgtgcttgtctcagctcctttccctttcgaggatggaaaaccaaaatctgcacttgtcggagaaacatcagctgataccatacagattgagaatacctctcctgaatctgtaaatctgtggagtgtaagaattttctcttcgaacccagaagacagctatgttctatcaatgatgagaccaccgtcagatgatgctaatgaggaggaaaagcatgcttttcttgctttgacgtccgtggaagaccgtacacttctgcctggacaaacccttacagtttggctgtcttgtacgccaaaagatattggcctgcatacatcaatcgtgcatgttgatatcggtgatgagaagattgagcgtgtggcttttcttttggcagatgacaatgtctcccaggccttattttctgataagccttattccaggagacgtgaccaagttaagaaatttgggccttctccaactgtgccaggtcgtcgtccaactaagcagcacgttcaaggattcaaacataggcttcctcagtatgcaatacctgcgcacatccgtgagctcattgaaagtaaacagaaacctgatgtcttatatgatgagttgagcatggtaaactatgcagaatatttcagcactcttctagtcatggaagagctcaatttggaggtattttcaacacatgtcgccttaaacttgaagctttgtcttggtttgctaactttagatgcccttttgcaggaggagatgagaacatatgacatggagggtgtcttaatgagaaggaggggtatgcattttttgtctcttgaggtccctggtttggcagaaaaaaggccatcactagtccaaggagacttcgtagttgctagatatgctgggaatcatgctcaggcttaccaagttagtccccttcacttgacaattgtgtatcttttgggcattcttaaaggttgaatataggttcatatgctcttaatgaataatgacacgtcggtttgtctccagggtttcattcacagggttgaagctgatgagatatttttacaatttgaccatcagtttcacatgaatcatcatgatagaaaccggtaccatgttagcttcacatataacagagtgaacatgagaaggctttacaagtcaattgacgatgcaaaatatttgggacctggcattttgtttcctcgccaatcaccttgtagagttttgaaaaggtggccgtttaatcctctgaatccacatataaatactgagcaagctgatgctgttgcaatggtacttgcctgcagaggaggttcaccatatgtgatatatggacctccaggaactggcaagaccatgaccattgtagaagccgttttgcagctttacacgggaaagaagagggcaaatattctcatttgtgctgcttccaatactgcagctgatcatgtactggaaaagctccttcaagctagctatctgatccggccaagtgatatctttaggctaaatgctcagagtcgccaatacgaggatgtcagtactgattttatcaagttttgcttctttcaagatcgggtgttcatgtgccctcccttacaagcattggtgcggtacaggatagtcatatcgacctattcgagttcctatcagctgcaggctgagggcattcgccaagggcatttcacacacattttcctggatgaggctggccaagcctctgaaccagaggcgatggttcctttgtcggggctgtgtggaagagacactgtggttgtgttagcaggagatccaaagcaattaggtccggtggtttactgtaagcaagcagagaaggatggtctggggacatcatatctggaaaggctgctgactgacttcgagccgtacggaacaaggaatcctaactacgtgacaaaactggtgaggaattaccgctgccatcctgcaatcctggagctaccatcagagcttttctatgagggtgaactgattccctgtaaagaaggagagtcatctgcttatgattgcataggccttcctgacaagtccttccctgttcttttcatcggaattcaaggatgcgatgagagggaaggcgccaacccatcatggttcaacaggatcgaggttagcaaagtggtctctatcatcaggaacctgacaaggggcggggacgttgatgcatctgatataggagtaatcactccgtaccgccagcaagtcgccaagataaagaaagccctagaggcattcgaaatgcccggcctgaaggtcgggagcgtcgaacagttccagggccaagagagggaggtgataatcatctccacagtccggtcgaccgtaaagcacaacgagttcgacaggtttttcaacctggggttcttgagcaaccataaaaggttcaacgtttctatcacccgcgcgaaatcgttgctcgtcatcgtcggaaacccttacattatcaccaaggtagtctctctgtcactcactcattagttcattatagcatgcactgttatgtattcatcatcaaactaactgctgtaacttcaggaccgtcactgggataggctcctgcgatactgcgctgacaatggctcttatcaaggatgcccccttccacccccggaatctcatggcttattcagacggtaccagnnattcttctccgagcatgacgacggggcatcaaagctggaccttctgggcaggacgactactacaaccaagaagccacctactgcagctacaacaaccaagagccttctgacttcggtttcaggcttggcagtggtgctgaacctgcttcggagaaccaagagttaccgtccgaggagctgcctgaggacgagaagcagccattattcagcaacccccaagcggatctcgaggagacgccgaagcaggacgtcgtcgaggaaggggctgcacagggaggcgtgctggccgacccgacatcgtcgacaaccgccgacgatcagctccagggtgcatatgcggagaagtacagcttccctcctggctggtgcgacgtttcgagcatcccggcgcaaggctggggcgactgatcgtcagacctgcgatcgccattggtagggggggtcattggcagaataattgaggccgatgaccttgtgaacccagcaccctcatcggtgtgtccctttcgttccgtcaagccttcgttcatttctcactgctggacagtttgttgcagcgagtgaactgtggcgtccatgtgtttaggacaggccatcgtgtgtgactgatgctggcaacacgaaacgtacgtgcaatgtggcgtggttattttgcgggtgccatatattgagcgtgtgctcatggttt

SEQ ID NO: 3152 - DNA, 1229 bp, Zea mays
cccacgcgtccgcccacgcgtccgccggccggccatcaccactgccggaattttttaactcgaccccgccctacctctcgccgtcgaccacaagtccacaacccacaaaatgcacgggaggacccagggcgccgccgtcggcgacatgacccagcgccttctcctcgccctctcgctcatcgcatcagcgaccgccgtgcccgctgtcatccgcacggtcccggacgaccccaccgcgggctcctctggcgcggcagacgccgcggacgcgctcttctgtgacagctggaggctgtcggtggagacggccaacgcgggcccctggagcgccgtgccctcgcgctgtggggctttcgtgcgggactacatggagggacctcgctacgcgtctgactccgccgtcgccgacgccgacgccctagccttcgcctccgaagccctggccgccgccgagtggggcggctcggcgagcgcgaggcctgcgtgggtgttcgacgtcgacgagacgctgctctctaacgcgccgtactacgcggtcaacggatggggatcacaggaattcaatgagacctcatttgatgaatgggtagatgctgcaaaggcaccaacattaccatcgagcttgaatttgtacaatcaacttcagggacttggtttccatgttatcctattgactggccggagtgaattccaacgtaatgccacagaattgaatcttttgtttgctggctacaactcatgggaaaaactcatactgaggcaaccttatgatattggcaagaacgctgtgcagtacaaatcagagagacgagcagcaatggaagcggaaggtttcaagatacttgggaactcaggggatcagtggagtgatttgataggatcgcccatggcaacgagatccttcaagctaccaaacccaatgtacttcatcagctgattttattgttagagcagtggacgaaggagcaggttttcatagggtgttcatatggtcccggtgtgaaactgcttttgttagacatccctcgggacataaatttagatttttatcttcaagcatgttgaaattcaactgaggcttgggtccgtcgaatctgccctatgatgatctgtaattacacacttcttttcccacactactggaagcatttgtggtaaggcaaattgtgaggtcaaaaaaaaaaaaaaaagcacgagcctttcgcacgagaccaaaaaaaaaaaaaaaa

SEQ ID NO: 3153 - DNA, 2143 bp, Zea mays
ggagtcacattgtcccgccggggccttcgccctgcccggcccggcgcccagacactggtcaagcgacgcaagggaaggatgtggttagctagcagcctgaaattctccgcccatcaactcagtcagcaggaagcaacccgcctagcgccctcgatccaaggacctcagagattcggccgtcgccactccggggccaagaaatgctcctcctgctcttcttctctgtcctcgccgccgttgccgccttcctcctcttcaagttcgccaccgtcgtcgatggggacttgacgctcgtatcccgcggtccgccgctgcgggagagggtcgacggcaaggtcgtgtggattactggagctagccgcgggattggggaggttcttgcaatgcacttcgcaaatttaggagcaaagctgatactatctgcacgtaacaaggacgcgcttgcgagagtgaaaaaaaacatcctcagcaagaatccagatagcagagttgaaatgttacccatggatttatcagctggtgaagaatctctgaaagaagtcgtacatgtggcagaatcatttttttctaatgcaggcgttgactatatggtccataatgcagccttcgaacgtcctaaacggagggctctagaagaaagtgaggaaggtcttaaggctacattgaatgtcaatgtcttcggaactattactttaactcgccttctagcaccttacatgcttgatagagggatgggccattttgttgtgatgagtagtgctgctggaaaggttcctgctcctggtcaggccatttactctgcctccaaacatgctcttaatggttactttgcttctctgcgatctgagttgtgtacaaaaggcattaaggtcactgttatctgccctggaccgattgaaacactacaatcttctgctgcagcttcttcatcgcaaacacattctgctgagaaacgtgagaaacgtgtttcggtggaacggtgtgttgaactgacaattgttgctgctactcatggactgaaagaagcatggatatcatatcagcctgtgctgactgttatgtacttggtgcaatacatgccaacaattggttattggctaatggacaaggttggtgcaaaacggctggatgcggccgcaaagaaagggaacacgtatagttggagtctcattttcagcagcaagaagtcagcatgaccaaattgctcgtagctgctatcaccatctttctcgattcatatggtcacgtgacttatattgttgtacgcaaaaaggtcggcctgaaaaggatcagatcatgtatagaaacaatatagtttagtgaaaaattggacccgtcactatgaccaataattatgattcagttgtgttagatttattgtgtggcgtaatgatgtactgtgtgtaatatatctttgtaataagcatatacccattttactctattattaatacagctttctaccctgtctagggctaaagttttcaaaaaaaaaaaaaaaatctagctaggttagtttctttcttccccacctcaaccaaatagtacctctgtcgacgtcttccctcgagattgccaggctgccccaagccacgacgctaggctgcgcctcccgcacgagaccacgctcgtgtgacggtgtcttccctcaagtctgccaggccgtgccacctgtcggtgctgctccctctcccctccatcgctggagctctcccccatgtcatggcatggctggcttccttctccttggcagcgagaccatcggtggaggacctcctcttcccttggtggagcgcacaccgctcctctccaccacaatggcgcagacctttctcctggcggcgcgccttgccctgccttcgccccccgtccctttatagcggcggcgcggtgatgaggacatcaacccccaacaaaggaatgactactccaactgaaccagcacaggagccactaggaccactcactcaagcttgtgcacgtgaattaaacttcgtgatgattctgaagaatgaaggaatagaagtttcctaaagtgcatacaccatctatgctcatgatgaatctgcccagaataaagtctaggtgttatgccacctatctatcttttagtttgaaaagaaataatcaagaaggtgtgtac

SEQ ID NO: 3154 - DNA, 1256 bp, Zea mays
ttgagcacactgaagaagttaatatatcactaaatgctgctgctggacggctcaaacaaacctagggaagagagggaccaatttgacgaagcaaacaatcaaatcatatttagcttgaaaaaaaagaggatgacctctcaaaatccattgccttatgtaatgtggaatccaatgggggcaagatctggatcggtttccttgaggactcgtggaagctgcagtcctcatacaatgaacagaaggataataaaacgtgtgatgagctggagaaatgtgtgagtgattttctaaagttgacaaaacatcatctttcagcattcaaggaagtcctaagccaattgattgagaatatcgaaacatatgtcggtaacttggctgtcttaacctcaagggaagaggaaaaagacatggggatgatgaggcatctgagaggacagatccacgtaaatcccttgaagaggaatatctagaaacagaaaagaagattataattgcgttcagcatagttgatcacataaagaaattgttttattctggggaaggggctgattcaaggagagatgacccagaggtcaagagcttaattgaggagattgagaaaatgagggaatcgttcgagtctatagaaaggccaacactaagcatagaatctgagaaagcaaaaccactacctgttgagggatcgaaactgagtccttcacctcttcaggctcctgctaccccaaaagctgcacacgttgactcaccaaaatctcccatgaaacctgagcagcatttcgattcagatgcggagcttgcaaccctgggatcagagatcgggaaagaagacaaagagtactcagttgaggagataagcgggtgggagtttgacgagctcgaagaggaccttaagagctgacacaaagaatcgacaaacagaacacaattcgatttggttatcttcactgacatgtattatttgtctgggccttgcgtgggcaagaaatacacactggttgatatgtacatagtgctgtttgattgtgtattgtcgcgcactcgcgctgtcaatttgtcactgtcttaagatatacggactgagctggtgtaacttgggcgaggcatttgctatttgtttgctcttgccgcgaatatttttatcttacatgtataccgaaccctgttgtaacagttgtaaacgcggaaaacaaaattcgaacatttgacagaatttgctccgtagaacattggattgttgggtttgagttttacattgc

SEQ ID NO: 3155 - DNA, 1405 bp, Zea mays
ctaattttgacagtccataacttaaagcaaataaaataaaatatcttaatgtactttctaggcattggttttcctagatatgttataagaagcgctagccaccagtgactgtagagacttaattgttgttgcacgatctggttaccaattcctctttgctgaatcacatatggtgtatttagtttgaggaatggggcatccatcatcttctcactcctcacatttttgtttgctatggggattggaatggttatctatgatcattcacctcatccttgcaatcacatgagcttccactaaagcccatgtgatataatgatgaacacctcataccaatctagatgagatgttttctcaaacaaaacaccttgatcgcttcatgattagctacataaaaatggatatagaaatttatcataataatacatcttgtatatttgtataactggcctgtttgggtggaagggtattttggtatgaaaacacccacattgtactgctgagaatgactagctgatagagaaacctggctgccatgaactaaccgttaacatggcagcatttcttcactaaacactggcctgccattccttgcatgatctgcgtgacagacagcatggcgcaataccagcacaaccaaatctcgcaaggcatgatcctagctctagcagccaacgtgatgaacctttctcatactggaacatggggaggttccgaagaaatactgcaacttcgtcggtcacacctttgggtgccgctcctgccaatttcggcacgaagaggaacgctgactcgaacgatttcctccctctgaagctcaggaaactaagcggggctatttagtggctgatttatgaaaaatatctggccgaccgttttttgatatgcataagaagcacaagtatgctgttacctgaaacagcatgcagtaatacttaaccacgttagggcttcagaaggctggagatggacgcatttggtggtggcaaccattgtaaattgtacgtttgctcccaaatcgttgcatttggcatcctctgacccactggcctgcatgtttgtatattttttgtgtgatatacggggagatgtcttgtgccacgtttcctccgtggcgtgtacattcaaacaaattggcatcaaacatgtagtaattttcgttctatggaattgtacgttttctgtttgcccccaaaaaaaaaaaaaaaaaaagcagttgcaatccaaaccttacaattctttttcaccctgaagttgcagccttgcaggtgctgcgatgaagccatgctgtagctgtggtgcaactgtgtgatatcaatttgccaagtttaacaagtgtgtaacctattccataaccatggctgaaccgctgaaagggatgcagtctggtatacgtagttctagt

SEQ ID NO: 3156 - DNA, 1896 bp, Zea mays
tcgaaaaagcttctctgccgtcgcctctttctccgcctcgaaggatctagagccgcacgtgctcccaaccaagcgccgcccgcctcgtgccctcgtccttgcgcgcgggctgcagttgttcttcaagtgccgcctccgcttcggcgcggatcgcctcccgttatcccgttcatggccggccgcagcgataagaaaccggcgagttccgccccgccgcggaagggcggttaccctcacggatcggtctacggaagttcttcggaacctcgaaaacaggatgcctgtacattctctccttcggttagcagcaaagattcactgcataaggtggtcacgcttacaccagttcaaccacagaaacctgtagactccagaggcagtcactgtaatgcaggatctgattctggagaggccccatttgatatatgcatgagtggtaacaagtgcgctgtaaagttaaaaccatccatattcgagaccaacagagaaagaaagcagcgagacagagaatgttccaaggatgtacgtccattgcagttgagacctgggatggttctgttgaaaagattcataaagcctaatgatcaggttaaaattgtcaaactttgttcgcaacttggtgttggtcctgggggattttatagacctggctaccgaaatggtgctttgctaaaactgtggatgatgtgcttagggaagaactgggatccagattcatcctcgtatggagatagacgtctgtttgatggtgctcaaccaccgaccataccagaagaatttcagaagttcgttcaagatggcatccaagcttcccatgaattcttgaaacaacaaaaaggagctaccaatgttgtgcaagaaatccctgcaatgtctccggatatctgcattgttaatttctacaatagtagtgggaggttgggtcttcatcaggacaaagatgaatcacagagcagccttgacaagggattgcctgtcgtttccttttcgataggcgagactgcagaattcatgtttggcgatgatagagacgaagagaagatttcaaaggttgatcttgaatccggcgacgtcctaatatttggtggcgagtcaaggcttatattccacggggttaacaacaccaaacctaaaacggcaccaaagtggcttacggacgagacaagtcttcgacctgggcgtctgaatctcacattcaggcagtactaggcaggtttcccccaccttgagcatttgcattggaacagcaaagaacttgctcatgatattctagtactaggcgcagttgggttagttaccagtagagatcacctgtcatttttcttatatatattccctcatggctactcacaaggagatctttctagtcactgaaaaccaccacttaatccattgctactcgcttaaatgtttgtttccatgttcaactttttcattttgccttcatcatgcatgcgagtatacgcggagggggagttcgtgactctactgagagtttcagacactcaattctttttacagggcttcacttgaaatacagtgcatttcttgcagcactgttaatacacaacaaacaataactgagaaaacgcttagtgccgtttggttcacagaatgtaacgtaaatagataattatttacattctattattaatggtaataagtttgaatacgaggatattagtttcttatgtagtaatctctccgttcataaatataccgttgattttttttaaaaaaactttgatcacttgtcttatttaaaaaaactataagtcattatttattttgtttattttttatcatttaaggtagtttatgtttgatttaaaattttatattttttaataaatattttgaaataagataagtggttaaagtttttaaaaaaaaaat

SEQ ID NO: 3157 - DNA, 3484 bp, Zea mays
caaaactctttgcaaaaccctgtttcatattggacaggagatgctccagcatcaaaagtacatcccatggctgatacatctcgccaatctttgcaatctcaaaatgttgatttactagccatgctgcaaccaaaggagaagcctcaagttcctactggtaattcgggtctgccactatgctccaattaccctgaagcaagtatcgttaatcccaacttgcatagtggagatcttgctcaaggggcccttaatatgcgtcaagatatgcagaactcccagaacattggtattggagttcaacaacacaacttaatgccacaaaaccgaccagctttggctcagttgccatctgagaagcttgctgagatgtctcaagatccacaactgttaaatatgattcgtcaagatctgcagaactcccagaacattggtattggatttcaacaacacaacttaatgccacaaaaccgaccagctttggctcagttgccacctgagaagcttgccgagatatctcaagatccgcaaatgttaaatatgcttcagcagcaatatcttttgtcacaactacaggtgcagtctcagacaccttttacacctcagcctccactctctatggtggacaagatgttattgctcaagcagcagcagcagcagcagcaactgcagcagcagcaacaacaactgcaacagcaactggagcagcaacaaaagctattgttgcagcagcaactgctctctcagatggtgcctcacgcgcatcctaatcaacacactgatgattcttatgcattgaagtatacttctgtgccatctgatgattctaccagtcttggttttagaagaatgcaagaggctattgaagtagatcagaaattttctgtccatggtatgcaagtgggtcaacaacctagtcagtcaattatgaattttagaaatatggatggtatagctttattgcaaaatcctgtaactgcactgccggtgccccatgaaactgctgtgggtgcacttccaaaagaggaccactctcgtcctggaatgtcggaagattttgcaaatgtcgacttacaattgaaatcaactatggtacactcaaagctggtggaagttgcagataggaacgagggttttaaatctcacgaagtggacactgcagcagaaaaaaataaaatgtctcattgggacccgcgtgcccggccggctataatcatggggagtgcttctgatgaagctaagaatttgcatgaaccaccactagatccaaagtcagaaaatttatcttctgatatttctggtcaggttcaagagtcaaacctgtctgcagaagatacgcctcctggcatcacagcagccgtggcaactgaagtaaaagttactgatacacaggagaccaaaaaagcagaaaagaaaaggaagcaaaagaaaactcgcgcgcctgcagatgctggcaaaggaacatcaaaggcggttgtagcccagcagccaagggcaggaaactgaggttgacaattctgatattggtggtaataagcatgatttaacagatggtacagaggaactattttggggttcacctatcacagtgcaaaatgagattttaccctccaaaagttttccagaggaacatgacgctgacaaagctgaatcgcagtttagttctctatcatctgatcctcatagcatggcaagccagcgtgcatggaaacaacctactcaaggtctcaggcctaagtcactgctagaaatccaagctgaggaacaactgcgtgcacagaaaggattaactactgaaactgctaagccagcagcttcagttccttcaatttcttggagtggcatgtcaatatcttccgagcaacattatgggggttcaaatatatcattgggaagtatggaaagtgctgttgagagaaataaaagaagccagttgcatgatttgctggcagaagaagttctggcgaggtcaagcattgcagataatgagaataatgccaatgatgcatttttctctcctctgtcgcctgctgctgttcaggctgatgctcctgcccttgatgataatgacttcattgaggccaaggacaaaaagaacaaaaagaggtcagcaaaaacaaaagcttctactgtgaaggctccatcacctgttgtttcctttgatccaccagctatttcgatgccttctgaaaagggaaagtctgccaagcaagcacaacaggagttagaaatattgccagctccaccaagtggtccatcgtttggagattttgttctttggaagagtgatcagactagctctgtgcctgctccagcatggtctaatgactcagcaaaggtgcagaaacctttgtctttgagagatattcagagagaacaagaaaggagaaccgtatctatccagcaacaagcaccctcaccaactccagcaaaggtggccccgaaccaaagaagtcatgtgaatgcttcttcctggcaagcttctggaccacctccatcacaggcagttgcccctgtccaaatgagttccaatgctcccagtcattccaggtcaagtgctgaagatgatttgttttggggcccttctgagcactccaaacaagatacaaagcagtctgagtttccaagtctgttgagccaaagcagaagttccatgatgaaggatcattctgcactgaatcgtcaaaagtctcaggcaggcagattaccagttccttctgctgctactgcaaaccaatctggcaaagggaaagcagaggctacaaacaagcagactgaggcaatggacttcagagattggttggagagtgaatgggccaagcttactggaacaaatgatgtaagcttccttgagttctgcataaagcaatcaactaccgaagcggaaatactcctccatgagaacattggttcccttgaccgcaaccacgagttcatcgacaagttcctcaactacaaggccttcctgtcagcagatgtgatccacatggccttccaagctcccagcagccgtggtgacggtgcagggtgggcaaaccctgctgctgcagctagaggaggcacggtcatagacgcggagctggatggcggcgggaagaaaaaggggaagaaggggaagaaggtgagtgccgcagtgttggggttcaacgtggcgagcaaccgtataatgatgggcgagatccagaacgtggattaggaggatggcggcacaccaacaccaccgtgtatataacatagtttggcctttggttacatgccaccgaagtctcagggctcgagggaagctgggggtgctcggaatggcggtctggtctacctgtttttgccgagggtgggaaactgagcttagatacagggtcatgtgctggtgattttgggttcctgtaacaattggttaggatcctgtaacggacagaaatattttcttcaatagaaactcaccagatggattcagttcagtagttaaaaaaaaacacacacccccccc

SEQ ID NO: 3158 - DNA, 554 bp, Zea mays
gagttcattgacaagttcctcaactacaaggcctcctgtcagcagatgtgatccacatggccttccaagcccccagcagccgtggtgacggtgcagggcgggcaaaccctgctgctgcagctagaggaggcacggtcatagacgtggagctggatggcggcgggaagaaaaaagggaagaaggggaagaaggtgagtgccgcagtgttggggttcaacgtggccagcaaccgtataatgatgggcgagatccagaacgtggattaggaggatggcggcacaccaccgtgtatataacatagtttggcctttggttacatgccaccgaagtctcagggctcgagggaagctgggggtgctcggaaatcggaatggcggtctggtctacctgtttttgccgagggtgggaaactgagcttagatgcagggtcttgtgctggtgattttgggttcctgtaacaattggttaggatcctgtaacggacagaaatattttcttctcaatagaaactcaccagatggattcagttcagtaaaaaaaaaaaaaaagcggcc

SEQ ID NO: 3159 - DNA, 1711 bp, Zea mays
acgaccagcaaaccaccggaccacacccgtctggcccacagaacaagcgaaacggatagaccaaaaaaaggaggaagaatacctagtagcgggcgacgcggccgcgaggcaggcaggtagaccacgccgcacgccagccagcggccagcgcccgccccgccgcgcttcggcattttcccattttctctctctgccgccgctccctcccgcggcggactcgataccccgcctctcctctcgcgaactagggggcagcgggcaggtgccggcaggcggctcgatcccttcctcctccctcgtcgcggggactgctgctgctgctgccgtgaccgcgagcatggccaccggcgccgttacgccgccgccgctggctggcgcgcggcgattcccccgtggacgaagcttcctccaccggcgcctcgctacctcgcctatgaaagatgaatctgtgatttccacagatggtggaaatgaggagacagacactgacagcctccatgttgctagaggattgtgctcatcctgggctttcgtcaagtttatccaataaggcatcagtggtcccaacccctttgcttccttctggacaatctgatctccggttcaatcgtcttcgaccctcaattgatgaaagtgattgcaaatacaaaagattatttggctgctatgttgctcgtgaggctgtgatcgatgaggaatactggatcgctgcatggttgagagcagaagatcagtatgaaaatgagtcaggcaatcgctatgttgaaagctttaaaagaaagtttgcatcaaaggaattccatgcattaaagaagagatgcaacacacaacatagagagaagtatatctgtcttgtcgcggtaaagaacgatgacatcaggcgaactgtcctgaatagtgttgttggtaccttagatgtatgtgtaaggcatcctctatatggggagaaatttcctgaggagcctggaaaaccgtctcttcactgtcgaatttatcagcctgatcagccaaaatttgggtatgtaacaaatgtatgtgttgctaaatatgcaaggcgtcaagggattgctagcaacatgctgttattggccatagatgctgcaaaacttaacggtgctgaaaatatttacattcatgtgcataaagataacttaccagcatggaggctctatgatcagattggattcaagatcgttgatcaggatgacgattgtcgttcatcagacctgtgcttactctccttcagttcataaggcttgctgactagataggaatagaagggacatggcccctagttccatctccctgtccagggaaatgccatcagtcctcgcgatttggaaaggcgggatggtatgtgccaagtaataccttcaccaccttgtatatgatgaaagtgtttccaaatgtttgcggctttcgagattgtcactagatcggtggcagttcagatccaccagaatgtttgaggtatctgaatacatcaaaagcttctgtcgtgtatagtttgtgcagtcagcaaagagcaaatgtttcttcgttgcccctgtgattcggcaatgaaaaattgaaaatacatgatgtcggtacctgatactgtgactgggctcttgttgctggccatatacaattgcaagtctttgacacccatgaacataaatgcttcatgctaataaacagatttatttggtttgaaaaaaaaaaaaaaaaa

SEQ ID NO: 3160 - DNA, 1960 bp, Zea mays
  misc_feature (1958)..(1958): n is a, c, g, or t
gccggccggtcccgaaaagacgttggggccctcgcggccggccgggcccgatctcccaccaccaccactgaacccgctgcttcccctcctccacacctctcggtttcgggaaacctctcccccgttcccctcgaagcctacgggctcggggggcttcgatcgaatcgaatcggatcggatcggaagcatggagatctcgctcgaggcgtcgtgggtgggcgtgcagcggcacgggcaggacctggcggaccgcctcgcgcagggcttctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcgagatcggcggcaggctcgggcaggcggggtccgagctcggtgcggcggttcagcatctcgcgcgccaggtgcctgtgcctgtgcccttccggaaatgggaagccgcacagccgccgaccgtggtgacgggggatgttgcgctcgctgtggggacggttgggtccgcgaacgtcgctttggaaagggctgtagacatagggtccctcgaggtggcagcggctgctgctgcggcggccactggaagtgccactgcaggtagtgtgggcgcggttggggccatggacgacgatagactggatgatgaggaagacggatttgattgcgaaattgggacattggagaacattaagaaggctaagggcactgtaaatgtctcagcaacttacaacaccaggcaccatgactttgagagttcagtagtcgcacgaggagacctttggaggttggagtcatcgcgtggcaatttaacttcagggaatgatagctcaccacttttccttgttcaacttgggcctttactgtttgttcgagactccacgcttcttttgccggttcatctgtcaaagcaacaccttctttggtatggttatgatcgcaagaacggaatgcactccctatgcccagctatctggtcaaagcatagaaaatggatgctgatgtcaatgatgtgcctcaaccctgtagcttgttccttcatggatgtgcaatttccaaatggacaaatgacatatgttgctggtgaggggataacagcaagtggttttatccctttatttggtggattactccaagcacatgcaaagtgtcccggtgatacaagagtgagcttctccttcaagaacaaacaaggtactaggttcagtccaacgtttcagtggcctgacaattctgtttcatttggagtcgcacaagctgtagcatggaagagatctggccttatggtcaggcccagcattcaaatcagtgtttgccccactttcggaggaactgatcctggaatatgcaccgagtttgtccactctttgaaggaggaagtcagcgtaatgtgtggtttctcttgctcaagacatccctcagcattcacagctctctctcttgggcgatccaaatggaatggccaggtcggcagttcgggactagtaatcaccttggagacaccccttgacaacatggcaaggccttctttatccgttcaattgaacgggggtttcgagttctgacatttcccccgtgggctctagaatacaactgtatatactgtatctcatagcgagaagatgatatgccactgtatatattgcacacatgtagctgtgattaagtagatatcttcccaaccggtgaagtgtatagtcctaaaaacagacaaatggcttactgttttggttcactgaataaatttgaaggcttgtatgtcgtacctgtgcgttcgaactatttgtcttcttcaataaaaattgtagtactcctaaataaaaaaaaaaaaaaaattgcggccaaaaaaaaaanag

SEQ ID NO: 3161 - DNA, 3368 bp, Zea mays
  misc_feature (3259)..(3259): n is a, c, g, or t
  misc_feature (3264)..(3264): n is a, c, g, or t
tgtaattttcataatctactactaggtctgtgcccgtgcgttgccacgagagtaaaaaatagtataaacatagatagcacaatacccgtgtgttgcaacggtatataaattgttcaacaaaatgttagtgcacaacgattacataaaagcgaacaacacaaaatattatcgacctcactatcttacagattccatgtgtggctctcactgcatgtccggtggtggcaccccatgccatgtcactggcgtgaaggagttaagatctgtggatgtggccccatgcacaactgtatggaggccagctaagggatggcagacacatccgagtttctgcttgggtatgttaaggacatgcttagtagctccaaaaaagttgtctgacataagaattagaaaattaaaatagttaccaaagatgacagatataaatgaggaagggccacatccttcagccacaattgatggtaaaaaagttgtctctcatcaaccttgagcaagtaatagtaaagcttatttgttccaattaaatagatgtcacatgccagtgattggttcatagtaaccttgtcacttatgtctttccttttatctaatccataattcttttatttaaatttccattactttgaagtcgctaggtctgtgctctcagatacaactaaacattcacacatggctttacctttcttgatctacacagataaaataaattaaaaataaggcaaaaagacaacactttctataggctgccaatcaggtgaaaaaaacaggtaccaactcaatttggcgggttgtgaatctaaatgtaaggtgaacgagcatcaccatagcagttgaagtcaactacaatgcgctacctctgagactaatattacctcaaataaaaagtcataatctacaagatcgtagtttttttttttgctatccgactttaaagatttcatatatatacattttatcatcatatgagttcatctataaaagttatagattttcaagataagttgatagagaaaataaaattctggcaattcatcgacagtaagtatttcccgttggttcatctagcggcagttgtataattttgtattttctttatttggacaaatacttttgcaaaaaatgtttttataaagattaaaaaaactcatacgtacacggtagtctggcccattaaagggtatgggcccatatgttctaagttctaaccctaaagtagcacccaccaggccgcagccctcgctcagttggccggcctcgccttcgcatccgtccggccgcagtcaacctccggttcggagttcccattccccaccaaccaccgtctccatcgcaccgtcgcactgtcgcctcgccggccgcacctacgccgttgaagtcgctgtcgcagctgcaggtgcgggcaacacgtgacctctctcaaggttatcctatctttgtcagtccgtattgtattcgtttgtttcccccacttctttttgtccggttctattcaatgatgcttctgggccataggctggtgccactagatttttggagtcttcttgctaaatcagggataagaccgccttgttgtttttgtgcctcgctagatcgttccgtaagggcacccatcgtcatagatacgattcataggttctgccactacttgtgcgcggagagccaagaaatgcgtcaggggttgtgaagggaaggagtgccgatggccggtggccacccggcgccgctgcggccggtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggctgctcaacgacctctcctacgccgtgctgtggcggatggccgagcgccaggtaaggctcggactgtctgtcgtcatcgattcaccgctgtcacgccgctctcacctcgacatgctgacacgcctagccggtgtgcttgtggtcgtcgtggagtgtcgccctggtgataacgaggaatggcgccggaggctggagagccgtgggtcggctgttgccaatggtggcggtggtgatggatggcataagccaaagacatgggctgagctggagaggcttctggaagggtaccaaggttgcacagactatgaaattggagatgtaccgaggattgtagtggatacaactgatccgacagttgatgaacaggtggtagctgaaaaggttgtgggttttcattagatcccatcttgcttgtagccaaccatcttgtgggagacaggattcacctgtttgccattagaaaccaaaatgtacactagcttaagcattaggtaaagtttcgttgcaaaaggttgatctgttgtactgcaatgctcaaagttcttttttttatgggtgtaacctaaaggttctgttactgttgggacttcaaagggattttgttgttgttgttgtgtgatctagaggtttcgtaaaaagatgttcttttttctggggttgttcctcaatctcctatctccattacatctttcacattccaatgaaatggaatatgacttttcagcatccatgtttaggacggaaagggcttcaacaagtgtgctaccaactgtccaactaccaagataagcatgcattgctgttttttctgtagtgatagatgcttttatgccaccatttggttcattttcacatgttttctttagcagaatcagtatggaaatactgctctttttttgctgtctttgttccattttctgtactatcttctccttttcatgatctttgttttggaaattgcgacatcaaatcccagtcaatctaaactttgtatgcttgcttggtttatctagtcatgtattaatactcatcacatttcagtgtctgctttgcaaaccaaattgatggttaagtgcttgcctatttgttctgcctgatttcatcgcagctcagttgtatgattgctgggtttcctacttttcagcttttgttttccgtttcatgttgtagtgttgctgtgtttcatgttttgatgagttttgttcatttatttgtagaacaacactctgtgttggtgtcaagatctatagagcaggcatttctagtaagtataggcttgagatgtgatgtttaccttctttatctaaataacattattgtaatgagctgtcaatgttacaagactacagaacaaatgcactgcattctattttagctaanaggtntattctttggaaaagaaaatgatgtgctaattagcttagttctggggacttcaggggttccatgccggcctaacctattggaacgacttgttagttgttattcc

SEQ ID NO: 3162 - DNA, 1680 bp, Zea mays
gggtacctcgaggccggccggggatgcaaacagcaccattcggtcgctccagcttttgtgcacgtccactgtgtccctcctcgctacccccgctttttgtgcgcggtggcaacgtgcgacagccgagaggcagaatgacgaagcaagtggtggtggtggacacagctctggtggcgccgagcgaggagacgccgcggcagccgctgtggctgtccaaccttgacctggccgtgccgaggacgcacacgccgctggtctactactacccggcgccgggcacgggctccttcgcgccggaccggctgagggccgcattgggcgccgctctggtgccattctacccacttgccgggcgcctcggcgttggcccggacggccggctgcagatcgagtgcaacagcaagggcgcgctcttcgtcgtcgccaacgcagacctcaccggcgcggacgtcttcgacgactacgagccgtcgtcggagatcaggaacacttttgtgccgttaggggagtccggcgaggcgaacaacagccccatatccatgttccaggtgacttttctcaagtgcggcggcgtggtgctaggaaccgccatccaccacgcggccatggacggcgtgggcgcgttccagtttatgcagacgtggtccggggtggcacgcggcctggacgtggcggaggcgtgcgggccgcagccgttccacgaccggacgctcctgcacgcgcggcgcccgccgtgcccgacatccgaccacttcgtctactccccggcgttcctcagcggccgcccccggccctacgtcacccgcatctactccgtctcgccgaagctcctcgccgacgtcaagtcgcgctgcgcgccaggcgtgtccacctactgcgccgtcaccgcgcacctctggcgctgcgtgtgcgtcgcgcgcgggctagcgccgggcgcggacacccgcctcggcctgccggccaacgtccgccaccgcctgcgccccccgctcccgcgcaccttcttcggcaacgccgtcgtgcgcgaccacgtcaccgcccccgtcagcaccgtcctcggcgcccctctcgggtccgtggcggagaccatcaagaaggcggtggaccgcgtggacgacgccttcgcgcggtcggtgctggactacctggagctgcagaatgcaggcggcaagcagctgagcggccaggctcaggcccaggcgcccagggagcagctcgtaccggcgacggacctgtgggcggtgagctggctggggatggccatgtacgacgccgacttcggctcaggcgcgccgcggttcgtcgcgccggcgcagatgttcggcatcggcacggcgtatatgacgccgcgcggtccggacagggacgacggcatcgccgtgctcatctctctggagcccgagtacctgtcgtgctttgagaaggtcttcttctataacgagtgatgtctcaggtctggagttcaaggatgtgaacgtgtgaatctccgttcgagtagtaagctatttttcctttccctttttttttgtacgtctgagcggtcccaccgagtattctaggtattccttgaaatacttattgttttggtcaaataaataaatatctgccttgcgttattgaagaaaaaaaaaaaaaataaaaaaaaaaaaaaaagctcaaggggggccccggtacccaatt

SEQ ID NO: 3163 - DNA, 1411 bp, Zea mays
attgggacctcggggccgcgggacgccccgacacgccgcctccctcgttctcgcgccgacgctcgccgcaccgcctccctctccctcgttgtcgcgccgcctccctgtccctcgttctcgagccgccacaccgcctccccagccggccaggtaacacacggcggctcttccctgctgggcttcggagctgccagtctgccacgccgccgccccagcagagaggcgagcacccccgccggcgcctcggagctttgaattggctgggcgcgcgaccggcctctgccgccgggccgcgagcagcagcaacccccctcgccggccatgacctccgctcactccaagctctactccgatgacgtcagcctcgtcgtggtcgtcgtcgacacgaaccccttcttctgggccgccgcggcgctccccttcgccgacttcttcgcgcacctgatccacttcgtgaactccctcctgctgctgaaccacctcaaccgtgtggtcgtcatcgcggcaggagtcagctcgtgtgcctacatcctggattccagcgatgccagcccctccggtggtgtggccgtctcggacaccttcgacaaggcaagccgcaaggcggaggagttcattgcacaagatgcgcgcgccactgcaggcaacggttccgttgcttctgccaatgccgcgtcgctgctctctggggcgctgtccatctctttgtgctatatacagaggattttccggtctgggtctcggcatccacaacctcggattttgtgcctgcagggatctccagacggacctgaacaatatgtggcagtgatgaattcaatattttctgctcaacgttccatggtaccaattgactcttgtattgtgggaacccaggattctgctttcttgcagcaggcttcgtacataacaggaggagtttatttgaagccacaagaactaaatggcctatttcaataccttgccgctgtatttgcaactgatttacactctagagcttttctgcgccttccaaaaactcttggagtggacttccgtgcttcgtgtttctgccataagaagactattgacatgggatatgtctgttcaatttgtttgtcaatattctgcaagaatcagaagaagtgttcaacctgcgggtcagaattcagtcgtgccatgcctgatttgaactccgtgccggatcaaagcaagtagtgtccagtgcgaagttaacccatcaacagacaatgcttttctctgtgcgtctcacaggttcctttcggactagcaccttcacgtgtgcagtgtgtacgagacgtttctttggtcgatatgtgaatcaatttccatgtctgaatattatcggggttttttttaaaaaaaaactgaaactgcagaattattttccaagtcgacgcggccgctagaa

SEQ ID NO: 3164 - DNA, 3594 bp, Zea mays
cctgcaggctgaccccactttcatcccctcaacaagccagttagccaccaggaaatcgaaaacccctgccgcattctcctccaacggctatatttgtcatgagcaccactgacacgctggccaaactcgctttctgatctccaaaataaagggtaatccccgaggaaccgattcgaaacaatcaaatagctccaggactctaacccaaagaactgagcgagccaaatcgtcgaacagatggaagccatggacacggaaccgtcctcccctgcgccggcagcagccgtcaatctgcctcctccgccgtaccatcactgcccagctccagctgatgaggttgcagcgacgccgcagccgaagccgaagcaatcaaccgcggggccggggctgaggacaccctcgccgccgccgtcggttcaggtgtccgggtactctctacacgacctgctgctgctgtccccgccacccccgagctcacgccgccaccggtcgagtacgcgtggggcagctgggacgagcgtggacgagagcctggagattgttgcggtggcggggacgcccacgcctccaaggcgcaggcggcgcgggggcgcggagcagtgtgtgacgcccgttctggcgtccccgaggaatgcacgacgggcgagacggaggctggagaaggacgtcgaggcggttgaggacgccggcaggagggcccgcaggaggaagtccacaagggctgcgccgaaagctgcagcggctgccgacaaggcagaggcggcgctgaacgaggaggatataaccatggctgtggtcccggcttgtcctgctgctacctgcggtgagcaatggtgtctcggcctgctcgtgatggctatagcctttgggatgtctgcttcaattttgctaaggattccactgtgattgttcctcttttggcacgtaggaactgacttcctggagcaatctgacttggaaggtctctgggaaaggatcgttgaattggtgatgtggaggaatatggctaaatcagcactttggttcggatttggatcgatgttcttctcatgctcattgtcaagagacgtcaccttcaggcatgcgaatttcgatattcaatttacccgaaagttattggttcacctatgtatcttcgttgtaatctggtacctggctttgggtgatgatttgcagcccaatctcagctctctgtcacctcggcgttatgatcttaggcttagctttcttcaaagattctgttcctcagaggtatgatttgattatatttgaattttgacttgtccaaaagatgattgaaccagaggtaatatgagtttgcaattgggcaggccgcaggtggagaatgagagaaggttccggttgactgaagaagacatgcttcgtgcttctcaagctgtgcttccgtttgcaaactccatgatatcgacggcgcaagtgattttctctggtgaaccttcaatgactctcaaagtgagctccaaatttggttcagatctggcagcactgcaagagacatttttcttaataattttaggagcctgtgtttgcttgaatttcaggtattgcctttacttctgttcggtgctaaatatgggggccttgttacagtgtggaggcttttagctgcaggtataatcgaatgcacaaggtacaagcaaacagtcttgccatgacttttgtaatataatgttgtgtttgctgcaaactgcaggatttttcatctagttttactagtccctaaagctatatagctgttattcaagtcgtattcataaaagaggtgtgattcacttaccagtaatgacacttttgttctctctagcaatccttctcatcataagactgaatactctctctcttttttttctctgttacctctggtgagattttgagagatcaggctctagaagcgtggaagtcttgcccacgcaaaaaacttgttgcagctattatagtaacaatgttctggaacatgttcagtgtgaagacacgcgtcatggcaggtatctctaactaatctggctgacatgtgcagtttccatgaaacatatcctttactatttacaagttattaggtgatacaattttcagacgtgcaaatattgagttattatatatatcatgcaaaatgttgaagtttgcatcttcatgaaaaactgatttctgcttaattcaggctaacgtgtgggtataaaactgttgatgcttgaaattgttaaattaagataatttgcatgtttcaaaaggcatttaaggctttaagctacaccttagttatgatgattaaagctgatggccgatgtacaccagcagtgtccacttgtggtgcaaagttaaaatagggaacacaatgtcatttgggtatgtaataaccatactacttgactcacaaaccaattgtgataagaaaagaaagacttgtgacagggacagtgggcccttgccacttcactagaacagtttgctcaaaatatgtactgtgatgccaaattcagcaatctgccaaactttatgttgtcagtgtgtaatttcaggattgcacgaccaaaatgttattggtgtagcgctgtttattacataaacactattgaacttgaaacatgtgcaactaagcgcctgtttcgagcggtttctctaggctccggctactctactatagcagcgatgtggcggagccaggagaatccccaaatatgcggctcccggccggtttcctcccagctacagtgtagcctacagtaaaaaactgtgatgcacaattgggagtcagaaccggaacaccctaataaaggagcaccaaacggggcctaaaatctgtttcagttcgttgtgattcctaaatgatgtatggattgctttttagtatgagagcagttgttgttattctctttccctgcactcaagtaaaaagaatcatttgttctcttaataaattaacatggacgtatatcttttgtccagcctttgtttcacttgtaatactgcgctataataagaaacacctcaaggcagcacaagttggaagttaccgagatgagcaggggcagacaatggagatggatagctaaaattttcagtactatgcggtcctaatgatgtagggttgtcagagtgcagccacaagtactgctactatttctgtacaataatattcagttagttccatgtctagtggtcctactagctaagatgtattttctgtacgttgcataagggagcctttgcaaacaatggagatggataaccaaagttttcagtactatgcagtcctaaatgatgtatgattcccagagtgcattcctaaatgatgtattattccacagtgctgctactatttctgtgcaataatattcatttagttctgtctagtggtctactagctaagatgtattttttgcatattgcataaggctgtatcaacggacaaccggtgacatagcggcgcgggcgatcggtactgatcgaattggctccaactccaattggctcagttggtcggttaattattagtcagtttctgggtcaattctatttaataaatatagcgggtgtccgattcattcacaccacaacagtaggtacaattatttc

SEQ ID NO: 3165 - DNA, 3787 bp, Zea mays
gtatatgttgtttttgtcaaaataatgggtattcaattgaataccattgaattgagccaggcccgcccctgatactgtatacaattacagagtgaatctcacaatgaggttgctggcgtatgtaaaccctactgtggaaagagaaataagtcgcaagaaaacaagaaagaaaggaaatagcatgtgggaggaagagcaggatgagcaaataatctgatagaacatgcaagttggtggaatacttaaatggtctgatgaacatgcagtcttttaacattttgtctgtgtatatatgtggcctagaactcttatttgtgcttccgcttcaaaatatcgtcaactggacaactcttcgagcaaagcttccccatcagaatagcaggatttttgtacaaaggtcattagtcatatttgctatcatcgcgtcgtcatgttgcctctcgaaagccgatacattagttaaaagttcgccgattgtacatcaccaaggtaagaatgagctcacttccgcatttccgcctgctcgacgcgcctccaaaaaaaagtgctgcggaggtatggagctgcgcgctgtcctcccgtgaaccccagaattcagacacccttgcaccctttcgtgccagctctgccctcccgtgaaccccagaatccagacacccttgcaccctttcgtgccagcagagctgcagaggcatggagctacgcgctgcgctcccgtcccaatcttccctgcagattccccgcctccacctcctaggcttaatagatagacctcatggtagctttctatatggggatctttagaacacgtcttgatgacagctgaggatataactttcccaaacctttgacatagacaaacttgacatttatgagatgcaatcggggttttatgagcttgtttgggagtgcttttaagagcttttctgagaatatagatttctagataatttagttgtcatgagaatttgaatatcgtgggatttacttgcaaaaaagatctacacggtttagggtttaggaaccgatagattcctctcgttgcgatgactcaacagatttcacgattttcacataagtgctcacaaaagatgattgagaagcaaagtgtttgacagatagaagccgattttgacagccagaagttagccagaagccaaaacaaacatgctctacattgtctttctattattacatttttaatttaattatagaaactccaaaatgacccgatctcgaggtgaatcctttggagctactaggcccagagacagcagcgtgctagtctgccgccgtcacggcccaatttaacccagcccccaggaacttaaccctagtcccgacccgtcccaccctatcagttgcgggcgcgcgtccctgtttcgctcgtgccgttgcgctgcgccaagcctccccacctctctcgtctcttctccacccgccgccctcgtgggagtgaaaccctagctagggttctgcccgccgccgccttcgatcaagacgcctgcagccttagcgcgagcccgccatggacacaggacgcaagcgcatcgcgccggggggcgccaacggcgcgggcggcccgaagcgcgcgagaggtgagcagcttctctagctccggggaatatggattggctgttgcttcacggaaggttcggctctctagggtttatagctggtcttcgttggtcggatctgcactccgtcgttcgcgacttcgctgggaactgcggagatccgtggcttttgctgctgcattggttttcgtgttttctctgattattgggagtattgggagtttggaaagacctagaatgtttttcgtgttttctctgattggtttacgtggtagctgaaggcttgatctcgtttaggtctatccacgggattttgctcgctggacgaaaatttgagggatgaaacgagacgtagttgacgtgctagattgagattgctactgttctgttttgatagatctttcggccttttaatgctttgttgaacttttaatgcttctttgctgggctaggtagaagttctccttttagtgctttcagtggtttaagcaagtatgatttttctaataacaaatcattggattggaccactgcttgcatactggaagatataagcagcattggtgaccttttaatgtgataatcccaatgtttcttcaatgaattattatctatttatattcgtattactttaccaagcgacatgatttagtaaagcaacacattattaattggcggaagtaataaatttggtgtaacagaatcggagacaactcaaatgggtgtaggaagcaaaaccaagccgtgcaccaaatttttcaggttctaatctagcttaaaatgaactctcatctggtaacatctactatcattatatgctattccttttaattaaaatttgctatgttattaaatgatgtgcttgatgctaacaaatgggtcagcctagattctgatacaggttggttttgtctaatcattgcttaagaacactcaacggagtaaaaattggaatctactgctgtttatcactgaaaactgatgcaacaagggaacatactgctgtatatcactgaaaatctgaaccatccaacaatggttacaaggaaaccttccccctcccaaaaggaaacaattcagtccagtaaccccatggaacagggttcacttgaagaaatcaagaagattagattgaacatggggactgtgattcagttttttgtgaatcgtccagttatttgttcaattacacttatcaatatacattgcagtagtagtacttttgaacaccaatatctttgaacctcgattatgtatcccatctttatcaagcatgatttgtataagattggttcgaatcatttacttcagtctttatgcattcattgcacatatatttttagcagtcatctagtgaggttacattatccagctgcatgcaacataatctcttcaatcaacatttttttgcatgtgtatcgactaatatcagtctgtaggttgtcagatatatttgcatgttctgttgcttatattatgctttcaatttgcagcactgcgggttgtccctttggttcaaattgccattttctccataacttcccgggtggctacctggcggtttcaaagatgaccaacttgggtgggccacctgttccggctcccccaggaaggatgcctatgggacctggtggtcctgatgggccaccttcacctgctctgaagactcgcttgtgtaacaagtacaacactgcagaaggatgtaaatgggggagcaaatgccactttgctcatggagagagggagcttggaaagcccctgcagatggacaactcgatgggagctcctccaatgggtccagggccaaacggtcacttcatgccaccgccaatgcctttcccagacatggttcctccctccacattcggtgcttccgccacagccaagatcagcgtcgatgcatcccttgctggtgccatcattgggaagggtggtaccaacacaaagcatatatcccgagtgactggggccaagttagccatccgggacaacgaggctgatcccaaccataaaaacatcgagctcgagggaacatttgaccagatcaagcacgctagcgcaatggtcacagagttgattgtccgcatcagtggtaagccgcctccacaagccaagaacaacccaggtagggggcctggttctcatgccgggggtcctggaagccacttcaaaaccaaattgtgcgagaacttcaacaaaggctcctgcac

SEQ ID NO: 3166 - DNA, 1467 bp, Zea mays
cattgggccccgagtccccgcccggcgctcgtgccgttgcgctgcggcaaagcctccccccacacctctctcctccacccgccgcccccgcgggaccgaaaccctagctagggttctgcccgccgccgccgccgcccttcgatccagacgcggccaggcttcccgcaacaccgccatggacacggggcgcaagcggaccgcaccggagggcgccaacggcgcgggcggccccaagcgcgcgagagaatcggagacaactggtgtaggaagcaaatccaagccgtgcaccaaatttttcagcactgcgggttgcccctttggtgcaagttgccattttctccataacttcccgggtggctaccaggccgtttcaaagatgaccaacttgggtggaccgcctgttccggctccaccaggaagaatgcctatgggacctggtggtcctgatgggccaccttcacctgctgtgaagactcgcatgtgtaacaagtacaacactgccgaaggatgtaaatgggggagcaagtgccactttgctcatggagagagggagcttggaaagcccctgcagatggacaacccgatgggacctcctccaatggggccagggcccaacgggcacttcatgccaccgccaatgcctttcccagacatggttcctccctccacattcggtgcttccgccacagccaagatcagcgtcgatgcatcccttgctggtgccatcattgggaagggtggtaccaacacaaagcatatatcccgagtgactggggccaagttagccatccgggacaacgaggctgatcccaaccataaaaacatcgagctcgagggaacatttgaccagatcaagcacgctagcgcaatggtcacagagttgattgtccgcatcagtggtaagccgcctccacaagccaagaacaacccaggtagggggcctggttctcatgccgggggtcctggaagcaacttcaaaaccaaattgtgcgagaacttcaacaaaggctcctgcacctttggagacaggtgccacttcgcccatggcgaaggtgagctgcgcaaacctgctgctgcttgacaggcatgcttattgtggcctgtggtgattaatctgcctgtatggctgaataacaccatgaccaaggacagtggcgccagcgccatggtgaagtgtgctgagccacatgctgcctgagagagagcatttccctgtggctcgtatttgatcttaatgctgtaacaaactctcctcgatggagattaagcaatggccgtttatttaggatttgtaggattgccgtattggtcacccttttatctatcctgtttttgtaccgtttcttaggcactcttggctggcagatcattgtgagtctgttgaacttgagaatagttgctattgatgttatcggtttgtggattcttactagctcaaaaaaaaaaaaaacggctaataaaaaaaaa

SEQ ID NO: 3167 - DNA, 1836 bp, Zea mays
atagtcccgacccgtcccaccctatcagttgcgggcgcgcgtccctgtttcgctcgtgccgttgcgctgcgccaagcctccccacctctctcgtctcttctccacccgccgccctcgtgggagtgaaaccctagctagggttctgcccgccgccgccttcgatcaagacgcctgcagccttagcgcgagcccgccatggacacaggacgcaagcgcatcgcgccggggggcgccaacggcgcgggcggcccgaagcgcgcgagagaatcggagacaactcaaatgggtgtaggaagcaaaaccaagccgtgcaccaaatttttcagcactgcgggttgtccctttggttcaaattgccattttctccataacttcccgggtggctacctggcggtttcaaagatgaccaacttgggtgggccacctgttccggctcccccaggaaggatgcctatgggacctggtggtcctgatgggccaccttcacctgctctgaagactcgcttgtgtaacaagtacaacactgcagaaggatgtaaatgggggagcaaatgccactttgctcatggagagagggagcttggaaagcccctgcagatggacaactcgatgggagctcctccaatgggtccagggccaaacggtcacttcatgccacctccaatgcctatcccagacatggttcctcactccacattcggtgcttcggccacagccaagatcagtgtcgatgcatcccttgctggcgccatcattgggaagagtggtatcaacacaaagcatatatcccgagtgactggggccaagttagccatccgggacaatgaggctgatcccaaccataaaaacatcgagctcgagggaacgtttgaccagatcaagcacgctagcgcaatggtcacagagttgattgtccgcatcagtggtaaggtgcctccacaagcaaagaacaacccaggcagggggcctggttctcatgctgggggtcctgcaagcaacttcaagaccaagttgtgcgagaacttcaacaaaggctcctgcacctttggagacaggtgccactttgcccatggcgaaagtgagttgcgcaaacctgctgctgcttgatagatgtgtttagtgtggcttgcggtgattactctgcctgtgtggctgaataacaccacagtcgcctatggtgagatgtactgggccacgtgctgcctgagagagatcatttccatcgcttgcgtagagacaatggccgttttttaggatttgtaggattgccgtattgttctgttcgatttatatctaaccctgccagaatcctatttttgtaccgtttcttagctactaattggtgccagatcattgtggttctgttgactcgagaatagttgctatcgatggtatgggtttgtgaattattgatagcatttttgaaatccagatagctaagctgaaatccagacatcattagtgttcagttgatggtatgtatttttcgtggttgtaaaccccaattgagccagacagtatctagcaacagttacgatttatcagttagcaccaggacgagaccgcgagatattagttggcccaactaggatcacagtcacgggtgaagccacgtctgacgtccatcgacgaaaagcctcatatatgcttcatcaacatgcagtagagcagccgcaaatcagcgtttccatcgaccaaacaatcctcagctctgctgatatggttcaccagccgcaaatcaaagacgagacatggtgcaaactgcaaacgagacgacgcagacgaatatgtcaagctttcaaaccagaggttcaaaaacagagcaaaagactgcag

SEQ ID NO: 3168 - DNA, 2254 bp, Zea mays
aaaacggaccggatcccgacccaatttaaccaagccccccatcagtgccggccccgcgctcgtgccgttgcgctgcggcaaagcctccccccacacctctctcctccacccgccgcccccgcgggaccgaaaccctagctagggttctgcccgccgccgccgccgccttcgatccagacgcggccagccttcccgcaacaccgccatggacacggggcgcaagcggaccgcaccggagggcgccaacggcgcgggcggccccaagcgcgcgagagaatcggagacaactggtgtaggaagcaaatccaagccgtgcaccaaatttttcaggttctaatctagcttaaaatgaacagtcatccggtaacatctactatcgttattatgctcttctttttttaaattaaaatttgttatgttactaaatgctgtgcttgatgctaacaaatgggtcggtctagattctgctacaggatggttttatctaatcattgcttaagaacactcaacggagtaaaaaattggaatctactgctgtttatcactgtgaaaattggtgcaacaagggaacgtactgctgtttatcactgtgaaaaccgatgcaacaagggaacctactgctgtatatcactgaaaatctgaaccatgcaacaatgttttcaaggaagcaaaacttcctctcaaaaggaacaatcagtcaataacaccatggaacaggttcacttgaagaaatcaagaagattagattgaacatggggactgtaattcaattccttgtgaattgtaccagttatttgttcaattgcatttccttatcaatatgttgcagtagtagttctgagcaccttgaagcttgattatgaatggcatttctatataaagcatgatttctaaaagattagtcggtatcatttacttcagcttctattctttgcatatatatctttagcagtcatctagcgaggctgccttatccagctgcatgtaacttaatctcttccatcaacattgtttgcatttgtgtatcaactaaaatcatctgtaggttgtcagatatattagcatgttctgttgcttatattatgttttcaatgtgcagcactgcgggttgcccctttggtgcaagttgccattttctccataacttcccgggtggctaccaggccgtttcaaagatgaccaacttgggtggaccgcctgttccggctccaccaggaagaatgcctatgggacctggtggtcctgatgggccaccttcacctgctgtgaagactcgcatgtgtaacaagtacaacactgccgaaggatgtaaatgggggagcaagtgccactttgctcatggagagagggagcttggaaagcccctgcagatggacaacccgatgggacctcctccaatggggccagggcccaacgggcacttcatgccaccgccaatgcctttcccagacatggttcctccctccacattcggtgcttccgccacagccaagatcagcgtcgatgcatcccttgctggtgccatcattgggaagggtggtaccaacacaaagcatatatcccgagtgactggggccaagttagccatccgggacaacgaggctgatcccaaccataaaaacatcgagctcgagggaacatttgaccagatcaagcacgctagcgcaatggtcacagaattgattgtccgcatcagtggtaagccgcctccacaagccaagaacaacccaggtagggggcctggttctcatgcggggggtcctggaagcaacttcaaaaccaaattgtgcgagaacttcaacaaaggctcatgcacctttggagacaggtgccacttcgcccatggcgaaggtgagctgcgcaaacctgctgctgcttgacaggcatgcttattgtggcctgtggtgattaatctgcctgtatggctgaataacaccataaccaaggacagtcgcgccatggtgaagtgtgctgagccacatgctgcctgagagagagcatttccctgtggctcgtatttgatcttaatgctgtaacaaactctcctcgatggagattaagcaatggccgtttatttaggatttgtaggattgccgtattggtcacccttttatctatcctgtttttgtaccgtttcttaggcactcttggctggcagatcattgtgagtctgttgaacttgagaatagttgctattgatgttatcggtttgtggattcttacaaaaaaaaaataaaaacagacggctaatttg

SEQ ID NO: 3169 - DNA, 1375 bp, Zea mays
agtcccgtcccgtccaccctatcagttgcgggcgcgcgtccctgtttcgctcgtgccgttgcgctgcgccaagcctccccacctctctcgtctcttctccacccgccgccctcgtgggagtgaaaccctagctagggttctgcccgccgccgccttcgatcaagacgcctgcagccttagcgcgagcccgccatggacacaggacgcaagcgcatcgcgccggggggcgccaacggcgcgggcggcccgaagcgcgcgagagcactgcgggttgtccctttggttcaaattgccattttctccataacttcccgggtggctacctggcggtttcaaagatgaccaacttgggtgggccacctgttccggctcccccaggaaggatgcctatgggacctggtggtcctgatgggccaccttcacctgctctgaagactcgcttgtgtaacaagtacaacactgcagaaggatgtaaatgggggagcaaatgccactttgctcatggagagagggagcttggaaagcccctgcagatggacaactcgatgggagctcctccaatgggtccagggccaaacggtcacttcatgccacctccaatgcctatcccagatatggttcctcactccacattcggtgcttcggccacagccaagatcagtgtcgatgcatcccttgctggcgccatcattgggaagagtggtatcaacacaaagcatatatcccgagtgactggggccaagttagccatccgggacaatgaggctgatcccaaccataaaaacatcgagctcgagggaacgtttgaccagatcaagcacgctagcgcaatggtcacagagttgattgtccgcatcagtggtaaggtgcctccacaagcaaagaacaacccaggcagggggcctggttctcatgctgggggtcctgcaagcaacttcaagaccaagttgtgcgagaacttcaacaaaggctcctgcacctttggagacaggtgccactttgcccatggcgaaagtgagttgcgcaaacctgctgctgcttgatagatgtgtttagtgtggcttgcggtgattactctgcctgtgtggctgaataacaccacagtcgcctatggtgagatgtactgggccacgtgctgcctgagagagatcatttccatcgcttgcgtagagacaatggccgttttttaggatttgtaggattgccgtattgttctgttcgatttatatctaaccctgccagaatcctatttttgtaccgtttcttagctactaattggtgccagatcattgtggttctgttgactcgagaatagttgctattgatggtatgggtttgtgaattaaaaaaaaaaaaaaaaaaaaactcgagagta

SEQ ID NO: 3170 - DNA, 1711 bp, Zea mays
tctacacgaaaaaaagattgtatacatatccaaaataacaattgaacgagctaaactgggattcagagttgttgacaatccttatatggtaaagctcaacaagagaaccattgtgcttgaagataaggatcaaattcaaggttttcctaaatatacattctcactaacacccttagataagttggaccaatacaaaaacaagaccgatcgttttatagatgtcattgctaagatcagtggagtatcaaatgtagcaaaggttcctacaacctcaggagatcagcaaatgaggagagttgtattattagaagaccttaagggaaacatgattgagctatcactatcaggaaaaagagctttggaatttgacggagatcaagttttagatgtgggtcagcaacatcatgttattgcaatatttgtaggaaccttagccaaactttacaaaggtgaatatacattcttgagtggaacatcagcatgccggtggtacatcaacgaaaatgacattgctgaaatcaaggctttccagaaaagtttgccaagtgaacctgtacctaccaaaaagacctatctccaaaatgatgatgcaactcacaaatttgaggagaaaagtctggaacagctcaagcatgtagaccctttccttgacatgggacaaagatatcagtgcacagctactataattggtatcacagaaaaccaaacatggtgttacaaagcatgcaagatctgtaacccagcaatcattcaaaaggaaaatggttataaatgcacaaaggaaggatgtccatctacacaatttgaatggaagtacaagataccattcatcgcaagtgaccacacctataatctagagtttatgttctttgaaaaaaagggaatggagcttataggaaagagtgcatcgactcttcgaaaacaatatgaaccaaaggagataccaccggatataacatcttggataggttataaattcacttttgttgttagagtcctatcaaagaaaagtgtcaagactattgatccatcctttgaagtgcttatgataaaagaaaaataccagaaggaacctattatatcatttatcagctcaagtggagttgtaccagcagaatcatcttcctctacaatggcagaatacaaggaattaccattgctaatgccaattacctccaaagacatagaaaaaaaggagcgatccacttcacaaccagaacacaccgaagaaactcaagatatggacattgaaccatctggcatttgggaagaatctcagatttcaaacaaaagaagctttggagacccaaactatgacaaacaggaaacaactgatgacaaagatgatcttccccaattcaagaaaatcaggagtacccactctcaaggaaaaagcaaaaaatgatgcatgatagactaagaagacaaagtaaagtagtagactttaaaagatcttgactaaagtaatatatctatattttctgtttcgataaacaacgatagcgctagcgctacatcttttgatgtatataaccatgtagtatcaatagcgctaaatcttaagcgtgtagcaccaacagcgctacatattttgatgtatataagcatgtagcatcaatagcgctacatcttttgttaaatataagcacatcttttgatatatataagcatgtagcatcaatagtgccagctatggtgctaatcttccgtt

SEQ ID NO: 3171 - DNA, 800 bp, Zea mays
tgtaatccgccccctcttaggggggaatgggttcccgggccccccgccccccctcgagtctgctacgtagcccccccccccccccttctagtaatttcatccgaaacccagattccagcaacagagcaatggttgaggttgagtccgctttaagacataaagcaagattagagaggcatcaacgcacagctgagcgtgtgacaaaagctcttgccgagaagaacatgcgggacctgctggctcaaagagagcaagcagagaaacataggctgtctgaattcctggatcctgagatcaagagatggtcaaatggaaaggaaggaaatctgagggccctgctatccacattgcaatatattcttggtgctgatagtggctggcaaccggtgccactaacagatctcattacagcggttgctgtgaagaaagcttacaggaaggcaaccctatgtgtccatccagataaactacagcagaggggcgctacgatcagacagaaatacatatgtgagaaggtttttgatcttctcaaggatgcttggaacaaattcacttcggaggagcgctaggggggcgggggtgctagagcggccgtttattttgaggcaggcgattcgtataatttctatagcgacatcgttagtttcttgattcaaaactgattgtaaatatgcagtcgtagccctagatatccgtgtcagaaacacagcgcagatgatgctggttagtaccttatctcagaatcagttgagcaaaaagagctccattgctcgtaagtttccaaaaaaaaaaaaaaaaaa

SEQ ID NO: 3172 - DNA, 745 bp, Zea mays
  misc_feature (691)..(691): n is a, c, g, or t
  misc_feature (723)..(723): n is a, c, g, or t
atatcagattcccagtcgcgcctccaagcccactagcgatatcagattcccagtcgcgcctcctccctcgttcagtccaggtccagccatggcgcgcctcggcctcttggccctcgcggtggccgtcctcgcgctagcgtccggcgtggcgtcgcaggcgccggggccggcgccgtcggccgactgcgcgtcggcgctggccgggctcatgggctgcctgccgtacgtgcagcaggggagcacgcagggcaagcccgacagggagtgctgcgccggcgtcaaggccgcgctgaagagccccgccaccgtcgcctgcctctgcgccgccgtcgggcagaactacggcatgcccgtcaacctcacccgcggcgccgggctgcccgcggcgtgcggcgaagaccccgccgccttgagcaagtgcaacaagcccacagcttccggaacggctccggcagtcccaagcccgggctcttccaagtcgtcgtcgtcgtcggcggcggcggcgatccgatccccgggctcagcgttcgccgttgtcgtcgccgcgactctgctctcgcactgcctcctctgaacatgcccgggtgtttggtggttttagttcatgatgatgagttgtgacgtgaacctgtgtatccgcactgtgccataattcgttgagttcaattgactaatcgaccatgttggctgntggcatactgcatgcagctattcatgtcgttntgcaagaaaaaaaaaaaaaaaa

SEQ ID NO: 3173 - DNA, 2352 bp, Zea mays
  misc_feature (1781)..(1781): n is a, c, g, or t
gctgggaaattttgaattatcaaagtaccacatgctaagagttctgtgaatcgaactgaatacatgattcattactgtaattagcagtctacataatcatccaagaatccgttttgattttttcattaacagtcctttgtgagttggtatggtatggatctgcaatgaatagattctacatattcaattctagaacgaggtataccatctaaaacaactaatgctgcgtattctgctgttttttataactggatattttgtattccatgacttaacagcaccgccgagttcaggtgaattccaaaaacagcacttacaagttcactccaaaggaggatgtttctggatttccaattgatccgtcagcaagagcggcggatgatggttacccacagcgtgttcctttgatgcaagctggccgttcttcgtccactctgggcagatcaagtggaatggatccaaaagcccaacgatttcacacctcccaaattgttactattactacagaaatgtccaaccaatctactgcatctgggcagagaggcaatgctccgaagatgtctaaccttggggaaagtgcccggaggcaatatttgagagagcaccggtccagttcaagatacagtcagctcaccgctgctgacccttctgacagacctgagtggaatcatcagttccaagaaagaccatcatcttcccatcggaaggatgatgctgcggtaaacaaagagactacagtggtgggttttgaacattcacggttgtttaaataggtgttttgtctaaatgccatcataaaagtctttggccattgcatgtagtacacccttttattcttccatacctatatgctggtctttacagacgcttccgtgtcattctatagaatgcaattgagaatgattgcgcatggaacgtgtgttcgtcacacgccgccaaagtgtaggaatcagtttattggcgcacatatgacgagaatttttcttcttctccttgttcaggtgaatggcacaaagaagaacagaatccactattcgggaccactgatgcctcacggagcgaatatggatgagattcttagagagcacgagcgacagatccaacaggcggtacgaagagcccgccttgacaaggggaagggaaagcacaacggcgagagagaccagtcagaggcactgctgtacaccaccgggaatgtcagggctgatcgctgaaaagttcagtttggtgtggacccccgatttgagcaaccatcagaagcgtagaaaatagcatcgagtcccttctatttttccacaccaagtggagaggtttttgctttgccagaaactccaactcctgatgcggtttggtgcccaggagatacagctgccaaaaagaaaacctgttcctgtagagatttaccacccagagtttagcattaggctgtctaaaatattttttttctctcaagatttgttgctggttatccatagccatcagttgtatatctcaagtcaagagtactctccctgaaagttgatccacatacctgttttgacatatgacaagatgaatacagatcgaaatacaggccactgtctgctaccctctgaaaaaaaaaaaaaaaaaactcgcgcccggagtgtgtccaaagaaattttcaagtggttacgctttggtatccacacttgtttttgacgtgggtttttgggtgcaaacactccatcttttatgattagatttgtaggtttttctacagtgattttgataaatttgggtggaggaaaagagtttctcanttttagcccactatgctcaccaatcttgccacagatttttcactcccaacatcctcagctgcaaagggaaaacctggttcaccaacgcctcgcttaaattatcgaaccttcataaccaactgtggttctctatcagacaaccaactcaagatggtttgaaggtacacgttttcttccttagaacacatcatgtcggcatgactcaaactcaaggactaactagtctaatacatgtgcgttgtgacaatacccaactatgtttgatgatattgattgagcaattaagcgacacttgcgttgtgatgatatccaactatatttgatgatattgattgggcgactaagcgacacttgaaagtcttgatggaccctctacataaaaataccataataaatgaatttaatgtcaaagtgaacatgttgttcatatactagatattgaactggtaaaacaaatattacacttgatcttagccaaaagaacaaaaaaatgagttgaaaaagagcacatatgctcgaattaaattatagccaatgttttgacttaggacttgggagcgagaagattgtg

SEQ ID NO: 3174 - DNA, 1713 bp, Zea mays
gcacgaggatctcctacttgacaataatggcattcttaaaatagcagattttggtctagctacattctttaatcccaaccaaaaacaacatttgacaagtcgcgtagtaacattgtggtaccggcctcctgagcttttgttgggttctactaactatggtgctgctgttgatctatggagtgccggttgcattcttgctgagttgctgtcagggaagcctatcatgccaggacgaactgaggtggaacagttacacaagatttttaagctttgtggttcaccatcagaggagttttgggctaatctgaagttatcccgagctaccatattcaagcctcagcatccgtaccgccgatgtgtgaatgatgtatataaggacttccctactactgctttaacacttctggactatctacttgctgtagaacctgggtcggcgcgtggttagtttgttgctttcttcttgtagttctttacaacaaagccttatgcctgtgatccatcaaatctacccaaatatcccccaagcaaggaatacgatgctaagcttcgagatgaagaagctaggaggcaaagagcagctgctaaaggacaggaagctgaagctggacggaggaagcaacttcctgcacccgatggtaatagtggattgcagcaccgccgagttcaggtgaattccaaaaacagcacttacaagttcactccaaaggaggatgtttctggatttccaattgatccgtcagcaagagctgcagataatggttacccacagcgtgttcctttgatgcaagctggccgttcttcgtccactctgggcagatcaagtggaacggatccaaaggcccaacgatttcacacctcccaaattgttactacagaaatgtccaaccaatctactgcatctgggcagagaggcaatgctcctaagatgtctaaccttggggaaagtgcccggaggcaatatttgagagagcaccggtccagttcaagatacagtcagctcaccgctgctgacccttctgacagacctgagtggaatcatcagttccaagaaagaccatcatcttcccatcggaaggatgatgctgcggtaaacaaagagactacagtggtgaatggcacaaagaagaacagaatccactattcgggaccactgatgcctcacggagcgaatatggatgagattcttagagagcacgagcgacagatccaacaggcggtacgaagagcccgccttgacaaggggaaggggaagcacaacggcgagagagaccagtcagaggcactgctgtacaccaccgggaatgtcagggctgatcgctgaaaagttcagtttggtgtggacccccgatttgagcaaccatcagaagcgtagaaaatagcattgagtcccttctatttttccacaccaagtggagaggtttttgctttgccagaaactccaactcctgatgcggtttggtgcccaggagatacagctgccaaaaagaaaacctgttcctgtagagatttaccacccagagtttagcattaggctgtctaaaatatttttttctcaagatttgttgctggttatccatagccatcaattgtatatctcaagtcaagagtactctccctgaaagttgatccacatacctgttttgacatatgacaagatgaatacagatcgaaatacaggccggaaaaaaaaaaaaaaaaaagcttatcgat

SEQ ID NO: 3175 - DNA, 3068 bp, Zea mays
  misc_feature (3061)..(3062): n is a, c, g, or t
ggatcaactcatatcaactgaccgagcgcttgtcaaaaaccaaacagaacaaggacccaggcaaaatccactgacggcaagagataggagggagatctcgtgatttccggtggcaaggttcggttttgatcccaaccccaggttcctcaccccgaggagaaaaggatccagattttcttcctctctagtaagttgcagttcgcggtggcgccgccccccgccgcttcctccgtgttgcgcggttccgatttggagtgagggggagcgcgtgccgtgggattcccgttcggatctacggagtgggcagctttcctgctccaattcggtcggccagcaacgaaggcccttgaatcttgttgatgcgcggccagatgcgggaagcgtactgggagaaggtttcttggaatcttcgtccgggctccgtggagtgaggtccctcgcccgccgggatcgccccgtcgtcctatgggctgcgtcagttccaagcaattccacggcggggacgaccatggggacggcaagccgcgccggcggccctcgagcaactcgctgaagcgcctggttagttacagttccagcaagaggcatgaggagttggaggaggaggatgaggtgggggcggctgtggcggccacgtcctcgagcggcggacgccgcgctgggaatgacgccagcacggcgaggctgatccggaagccgccagcactggtggtcgaggctgtgccggcattgtcggaggaggctgccactttggcggttggtgtagttgatgcagaaagggcggttgctgcagcgactgggaatcggaagcggcctcctgcagatgtacatatcaatggcgcggcagagcaaggactgagtagcgttggtgttagaacggagggggaggccaaaccaaggatcagggacgtgcccaatggcgtccagggggagcatgtggtggcagggtggccgagatggctcacagaggtggcggcagaggcggttcgtgggtggcaacctcggagggctgagtctttcgagaagctggacaagataggacaaggtacatatagcagcgtttataaagcacgtgatcttgagaatggaaaaattgtcgctctgaagaaagttcggtttgccaatatggaccctgagagtgtccgatttatggcaagggaaatccacatcttaagaaggcttgatcatccaaatgttatcaatcgagtcggcacgacgacatcacgcatgtcaagcagcttgtatcttgtatttgaatacatggagcacgaccttgcaggccttgcagctaccccaggcttaaaattctcagaacctcaggtcaagtgttacatgcaacagctactctctggacttgaccattgtcataaccgtggtgttttgcatcgggatataaagggtgcaaatctcttacttgacaataatggcattcttaaaatagcagattttggtctagctacattctttaatcccaatcaaaaacaacatttgacaagtcgtgtagtaacattgtggtaccggcctcctgagcttttgttgggttctactaactatggtgctgctgttgatctatggagtgccggttgcattcttgctgagttgctgtcagggaagcctatcatgccaggacgaactgaggtggaacagttacacaagatttttaagctttgtggttcaccatcagaggacttttgggctaatctgaagttatcccgagctaccatattcaagcctcagcatccgtaccgccgatgtgtgaatgatgtatataaggacttccctactactgctttaacacttctggactatctacttgctgtagaacctgggaataggggtaccgctgcatctgcccttgacagtgaattttttacaacaaagccatatgcctgcgatccatcaagtctacccaagtatcccccaagcaaggaatatgatgctaagcttcgagatgaagaagctaggaggcaaagagcagctgctaaaggacaggaagctgaagctggacggaggaagcaacctcctgcacctgatggtaatagtggattgcagcaccgccgagttcagatgaatcctaaaagcagcagttacaagttcactccaaaggaggatgctgtttctggatttccaattgatccgccagcaagagctgctgcagacaatggttaccctcagcgcgttcctctgatgcaagctggccgttcttcctccactctgggtagatcaagtgggatggatccaaaggcccaaagattccacacctcccaaattgtcactactgagatgtccggccaatctactgcatctgggcagcgaggcaatgctcctaagatgtctaacctcggggaaagtgccaggagacaatatcttcgagagcatcggtccagttcaagatacagtcaactcactgctgcggacccttctgacaggcctgaatggaaccatcaattccaagagcggccatcgtcttcccatcggaaggatgatgctgtggcaaacaaggagcatacggtggtgaacgggacaaagaagaacagaatccactattcggggccattgatgcctcctggagtgaacatggatgagattcttagagagcacgagcgacagatccaacaagcagtgcgaagagcgcgccttgacaagggaaagggaaagcacagcggtgagagagaccagtcggagtcactgctgtgtaccaccgggaatctcagggctgatcgctaagttcagtttgagcagtcatcagaagcaaagaaaacagcatcgaatcccttatattttttcggttcccccgccccaccccaacccccaagcggagaggtttttgttctgccagaaactcaaactcctgatgcggtttggtacccaggaggtgggcagctgccaaaagaaaacctgttcctgtagagatttaccgccccagagtctagcatatgcggtctgaaatattttttccctgaagatttgttggttatccatagtcctcaattgtatatctcaaaagtactcacccccaaaaatgaaaaattgatccatacactcgttttaaaaaaaaaannaaaaaa

SEQ ID NO: 3176 - DNA, 612 bp, Zea mays
ttatggacgtgcccaatggcgtccagggggagcatgtggtggcagggtggccgagatggctcacagaggtggcggcagaggcggttcgtgggtggcaacctcggagggccgagtcttttgagaagttggacaagataggacaaggtacatatagcagcgtttataaagcacgtgatcttgagaacggaaaaattgtggctctgaagaaagttcggtttgccaatatggaccctgagagtgtccgatttatggcaagggaaatccacatcttaagaagacttgatcatccaaatgtcatcaaacttgaaggtttggtgacgtcacgcatgtcaagcagcttgtatcttgtatttgaatacatggagcacgaccttgcaggccttgcagctaccccaggcttaaaattctcagaacctcaggtcaagtgttacatgcaacagctactctctggacttgaccattgtcataaccggggtgttttgcatcgggatataaagggtgcaaatctcctacttgacaataatggcattcttaaagtagcagattttcgtctagctacattctttaatcccaaccagaacaacatttgacaagtcgcgtagttacattgtg

SEQ ID NO: 3177 - DNA, 2760 bp, Zea mays
  misc_feature (2124)..(2124): n is a, c, g, or t
gttctcccatcccaggtcccaactgccaactcccaggtcaggtacctccttccccaggcagccgcgtaatccctcgatggggacgacggacgagacggtcatacttcaactgccgcgtccccgaatattggctattttccaaccggcggcgcagccggtgacgcgcaggcgggcgggttcatctgacccttcgtcgactcgtggcagatgtgactttctgaggccggtgggcctgcccgcgggcgcccctggcgtgcgcagtgcgcactcgcatcgcatggtattaatagtcattgcaagccaggacgggccgagaaaagagaaggtggaagaacagcaggagagtcggaggaagcaagcttgcccatacgctggtacttatgtgctgatactactgcagccgcgctgcgagagaagaggagtgggagcacgtggagccaaaggggcgattctttgcttggccttcatttctcgcctcttccgcatctcgagttgtcgtgattaacaagacagcaagacctcggcggcggcaaacagtcgagcacctgcgagcgtctctgccaccgggactcaagaggcaatgccagcaccagccccaccaattcgtctgggacctccgactccctatatatcctctcatggatccaaagttgcacgcctacacatgtatgactggattgtgctaattcttttagctgtattggatggagttcttaatataatagaacccttccatcgcttcgtcggatcagaaatgatgacagacctcagataccccatgaagggcaatacagtgccattttgggctgtgccgataattggtatcattgggcctatggttatcataacagtgatatactttaagaagagaaatgtatatgatctgcatcatgccatactaggtctcctattttcagtacttattactgctgttttaactgatgcgataaaggatggtgttgggcgaccacgtcctgatttcttctggcgttgcttccctgatggaaaacctgagtataacaactttactacaggcgccatatgccatggccaggcgagtgttattaaagaaggtcataaaagctttccaagtggtcatacttcatggtcttttgctggccttgggttcctttcatggtatttggctggtaaaatcaaagtattcgatcgtagaggacatgttgcaaaagtctgcattgtcctttcccctctgcttcttgcagccttagtggcagtttctcgagttgatgactattggcatcattggcaagacgtatgtactggcggattacttgggttcacggttgcttccatttgctacctgcagtttttttccactaccatctgatgaaaatggactgtggccgcacgcatatttccgacacattcttgagccagagggtgacagccaagcgcaacccacgtacatgagccgtcgcagctcggttcagaacggttcctttcagtacagccctgacgcagtggaaatgaggagcacgagccaagcaatggattccatggaagctggccagagagcccaataatgatggaattaataggaacatcaatttagccacggaccgttgtaatgtaatataacgtcgttgtagcgcttagtacagcaagatcttgttcagatcccttattgtgtagtataacagttcctgaatgatggtcacgtttctgctggtcctccgaagactgaagcgcgactgattaccgcgttggcgtgatccggctggctgccatgtgactcaggcgatgaacaatgcaaatttaaaactcgttcggtgcgatggggttcattgggactggggccattgccgcagaaccatgtccctctccctccacacacacacagcacagcggggcagatctgaatgtgaatggatcaatttcaggcacctgcgcatcatgaccaaattggtcctcctccctccctctgttcaaacagtacagtactcgtagttaactgggactggacgaaagcctgcaagctgacccgccgacatgtgataggttaatcaccgaatgcgtgtttattttaaaacgaactatgtcttgctacggaggaagtacgtcgctgcaaacgctactttgtggcacacgtcaccttaacctttncagcgaaagacgcagtgatcaatcatggagacaaaaaacttgaccagatttttttaaccacagcctaaaattcgctcccatggggagtcgaactcaggacctgaggagtgctactcagaccaactaaccaactcagctagaggccctttcgcatcaatcatggagacagagcaggagagatggtcccagtcctcagttttttttttctcttttcttcttcttttcattcatgacgacataagcggcagcagagatttcagtggtgtggtcaaatgtatgttgctaataaaaaaaacaggagcagggagtagggccggcctctgtgagtgtgacagctgttgagatgagatgcatgtctgtcaaagcgcgcaaaggtgtcgtagtggcagtagtactattccgatcggcagcgttgcgttgcgcatgcatgcgttggagctgcgaagatctgtttgactctggaggatagttgaagggtggctacaactacaaataacaaaacgggttggcgccaaatagttttgacccctcaacctcaagtgctcctgtactgtaccactgagcggatcatgcaaggcacccaagacctcgagagtcgttgggggaaaaaccccatgttttatatctatctgcacg

SEQ ID NO: 3178 - DNA, 9793 bp, Zea mays
  misc_feature (8081)..(8081): n is a, c, g, or t
  misc_feature (8084)..(8084): n is a, c, g, or t
aaatcactctctctcacacacacacacagcaccatgcttcacaggaggagccgcacgctgggagggagctccgatcgacctgcgcgccgagctgtcgcggtgaagagcggcagggggagcaatggcgcggccacggacctgctcgtctgcttcccgtcgcgggcgcacctcgccctcatgccgcccaaggccatctgcagcccgtcgcggccgtcggcgtccgagccggtcaagcgccggcacagcaccagccggccgcccagcgggctctacaagtcggccgcgggcgcggccaggaacccgagccgccgcggcgcggacgtccccgtggacgacgagccgacgtcgcccaaggtgacgtgcgtggggcagatcaaggcccgccaggccaagcccaagggccccgggcccggcggtggcggtggcggtggcaagaagaccaagaaggccacgtggctgcaggcgctggggatcaagaaggacgccctggcgctcttggacgccctgcacggcgctttcaggttcaacgttgccggatgcttcggcagcttccccggcgccgtgggcgtggggtacacttccggggaggacgacgaagacgaggaacacgatgcgccgcgcaccgagaaggaaacagaacacggcgcggcattggcccggtggttcatggtattggaggaaggcaagaaggtgtctgccaagaagctgcagggccaaaaaccggaacagagccaccaggaggaggacagggaggaagacgcggccccgccggcgaacgcgctgatgctgatgcggtgccggtcggcaccggcgaagggattagcgaggaggctagagacagaggaggagcgcaatgatgtgaagggcgccgccaagaagactccagatcaggaagagaaggagaacgagggcctggtgctcatgacatactcgccggacttcttcaaggtgtcccttgacattgccaaggagacttggatcgtcggcggtgatgacgcggtcctgcgctgccggagctggaagagatgatcgcagtgactgttcaacaaggaatgtatgtgccttttgtttaccttttactcctccgcttgctttttttcttctttttttccgacactcttgatgattactactactcttgcataaggctcgtgtgaagggtacgatcagcacacagcagaattggtttagccaaggccactgtatgtctgtattggcctcaccctgcaaaacattcctgctctgtaaatagtgctgtaaagtcccttgttaaatgttgcccaggcatacttgctcggtgagggctgatttggtttagagaattgattcactggtcaccaaattaaaccagccatgatatgtgagtgagactgagtagtactcgcacatatgatgaacttgacagctcatcctttcgtgccagtaaagcttccatcttggcattcagataaaattctctagatgctttactctggcctaataatggaacagaatctctatgatgatcttttcagaatatctcgtttttcttcctggaaaccgaatgctttgttggcatggttcattggcttgcctctattcaggtcatgtgagctgtgaggagcggcaagatcaggcccttttacggacagagcctacactgatgtctgtctgtcggttttagctggagctttccattttttttttggacaaaccaactactctccatcaaggccatgagccatgttccaacaagaagtgtacttgctcctgcggccttgcccaaaggcaattattgtcttagctattatctcatgggcctaaaggagagaataaagagattgattaaaggaggatttaagtgcgagatccatgaagtgatagcttactcgcaaagcccattgctccagggccggctctacgattttaggggcccctaggcgaactaaacagcacagatgggtcatttgtgatatatatatttttaaaaaacctaccccatgattaaaaggataatagtactaatgatatatgtatatataatttgtttaaaataatgcctacagtagaaactaaaagagccatgaaacaaaacaaacatgaacacctgatcattttgttttctctcttttttgtctaagcatccgacaaatgcttctgagcaacattataaaatcaaaattatacatgaaagtaaaaatagttagtgatcaccggaattaaaagctttaggcacctagctaattatcatgctttttgaatattacatcatattaatcagtgtattttgttggattaccaagacatatcatttttttcaccagaagagttgattctaggcaacgaattcatcctatatacttgaaaatttgggcccctctccaacgtgggccccggtggtcgcccctattgcatagggccagagccggccctgcttgcttccattcttgaggctgggtccaacagcggtcgatagcaacacgtgacgacgtgggttgggcaccggtcaacggacaatatcgaccacattaaagccagcggttggtaacaattagtctgttggacggttgggtcggttacacatagtcggttctgatttgtttgttcgatcaatatcgattcgaacccagttgaaaccaaatgatttagtgacacggtgtattctagttggtccccgtgtgtgtcttttcagctagccgttgtatatgtatgaatgtatccgttttaaactgtttgaaatctaaaaattccaaaaaaataaaaaataattcatggaatctgacctataaatataggatgatgtttgaaatcattcacacccctcactcgccatttcactcatattccttggtattgtagctgcctactctccttcaatatggatcacacgtggagtccgagctttcaaacctccaccgacttgttcaatgaccaatttccacagcttccccgcactcatactggtgtggaggaggtcttcttcgacggtatttctctcataaatcatcatcaaaagaatgttttgtctatcaccattctctcgcttcacagcctctattttcatacacatatcctttgtatccctaccgactttccattgatgttcctccttcctccaccactgaagcttcttcccccactgaagctcctatccctgacgctcctccttcgtcaccattgtgcaaaaaatcatcttaatccgagtttatttaagacgttttgcattttgagaggagaagttttaaggtctaaataagccaaacctgactggggcacccatcaatcttggtcaggcatggatcctggccgagccgaccctataacccggctatgccgcctttgagtaagctaggaaggccaaactcggtcaagccgacccttcactcccgaccaagccgctttgcatgtgctatttgtgttatgagtgtttttctgtttcgggtgtctaaacttcattctgtttattgcagtgggtttctaattttctcagaaacttttttcaaatcatcaaaccacccgttggtttagttgatttgtgtgtgctttcttcacctttgttgaggtcgagagtaacactttcgagtttcgaagtgtttcatgtgtgcgtttatttttccgttggtttaagtgttacattgtgttttctggtcataacagagagcatgcagtcactagctgccttaggagatacttgtttggagattttggattttttaggattagttcaataatggctattagaaagaatttttaatttgctctcattcacctagccgtctgattgtccttcaggtttaccactgaattgtagttgtttaggttgtcatgctcagtttttattttgcagaatttcttctaataaatagtgcacttgttaagttttgagcctaatttccttttctttttaggtgaacagcggaaattccctgaattctttggagggttttcttcaaaagaaaataattaagtcatcgatcaaagttttacatctgaagttgtaagatgggaacagcaggagaatggctgcagctgcagcaaaagaggccttgctcaaaggaacaaatcacataatttagattcgagatgatcattcatttctagagcagagtcttcagtcggtagttgtcattttcagagccaaactgaaaccttacaaatctctgggatccgtcaccggcacccctgcaaccaaatacatcagctttcttttcgcaaggaaccaaacgcattcaactaactatacatcacactggagcaagtattatgtacagttccatctcttgacctccttttcaaattggtgtatatggtggacaaaaaaaacatacagatttggtataacaaattgttcatcggcgcatgcagaattgttctttcgaaaatcttgtcctcttaagtcttaagcagtcgcggttgatttctctggtagccgacagagtaaagaaaacctgcaaagaaagacaggctatcctatgatcaacatgccaaacttttgctttaaaaaagatggtgggcagtcaaggaatctgccggattttctaatcactacttatttgtttatctaagcgtgaccatctaccacctattaaccagttaaaatttagatagataaagagcactgaagtttgttaggaccgacactttgaatcattagtccaaggaatatgagtgcgcactttcaaatgtagttgacacaaaatacaactgcaagagctggagaagggacatgtagttacatgacgtcagtgctgagatctggctgctgcggccccatgcctttggcccttgagcttggcttcgacctcagagagagccttcttcacgtcctcattctccggcagttcttggaccagcacctggtaatctctcaaggacgcttcccacctctccagcgggacacacacgacaacaccaaaaacacaatggcaaaaataagatcacccgcacggggagactgcagttgcagtgttgcagaacagcagcggcgtacaacgcaccttgacgttgcagtccgccctcctgagccgcgccttgctgtacgaggggcgcacgtcgagcgcggcgctgcagtcctcgacggccttctcgtgccgcccgagcttggcgtggcacgccgcgcggttgcagagcagcacggcgttgccgggctccctgtcgaggccctcgccgtacgcggcgcacgcctccgcgaacttggcggccttgaagaggtcgttgccacgcagccgcgccgcggccgccgccttggccctcctctgaacgaccgagacctcccggttgcttgggtccagctgaaacgccgtctgcgccgtcgccaccgcgtcctcgaacctaccgtgatgtgaatcatgtggtcacgagaattcgagcgtcaaccacgccacgtttttttttttttttgagagggggagtgcgtttctgtgtggaggcaggacaggacgggaatgaacaaaccttccagcagccatgtcgacctgagctcgcacgatgaggaagtaggcgtggccgaaggtgccgaagaacttggtcgactcgtcgaccccgaaccttggcgcgccggcgccgctgagaagcgagtcggcttcgtcgtgccgttgcagcctcagcaacgcctcggcttgcaacgccatcacctagcagataagttcaccgagaggaacacgtttgtcacacgtgcagtacaggggtcatgcatggagctgtgtggcacatatcgtggcggacgagcgctgacctgcggagcacagtcggcgccgtcggccacggcggcctgcgcttcctggagcaccgtgatccagttcttgagcctgcgcgcgtcgttgctcctggcgatgcggctcttcaccgattgcgcacgggaaacgtctgcgcccgcggattcgttggaggattgcttcatgtggtagatggctttgtcaggttctcctaatccgatgagtaacacgtaaactcgttacgatatgcaatgaattcctatacatatttaaccgattgccacaattctatataatccagtacaatgtttggcatctgactctaggtgattcttaatcctaataataacatcctaaacaatttgctgtaggaaaatgaaggcaaggacttgtttctctgagagttctcaattagtgcaatcatgagcttgaaaaagaagggggtagccatgcttgccgaagaggtaattagctattcaaagcactaatcatcaaagtgttcctaccgtaaattaaggcagacggctgtgcactttgtgcttgacctgctaatccaatgacctaacgtacgttccaaacgagcacatgcggaataaaataatgccatgatctaatcatcaaggagttgtagtaagtgcagttcttagggtgaaaaaggtggaggcgaccaccaagagcagataattttattcatacgaaccatcctaaaaccttagtgcacagtgacgtatacgtagatactccattataaatttcattctagtagctaagaattattatattgttagctgctacagcatgcaatgattcgatatttagtgtttttctataggtaaggtcataaaattcaaaaaaattatttttagcaacttcagtgcaacaatgctaatattgtgtttttctagtcatgctaaaatcagattcccctgttcaatgttgtagcagcattaaatatcgataactgcaactggcgtatatgtataatgaacaggtaaaaaacaggcaccatgcatgcagtgtcaccgcacaactggtgacgaagagttgaagcagaattggacgagcagtgacacgacggaggggcaaggcaatggatggcagaaatctgtagactgtgcctctctctgatctgaaaatcggcgagatgtacgcggtacctgaggtacaagccggcaagccggtggtgcgcgcgatcgtacgaaggatcgatccggacggcctccttgcagtcggcgacggcctcgatgaggcgtccgagcgcggcgagcgcggccgccttgttgctccagtacgccgggcggctggcgtccatgatgatggcctggtcgtagagcgccaccgcctccgcgtagtgcccctggcggtactcctcgttgcccatctccttgagcttctcggggtccgtgcggtgcgacagcgcccggcacagctggccccccgctgcaggcatgccggccggggctccctgacgatgttccccatgccggaggacgcgtacccgtggggcgccttccgctcgttcgccgccctgccgcccgcgttcaggttgccgaggttgcggtgcagcatcatgttgcccgaggtggcgcgcaccagctgcgcggtgcccttgaccctctggtggtcgaggatcatcctgtccagctccgcggccatgccgctgtactccgccgccggctccgcggcgggcgctgccttggcggccggcctgctcctgccgttctgcgccgccgccggcacgggcatggcgctggggcggcgcgcgagggaggagtcgcggtgcgcggcgggcttctggttcggcggcgccgcggcctcggcctcggcctcggccccgttgatcctgtggagggaggtcatggacgcggagcggcggcggcggaacatgccgttgtagatgccgaacagggcgcagccggtcggcgggtcgcgcggctccgtcatggcgaccatgaccgtggcgacgttcgcggccgcgcggccccggcccgcggagtgctgcgtgggggcggggggaaggcaggggacgatgtggggggcagtgccaaagatggagaggcagccaggtggtgtgctgggcgtttggtcctggttgacaaccaacgaggcaacgcaacgacgacgggctccggacatggggtgggaatgtggggagcacggggatttttaaagttctcagtttcttctcctattattttcagtttttttttttggctatgcatgactgcatccatcttttttgttcgggagatgtgtatatagtcattgacagaaggacgatcacgcgttcgttaacgcactcacggtgtgaatggcttggttaggtcaaacgtccagattttggtagttatggtggcatctggtttattagtttggactgtgtttacnacnttgtacgtgttttgtgtttaaatggagacgcccactcaacatgggagttagtttgtagcaaaaacaaagcactagctagacaaagctgcgcaaaagcaaactaagcacatacagagaataataataagagggctagagtacgtacgtgtgagcaatgagcatgcaccatttgaccaaggatgaggcgtgttcatgagccacacctgctctaggcggctatggaggccccaaaggaataaacggatgttcagaagattttgtgttttttttttctgtctatctctcgtttaagtttccttgttgcgagtctatgggctatggcgaatcaattagggtcactcccttttctttatttctttttaaaaaaaaataaagtgtagccgggcaaccacattcttccctattaatcaggccggctcatcagtcattcccacgatcaaatcgtaaagtaatattttgaaaaacagctggtgactgacactgtagcgggctactgtattcccgtgtactcgttactacccattaggccggcccctcattaggatttgctcgctatcaccccagctcatcagcgtaatgtgatgttttcctgctggatgcatggctgccgcctgcctggaacccccagctttgcttgcacgtatgattccattgacgcgcgcgtgctgctgaaatccccggcggctggaagcggaaggtttactggccccgactcgctgtagggcatgcagttctggtggagtacccctccattattctccactgttcatgtaccaaccaacccgaccggcaactcccgaaaacgtgttggtggtgctgaacgtgcaaaacacgtgcgtcatcctccgcctcaggcccgaccccgagttggcacagcgtcgtctgccggccggtctccccgtcatttttattggtcgcgactcggcgacaaacacggtgccacgcagctgtgcgctctcgtctctcgtcaacccctttgcctgctttagttttccgattcaggcccgcaacaacgcacgtctaaattctgctaattatagagtgatggatgacacgcatgtaatcaatccaaaaaaaaagtatggttacaattgtgatattggggtggactggtaatggcagcataactaggtcaactcgacgtcattacaattgtgattgcatagtatggttaacaaggtttgagtagcaatggatgttttgtacagtgacgagactggccagtggcttcccgaccgctcccatatcccctaccctatctcatccactattttaaacttcactttgtaaacagtattatctatagtgcaaatccttcattttccacgatccacttaagacatcctaaggtagaagctgtgcaacagacatgagcagggttatattggtttagggtgaaaaaagcaactatgaatttataaaaggaaataaaaatactaaaaagttaaattcataagagggtcaaggaaatgaataggagtaatttgtaggacacttgacattagtattcacgccggggcctgcggccgacaaactggactgcggtggtgcatgttgcattgctgctacggtgggctggatggaactggatggctcaaccccagacaggccgtcccataattttttcgggctatgtatataagcgagccgataggattgtgtgctgggctgtgtatataagcgacccgataggaggtagaaaaaataag

SEQ ID NO: 3179 - DNA, 3435 bp, Zea mays
  misc_feature (2334)..(2334): n is a, c, g, or t
ggattgggtgtgagatatggattcacccaatccatacccggattaaatccatggtgggattatatcccatgtaaccgaacaaggcctaagctgatcatttttttccatgaacttgtgtttataggagtaaaaaaaactgtgaaagctttgggaatggagttgacagcttcgactgaataacagaagaattttcactcgtcttctcctgatctcatggaacttcttgatagtaatggccacggggaaacaagagcacagggtgctgaaaacattgcaccagtttctgctaatagtccagatacatcatcggaaatgcaagggaagttacctcacagtttgacagagcaccaggaagaaatggggtcccctgcaggccatgcagggagtttgtcgccgaaaattgtctcccacatagaaccagctcgagcatctgatgacccctcaaaagatgagggacgtcatgctgctttattaacagataagagtggagttgaaatcatatacgaaaatggttttactggcgccagtagtattattccagcagctgaaatgaaatctgaagaagacaatatgtactgtcgtaacaacgttgccgtcacccccacaaagaaagtagaatcagtaaaggggtgcgaaggctcacacacaggtcttgttgacactagcgccccattcgagtctgttaaacaggctgtcaccaagtttggaggaattgttgattggaaagcctacagggctcggtcattagaggtaatgtctctgggtttcacaacgtatatggatcatggtcagacacatgatcaccttgttttatgtccatcaatcgctgccacacaacagttctttatctttgtttgtatgcagagacgcagggtcatgcaacttgaacttgagaaggttcagcaagagattccacagttcaaagaagactgggagactgctgaggtggccaaggcacacgtcattgaggagctagagagaactaccagacttgtcgacgagctgaagcatgagctggagagggcacagctcgaagtggaccaagcgaagcaagattccgagcttgccctgctgagggcacaagagatggagcaagggattgacgatgaagctagtgtaatagcccagacacagttggcagtcgccaaagaaagacatgaaaaggctgttgaggagctggaattgctgaaagaggagctaagatcaacgcatgaacagtatgctgtattagccactgaaagggatgtagccgttaaaagggccaaggaagttgttcgtgctgcgaaggatactgagaagcaagtagaggaactcactttagaactgatcgcatccaaagagtctctcgagtcagcccacgcttcacaccatgaggttgaagagcacaggctcggggcagctttggcgaaagagcaggatttcctggcttgggacaaagagctgcaggaggcacaagaggagctaaaccagctccacgaacaaatcgcatcgaaaacgaatgtggaggctgaagctgttgaaaacgagcgcaaactacttagcctgaaaagtgagctagctgcctatgtggaagacaaattgaatgaagaggctggaatgcttcagcaacaaggttctgacgaagaaaaagaaatcagtaggtcaatcaagcaagctcttgcttcaaaaaggaaggagcttgctgaacttaaagggaaactagaaaatgcgagaaatgaagccaacctagtaagagttactgcagaatcactcagttcagagctcgatagggagaaagcttcactcgccgcattgcagcagagcgagggtatggcatccatcacagtttcctctctagaagccgagctcgataggacagagcaagagatagagatggtacataagaaagaagcggaagctcgggaaaaaatggcggagcttccaaggatgttgcagcgagcagcccaggaggcagaagatgccaagatggcggctcactcggcacaagaggaactgagaaaggccaaggaagaggttgagcgggccaaggcttctgcgacaacggcaggtaccaggttgcgtgcagtttcgaaggagatagaggcgtctaaagcatctgagcggctagccatagcggcagctcaagcgatgcaagagagcgaggacacaggaagcactggcgcttctcctcgagtagtaacgcttcctgtaagtgagtaccatgctcttagcgagaaggttcatgaagccgaagaacttgcaaacgagagggtggcggtcgcgttggcgcaggtagagttggcaaaggtgtctgaatcgaggagtctagagaggctacaggaagcgtccaagganacggagaaaaagaagagcgatcttcgcatcgcgctggagagggccgagagggcaaatgaagggaagcttggcgctgagcgggagctgagaagatggagagctggacatgtgcagcgtcggaaagcccatgaggctgcacagcatgcagttagtcctgtcagaactccacccaggatgtttgtccagcagaagggctcttatctggaaggaaacgaactcagagatccaaaggtgcacaggtcaactggcagtatggatcagtttgtttcggacaagaaatcgaggaaaaagaagtcgttcttaacccagttgtccacacttttgtctagaaaggcacatgcacaaacataagagtgattgttctgaaaaaaaaagagagtttctgtgtctttgtaaaatgttaatggtgtaaatttagttttggatcatgctcttgtaaattgtttcgcacttgaagactgtatgagtgtatgtctttgtatggtgtgtttttttttctgctttacatcgaaaaccctggaaggaatatcctttgtgatacaagaataccagacacgacaggtgttctcagttatcatgtctaaacacaaattggggtcatccttatgatagcaaattatcgggagtcaggatttcagcagattgcatgttcgttttcacccaatccatattgattaaagaggattggatgagtttaaatccaatcccataaaatctacgtgacataggaataaccgaaaaaggccttaagtggtagaaaacttctgaaatggttgtcatatttaggggatatttgaatacactatagctaataattagctgttaaaattagctaaagacatctaaacagtctagctaatagttgagccattagcaaattagctagctaactccactagcaatttttagtcaactaagagcatctccaagagactagctaaatgactcgccaagctaaattttggctattcaacagcaaaataactttctaacagattagctatttgactcgccaaactatccgactctctaaattagctctcccactagctaaatttggctagtcatctgactagcaaaactaaatagatagtatgtgaa

SEQ ID NO: 3180 - DNA, 4294 bp, Zea mays
actggtttagtccctctattagttcttgtgtttggagaattagggactaaacatgcctaaagtcgattgtttggactactgcagaattaatcgacaaaagcgcgaggctttatttacaaaagcgagccacgtagcctaatccagcttatcgctaatcccgagctgcggtgcgctgaggcctcggcccctcccccgggccccggcccggggacgagtgcgcggtgacgtgagcataagagacaacaaagctttgacacgcaaaagcacacgcgcacacagcacggcactacggcagaaggaaaaaaagaggcaggcggacgacacagagagaggctcggaacaaggaaagagtcgccggcggcggagaccccaaccgaaggcccccggtcgcttcgccgggcaaggcgtgtccgtgcccctcggacaccgggtaaagctcactcctttctgctgtagttttgccagcttaatttggttttgacacagtgattttgtcgtcgaggctggtttcggtgaatttggttgacgggttctcggtgctgccgtcgcatggatgcgttcggctccgcggcccggaggcttttgctggtgccgtgggagatcttggtcggggtttggagctttcctggttttggctgtggttcctgtttagcgtcgcctaacgcaaggattggtttctgtcgtttggtagatatataaatattcggttaagaggatttggtttgagctcgtctgctatacgagctggaactggaattaggaggtgacacgcctttcctggttatagcttcgatgctaagataagctcgagtgcttgaggcccagcggctgcgatccatggattagaggcgacggtagaacagcaacaactctgagctagctgacccaatctcagcatcatcttgtttgatcatgacgttcttgctttgtttgctttggattttatcaaaagtagaaaactgttgcctttttatgtgttgttggaaagaccatttggctacacgaacggaacggaaagaggtttggtggaagtgtggaacagttgccgagcagtaattgctgagctggttcgtgactccgtgtcggtgagtgcccatggttcatgcttatagcaccggatcacacttctcctgtgctgcccgctgtcatctttactgcacacaagagtgtctgtggatggttccatggtatatgcacatgaaacggggtgattcataaattgctgaagtttttttagttttccatactgtatgaatggtagtgataataataaaactatctccgactacaaggaggtgtacggtatgagctcattctgcttagtttacccgtaataatatatgtgcagtttattttctgtaaggtgacattttttcctgaacttctgtttataggagtaaaaaacagtgaacgctaagctttgggcacggcgttgacagtttctgctgaataacgggaaaaaaatttactcgcctctctcctgaatccatggaacttcttgatactaatggtcatgggaaaacaagagcacagaatgctgaaaatatggcaccagtttctgttaagagtccagatacatcactggaaatcaaagagaagtcgccccacaatttgacagagcaccaggaagaactggggccccctgtaggccatgacgggagtttgtcaccgaaaattctctcccacatacaaccaactcaggcatcggatgattcgtcaaaagatgagggagaccatgctgctgtaacaaataaggatggagttgaaaccatatccgaaaatggttttactggttcgaatattaggccaacagttgaaaagaaatctgaagaagacaatgtgtatagtcatgagaccgttgctgccacccccaaaaagaaagtagaaccagtaaagggatctgaaggctcatacacaggacttgttgacactagtgcaccattcgagtctgttaaagaggctgtcaccaagtttggaggaattgttgattggaaagcctacagggctcagtcattagaggttttgtctctttgtttcacaccaaatatggatcaagagacgcagggttgtgcaccttgaacttgaaaaggttcagcaggagattccacaattcaaagaagactgggaaaccgctgaggtggctaagtcagacgtcattgaggagctagagagaactaatagacttgtcgacgagctgaagcataagctggagagggcacagcttgaagtggaccaagcaaagcaagattctgagcttgccctgcttagggcacaagagatggagcaggggattgatgatgacgctagtgtaatagcccaaacacagttggcagttgccaaagaaagacatgaaaaggctgttgaggagctcaaattgctgaaagaggagctaagatcaacacatgaacaatatgctgtattagccactgaaagggatgcagccattaaacgggccgaggaagttgtttgtgctgccaaggatactgagaagcaagtagaggagctcactttagaacttattgcatccaaagagtctctcgagttagcccatgcttcacaccatgaagctgaagagcacagacttggggcagctatggccaaagagcaggatttcctggcttgggagaaagagctagaagaggcacaagcagagctaaaccagctcaacgaacaaattgcatccaaaaggaatgtggagtccaaagctcatgaaaacgagtgcaaactacttggcctgaaaagtgagctagctgtctatgtggaaaacaaattgaatgaagaggctggaatggttcaggagcaaggttccgacgaagcaaaagaaattagtaggtcaatcaagcaggctctagcttcaaagaggaaggagcttgctgaatttaaagggaaattagaaaacgcaagaattgaagccaatttagtaagagttgttgtagaatcactcagctcagagcttgatagggagaaagcttcacttgctacattgcagcagactgagggtatggcatgcatcacagttgcttctctagaagctgagctcgacaggacagagcaagagatagaattggtacataagaaagaagcagaaactcgggaaatgatggcggagcttccaaggatgttgcagcaagcagcccaggaggcagacgatgccaagatggcagctcatttggcacaagaagaactgagaaaggccaaggaagaagctgagcgaactaaggcttctgcgacaactgcagataccaggttgcgtgcagttctgaaagaaatagaggcgtctaaagcatccaaggggctagccatagcggcagttcaagcgatgcaagagagcaatgacgcaggaagcgctggtgcttctcctcgaggagtaacgcttcctataagcgagtaccatgctcttagcaagagggttcacgaagccgaggaacttgcgagcgagagggtggcagccgcgtttgcacaaatagagttggcaaaagagtccgaatcaaggaacctagagaggctgcaagaagcatccaaggagatggatgaaaagaagagtgatctccaaatcgcgctggagagggctgagagtgcaaacgaggggaagctcggtgctgagcaggagctgagaagatggagagctgaacatgtgcagcgccggaaagcccacgaggctacacaacatccagtcagtcctgtgagaactccaccgaggatgcttgtcgagcagaagggctcttaccgggaagaaaatgaacttcccacagatccgaagttgcacaagtcaaatggtagtatggatcagtttgtttccagcgagaaatcgcggaaaaagaagtcgttcttcccccagatgtccacacttttgtctagaaaggcacagacacaaacataagactataagagtgattgttctgaagaaaagagttcgttcatgtatctttgtaaaatgtaaatggtgtaaattttaatttttgcccatgctcttgtaaattgtctatttgtctcatacttgaagaagactgagtgtatgtctttgtatgatgttcttggagaggatgctgttacccagatctttctttgccttaaaaaaaaaaaaaaaacttcttacatcgaaaaggaatttgtttgtccatttatcaagttgggatcatccttcgtcgtgttagatctggcttctggtagcacattagcggaagggagccaagattccctatttttccaaagaaaaatgaattaacttctcttaaaaaataattttttggaaaaatgaggttttcaaactagcactaaagtggcagaaaaactg

SEQ ID NO: 3181 - DNA, 7148 bp, Zea mays
tgggtttttttttttagttttaattccaatttgtggaaaatttgatcatgtggttctcagaattcttcgcccgttttctttgccccacagtcgtaaaataaaatctcgtagaaactgacgcgttgtcgcggagtgcagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccaccgctaccactggcctcaatctgcaaaccctagccctcgtcgccggcggccatggccgagaccgtcgacgacaaggtcagctacttccaggccgtcaccggcatctccaacacggacctctgcacggagatcctcgccgcgcacaattgggacctgcagctcgcggtgtccaccatcaccgccaacccctcctcgccctccgcttcggcctccacctcctcgcgtgacccggccccttccgctccgctggcggtagatgcagagttcgtcgcgcccccgccgccgatgccgctgccgctgccgccccagcagcagccggggatcgcgtggaagctggtgacgctccccttccacgtggtctcgggtggggtcggcctcgtcgccggcacgttccgccttggcgcctgggtagccgggggcgtgctgtcccgctccctctccctcctcggcctcgcggggcaagccggcagcggtgaccgcctgctagagttgccgccgtcagctgccgaggcggccgacttcgtcgctgagttcgagcgcgagttcggcgctggccgcggcccgcgcttcgtggccgaggggttcgctgatgcgctgaagcgagcgcagcgggaattcaagcttctgttcgtgtacctccactcccctgatcacccggatacccctgccttctgcggtggctgcctctgcgctgaacccgtcgcggcctttatagatgagaacttcgttgcctggggcggtagcatcagaaggactgaagggttcaagatgagcaacagcctgaatgcgtcgagatttccgttttgtgctgtggtcatggcttctacaaaccagagaatcgtgctattgcagcaggttgaagggcccaaatcacctgaagagatgataacagttcttcaacgtgttgttgaagaatgtgctacatcacttgttgctgctaggattgaagctgaagagagactaaacaaccagcgtttgcgtgaggaacaagatgctgcttacagagctgcacttgaagctgaccaggtacctgggaacgctctgatgggctagtgtgcatcactgatttgattacttaatactctggccattctaaagtgtaagacattttgtcttttctagatatactacttttactatgtatcttggcataatgtatatctaagcgcatagcaaaagctatatacctagtaaagtcaaaacatcttataatttggaatggagagggtagtagaaaaagcatgcatgttcatgtataaaatgaatgtatggctggagggtaacatggacgtctgtgactgatgacatttctaatttttagttaagaaagttgtaccttcaggtattatgtttgtgcattaaaggagtttagaaacatgcacctcattttgttctactattggtgttgagctaatcacacatctttttggaataatattaccaggccagggaacgtgaaaggatagaggaacaggaaagacgtgaaagggaggctgtagaggctgagaaaaagcgtaaagaagaggaggaagctgtagcaagggcatcccaagaagcagctgagaaggaagctgctcttgcaaggaggaggcaagagaaggccatggctcttggagctgaacctgagaaaggaccaggtgttactcgggtatgtgatgtctaaccctctatgcttgtgtctttaaactacctttttccaattcttactgcaagatagcatgcttcatgttgtgccgatttttaaggatttgtctatttgagtgcgtcaaatatcactgttgtgcctgcaaatatctgtttcatgtacgatatatttacagtgattgcaatgaatccttcgttactatctgagttaattgttagttttggctacgtagtgcctgaatttgatatctgcagatgcactctgcatcctctacagtagttagcacgttacgctattagtgtatccatgtatgcaaattcttgtgaagctaactggggtagacgttgtgatgacttggcaggttctcataagattcccaacgggagcccccagagagcggagattctacagttctgcaaccgtcgcttccctctatgactatgtcgattctctagactgcatgaaagcggagaagtacaccctagtttcgaatttcccacgcgttacatatggtccagaaaagcaatccctgacgctggaggaagcaggcttgcatctgcaggcgagcttgtttatcgagatagaacaatgatgctgtaagctaaagaaaagccgaaactaaagtacagacgctcctttttcgaagttgttcagcgacagttaaggatttccagatggtaatacaccacaggtgcatgcttcttgtgtacttttgtcatgaactaaaattcgcttccaccaatatcagttggctgcagccaggtcttgtaatatgttgtgtgacttacgtttctcagccactatactgcagtgcttcagggaggtaggcaaaactggaaggcttgtagccacaccgccatacatatgatttgctcccgttgtcgttgagcagccggagatccttatgtgttgtggattctgaaacttcagagtttccgcggttctcctgatcctctcgatcagagctgggttgcttttgcagcaaaaagtcaggcctgacggtttttaggcgccagaacagtgacaagcctggcctggcctggtcctgttagccgaagtatgatgaagtatttgtttgcctatccttctgacaagttcggtatccaaaaaatggcattttgagagttccaaactggagacaagttcatgaagcgcataaacgatattttagaacttcaggatctggattgcatccacaagataggtatagtgaccgatttattccatacttcacagaataacattttagagtttgggacacagcgattgatttattctataatttacagaaactggattttttttatccaaaacagacgctacttttgcgtaaagaatgtggaggcgacatcaacgccaatttccactatcaacattttctctctctcttatctccatatcacattcacatctaccattaccattattttgcggcggaaacaggttcaaaaataactctggaaatatgcctgtctaccacatgcggcgggcagtgagcagcgtagtaacagcttttcacgatgctcagaaaggtctgccttgtctcgctgctgccggttttcttctcaccgagtctcagaagatactgaacgaactctcgtatacgcagcttcaattcgtcatcgacatggctcatcatctcttcgttcttctcggggtcctatatgaagccatatacatgcatcatcaggtcatcatgttcgtcacatgaaaaaagggaaataataactacgcacaaactttctgtagtatatatgtgctatacctgagatactagcatcttctgcttgagactgtcacatatagacccagtgagctggataatccgacggtcaccatcttcgctcgcagcctcacctgcagctcgcccagcgctgatctcgatcattcgagctaaaagcagacacgtttgcttgtcatgaaccatgcgcgacccttcttgttccacagcactggatccattacacacgctgtctgctgcatctgccttctccctgacccattcagcccactacacaagttcacagaagaataatggtattagtagctaggatgactgtgcatgctgaacaaaaacgatagatgtcgtagtacttgttaactgcaaaaaaaaaaaaaatctcttcttctgaacgttacgtttaacttacagctgatctcagtagcttgtggatgtcctccggatcaccgccgtgaatcggctgcgcttctcgcgctaacgagtcggtaagccgcagaactgccttcacaagaacagcgtcacttccacttgatgagttgaacctggatatatatgcaccacattgcattggtctcagataatggcaacaaaaaagaaaaaaaaaacttaaatttttaatttcccatcgatcagcttattaccatgatccatccgtttcttcactggggcggcaacgcaaggagtgttccaagcgttctctgaatgaggggctgttacggagatgggtagagacggcgttggcaagtatcgccgctctggcccacgcaagccgctccgcggctcggcacggctcgtagacggaagcggcggccaggaaatacgctcgcagagcatcctcttgcgccactccgaaatccatgagccggttctcagtgtaccacctatatataggtgataagatatatacgagaagcccttattatatatcaaggatatatatgatgatctgtgcagatttattttgtatcgagaagaaatggtaatcgcgaaaaaataaaaaaccatacatactttttcaggccttgccactcaagctgatgtagggcttggcaatggttgaagtccatcctagccagctcaagatacacgtcgttattcacaagaggcatcctgtcaaaaaaagaaaaacaaaaagacagccatcacatacactgaggttatttggcttcaattacatgcatcaaaagaaccaatgcaaatttctgaaaccaaatatatagctaaagatctatctacctgtagagcgtcttcccgatccagacatcgtcgccgccgccgtactgttcgagatagtctctggcctccacgcgcggcaggttcccataccaagggaagtccagggtgtacactacctctccaggcaggtccttagatatgatccatttgtcacggagcgctccctcggcttgtttccgcctgaggaactcgtacgagaaaggccctgcacggtgcaggacgtcctcccccgggaagcttatctgggaggcccctgttgaggttgtacatccccgtcaccgcctggttcgactgccccacgaaggcgaagaactccccgtccttctcgaagttcttgaacacatctacacgtacacaggcagggcagaagcacgttttttttattattattacgtacgatgggtgggagaccaaatgaaaaatgttcaggacacgcgtgtgtatgacgtgacgatctctgttgtctgcgcgttttttttgtttgtttgttacgtacctggcgagacgctgtatccgtgcagccgtagcaggcggaaagccatggccgtgtcgtccacctccttcacgtcggagttcctcgcccagcagatcccgtcctcagtccagtgcctgttcacgtagtccatgcactgctcaatctctttctggaagtagcgggagatcccgagacgctccaggcgatcgacagcccatatgtgctcgaaaaggtccacggggtagacgttgggcactgcgagaaacggcgagagaagacgaaccgttgaagagacgagaaggaaggcgcatgcagtgggcaacgctgcattgcatgcatgcatgctatgcccatgtatctacgctactgcttgccgcttgcgtacctcctccgttgaatttcttgactgtcctgtcgatgtagctgaagcacctgtcgtcgccggtgttcatgagagcgtacgcggtggccgcgggtgagaagaggaaggacccgtcgctcgactgcagtttcagaagccttgcccagtctagcccgggcatcccttccaggctgtggagaatggatgtgggaaccgtgtgcatcacttccttaggaatcctcttcaccttgatctccctgctcgagtagcttgcctgcagagcctggtggtcgtacgggaagtcgtggacgcccagactcttggctagttcgatgagggaagggaacgcgagctcgaaccctatcggcatggactcctcgtcctccgtcgctagcttccacatgttccggccgaggaaagagagccctgtgaacacacacacacacacacttgagtcttcagcaacgcccgttttctgtcgaggtacactgccgtcgtgtgttctctcgatcggccagcacacagtaattacgtacctctgccgcgcatctcgggctccagcgaccacctggtgagcgtgacgacgcacgccagcgtgttgatcaggcggtcgtacgcggagaacagggccgcgtcgccccacgagccgtcggggagctggttgttccggatccaccgcacggcggccgggaactgcgggccctcgccgccgtccagcctgggcacaagaccgacccaggcggtgtcgtacgccgacacgctgatgtccccgtcgctcatcgacgtcagcattgccctgatctcgtcgaccagcggctcagcgtcgtcgtcgtccgtaggccatctcgtgcggcggctttcggcatcggttctcacgatgggcgttagggacgaacctgcatgcatgcgtgcgttacaaacctagctgtttgctgctcagatttggagcgagctagcgatcacccgtacctttggcgacggcggcggattcgctggtgtcctgggcccgcgcccgcgccctccaccggccggcggccgcggggacggcgactgcatccgtcttcttcttgatgcgggaactccatgggcctagttgaacgaccgcaagggaagaaaggttttgaactgttgtgcaagacgatgaaagaaccatctttgcgcttgcgcttgtagtacgtttttacttttctactactagttgagaatgagatgtgtggtttctcttctcttcttcctttggccggatatatcggagaagagatctactactataatactcgcactgaaacgcatgaaactgactagtaattcatttcagagccgtcgtccccacataaatgctgctggggcgctatctgcggatgtgtgcgtgaaaggacaccaccacccag

SEQ ID NO: 3182 - DNA, 2167 bp, Zea mays
cctcgaggccggccgggccgggccattcacgcatacagcagccgagacgtagcctcccgcggtgacactcgcgcacttcagcactcagccactcagcacagccactgacccgtcgcctccccggctcgcgaccgcatctctctcgccccttccaagttcctaatcgccaccgctgtccccaaccagcaaaccctagccctcatcgccggcggccatggccgagaccgtcgacgacaagatcagttacttccaggctgtcaccggcatctccgacacggacctctgcacggaaatcctcgccgcgcacaactgggacctgcagctcgcggtgtcctccatcaccgccaacccctcctcgccctccgccccggtttccacctcctcacgcgacccggccccttccgcccctttggcagatgcggagttcgtcgcgccaccgccgccgataccgccgccgcctcagcagcagccggggatcgcgtggaagctggtgacgctccccttctacgtggtctcgggtggggccagcctcgtcgccggctccttccgccttggcgcctgggtcgccgggggcgtgctgtcccgctccctctccctcctcggcctcgcggggcaggccggcagcggcgaccgcctgctagagctgccgccgtcagctgccgaggcggctgacttcgtcgccgagttcgagcgcgagtgcggcgctggccgcggcccgcgcttcgtggccgaggggttcgctgatgcgctgcagcgagcgcagcgggaattcaagcttctgttcgtgtacctccactcccctgatcacccggatacccctgccttctgcggcggctgcctctgtgctgaaccggtcgcggcctttatagatgagaacttcgttgcgtggggtggtagtatcagaaggaccgaagggttcaagatgagcaacagcctgaatgcgtcgagattcccgttttgtgctgtggtcatggcttctacaaaccagagaatcgtgctattgcagcaggttgaagggcccaaatcacctgaagagatgataacaattcttcaacgtgttgttgaagaatgtgctacatcactcgttgctgccaggattgaagctgaagagagactaaacaaccagcgtttgcgtgaggaacaagatgctgcttacagagctgcacttgaagctgaccaggccagggaacgtgaaaggatagaggaacaggaaagacgtgaaagggaggctgtagaggctgagaaaaagcgtaaagaagaggaggaagctgtagcaagggcagcccaagaagcagctgaaaaggaagctgctcttgcaaggaggaggcaagagaaggccatggctcttggagctgaacctgagaaaggaccaggtgttactcgggttctcataagattcccaacgggagagcgcaaagagcggagattccatagttctgcaaccgtcacttccctctatgactacgtcgattctttagactgcatgaaagcagagaattacagcctagtttcaaatttcccacgggtcacatatggtccagagaagcactccctgacactggaggaggcaggcttgcatccgcaggcgagcctgtttatcgagatagagcaatgatgctatagaaaaaccggaacttggaagtataggtgctcctttttccgaatttgtccagtaacagttaaggatttccagatgtattacacaccacaggtgcatgcttgttcatgaaataaaattcgccctcaccaagatcagttgactgcagccaggtcttgtgaattgtgattcgtttggaaagcctgccttgattctgtcagccaaagcatgacgacctaatttgcctatccttccgtaagacatcctcaagaaaggaattctccctggcttcttttagcaactaagtgactccagggtaaaatggattcgcaagttcagttggattcaatttgggtaggcatatcaagcttccatacattaagaaaactactactttttctctatatatatatagaccacagtttctgcttgatagttgttcaaacacgttcaaaatctttacaatgagcattaatttagtccgacttgagcacggcttgacccattgtctactggacctatgttggcttggtccaatcatcgtgctatgtctaagtcttagttgtgtcg

SEQ ID NO: 3183 - DNA, 1777 bp, Zea mays
  misc_feature (474)..(474): n is a, c, g, or t
  misc_feature (533)..(534): n is a, c, g, or t
  misc_feature (608)..(608): n is a, c, g, or t
  misc_feature (666)..(667): n is a, c, g, or t
  misc_feature (685)..(685): n is a, c, g, or t
  misc_feature (695)..(695): n is a, c, g, or t
cattgggtacctcgaggccggccgggactgacctgtcggccgtcgccctcccggctcgcaaccgcatctctctcggcttctggcctcttcctagttcctaactaccaccgccaccgctaccactggcctcaatctgcaaaccctagccctcgtcgccggcggccatggccgagaccgtcgacgacaaggtcagctacttccaggccgtcaccggcatctccaacacggacctctgcacggagatcctcgccgcgcacaattgggacctgcagctcgcggtgtccaccatcaccgccaacccctcctcgccctccgcttcggcctccacctcctcgcgtgacccggccccttccgctccactggcggtagatgcagagttcgtcgcgcccccgccgccgatgccgctgccgctgccgccccagcagcagccgggggatcgcgtggaagctggtgacgctccccttccacgtggtnctcggggtggggtcggcctcgtcgccggcacgttccgccttggcgcctgggtaggccgnngggcgtgctgtcccgctccctctccctctccgggcctcgcggggcaggcggggcagcggtgaccgcctgctagnagttgccgccgtcagctgccgaggcggccgactttcgtcgctgagttcgagcgcgggnnttcggcgctggccgcggnccgcgctcgnggccgaggggttcgctgatgcgctgaagcgagcgcagcgggaattcaagcttctgttcgtgtacctccactcccctgatcacccggatacccctgccttctgcggtggctgcctctgcgctgaacccgtcgcggcctttatagatgagaacttcgttgcctggggcggtagcatcagaaggactgaagggttcaagatgagcaacagcctgaatgcgtcgagatttccgttttgtgctgtggtcatggcttctacaaaccagagaatcgtgctattgcagcaggttgaagggcccaaatcacctgaagagatgataacagttcttcaacgtgttgttgaagaatgtgctacatcacttgttgctgctaggattgaagctgaagagagactaaacaaccagcgattgcgtgaggaacaagatgctgcttacagagctgcacttgaagctgatcaggccagggaacgtgaaaggttagaggaactggaaagacgtgaaagagaggctgcagaggctgagaaaaagcgtaaagaagaggaggaagctgtagcaagggcatcccaagaagcagctgagaaggaagctgctcttgcaaggaggaggcaagagaaggccatggctcttggagctgaacctgagaaaggaccaggtgttactcgggttctcataagattcccaactggagagcgcagagagcggagattctacagttctgcaaccgtcgcttccctctatgactatgtcgattctctagactgcatgaaagcggagaagtacaccctagtttcgaatttcccacgcgttacatatggtccagaaaagcaatccctgacgctggaggaagcaggcttgcatctgcaggcgagcttgtttatcgagatagaacaatgatgctgtaagctaaagaaaagccgaaactaaagtacagacgctcctttttcgaagttgttcagcgacagttaaggatttccagatggtaatacaccacaggtgcatgcttcttgtgtacttttgtcatgaactaaaattcgcttccaccaatatcagttggctgcagccaggtcttgcaaaaaaaaaaaaaaaa

SEQ ID NO: 3184 - DNA, 2571 bp, Zea mays
tttgggcgggttttgcaccttacttatatattgaggatagttggaaatggcaccatcagttggcctctaggatctctttgtctatggcaaagtgtttgttgtttgcaaaatttttgaagtccatagcgcaagaagacacaatatctagtagcagtgagcaagatgtcgctgtgaaaatttcctgtgagcttgcacaaaagcattggcaaagtgctcttgaaggtctaggagataccattttggtaaatcaggaaacacagttctggcaggtggcatcagctatgcttgattatataatggggataccaaacgtccttgcttggggtaatgttcttaatgctacatgctctgcggtcaagcacttctgctcccatgcacctaggctatcttggaggctgcagacagataagtggttgtcattattagtttcaggtggaattgagggcttcaaaaacagtgagatctgtttgattgatcttttctgtacaatgttgaatcattctgaaccagagcccccgcgtccggctgtacaacagcttgggaggattattaactcaacaagttctactgaagctgatttgaaatatccaaactatgaccaaaatttcctcatatctgtttcaacagtaacatcccttttggtaactcatacatgggacagcgtagcagcattggctctccatgactcttctatgctattaaggaatcatgcaatggcattgcttactgaatatgtgccttttgttgataggaagcacctgcagtccttcctttcatccagtaacggtatcctgactggtttgggacaactttctggtgtaattgaagagggctattttacacgaatgtctttgctgttgttttctaaggcatgtctttattctaatcctgaagatatcgctttgatacctgaatgtgtttggcagaagttggaaaacatgcaaacatcaactggaggttttggatatatggagaaagatctctgcctagctctgtgccaactaaaaagtgaatcagatgctacaactgttgcaaaagttctttctggatgtaatagtcaaccagtcagccctgatttcaagagcatccgtgaatcaatcctccaggtgatgtcctctttgagttctattgaagcatactttgagttcttcgcagccagatctgcacaagaacatgaggaacttgaagaagccgagattgaattggagcttattgaaaaagagaagtcagttcctaactttgttgagcataccaatgatacgatggtgcttgccatgccatcatatgaccgtgatggtagtgaggttaataaacggctccagcaaatccgggaaaatattcggtccctggaaaggtctaggctgaaagaggaaattacagcgcgcagacaaaagaagctgcttctaagacatgcccgtgaaaagtacctagaagagacatgctccagggaaacggagcttatgcaagagctcgacagggaaagagctctcgagatggaacgtgaagtagaaaggcagcgtcaactggatattgagcgtgcaaagtctagggaactgcaattcaacattgatttggaaaaagagaaacaaactcagagagagcttcaacgcgaactggagcaagtcgagttggggcggtcatcaaggcgtgagttctctgccaatcccaacagccgctccagggagaggtaccgcgaaagggatggtggcggcagagcacagcaggaggcggggagcctgaggtcttcgagcagccgaggccaggaggggggctctgcccaggcgcccgcaccggccgggccgggccctaccgtcatgctcgccgggtcaaggacgttctcgggggccaaccttccaacgattctgcagcctcgcgagcgcgctgccgacgaggacagcgcttgggccgaggacgctagcagcaacggagatcctgaactggacggcgtgaggccgcatgggccgcgaggcagcaggtcatcctcctctaggcaggttgcggagaggagggagcgggatggcactgctgctggcacgggcaggagagaagggaaatgggagaggaagcagcacccgtgactattccctgcttgtgttgtgcctaagcctaacggaggcttcctcaatcgttgtaattgtactcgtatgggcattggatcacgtggctgcttagtcaacggtaccgtgcattgataaaaaggttggatcatcgtatgggaacactaccaatcagctgcctgctcagtcaacagcaccattaccatcacaccgacttttgccaaaaaaaaaaaaaaaaaaaaaaaaaaaatcaaggcttgtcaatccaaaagaggatttgagtattaaatccactcttaaggctagtttgagaaccttatttttttaagagattttcttttttttttaagataaattagtttattttctcttgagaaaatagaaatctcttggaaaattggagttgctaaactagcccttagtcaaaaatgactagtagagaatttaatcttcaattgccttctggatttacgtaaaaaaaaaaaaaaaaaaactcgagggggggcccggtacc

SEQ ID NO: 3185 - DNA, 1485 bp, Zea mays
cgcccgcggaagtaactctggctgcgaccgcacccacgcgtttgtattgactatggcaaagagtgtgctgtgtgggttttttttgaagaccatcgcgcacgacgacacaatatctagtagcagggagcaagatgtcgctgagaaaatttactgtgagcttgcacaaaagcattggcaaagtgctcttgaaggactaggagataccattttggtaaatcaggaaacacagttctggcaggtggcatcagctatgcttgattacataatggggataccaaacgtccttgcttggggtaatgttcttaatgctacatgctctgcggtcaagcacttctgctcccatgcacctaggctatcttggaggctgcagacagataagtggttgtcattattagtttcaggtggaattgagggcttcaaaaacagtgagatctgtttgattgatcttttctgtacaatgttgaatcattctgaaccagagcagcgttttgttgctgtacaacagcttgggaggattattaactcaacaagttctactgaagctgatttgaaatatccaaactatgaccaaaatttcctcatatctgtttcgacagtaacatcccttttggtaactcatacatgggacagagtagcagcattggctctccatgactcttctatgctattaaggaatcatgcaatggcattgcttactgaatatgtgccttttgttgataggaagcacctgcagtccttcctttcatccagtaacggtatcctgactggtttgggacaactttctggtgtaattgaagagggctattttacacgaatgtctttgctgttgttttctaaggcatgtctttattctaatcctgaagatatcgctttgatacctgaatgtgtttggcagaagttggaaaacatgcaaacatcaactggtaaaatctgtgataattgaatattcagatttctgaggcagcatatataaatttcattgtattccctatacgatgtcctgcttgttcaagctattttttttcttgttatgtactaggaggttttggatatatggagaaagatctctgcctagctctgtgccaactaaaaagtgaatcagatgctacaactgtactgccccttcccaccccctctccggtacttatgtactgtaacatgtttaccaagtaccgacttcaaatctcttccattaggttgcaaaagttctttctggatgtaatagtcaaccagtcagccctgatttcaagagcatccgtgaatcaatcctccaggtcagtgttttgaatgatcattattatttttggtcttctccatctgtattgtcgcttctatttctactttattgcacggttatctgtttcagttcattacttgatttatgttctcattgttgatcgtgcctgcatataagactcattttatattttgcggacagtttcaatctttgtaataactgcacttagactaagtgtgcccccaaaa

SEQ ID NO: 3186 - DNA, 2809 bp, Zea mays
cgctggacttccattcgaaaatgggacttgtcatcatcttgtatgccgtttccatagcaacactactagtcctcctttggtttcacaagcccggagtagtgtagtcaccgttcccggcgacgagaagcgacgtcgacgacttccgcctggaccatggacccttccagtcatcggcagcatccaccacgtggcgcgcggcctaggacaccgcaccatgatggagctgtcccgtcggcacggccccctcatgttcctccgcctcggcgaggtcccgacgctggtggtgtccagcgccgaggcggcggagctggtgatgaagacccacgacctcgccttctgctcccgcccgacaaccagcgtcaccatcgacatcgttggctgcaagggcaaggggctcggcttcgccccctacggcgaccggtggcgccagatgaagaagatcgtcgtggtggagcttctcagcgccgcgcaggtcaagcgcatcgagtccatcagagccaacgaggtgggacgcctcctccagtccatcgccgccgcccgtggagccgtcaacgtcagcgccgaggtgaaggcgctcgcgccggacctcgtggcgagggccatgttcggtggcaactgcgccgagaaggccgacttcatccgccggtacaacgaggtcagccagctggtgtcgggcttcttcctggtggacctgttcccgtcgtcgaggctggtacggtggctgagcatcggcgagcgccgtctcctgaggagctacggcggtatccagcgcatcatcgcgtccatcatcgagagccgcaaagctgccagcaccagcgacgatggggacaactgcagctcgcacgaccatcctgcagaggatcttctcggcgtgctgctcaggctgcagaaggagggctcgctagctttccctctcacctccgagattataggcgccgtcatgtttgtaagtacccctactcttgttctctttgcacttattttaacatatcaattcacattaaattaattctccatcagtcccaaagtaaagaattacattttacagtcatatatagtgtcaactcaaattatttcaagtcgaccatataaaaaggtattaatatttactagtttaaataagtaccaacaaattcaacatgaaatataaatctgtagcatatatctggggacatacaaaatttggctaaattttatgatagattgatttcgaccacgagtagacctagagtttctgttctatgatagacaaagtacacataataacgtacaaattactatgtacttgtttcaggacatattcggaggtgccaccacaaccctagggtccacgatggagtgggctatgtcagagctaaggaagaaatcagagacgatgagaaagacacaagaggacattcgtcgcgtgctaggtgggtcacgacgaggtgtcatcacgaacactgacctcgttggcctcacctacctaccaatggttatcaaggaggttcttcggctgcatcctccaaaccctctgttggtcccgcgtgagtcgagagaggattgccaagtcatgggctaccacattcccaaaggcaccaaggtgctcgtgaacgcatttgcgatctccagggattcaaggtactggaacaaccctgaagattttagcccagagaggtttcagaataacaatgtcgactacaaagggaccgattttgagttcacccccttcggtgctggtcgtcgacgctgccctgcaatcatgtttgccacttctactctagagattgcattggcaaaccttctctaccacttcgactgggctcttccggatggagtgagcccaaagatggtggaaatgtctgagcaatacgggatgggtgtcaccaaaaagttagacctgcatttgagagccatcccatatgtatactctactatggcataggtatggggggtggttaaagctacctgcaccttaacttgaggtcctttgatgatcgatcattgcatcttcctatttctgaataagggtgaacttttctatgcccatcttgtaggccactagtttgttttacatagagcaacttcaggagcttcctaaaaaaaaaaaaaaaaatgttttttgccaaaaagagaaaaagtacccctctaagagtttgaaaaacaagtccattaaaagtaagaaattggatgtaactttctgtggtggatagcaactccatgttcgctcacttcgccttgcacccccgttgcccgcttcacgttcttttttcaacacaagtccaacatcattactgtaaaaaaatattgggagacatgctccctaattaacaaaggcaggcataaaagagtatcacctctctctcaaaaggaagcaccctactctcttagtgtttactaacatttctttctactgaaaagcggttcccccaatcctttatgcagttcaaccgcatatctcacagactcacccaaattgctagatctggacgccccacatatatatagcctccattttgtttcttcaacctctctccacatgtccaattcacatcaaacttgagacaaaagttgaaaaagagcatttactctctcccttgtcactcgcactaccccaaatcttctcccaaaatcgtagtgggaaaacttggtatgaggttaagatctcggatctttgagttccattcttccatcccacttgctttgagctttgggcaaacatcaaaaccttgggcagatttgttactcttggagcttctatacatctagtcatcgcttgagagtctccgagtttgtggaaggcctcaagaagtttgtatcacttgctctc

SEQ ID NO: 3187 - DNA, 1225 bp, Zea mays
atcaacaaatcagcatcctccaggagtccaggtccaggtccaatccaatacagttgcttcttctctgacgcaacgcaaccccaactccccaagctcgcggcaaccgcgagtacctcactctgtgcaaccgccgccacgcgcaggtgttgactgttgacttgatggatcagattatggattttcctgttgacccaatcatggcagctaaggcctataagtacaaagcagaaatacttattaatgaatacttgctagcagattcatatgttctatacacttctgtgctcgcggggctcctgatgtgcaagttgtcgtatgacttcacacacataatcagttctgtctacttcaaaggttatgcctctcttgcaaagatgaaaaaaattgaatggaacaacagaggaatgtccactgtccatgcaatattcattacaatgatgtcagtatacctagtcttcttatcagacttgttctctgatcagctggaaggtccagtaacatttcgcagttcacacctctccaatttaacattgggggtctctgttgggtacttcattgcggatcttgcaatgatattttggttctacccttctcttggtggtatggagtatgttttccaccacatcctgtgccttgtttgtgctgtatattctatgctttctggggaaggacagctatacgcatacatgtttctcatctctgagactaccaccccgggaatcaacctacgatggttcctcgacgttgctggaaagaaaaattccaaagcatacattgccaacggggttgcaatgtttgttacttggctgatggtccggatagttctgttcgtctacttgttttatcacatccttacaaattatgatcaggttaagcagatggacacttttgcttgtgttctgatatctgtcgcccccaccatactgttcactatgaatataatatggttttccaagatcgtaaaaggtctcaagaagacgcttgccaaaaggcacactgaataggggaatgcgcgtacatgtacatccatcccatctgtacattcacttacagctatgcacatagtagctaacgcagacatgctgttaattcagctttttcgttgtgactgctcagcttgttttctggatgttatatggttttgtgtgtatgttaggtctaactgcgtgtgcttaatgtaatagttcatcgatttgtaaaatttaggtctatgcgatagcttcag

SEQ ID NO: 3188 - DNA, 1497 bp, Zea mays
ccgggtcgacctagcgtccgcttcgccctccggacttcttttcctgccctttgcatcttccagcacgttctccaatccccaccggcccatcctctacggaaacaagaacagggacaaaagactgaaacaatcatcaacaaatcagcatcctccaggagtccaggtccaggtccaggtccaatccaatacagttgcttcttctctgacgcaacgcaacgcaacgcaaccccaactccccaagctcgcggcaaccgcgagtacctcactctgtgcaaccgccgccacgcgcaggtgttgactgttgacttgatggatcagattatggattttcctgttgacccaatcatggcagctaaggcctataagtacaaagcagaaatactttttaatgaatacttgctagcagattcatatgttctatacacttctgtgctcgcggggctcctgatgtgcaagttgtcgtatgacttcacacacataatcagttctgtctacttcaaaggttatgcctctcttgcaaagatgaaaaaaattgaatggaacaacagaggaatgtccactgtccatgcaatattcattacaatgatgtcagtatacctagtcttcttatcagacttgttctctgatcagctggaaggtccagtaacatttcgcagttcacacctctccaatttaacattgggggtctctgttgggtacttcattgcggatcttgcaatgatattttggttctacccttctcttggtggtatggagtatgttttccaccacatcctgtgccttgtttgtgctgtatattctatgctttctggggaaggacagctatacgcatacatgtttctcatctctgagactaccaccccgggaatcaacctacgatggttcctcgacgttgctggaaagaaaaattccaaagcatacattgccaacggggttgcaatgtttgttacttggctgatggtccggatagttctgttcgtctacttgttttatcacatccttacaaattatgatcaggttaagcagatggacacttttgcttgtgttctgatatctgtcgcccccaccatactgttcactatgaatataatatggttttccaagatcgtaaaaggtctcaagaagacgcttgccaaaaggcacactgaataggggaatgcgcgtacatgtacatccatcccatctgtacattcacttacagctatgcacatattagctaatgcagacatgctgttaattcagctttttcgttgtgactgctcagcttgttttctggatgttatatggttttgtgtgtatgttaggtctaactgcgtgtgcttaatgtaatagttcatcgatttgtaaaatttaggtctatgcgatagcttcagaaatttcacattcggtttctgagactgggtttacccttgttccagtcccgcttttgccctttgccattaattttgaccatggtggacaaagaagctaattaaggaaggcgatgaagtttaaccc

SEQ ID NO: 3189 - DNA, 1362 bp, Zea mays
tgggtacctcgaggccggccgggccgggatggcagatatgttctctttttcaatacgtatgatgaatcgaaagggattgatatgttgtgtgaggcttggaaagataagcatgggatgtcatcttggacttgggatagagataacagagtctgttagagggagaatcacggcgagagcgtgctcgtgggcacccctctccgtcaactgggtgcgcgatcgatcgatcgaaatatcgaactgcagttgccaaaaccccaatccggtcttctatttccgatcgagccgcaaacgaggcaggaagaaggccggcgcaggcgcaggcgcggatggcgatgggagcgacggttcgcgcggcggccgcggacgccgtggtgacgttcctgtgggtgctgtgcgcctccgcgctcggtgcctccacagcagccgtcacgtcgtacctgggggtgcaggagggcgccggccactacgcgctcctcgtcaccacgtccctcctctcggtgctcctcttcaccttcgatctcctctgcggtgcgctcggcggcgccagcttcaaccccaccgacttcgccgcctcctatgccgccggactcgacagcccctccctcttctcggttgcgctccgcttcccggcgcaggccgccggcgctgtgggcggcgccctggccatctcggagctgatgccggcgcagtataagcacacgctcgcgggcccctcactcaaggtggatccccacaccggtgccctagccgaaggggtgctcaccttcgtcatcaccctgaccgtgctctgggtcatcgtcaagggcccccgcaacgtcatcctcaagaccttgctgctctcaacctccatcgtctccgtcatcctcgcaggcgcagagtacacggggccgtctatgaacccagctaatgcatttggctgggcatatgttaacaattggcacaacacatgggagcagctgtatgtgtactggatatgcccctttattggggccatgcttgctggatggatatttagggtggtgttcctaccaccggcacctaagcccaagaccaagaaagcatgattactcgtttatggatgctggtttagaagaaataagaaatagaggaaggtcacataagctcatgtgttgtacttgatttcctcaacttcccacaaactgggtgttgtgctctgttacttatttctcatcaataatttatgtttacttgtaattttgggctagtcaggatgtgtttttgtccttttatttagtttttgtatgttttctttatgagtacagtaaaatcattgatctcaattgagatggaaatgagctgaggtcggctcggcttgctccaaaaacaaaaaaaaaaaaaaaa

SEQ ID NO: 3190 - DNA, 6131 bp, Zea mays
  misc_feature (2516)..(2516): n is a, c, g, or t
tccctcaagcgaggaatctccatattttggagtctctcacgccttacacaactgttctccaataaacacaagagtaaaagggggaagtttctacaaatattccaaaagtaaatttaagatgtaagattaatagttttattttataacaattagaatcggatagtatccactccatggtaaaataaatgttaataatacatttatttcatattaatacatctgtcttttttagcttttgagtttctgtctatgtgcaaatagatgattatttttctgtttatgctcaaatagttgatgataaatctaaacacataaataaaacgaatacattaattattgtatgaattaatttgaaagttaaaacgaattttatttgaattggacgttttgtcgtatattcacaaagaaatatgtgcagtcgcgggctgcgagggcggggtctggtcacggagccggtcaaggtgcagtcaagcagcgacgaggggaggcaggcggtcagagactcagagcgcgcagaagaagctggcgaatcagggcggctagttggacttgacgacttgtcacgtcccgtgcgtgccgaacttgccgtgcgcagcaacctacctaccccggcccaccgttgcggtcccgtgcatgcgcagccgggttccgctcccgcggtcaccggcgccggccccggccccgccttccgtttcagtgctcttcggctttcacgcaccggggcgcgcgcggttgcatttgcgtgcgccgctggtacccgaccgtgcccggtgagtcggtgaccgcggtgaagacttccgaggctctcgtggtagcacgacatatgtttcagcgacccgactaggcctgtgcgtggcgcgacgcgttccgatgcatggtccaagcctgcctgtttcaagcatttgttacagtgaacgagttatcaaccagatgttttgctgaccggataaggaatttttgttatttttttacaaatgttaaattaaaacaagaaacaaaatattcatgttttttcggtttgttactacgctaaattaaatcaagaaacaaaagctcgtcaaattaggaagcaaaaaaaaaatcaaatactaggcggcaatctaaggtaggaagccaaatccggcctttcttcctctcggaaaatacttaaaaggcccttgttccttgtacccgctgaagataagacccactaaaaacacgacccacatgtcagtggaatttcaaaacgctgccagttccatccccattccgaccctgccgccgcacccgccccttccccagcccatccggcccggtcccttcagattctcgacagtccgcgttaaataggccgccccgctcgccttccactcctcgttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcgtcggatccggcggagtcccatgtcgcctctcgccgcttccctacccctccaaaggtatcgctcggctgactcttgcgtgaagtcgtcggagcaaactatctatcagtagtactagcagtgtcgtttcgttttggtctgtcgtggcgtggtagtaagaaatgcaagtgagcagcaccagtatctttccgtttgaatcagttgtaaggcagtcatggtcatggttggctctgccggatctatctgtcatgaactatctatattatatcattatcaatgttatgcaatgagtctttggcattgagttaaggtaaaaaaaaaaaatgcctttgttgattcttttggttggttttcgttcttgtgtcgtctgtaatctttgcaggatcaacttcggcgtcctttttgtgttaaattatgatagcggagtgggattgttgtcttaagatcnttttgtgttgtattatgatagtgcatagtggagtgagactgggtctcaaagagatggggaaattactactatgacgaaaattcgagttcatcagaataaaggatgaaatgtattggggggagaaggagccgaaaggtgaagagtggtcagatggatggtgtattggtgcggtaaagtgtgctgcaaaagcaagcaggcaccaggtgcagtgctgctgctgtgcagactggcactggcattgctgttttggcaacagagagcgtctgggtctgggtggcatggtatgggtctgcttcatgcacgagcacggcgccaggctctgttttgtccgcatcgcggggcggttgtggaaaagcgaggggcggtttccatttctgttgcaaagcctgacagcttagcgagaccttttatttttctgatttcctgcttcgattccaactttcatgtggtgtgtggtacgggcagtagttgcgacgcgcaatttcgcatctcataggccatgaacgatcttcattttttttccttgtcctccgctgggttaatgtttgtcccatgtattagtggcgaagccaaatcgcaatctccaaatttgattgaaacgaatcccaaagttttcatagttgggttcattccaagaaaaaagtgaaagctgatgtttcgcacggggaatcttgcttgtttcgtttcgcgccaaaagtgaaagctgtgtgtggatcacgttttcaggttacacaagtacagatctaaacatccggcctgtgcccgagtatatcagatttacggacgctgttaagtaatttgttcttgtttgccgaacgatgaaattcctgctatgaacgcttttctctctcatggaagttcagttctggaccgatacgaaaggcatcttgagtcattggtgaccattgttggggaaaatgagatatctctgcaacttattaaggtagtaaccaagttgtttgtgcaatctcaatcgtccgatgaagctcctatcccgtagcacaccacacatatcacttttttgcctcccgaccctaacgtcgcccaacgtcctcccctcaatctcaaatgttaaaccgtcctattcgtcaaaatctctcgtactgaaccatcccgtggcatgaagctgcttcgtctcaactgacttcggagctgaacattattagcgtgttttgtttgaggaatgaggtagtacatcaatttctcagtcctcactttcttgtttggtttgtggaattgaataagctgatctatcactattttattccttataagccaataatttatggaataaatttatgatacgtcatcttatttaaaatggattgattgttcaaaccaaacacccctatcttatattgacacaatttgtttcagacctgcagcatcacggctctccttgatccggaggttgcacgggtcatgggcccctgccaagcccgagtttggcccaactgcgcaggtccattcagggcggcccactcggcgtccaggaaaagccggacgagagggccgcaagtgtccgcggttgtcgagatgatgcagcttttgcttggagcttggtgagcccatggtgctcgaccacacataggagagcatataccagaatggaacccagtacgcaataatatgctgggagcctgggattgctggtcagtaccgccgattaggaccaactcgcttcctcggatgaatgaacgctaatttaaaagcttcgttcttgagcacggaagcacgaccttacttgaacaggatctgttctataggatcgtaccgttgcacccttgattattaaggaggcaaggttgatgaaccatgacctgtgggccagagcgtgattaacggctattaaggaggcaaggttgatgaaccatgacctgtgggccagagcgtgattaacggccaggacctgcttgatgtctgtttccggagctgtagaggatcgttccccccttctggggtgggctcataggttgttgacaggttctcttttttttctcagcattgctcctcgtttttaagactaacgcgccttcttgttttttccatcaacagagcaagagctacagtttttttggcactcgagaagtttcttcaaatctgacttcatgcgattgtgcgacacacatgattctttctactcgatttgcagaaagttcacagttgtttccatctttattttcttgttggttaatgcaaagctacgtattctacatctgtctgcagattctcgagtgctagtctcaatgtcttttattctcttcagtttgcagtagtgatacttcagatgtataatcttgttttactatttggttttgtttatttcgaccctcttcctttctacgcttttactgcaggctgtgcagaagttgattgacgaggaattcgaaagtattgtccatttgcggacgtcgtggtttcaaaatagagtttgaacagcacggcatggcttcatcagactttctagagcagaaaacaaacttgaggctcttctgcaggttgtgtaaactcttgtttctcttcccttctgtgcacacgcatctgtctttccatacacttgtatataaatgtatatatatacacacacacacacgagcgcacattgttcagttattgttgcttttttttttggtctgtaatttagctatgtcagaatgacggatcgatgattccaaattttcaattgataactgttgtgaaaacgtggagtatgaatagaatcgtatatccacggttaactaccatggaaaggttccagctggactacaatcatactaggaaagtagggaagagctgagcgcgtcaagaaggtaaagctagagcaggcacgaccagaatgaagcccacgcattaatattacacataataggacagcatatagcagaatgcagcggcccagtcccgccgattagcaccacctcgcttgctcagatgagggaacgctgatttaaaagcttggttctcgagcccggtaacacgaccttacttgaacaggatctgttctataggatcgtactgttgtatccttgattgataaggaggcaagcacttaaacctggttgatgatccatgacctgtgggtcagagcgtgattaacggccgccaccggctctgatgcctgtgtccggtgctgtagatgatcgttcctccgccagttctacctggctggggtggcccatgggttatctgacgggttgtcttttttttgtgtcctgcaaaaatattgctgctgtctacctcggttttgaacacatatctttcttgaatttgggattaacggggaagtttgttttggaccatgcttaactcccatgtgtgctacatgcatgcgttgggtccttaccaggcgttagttagttttgagcactgcacaccgaggaaaaaacgagacgatcctagctaggcgttagttaccggatatctttcttctgaacaagatctgtcgtatactcgtatacagctgcgaagcatggcctgtgggaaatgtaagggcgtgattaacggcttggattggagcttgagacatggtgttagaaataaatgcgacacaaataggatcaatcacagagaagacacggatttaacgtggaaaacccctccaaagtgaaggggaaa

SEQ ID NO: 3191 - DNA, 1696 bp, Zea mays
  misc_feature (1675)..(1675): n is a, c, g, or t
  misc_feature (1683)..(1683): n is a, c, g, or t
  misc_feature (1687)..(1688): n is a, c, g, or t
  misc_feature (1695)..(1696): n is a, c, g, or t
cggacgcgtggggtgtttcaacagaatcttgtccatgaggaggatttcaaatcatctggatcaacaatgataaaaaatgcaaaccttattgtcaaagttgacaataattatttcccctggaataaagtttctcatgttattcttgggaaggctgtatatggctcaaagtttcccttagaacccactgatgctgttccggttgaacaacaggaaacacccaaatcaagagaggactctcttagaatgtctccctcaagccggagatggaggctttggctcaatccctttcggataacaagatcccttcaacgtagtaacagtgattcttccgaagacattttccttgactcagagtctgttttgagtccaatggatgatcaaactctggagaacaacaaaaaccagtcacctagaaagcaattcgtacggactttgattcccacaagtgaacaggtagcatctttaaatctgaaggagggccaaaacttggtgacctttagcttctccaccagagttcttgggaagcaacaggttgatgcacatatttacttgtggaaatggaatgctaaaattgtgatatctgatgtggatggcaccataacaaggtctgacgtgctgggtcaggtcatgcctttggttggacgtgattggagtcactcaggtgttgctcgccttttttctgcaattaaggaaaacggttatcaactactattccttagtgctagagcaattgtccaggcatatctcacgaagaacttcctctttaatctcaaacaggatgggaaagcacttacccaatgggcctgttgtaatttcacctgatggcttgtttccttcactctaccgagaagagttatacggagagccccacatgaattcaagattgcttgcctggaggacattaaggcgctctttccttctgattacaatccattttatgctgggtttggtaacagagatactgatgagctcagttacaagaagatgggaatacctaaaggcaagatttttatcatcaacccaaagggtgaagtggctgtcaacagttctgttgatgtgaagtcttatacgtccctacatacccttgtcaatgacatgtttccaccaacgactctggttgagcaggaagactacaacaactggaattactggaaggtgccattaccagatgttgatttgtagtgtagttttgacagaaacagccgtagataccagtagatcctgcaaaagcctagcagtagagcttcctgtaccctaattttcagccaccacgacggttttaggtccaatttgtgaaggtctcaagaattcccggatgtatggttttctgaaagccaatggcccaaggaaacgttgccactttatttccttcgacggagctttcacgtgatcatacggcttttgggtagtcatctgattgtcttcgtcgaacttgttgtacccagaggtctgagccctagaccctcgattcattagagaacccgtgatctggtcattgtccaagctactttgttctgattgcaggaaatctttaggtgccaaaagcagctgtacatttttttttcgtgatccaaaaacagctgtacatcgtatatcagcggatagaagagaattgctaagcatatctgcatcttgaaaccaaaaaaaaaaaaaaaggggggagaggggtggggtngaaaaganaagnnggaaccnn

SEQ ID NO: 3192 - DNA, 2309 bp, Zea mays
gggtggttttggatgcttccaaggaaatggactatctgtactctaaataaaggaaatacactactttgtaattttatcgatgagatttaacacttccttacttacattgtcatagtttgtgagttattttcagttctaaagtattattgtgagcaatgttgagtagtagtatctacatttacatgtggacctactgaagttttaaatttactacaaatttttagatgccttgtttggatcatgaacatttcaattgattctggattaattggtgaatggttctctagcgtaacggttaaggcttccgattagcacctttaggttccgggtttgatccccgtcgggggcgaatttcgggcttggttaaaaaaatcccctcgttgtgtcccgcccgctctcgtggatcgatatcctatgcaccaccctctggctgggctgttgtagagtgggcagttgatcggcccgttagtgataaggggccagggttcgggggttttgtcagccggaaccatgtttcggtctcttcttaatataatataatatcgggagggcggtctttccattccggccgagtttttttattctggattaattggtttaggaaggccgattctagaactgtctacttaccatatttactgaaagtttttaggtttagtacgtagtgttttttttttaattcgataaatgctaattttaaattttcattgtaattgggataatatttttgcattggaaaatgacatctatactgtttttatgtacatttttcatatttttgaaaaccagatagaagtcagttagaacacattattttactactggaaaaaccagtgttttcctaaacaccaaaaagtaaacagtcgatcacctaatgtttagtcattactcaggctaaacatacattaaacaggttaaacggtcaattaaacgggatagatggactattaaacagaaatgacatcatcgtgcagtgttaatatggtgtttaaacatactaaacgaccatttaggagaaactgggaaaaacaggattttagtatccaaattttttcctatctatgtatctagcaaaattatgacctccggaaacatttggttgtactcgggctctaaatcaagtttaaccaaatttggttgtacagtataaccaaatctagttgtacttggacccatggttgaagcaaaatccatttaacctgttgctatgtgctaatttctgtctttaacatttgctggtggattaagataaatgttggatctaaattgcaaacattttttttcatgattgaaaatactgtttgccgtgtagttctgtaatatttttttttgtataatgttaagattgagaacaagcatctgtgctaatcttaattattaattgttattctcctacaatgcagagaaaattgattttgagttttgcacacaagtaccgtcttggtctctggaagccccaagcagaacccaggaaagtttaaagttggttcgttcttgaaagatagtctactgttggactgaggcatgtttgggacattgaatatttgctttgtaatttagaaacctcaaacctttgttctctgtctctagccatacttatttgcaaccattacgcaaaaaaaaaaaaagattctagaaagattccaacttattgtgtgtgggtttgctccttttgtaataacaaatcataagactgttggtttcatccctaatccatcgggattagagtggattgagggaggttttgacttgtaggggattcaatccctctcaatccttgcggtttgataaaaccgaacagggtcaaaggtgcagccccctgtgataatctgtcacttgatgtttgtatttttacttaggtttcttaccaacaacattgcagttttgttaacgtagcctaagtaaattgattaggttcagagttggacccgacggtccacaattcaacaatgttgtaatgacatagaagtttttgtggttctacgctgccctttcaagctgcaaatgcgcattatctgtttgcactgtgatgattttagttgaatttcatgtggttgccacaggtagcaaattgaacactctagttatagcatctttctgacccttgaggctactttggaagtgggtttcggtttacagatcgaaccaaaatttgcagtgcccggttcaatttaatatacgcaaacagacggttatagaacgaaatataaagctgcaatttcttggttggaggacgaacctagacggaagaatcatgtaatgtaatactttgactcatgtgctaagactaccatcatggagagcggtta

SEQ ID NO: 3193 - DNA, 829 bp, Zea mays
gggccccccggggccgcccgttgggccgaactaggcagcgtggaaaggctacggagagcggagaggcgctccattgaagcggacggcaacgagctctgcatgctgcgctgcgcccttctcaccgccgccagcccgccagaaggtctcctcccgtctctagagtggctctttctctctccgtcaaatggctctcgcgtgcgcctctcacgcgtgccgctttctcctcgccggccaggcgagatctttccacgcccagccctaccatgccaaggtcggcgtggtggagttcctgaacggcgtcgggaaaggggtggaggcgcacgccgcgaagctggaggaggctgtgggcggcgacctccagaggctccttgaggcccgcacgctgcggctcaagaagctcggcatcccctgcaagcatagaaaattgattttgagttttgcacacaagtaccgtcttggtctctggaagcccaaagcagaacccaggaaagttgaataaagttggttcgttcttgaaagatagtctactgttggactgaggcatgtttgggacattgaatatttgctttgtaatttagaaacctcaaacctttgttctctgtctctagccatacttatttgcaaccattacgcaaaaaaaaaaaaagattctagaaagattccaacttattgtgtgtgggtttgctccttttgtaataacaaatcataagactgttggtttcatccctaattcatcaggattggagtggattgagtgaggttttgacttgtaggggattcaatccctctcaatccttacggtttgataaaatcaaaaaaaaaaaaaaaa

SEQ ID NO: 3194 - DNA, 873 bp, Zea mays
cgagaccccgtccccgcccgccgagctgatggcaacgagttctccagggcggcggcgcacgggcacctcctgcctaccagaaggcctccgcaccgagctcttctcatcgccaccatcaccagaaggcttccgcccctctctccagtgtctctttctctctccatcgcatggctctcgcgtgcgccactcacgcgcgccgcttcctcctcgctggcccggcgagatctttccacgcccagccctaccaggccaaggtcggcgtggtggagttcttgaacggcgtcgggaagggggtggaagcgcacgccgcgaagctggaggaggctgtgggcggcgacatgcagaggctcctcgaggcccgcacgctgcggctcaagaagcttggcatcccctgcaagcataggaagttgattttgagttttgctcacaagtaccgtcttggtctctggaagcctcaagcagaacccaggaaagttgaataaaattggtttgttcttgaaagctagtctactgttggactgaggcttgtttgggacattttgaatatttccttttgtaatttaggagccacaaatctttgttctctgtctctggccatacttatttgcatccattgtgcaattttttctagaaaatttccaacttcgcgtggaataacaaaccgcaacaggtgcagccccctgtgataatctatcacttattgactgtattgttcctttggattcttaccaacaacattgcagttgtattaatgtaatctaagcaaattggattaggttcagattctcagaaagatacattactgtgcattagagttccagtcaatttatatgtagacaagtcaaacatgttgtaatgctatggggtgtttct

SEQ ID NO: 3195 - DNA, 2884 bp, Zea mays
  misc_feature (400)..(400): n is a, c, g, or t
ccttattatgtttcgtagttttgtaaaaaaaatgatgtgtggaaagcgttagcggagttaagctacttttatagacacctttgtgctaaagaaataaagaaagagatgatgaagaagcttgaaccacaaataccagttttggtatgcaaacctgaaaaaatatttcctccaggtttcttcaatctgatgcaacatctacttgttcacctaccatacgaagctaaggtacgtggtcctgtccagtatacatggatgtatcacattgaaaggacactaaagaagctacgtgcaatgattagtaataagagacgagttgaagggtgcattgcggaagaattaaaatacaaagagatagcatcgttttcgggcttgtaatttgcagaggaacacaatgtcaacncgtctgcgttgcggtatcaaaacatagcctaccatctcacagaaaaaaatgcagcatatattaaaaagaaggttacttgaaaacagtggttagatggatacgcaatacgttgtcagatcatgtcatgctggtttcactaataataactcttgtcacccattggcttgtccaagtgccgacggggttaatgtggccgaagaggatttccttgattcctgttgcgttatgctgtagaaaattcgttcaaaccttatagagttttcataaatccgcgttgtgtcaatcactcatgagtgagtttaggacgacatatccttacctatagaaaatttttttctctcttctttatataacttgctttattattctataccctcaaatatggatcggatgaggattgccgatagtatgggggcttttttttttttttttttcggtatgtataataagtatattgatatatattttgaggacacaggtacaacaacagcagcatgcacacacactgcaaattaaacagatgcatgcatggaattagtcaacctccacacacacagagaccgcacatgcacttattcatataaggctctaagccatacatccacggcgcacatttctgcatggttgcatatacgcgcgttcagataaagggagggcctgcaggaacgcatttgtagggacctttgatgttgcgagtgccaaacactgttgtagtagagggatagcacaagcatatgcggctgctgttgttgttgccttgttggttcgtcacaggtaatggaacggggacaagagtaatgccctgttgaaggaacgtcttaatgccttcaattaaggagattaggttagggaagccagggggacatcggttttgggatggtgccggagcaggtgttgtcgtcggtgctggtgctggtgcaggggatggtgatggtgtcggtgtaggcgttggggctgcagcagcaggagttggtgcaggcgtcggcgacgataactgtccatgcactgaaaccgttaacatgagtgccaaggcaaggacgaggagcgcaatggacttgttggatgccatcgcactgatgaaacggtagtgttgtgtgtgtgtgtgtttctttgtcggacccggccggcccccagcgcgcactcataggccggcaatctctcagcacaagttttgcccatgcatggcggagcaggcatcaaggtcagccagggtttgcgttgcttgtgtcctgctagccggcggcggcacaccaccaatgaattgaagcgcacaagttttcagccatatagaacgtaccctcctggacatttgaggccgtcctctcgtcccatatcctagctgcttcattgcatctccagtctagggctttatttgccgtcgtcggctcacaaaagcaaaaggaagaccaatgcgtcgcgcgccctaccgctagatgaatgtttggagtggcactagctagagtcatgcatcaccagcctaactcttgacagaatagtgctattgtacatatatagtgctattagtacatgtatgtacgtacgtatggagcacgtggaatgctatagacactcgaacgggagcaccggtagaaaagagctctaacctagcggtacatataaattttcactggcggtttcagttaccacgcgccagtaaaaataaacaggtttgactgacttaatcaaccatccagatcggtcctatatgggttcatgagacagaacggacgatacatcacaaaccctgaccaggtattattagtaatagtcatgtatgtatttaaatcattaaagatgaaaatgtgttatcgagtgtaaatagataatgtttataaacttcctttataggaatttcagcgaggaaagccatagaacttgaccgaaagtgcattgtatggcataattgcggacatatgcacgttcataatgaaagatgtcattctcattgaagtaaaatatcacgatactaccagtacattagccagaccagagtttagagtgctcacaaaattagtagattatctctagctgaggtagttattagagttttggtgaaaactttgatgtatagaatgtgtgatgggttgtacttaaacccaagactttgatgtatatatataaatgtatgatagaatttaattccatgttgcttttaatatatatactagtcatttgttcgtgcgttgctacggaattaatatgataaaatacattggtatataaaaaatattgtgttccagcaatccacggatatatatcacatatataggctttgtttaaatggatactttttaaaacatatttcaaaaatctttataataataataaaatactgggagcggttgctacgtttgtggaggggagctagcctagcatggagagaacgaagtgagccacgcacgaagaaattgtcagagatatgggtcgcccccagtactttgctcgctctgctctattggaccgcaataagacatccaacccacg

SEQ ID NO: 3196 - DNA, 1955 bp, Zea mays
cgtgatttcttcgtaaaacgggatgtcccgtgcattactatctaaattaagttaacgtctcgtatctagtatggaggagaatcgtcgatggatgtatgaaggccgtgaatggttccttgaagtccaggttgcatgtgggcatggaaaaggatcgaacctgcacaggtgtacaaaagatctcaagagaataatagacatttcaacgtacatacaagactagcttgagtcttgacagcgatcctgtgcagttgcgggcacaacgatatttcttggcgggcagcataaatccgccagagatgagctgcaacacgaggccaatatgccaaaatgccaccccaagagctgagctcaatcggtgtgcactagtattttatcaaattatgcgtcatggtaaggcacggttattatactaagctagtagcgcattaaaacttgggtatatatgtgtggcatgacatgagagccctcccgatgctaaggctctttattttatatggtcccatcttggaatgttgatgcaaatagtcatgggcctgtataaatggttccttggagtccaggttgcatgtgggcatggaaaaggaacctgcacaggtgtacaaaagatctcaagagaatatagacacttcaacgtacatggaagacctcgagtcttgacagcgtcccgtgcagttgcgcgcggccgggcacaacgatatttctcgacgggcagcataaatccgccacagatgagctgcatatacagacacatccccttcgcaagtggtcaatattccaaaatgccaccccaagaccctgagctcgatcggttgcctgcctgcctgtgcatgcaagcgtacatcagtagtgttcggaataatcgtttacaaatttagagggctatcttgatattatatgcacgaaattctccgtagcgtttcatgaagtttcgttggatatgtacaacactagctagctaaaagatgggagagcatcagacatatggaatatagctagatcacccggattcagaattatattggtcctggactgaaacactattcccatcccatcccatcccatggagctgagcccggccaagtagtagctacctcgactcagtgagcgacgtgcgtgtccatttgtagacgtggcacacgcgctgtggcggaaacatttgcaaaggagtagaaagtgctataaatagtctggggaccctggcgcccgccgggacaccccacgcgtccgcccacgcgtccgctcacacagtgcagtcagtcacacagagcctactagccagcactacctaccagcagttcctcccgtgtgcaaactgcaaagcaagcaatggacatgggcttctacaagcgcgccagcaggggcggcggcatcaagcacaaggcggcggcgatgcccttctaccccaggaaaccggcgcaggtggcgcccgccgcgccggcggcgcagcaggccgtcagcaaggcgaaacagccctcagcgaccaccatgtggtcgattccggcaccgccatcgtcaaccgtggtcgccatggaggttgctggaaacggcatggtgctcgacggcgactccgacgtcgacagccgggcggcctcgtacatatccagggtgcaggagcggctccggcgcgagcgcatggccgaggactggcggatgtactactgaccaccatgcgctgcgctgcgcttctggctgcatgatccccgaggccagcaaaggtcgggtgtgccgtgtgcccagttagttaaatatatatataatatatataccaatagtacttactaatccatgagttaagtagttacttactcggtgtgtgtatgacgtacacttcttgtactaagtacggtgtgttatatgttttatatgacaacttctcgattttagagaaaaaatagttcatatttagtgtcgtgataattcaacgaatttgatgtcgtaaaaaacaattttatatt

SEQ ID NO: 3197 - DNA, 1404 bp, Zea mays
ggtcatatttatatatatcattacttgtgtacttaaaccactgaaaggccctattaattctactctctaatatttccaatgtagagaatgtcaaatacaaaacaaaccatctgagatggcgaacaccataaagacaatattccttttctgcacaaaagaccggtaaatctgcatatgtttttgtatttaatttgctgtatttggttcggcaaaacgaagcatctccgcctacatgatactacccgcgtcatcgaatatttgtcgctcgctagtttatttttttgaactaaactgtgacaaataaaaaacggaagtagtatattggatccaaaaccttacagtacttaaagttgtaaccatcaataatgcagtggtttacaataggggagcagcgccgctgtttgatgggatctcggtagcagcctgtgcgagctgcaacccactcaggccaaatattttgtcgcagaaacattcttcaccccttcttttccactcccccaacttcccaaactagtgagtggatttgcacatatcgttgctcccactggctgttccccagctcacttcactttagatatgcgcacctgaagaaaactactataaacaatgctgatgttcagcctttggtttacagttaagtagtagcattcaaagattagtcattccatggtattgttgttttttcatgtgatgggcatctaacggccatcatataggctcctcatttgctggtgcttagttgatgtgtcacgcatatgttattgcatgctttaatttgaggtgccaagaaatgcatgatccgaacaatttaaggaatatgccaataatacgtacgatggcgattcaaaggtagttatttggttccttcttttgacagcacgactacaagttgcctctccaatggtggcggcgatcgcttcattagctcgaccgcaccacatgcatgcattctgttatgtttggttcgttgggggcattgcatctttttagtggtgggcatgcagtgacctcatagggcaagaaggacaattagctgaatgattaacatttaacaacaaaatacggaataaccattgtgtagattgctcaggtcacagtcacagtcacagttgacagtcacatgtgtcactacagtaaacggagaaacgtctgacggcccccttacctccgacggcctcttacaggaccgtcggacataaggttatgtccgacggccgcaaccggctctcggaaatagccctcatgtccgacggcctactcttatgtccgacggccctgtgcttatgtccgacggtcctgtacgaggccgtcggacataaggttatgtccgacggccctatacctagccgtcggacataagcctttttaacgcgcggatcggacccgcgcggctttcatttcacc

SEQ ID NO: 3198 - DNA, 2302 bp, Zea mays
gagtataacgcgaacgatgtcgttgcagatgcaatgtactatgcacgaattcaggctataaaggcatggtacagagcaaatgctgatgatcgaccgatgccaaatacaaaggccgagtggtcatcaatttacttgacggaggagcaatacctagaggtaaacaggttgttgcctctcatatcgcacgaagccatgtatttgcttgctttatttaaaaaatttcatgtaggtgtcggtgccgtggatggccacccgatcagacggttatcgagcattgtgcaaatggtgggcttcccctgagtttcgtgccatttccgaaaggaacagaggaaaccgtggaactgagtcgttccacaactacggcggtgatggtcatgtgcgcttggctaagcgaatggtaagtctcagtttgtcgtaactttgaattacatagaaatgtgtcaatataacttttatgtacaggaagtcaaatccggctgtacgcccacggatgtggaggtgtatatgcaaggccataggggttctgatcctcagaatcctgatgtgttatgcactcagacggccaccgaccgtctagtgagtttttgatactctattatgtgtttgatattgtttgcaatggcataggggttatgcacttatatttgatattgtttgcctccaggcttcgtatgggcaggagatggttcaacgccatggggaggagtacgattggaggagccagccaatcgaccctcaggcagcatatgctagtgcaggaggacaagcccatggacggtgagattatttgatttggttttcaaaattcaactgagccatgagttactatactaagtgcatggttcactcttgtaggttgggtatttttgattctacgattgattccagagagctgagacgccgtggacgacaatccacatcgtcgtcttcacagtcgtcccgttcacgatcagcagcccatgagatagagcttgcggtgttgcgtcaacaggcagagtaccatcaatcagtcttgagggaacaattggagtaccagaggcaacaatctgaataccagagacaacaagccgagtaccagaagaagagggacgagtattatgcaagcctccaggcccaaaatcaagctcttctctcggtaagctgaagtaacattttgtagcttattttgcaaaacacttgatgtgtatcttgtttgctcaacaatgacttgtatataatttgtagcaactagcccaacaagcgggcgtcccgatgccgacatatgggatgccgcctccggactttgcactgccaatgccaatgttggcgcctccaccaccgcctccgcctccgtcacaattccctatggtatgtacacatatgcgtgtgtgacatgttcatagatgtcttatgtgtttaaatgaacaactgagtggttactatttcatgtgcttgtgttatagggatttcagacaccacccgcttcagctcgcgcgcctcggctcgggtctggtcaggacgacccaacacatccgtgggtgaacaatcttttcagcacgcatagtccagccggaggaggtggcgatggatatgagtgatactgatgtaaaacacttgttgcaacctttcatgtgaaagcctacccgtcgaataatgttcattttggagtttggacaactatgtttatgtaaacacttgttgcaaccatttggaactatgtcgttatgttaaattttgtgaatgtgaatgcttatgtgattatatttgtgaatgtgtatacttatgtgagtatatttgtgaatgtgaatgtgtatatgtgtataaaatctgttttgtatttgcaaatgtcagattttttaaatttcagaattttgtgcaatttctgaaaaatgttatgtccgacggcttagtgtaggtcgtcggacataaggtgtatgttatgtccgacggcttaaaaccgtcggacataagttatatgttatgtccgacggctttaaaccgtcggacataacagcagtgggcccaggcggcgggtaaaacagttacgacatcttatctccgatggtccgatggggccgtcggacataacttatgtccgacggcggccgtcggacataatgctatttgcgacgcgttattctcgacggcttaaaaccgtcggagataggttaatgctgtcggacataactatctccgacggtctgaatcttatgtccgacggctttagccgtcggaaatttcttcgtttactgtagtgcttgcacgcattagctgctacatgcaccaggcgttggcatgcaagagatcgaatggcatgcatgca

SEQ ID NO: 3199 - DNA, 2212 bp, Zea mays
cccacgcgtccgtgcagaaacttggattgcaaccaacaagttatacatatgacggttttattaaaaccgtgatagctgggaaaggaattgcatatgccagcatagtgattaacgccatggagagaaggggcattgaaccttacagtgatacacttgctgctctctcagagggtcatagcaatagtttacagttggatttggctgaggagtttttggaaagaatttcagagataaaaccaaagcatataggttcctttaatgctttgctttctggatgtgcgattatgaatgaaccagaaagagctgtccgcatactagctaaaatgaaacatgtgaacatgaagccaactctcaggacatatgaacttttgttttctctgtttggaaatgtaaatgttccttatgaacaaggagatgtgctctctcatgtcgatgtttccaaaaggataagtatcattgagatggacatgtttaacaatggaatccaacacagctttgtgtccatgaagaacttgatacgagcttttggagctgaggggatgatagaggaaatgctgaggtacctgaatatagcagaaaatactctgtggaacataaatccttatcagaagagtgatctctacagcactgcgttgcatgctctggttgatgtgaaggaaactcacagagcagtaaagatgttcaaaatcatgagatcatgcagtcttccaactaatatttcaatttataataccatgatagagtgctgcaaatggctgccatgcttcaaatcagctagtgctttgctgtctttgatgcttcgagatggtttcaatcctacggttgtgacttttacatcactcctgaaggttgtattagaaaatgataattttgaaggggctctggatctgcttgatatatgcaagattgaaggacttcagcctggcatacagactttcaacacagtactcttacgtgcatatgctagaggtcaaattcatgtccttgaatatattttggagtgtatacatcgatcaaaaatccaacctgatccatcaacactttggtacacgttttgtgcctacgaggagcatgaactgtacaatactgcaattgagtcactgctagtcctcagcatgagaatgatatctgaggatgccggcattcctagtgagaaaagaattgtttttgaagatctaatcctcagtgaagaacctgatgctgaattcaggatcataagggcattccaagcaggcgaagaattccttgcgacagctttactgaacctaagatggtgtgccacaatgggtgccaccgtatcttggtcaccggaggaaagtctttgggcaatgaggctggcagcctcgtatgatgctaacaagagaccacatataaacccctcggatgttcccaaatctaggggaaggaatccacttaaccgcccatattgggaggctaacaggtgattggttgattggttggctacgctccggcccgcggcgttccgttgatcacgcttggcacgtgtttggatggctgcagagcatctctatcgcctgctcccacgcatgcagcgttgttttttttcttcactgggtagcctgcatgcgcggaaacgcaactccccttgtttccagcggcccaggctggcacgatgctggtgcgagatgcccccacaaccaatcatgcgttaactgaggcagacctggagtctagcgtttcacagaatgaaggcaaatctctctgttgagtatgatgacaatgtcgtgttctgttttgctggaagccagtcgatgttttgtttacctaactaacatgattgcagtacgatcgggtggcctccctacctgtcgtgaagcttgttccgcatgattgctccaaattggcctcgtaccgttttcaggcttctaggccaacagctctatgttccgattctttacattacttgataggttgctcactttatttacccagttgtcatttctgattatactggctgtcgggagcattagctttgcaaaattgtaggaatatatatgacaacgacgaagatcgagtcgcatggcagtgacagaagaataagaggtgttacgattacaatagctggaaaccaaaacttgctctggttattttgaaggtgaaaaaatttggaatgacgatgttacaattacactttattctggcaaaggtagattgtagaaggatggatagtgatgcactgttaccgcgtggt

SEQ ID NO: 3200 - DNA, 1447 bp, Zea mays
gcattgcgccctcgcggccggccggggtctcgtcatcggcaggacatccacaccaacccgtgctcaaggaaaaaaaaccggggcggcgaaaaccctcgaaccctaatccttacgcccctcatggcggacgctgatgcggcgctgccaacgccgcctccggaggtagtagcccccgaggagcatcccgtgggcgccgaatccaccgtcgccgcgccggccgaagtcgataacaagcggaagctagaggaggtcagcgccgacgcggaggtgaaaggcaccagcgaggacgccaagcgcccgcgcgtggacggcgagcccgacgccgcaacaggggttgagcagcaaatcgatgggtcctccgtgaatgcggatcccgcagctccggaggataaggctgctcttaacgttggcgcagcaatggatggtgataatgacacgcctgctcccgctcccgctccagactcgcaggcggtttctgacgagaagccgcttgaagcagcagctgaagctccacagcaggaaggtgatgcagcaactgctgtacaggagatttctcgtaagatcgaagtgcccaacagcaaggttggtgtcgttattggaaaagctggtgagacaatcaggaacttgcaaatcagctcgggtgcaaagatccaaatcaccaaggacatcgaagcggactcaaatgccctgactcggccggttgaactagttggaacacctggcagcgttgataaagctgagcagcttattaagagtgtcatagctgaggctgaggctggtggttcccctgccttaatagctagaggatttggaagtggacagcctggatcagagcaatttgagatgacagttcctgataacaaggtcggtctcattatcggaaaaggtggtgagacaattaaaggcatgcagaccaaatctggtgctcgtattcagttaataccccaacatcctccagagggtgttacattgactgaaagaattgtacgtgttactgggaataagaagcagattgaagctgcaaaggatttgatcaagcaagctatgaatcagacattttcaaagcatacaaatcagtctggcggatatggtccacaaggttaccgacctcagggtcatggtgccgcttctcagttggggccacgctctcagaatcatggctatggatacccacctagaggtatgcctccacctcaaaactacaacgcaccctacggtggctacccaccgcagggaccgtcaagaggtggcatgggctgggaccagaggccgggcccaccaacccatccttcgtaccagggtggtggttctgactactacaagcagggatctcagccatatgatagccagccacccagctaccctcctgggccagggaattacaacagttatgggcaatcccagggccctaactatggccaacctcagtatccgcaacatgcacctc

SEQ ID NO: 3201 - DNA, 2168 bp, Zea mays
  misc_feature (7)..(7): n is a, c, g, or t
  misc_feature (9)..(16): n is a, c, g, or t
  misc_feature (19)..(19): n is a, c, g, or t
  misc_feature (25)..(25): n is a, c, g, or t
  misc_feature (31)..(31): n is a, c, g, or t
  misc_feature (33)..(34): n is a, c, g, or t
  misc_feature (44)..(46): n is a, c, g, or t
  misc_feature (49)..(49): n is a, c, g, or t
  misc_feature (52)..(52): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (64)..(64): n is a, c, g, or t
  misc_feature (66)..(66): n is a, c, g, or t
  misc_feature (68)..(69): n is a, c, g, or t
  misc_feature (76)..(76): n is a, c, g, or t
tcccccncnnnnnnnnccnctctanaactantnngatccccccnnnctncangganananananananntcactantcccccccccccccccccccgctgaagctccacagcaggaaggtgatgcagcaactgctgtacaggagatttctcgtaagatcgaagtgcccaacagcaaggttggtgtcgttattggaaaagctggtgagacaatcaggaacttgcaaatcagctcgggtgcaaagatccaaatcaccaaggacatcgaagcggactcaaatgccctgactcggccggttgaactagttggaacacctggcagcgttgataaagctgagcagcttattaagagtgtcatagctgaggctgaggctggtggttcccctgccttaatagctagaggatttggaagtggacagcctggatcagagcaatttgagatgacagttcctgataacaaggtcggtctcattatcggaaaaggtggtgagacaattaaaggcatgcagaccaaatctggtgctcgtattcagttaataccccaacatcctccagagggtgttacattgactgaaagaattgtacgtgttactgggaataagaagcagattcaagcttccccttttggtttctaacatgaattcttgtacagacattttcaaagcatacaaatcagtctggcggatatggtccacaaggttaccgacctcagggtcatggtgccgcttctcagttggggccacgctctcagaatcatggctatggatacccacctagaggtatgcctccacctcaaaactacaacgcaccctacggtggctacccaccgcagggaccgtcaagaggtggcatgggctgggaccagaggccgggcccaccaacccatccttcgtaccagggtggtggttctgactactacaagcagggatctcagccatatgatagccagccacccagctaccctcctgggccagggaattacaacagttatgggcaatcccagggccctaactatggccaacctcagtatccgcaacatgcacctcaacagaactacagccatggctatggtgatcctagatacaatgccccccctccgaaccagcagtactatggtcagccaccgatggccccgcagcaaggctatcctcaacagccagatccctatgctaggcctccatacagtggacctggtcaatggacccccaggggtgctcccgccgcagatggctcctaccaggcgccaccttcatcttatgggccaccgtctcagcaacctcctgcttatgggcaaacatatggtgcagcaacgggacctgatgggtatggtcaacagggttacccacagcagggtggccaggtaccagcttcatatggtcagagtgcaccagcagctccaggatatcctcagcaaggcacgcagcaaggtggctatgcacagtacccgcagacccaaccagcatatggtgatcaagcagctcaagccaatgcgaactatgggtaccagggagctccagcagatcccaactacggaagtgcgtacccacagcagccagggtatggtcctcctggtcaggcaactggtcaggctggttatgcatcctctgcgccagcggccagccagcctgtgtatggccaggctggatatacccagccacctacaaatcctccaagttatgatcagtctgcagcaccagcggcgactcagagcggttatgctgcgccccctgcaaatccacaacagcctgctgcagcaaaaggggtctcgccacagcctgctgctgctgctgctgctggatatggtgctagcgggcagtggacggcatgagcctcgtcttccgaacttcgatgacagcaaggtcaggttggatatccgcttttggcgcgtgtttgaatgtttgcatcttttggatgtctgtggacgcatcatgtagggcttgaccccgttatcgaaagagattgtaaccccttgagttgtgatactggacatcttctgtagtatctacgagtagttgcttaatgtgacttttaaacattctattcagtttggatgttccttgtcttgctacttcacagcttgccaagccagtaatctttggattcaaaaaaaaaaaaaaaatggtctttgctgtcgttcctgtaaataaatattggcgtttggccttctctt

SEQ ID NO: 3202 - DNA, 3037 bp, Zea mays
gtggagatttaagggtttattttcttgaacattgtttcttgaacgttttagtgatcattactggacagtgtttactaagtattgagatatgagctactatgcaggcggatattctcaatgctgttcttatttaactgcattgtgaacagtctgtttcccattgatggattcctattacagttggctttatgtttttctgcggtgtctgttatttacttctctttttggtttcttacatggtttcttgtacagacattttcaaggcatacaaaccagtctggcggatatggtccacaaggttaccgccctcagggtcaaggtgccgcttctcagtggggaccacgttctcagaatcatggctatggatacccacctagaggtatgcctccacctcaaaactacaacacaccctacggcagctacccgccgcagcagggaccaccaagaggtggcatgggctgggaccagaggcagggccctccaccccatccttcgtaccagggtggtgcttctgattactacaagcagggatctcagccatatgatagccagccaccgagctaccctcctgggccagggaattacaacagttatggtcaatcacagggtcctaactatggccaacctcaatacccgcaacatgcgcctcagcagaactacagccatgggtatggtgatcctagatacaatgctccccctccgaaccagcagtactatggtcagccgccaatgggcccgcagcaaggctatcctcaacagccagatccctatgctaggcctccatacagtggacctggtcaatggcctcccaggggtgctccggctgcagatggctcttaccaggcgccagctgcatcttatgggccgccttctcagcacccttctgcttatgggcaaacgtacagtgcagcaactggatctgatggatatgctcaacagggttacccacagcagggtgggcaggcaccagctccatatggtcagagtgcaccagcagctccaggctatcctcagcagcaaggtggctatgcacagtacccacagacccaaccagcatatggtgagcaagcagctcaaaccaatgcgagctatgggtaccagggagctccagcagatcctaactatggaagtgcctacccacagccaggatatggtcctcctggtcaggctactggtcaggctggttatgcctcctcagcagccagccagcctgcgtatggccaggcaggatacacccagccgcctacaaatcctccaggttatgagcagtctgcggcaccagcaacaacccagagcggctatgctgcgcccccagcaaatccacagcagcctgctgcagcaaaaggggtctcgccacagcctggtggtggtgctgctgcatatggtgctggtgggcagtggacagcatgaccctcctcgaacctcaaacatggctcgctggtagcaatatcgtgctcaatatttgcaccttccggatgcatccttggttatcggaagagattgtgtaactccttgattagtgatacttggcatctctgtagtagcacctactagtagttcgttggttaactgtgactataaacatcctaattcctattcacttcgaatcaaacttcgcagcttgccaagtaatttttttggatttgtgtttattcatgtaaaatagttactggtttggctcacagaatgatgattctgtttctgcagttcattcaaatttggttctgatggatgttaaacctagtgatgacaatttaacccgcaaatctgaaattagataggtgcgtgtatgtgtgaagattttgacccgtggttgcaacccatacctaacctgaagtttcgtgggtgttagatgcgggtttttatttcaacctgtatttgacccgaaattcaacccgtatttgaccccaaatttggtttactccttattttgcgcaataatgactaaagatacaatagtaattattttcaattagtgacttggttaatgattcatgaagtgttttgttggtgcttaacgtaaggtttaaatccataaatataactcaattattgctggtatttaaatacttataactaaattattgcttgaaagtgtataatgagtaaaacccacgggtgatcttaaacccactcgaaacctgatggatttggatgtgggtttaaatttgcacccgcgtgtgcgatcgcgggtgagtttaggtagatttcacgagtttgatcgcgaacatggtttttctccaccgactcaaatctgattcattgtcatccctagtcaagccgaacatactatccctagtcaagccgaacatactgttgctcttgcaatgtgagaagcgttatgtacatatggatcgattagcggttgattgcaactatagtaagatcttgtccagtagtttatccatatggtcacctaaaatactgttttgcacctaaaatattgttttgcacggtagaccgcactgttcgcagagtggagtttaaaataggagatcataaggaaactgtaccattgtcgaatagtattctactccctctattttcgaatatttgttagctgctagtttatttttgaactaaaacacgataaataaaaaaactaaggaacatactactaagattgtctcaacgggtaatctaaaataggggtcacaaaattgtagatgacattgtttgatgctgtttgtagagtaaagtttgaaataggagacacgatagggaatctgctagagatagcctaaggtcttgatcggttatttccatgccatatgaattggagggaattggaaaaaaataggaaggattttgatttgttatggatttaagtccatccgatcttctccaatctatatgaattaagataaaaatgaacatatgttgagtgtgggggtgaagtagatggtgagggttcccatgctccaagtagatggtgagggtgaagtagaatgtgggtggtgaccccactccaaattgatggtgagggtgaagttgaagatgtcgatggtgattctcgagggggggcccggtacccatc

SEQ ID NO: 3203 - DNA, 2568 bp, Zea mays
ctcgaggccggccgggagtggtgtgcccggcggggtcaaaaaatctgggcggtgaaaccctcaaaccctaatcctttggcccctcaccatggcggacgctgacgacgcgccgccaacgccgcctcctgaggtagtagcccccgaggagcatcccgcggtcgccgaatccgccgttgccgcgcagcaggagggggcagcgacggcccaagtcgataacaagcggaagctcgaggaggctggcgccgacgcggaggcgaacggcaccggcgaggacgccaagcgcccgcgcgtggatggtgagcccgacgctgccacaggcattgagcagcagaacgatgggtcctccgtgaatgtctccgtgaatgtggaggaacccgcagctgcagaggaggataaggttgctcccaccgatggggcagcgacggatggtgataatgacacggccgctcctgctacggattcgcaggcgggttctgatgacaaaccgcttgaagcagcagctgaagctccacaaccggaaagtgatgcagcagctgttgcccaggagatctctcgtatgatcgaagtacccaacagcagggtcggtgtccttattggaaaagctggtgagacaatcaggaacttgcaaatgagctcgggtgcaaagatccaaatcaccaaggacgccgatgcggactcaaatgccctgactcgtccggttgaactagttggaacccttggaagcgttgataaagcagagctgcttattaagagtgtcatagctgaggctgaggctggcggttcccctgccttaatagctagaggatttggaagtggacagcctgggtcagagcaatttgagatgacagttcctgataacaaggttggtctcattatcggaaaaggtggtgatgcaattaaaggcatgcaaaccaaatctggtgctcgtattcagttaataccccaacatcctccagagggcgttacattgactgaaagaattgtacgtgttactgggaataagaagcagattgaacttgcgaaggatttgatcaagcaagctatgaatcagacattttcaaggcatacaaaccagtctggcggatatggtccacaaggttaccgccctcagggtcaaggtgccgcttctcagtggggaccacgttctcagaatcatggctatggatacccacctagaggtatgcctccacctcaaaactacaacacaccctacggcagctacccgccgcagcagggaccaccaagaggtggcatgggctgggaccagaggcagggccctccaccccatccttcgtaccagggtggtgcttctgattactacaagcagggatctcagccatatgatagccagccaccgagctaccctcctgggccagggaattacaacagttatggtcaatcacagggtcctaactatggccaacctcaatacccgcaacatgcgcctcagcagaactacagccatgggtatggtgatcctagatacaatgctccccctccgaaccagcagtactatggtcagccgccaatgggcccgcagcaaggctatcctcaacagccagatccctatgctaggcctccatacagtggacctggtcaatggcctcccaggggtgctccggctgcagatggctcttaccaggcgccagctgcatcttatgggccgccttctcagcacccttctgcttatgggcaaacgtacagtgcagcaactggatctgatggatatgctcaacagggttacccacagcagggtgggcaggcaccagctccatatggtcagagtgcaccagcagctccaggctatcctcagcagcaaggtggctatgcacagtacccacagacccaaccagcatatggtgagcaagcagctcaaaccaatgcgagctatgggtaccagggagctccagcagatcctaactatggaagtgcctacccacagccaggatatggtcctcctggtcaggctactggtcaggctggttatgcctcctcagcagccagccagcctgcgtatggccaggcaggatacacccagccgcctacaaatcctccaggttatgagcagtctgcggcaccagcaacaacccagagcggctatgctgcgcccccagcaaatccacagcagcctgctgcagcaaaaggggtctcgccacagcctggtggtggtgctgctgcatatggtgctggtgggcagtggacagcatgaccctcctcgaacctcaaacatggctcgctggtagcaatatcgtgctcaatatttgcaccttccggatgcatccttggttatcggaagagattgtgtaactccttgattagtgatacttggcatctctgtagtagcacctactagtagttcgttggttaactgtgacaataaacatcctaattcctattcacttcgaatcaaacttcgcagcttgccaagtaatttttttggatttgtgtttattcatgtaaaatagttactggtttggctcacagaatgatgattctgtttctgcagttcatccaaaaaaaaaaaaaaaactcgagggggggcccggctctgcgttgttaccactgctt

SEQ ID NO: 3204 - DNA, 1423 bp, Zea mays
tgtggtgaaatagcctccatggaataacccaaagattggatcaaaatgatgcaataaccgctatgtggcaaatgattcatttgacccagtcggcaaagaggcccgcactagataggtgacccaataaggcaataatgaacccatggtcggagtagtggtgtcattacatgaacataagttactatttaattagcatcgagaatagaaggtggcgatcatttccttagctcctgttagtgtccctgaacataagttacccatggtctgagatgttacatctttctgagccatcttctctcggtttgtacttctgttagtgtccctggcaccatatcattcatttggagatattcaatcagctgtgtggctatgtaaaattggttgtattttaggtgatctgtgagcattaactttcaatgtaccaaaaatcgatcttaatatatgagatggattatatgggggaaaaaattaggccctggatttttcagttaggatgtgctatttgtttggtaaactagagcagatatataccccgatacaaattgcattacatttaggccctgtttgggaacaaagtttttcttcataccggatgctattcagttcatggagtcatgggctaatgatgtttatcgtgtgcattgatgcaggatggatggaaggaactaaggaacttgaaatcatggacactgccacactgcactattgggcattcgcattcagggcaatagaagcatctgaaatccgtttggagaattttgtttgtttattccccattgcactaagataccttggagcaatctgatagggggggcctaagtcgttttttgttcagtctgagaagggttatcaattactgtgtattgtcatctaaaatatagagtataaaataattaagtttgaaagatacaaggtatattgtgttgatgtctttataggctaaggccatagcccataagtcaaatttagggttgtagcactgaaactaaccgagcaaaaggacaaaactgtgaaaggcagcgagttccttaaacaccgagctagctagctgcttgagatctcactagcaagtctgttatcagcacttctgtcagagcatctccaaggtcccttaaattggtgtcatatcttaaaatatagatctaaacttataaaaacagtttaaataatgtcctaaattatagtctcttccaaaaatatataaagcatataatgaattgacctaaatatactgcttcccagattagtgatatatccttgttttctatattatcccaaaccttttctttcctgataatataatttgtttcctaaaatacatgacttagagcataaccgttggagtgcagaaataaaatttctatagccctccccttgcccttctagaacgagtacaagaataaaatttctctagctcttcatg

SEQ ID NO: 3205 - DNA, 2892 bp, Zea mays
ctgcgggagggggaggggggcaagacggcaagtggtgggagtgggaactcgatcggtgacgccgtcggtgaaagggtggaggagcccggcgcccggcggcgctggcgctgtcgttgtccaggtcccgcagcaggaggccgtcgacggagtcggtggcgcagtggtcctggaggagcggttttcttccgggcgcgcaccatgcgccccgtgcatgtcgaggttgaggaagcgggcgtggccggggtagaggccgcgcgtggccgtcggggagcatcatgccatcatccagcgccgccgcgggtggagacgcagatcggatatatatgtcttctcaagctcgtccaatcggctgcacacagacagtgcagattgttgtcggcatggcaatcctcacggccaaaactggtgatggcaatgccacctcgttctggttcgacgtttttccttgcgtgtactcagcttgtaaaagagaaatttggaattctgttattatcctataatgccattttgtcatttaataaaacgaataagggaatgcaacagaagcacccgcagtcggcggcgggcggcgaaccaggctggtgccaagaaacttagaacgaatgaggtctcttcctgtctgaaatttcttctatggatgaaccctgaagcaatgcttcattgttctgatgcggaagttgccttcaattttcaaaaataaaaaggaacaagatcaatgtgagcagaccaatccatcttcatgaagtggggaaccatgcaggaggtacaaatacaatcagtaaggccagcacaacagaggtctctcctgttctttcagggacttgataaattaggcatcaaaaagatcaacgtacaaaggaaagcacaagcatctttcattgactcacagaattaaccataagaaagatacagaagttagtaaagacaggaagatcgaatctcaaaataccatggccatgatacagcaagaaatgataagcgcatagagagagagagaaaaaatgtaaaatgtgcaagcaagcagttcggggggtgctattttcaggaaacgctgggtcagtcatcatctagtacacaacagcgatggaaatggctttcggtctcatctccacgcttcgatccgctcaactctggagtttatgcggctcacgatgctcgcacctcttgatttctcagctgcaggcgtggtgcgcgtgccagactggcccttgccctttctagtcctcctccggttcaggcttcggctccccttgcctgcctggagagaatttgtggctgtcgtgccggaagcatcagcgatagcagctgggccagcaggtgcaggctgtgagccactactagtggagtcctccacacccgttgctacctcgcttgtctgggcagtgaaagcagcagtggctcctaaatcggtgttagtttcgttagacttgtcatcagtgctgtggccagggctgttcaggaggggctcttccttggcgaaagaagggcgcctggatccttcctcgaggagagaatcaagtgtcacggtgggcttctgatgcccgttttcatcagatgggtccttctggggcagcaaagcatcctctggggtcgactcctctctatccttgagggtcttttgtaccagcatcttgagaaaattcatcacttggactgcatacatcagtgcagtcaaaggatctgccatctgagtcatatttggtgcgaagaccatagcaatattgcgatcgttcatcttgtttatgtgttcttcttggactacgtcggccatcagattcacagcccagtcaagcaaagctgcttcagctggtggaaggcatttcgctacgcgagcacagtcctcttcagattggcattgcatcacctgttcaggtgggatagggtccagtacgcccctcggcatttctctaaaccaggctttaattagacctgccaaacagtggacatcaatgccatctggaacaattccactatttagttggtctctcacaaactcttcctggctattttctgcatttatacggaagatcccttctgcctgaaggccaccctgttcataaaggcgtctctgcatcatcaaaaggattgttgggacactgtttcctcgggaatcataggaacactgcattgattctgttgaaacaccgaagacacttgcactggcactgggagcacggcggggcacttcgggctcgaattcaacgggcagcccctaggaatccgtggaacctatcgaacgtgacgtgcgccacgtgctgcacgtccgtgggcaacccaatctccatcccgcagccgccgtgttcgccttcgccgccgcccacggtcctgcacccgagcaacgacttccgcagtagctcaaagagcagcgccaagaaggaccaccgctcctcttcctcctccgccgcctcttgcccgcgcagttcaaggagtcgtcggctccccgcagatcccgcagtgcgctccgggctgccgcttccttggagcacgtcgctgtcggcattggctaaataccgcagcgaagaggagggggagggggagggggaggcgggggcgcggcttgcggtggaagcgaggttggtcgggccccggaggagcgccacctccgtcattgctcccctcctttccgaattctcactggaattatgagctgtgatctggtgcggtgtagggccgatttgggggcgggggcggattcgggatgagttttcttggagatttcggtgatggtggagcggggccaaatgcaccgagaaatgattggggattctccagtggagttcttggtgcgcccccctatttaggatttctgatgcttgcttccccttcttccggagattgggattgttggggcaggacggggactcgaaggggggaggaggattggttgtgatc

SEQ ID NO: 3206 - DNA, 2064 bp, Zea mays
  misc_feature (75)..(75): n is a, c, g, or t
gaaaaaacacgcagaaaatatttatatgcaaattgtggtccaaagcatatccaccatcagaagacatgttcattncatcaatactacagttcaaatcctgcaaaggctgccataacaaaaaccaacttcatactttataacatgatttagatggaattcaaactccagctaaagttttgctttttcaaaagtttatttcagatcaaagcagcatggaggttgtaagactgtgttcagcagttcatccatatggtcaccaaaaatattgttttgcactgtagattcgcaaggtggagtttgaatatggggaaggataaggatcaaaactatagtactgaaacaaccataccatcaaaatgcaactattaaccacctcccgtgtcaagcaaacaccatttacattttacaactttctaacagaacagaatctaatacttactatctgcaactgttggaaccaaagcaccacatatatttggaattataagaaggggggaaaaaaggtgcaaacaccatccaagcgaaaatttaaattggagcaaacaccatccatgttattgcataagtaaactctgaaaagaaagccagattttctggaagcgtgaactcgatagcaatttgatgagggagaagagacatacctggcactgggagcacggcggggcacttcgggctcgaattcaacgggcaggcctaggaatccgtggaacctatcgaacgtgacgtgcgccacgtgctgcacgtccgtgggcaacccaatctccatcccgcagccgccgtgttcgccttcgccgccgcccacggtcctgcacccgagcaacgacttccgcagtagctcaaagagcagcgccaagaaggaccaccgctcctcttcctcctccgccgcctcttgcccgcgcagttcaaggagtcgtcggctccccgcagatcccgcagtgcgctccgggctgccgcttccttggagcacgtcgctgtcggcattggctaaataccgcagcgaagaggagggggagggggagggggaggcgggggcgcggctttcggtggaagcgaggttggtcgggccccggaggagcgccacctccgtcattgctcccctcctttccgaattctcactggaattatgagctgtgatctggtgcggtgtagggccgatttgggggcgggggcggattcgggatgagttttcttggagatttcggtgatggtggagcggggccaaatgcaccgagaaatgattggggattctcagtggagttcttggtgcgcccccctatttaggatttctgatgcttgcttccccttcttccggagattgggattgttggggcaggacggggactcgaaggggggaggaggattggttgtggtggtgcgcgtggtccaaatccacgaatccaaatcagaaagaccggcacagcccggcggcgagccgcccaatggacaacagaagggggatttttttattaaagaaaactccggtaaggaatctttagaaataaaagacgcaaatttttagcaggggatgatgagctctcgtcgtgggggcgtttggtggagaatggataggatttttgtggaggtggagttggattgaagggagggcttgagctggcggcgatggcagtatggcaccatcattcgtctactgctcctactcctctcccttctcctttatggacacatggatgctcgtgcgcacgctctcctcgcttctcgttcacgcgtgcgggcgtgcgttccttcatcactgttcatgctacacatcatctcactcatcagactctggaaaaaaaaagtctagccttttgataaccgtctcgaattgcctacgccaccgggagtttacgtgatggacataccaaccatggctttcagagtactcgagtgatttaactgactgttaggtgttcagtgttcttgtctccttttggaccctactcaggctgtatttggttgctcctgctaaagtttagctcgggtcacatcaagcgtttgacttttaaataggagtatgaaatatagatccaactaactgaactagattcgtctcgtcttttaatc

SEQ ID NO: 3207 - DNA, 1236 bp, Zea mays
ggagagaagctaaagctgctgcttcagaagaaaaggagcggtctgtaaatgaacgactgtcgcaaagtttatcccgcataactgttcttgagacccagattacaattcttaggacagagcaaacacagctgagccgatctcttgaaaaggagaggcagagagcatctgaaagtagacaggagtacctagcaattaaagaggaggcagcaatgcgagcagggcgggctaagcagctcgaagaagtgataaaggatcttagagttaagcacaaggaggagctgcaagaagcagcagaacacagggaacttcttgagaaggaccttgaaagggaaaaggctgccaggggcagaaattgagaaaacatcttcccgtgaagcgcctaaagtcccacttcccgatcagacaagaaatgcccctctcagaaagctgcctagttctggcagtataaatagtctagaagaaagccatttccttcaggcttcgttggatttatctgacaatgcttccttagagaggcgaatgtcttcagaaagtaatatgtcatattatctgaggaccatgactccaagtgcttttgagtcagcacttcgtcaaaaggatggagagcttgcttcttacatgtctcgcttggcctcattggaatctattcggaattcactggcagaggagttggtgaaactgacagaacaatgtgaaaagttacggactgaagccgctgctgtgcctggcttaagggctgaattggaagctctgaaacaaaggcacttccaagctctagaactaatgggggaacgtgatgaagagctggaggagctaagaaatgatattgttgacctaaaagagatgtacagggagcaggtggatcttcttgttagccagctccaggcattgggtgctcgtgtatagtgccggtatggatttgtcgtgccatcgggcaaggcaagataggtctgagacttgagcatgttttcctttttattttgtaaccgtacaacggcactgaaaatattcgtttgtacacatcaaaaacaccttcggcgttgggtttaggaggatacgttgttgtatactagatcaagtagtttcacagttttacgtgcattctttttttttcatctgtgttcattgaaatgtatcaaatttgaatccatttgcatgtgtacctcagaggaatgcaatcaatcaataatatcgagagctctttttatgtccaaaaaaaaaaaaaaaaaaacccca

SEQ ID NO: 3208 - DNA, 1730 bp, Zea mays
aaaaagagggaataatctaatcaatacaaaataggccatacataaatcatggaatccctggcaactttccaatcttactaatgacagatgatgtaacaatcaactttatgtacctagtacaatcagaataattcttagatgaggtaagcaagtacagtaaaatcatggatgctacaagattgcatcagcgaaatgattgaccaattgtttgatggaacatgggaaaaaacacagaaattatttctatgaacagttgtggtccaaagcatatccactatcaaaagacatgcccatttcatcaaccgtagttcaaatcctgctaaggccgccaacacgaaaaccaacttcatacttcataacacaattcaaacgaaactcaaattccacttaaaattttgctttttcaatgatatttcagatcaagggagcatggaggctgtaacacaaacaaaagggactacttttcaaggatcaaaactatattgcggaaacgagcatgccatcaaaatgctaaagagtgatgaactattaacgaacctgtgtcaagcaaacatcatctagattttacagctttctaaaagaacataatctaatacttattgttatcaactgttcatatcaattaccaaagcaccagacatacttggaattaaaagaagaaaactgcaaacaccctcaagttaaagttcaaattggagctaaaaaagttcatgttattgcataagtaaattctgcaaaaataaagtcagatttctggaagcgtgaacttaaaattaatctgaattgacgatggacactaagagtcatacctcacgctgggagcacggaggggcacttcgggcttgaattcaacgggcagccccaggaatccatggaacctatcgaacgtgacgtgcgcgacatgttgcacgtccgtgggcagcccgatctccatcccgccgccgccgtgttcgccttcaccgccgccgcccaccgtcctgcacccgagcagcgacttctgcaacagctcgaagagcagcgccaagaacgaccaccgctcctcttcctcctccacggcctcttgcccgcgctgttcaaggagtcgccggctcctagcagatcccgcagtgcgctcggggctgccgcttcttgggagcacgtcgctgtcggcattggctaaatagcacagcgttgaggagggggaggagaggcggaggcgcgacttacggtggaagcgaggttggtcgggccccggaggagcgccacctccgtcattgcttcctccttttcgaattctcactggaatcatgagatgtgatctggtgcggtgtaggaccgattttggggggcgattcgggatgggtaaatttcgctggtggtggaggggggccaaatgcacccagaaatgtccgccgagggggaggccaccggcgggtgaggagcgatcgatggggcggtggaggcttaccggcggaggggagtggaggctcgccggcggggatgaggccgccgcgcggtgaaaactgcctgcgggtatgaggccgccgcgcggtgaagactgcctgcctgaagtctctagggtcccgcccggctgcgccggtcccaatttaattgatagatgggccacatacggcaaccaaataactcagctcacgcaggctaccgcgacgcaaatataatgtaccatatcggccagccaaaggttgcggtagcaacttataaaccttcgtgctacagaggaagcaggacct

SEQ ID NO: 3209 - DNA, 2473 bp, Zea mays
ctctttcttgtttatttatcgtagtttagttcaaaataaattaactagcggcgacaaatattcgataactgaggctgagctcgtccaactccaatcggctgcacagacagtgcagattgttgtcggcatcaacggcatggccacatggcaaaccccacggccaaaactggtgatggcaatgccacctcgttctggttcgacgtttttccttgcgtgtactctgcttgtaaaagagaaatttggaattctgttattatcctataatgccattttgtcatttaataaaacgaaaaagtgaatgcaacagaagcacccgcagtcggctacaaagggatacaaagacactccttcactgtatataaatatatacaagatcaataaaaagtgactacgagttttcattctctgttcacacaactatttacatttaacagtcacgtcctctgcctcgcaccgggagatcgacagctcatgccgcagctccagcagcatcgccgtgggcaccgaggacgactgcgagtgctcggttctgttgcctcgcccttcaatacaatgtaaagatcacttttaaaagctagattggaaaccctattttcttaagagatttacattttattaaaaaaagtagttattttttcttggaaaaataggaatatcttggaagaatagagttaccaaactagccataataatagcaaaattccaagtttccgcttgaaaaacgagtgagttctatagggaagattgtctcagtcatgaagaggcctgccctaggcactcccaggctggtgccaagaaacttagaacgaatgaggtctcttcctgtctgaaatttcttctatggatgaaccctgaagcaatgcttcattgttctgatacggaagttggcttgaattttcaaaaagaaaaaggaacaaggaagatcaatgtgagcagaccaatccatcttcacgaagggggaaggggaaacatgcaggaggtacaaatacaatcagtaaggccagcacaacagaggtcacacctgaactttcagggacttgataaatgaggccctcggggcctttttttttcattggaaagcacaagcatctttcattgactcacagaattaaccataagaaagatacagaagttagtaaagacaggaagatcgaatctcaaaataccatggccatgatacagcaagaaatgataagcgcatagagagagagagaaaaatgtaaaatgtgcaagcaagcagttcggggggtgctattttcaggaaacgctgggtcagtcatcatctagtacacaacagcgatggaaatggctttcggtctcatctccacgcttcgatccgctcaactctggagtttatgcggctcacgatgctcgcacctcttgatttctcagctgcaggcgtggtgcgcgtgccagactggcccttgccctttctagtcctcctccggttcaggcttcggctccccttgcctgcctggagagaatttgtggctgtcgtgccggaagcatcagcgatagcagctgggccagcaggtgcaggctgtgagccactactagtggagtcctccacacccgttgctacctcgcttgtctgggcagtgaaagcagcagtggctcctaaatcggtgttagtttcgttagacttgtcatcagtgctgtggccagggctgttcaggaggggctcttccttggcgaaagaagggcgcctggatccttcctcgaggagagaatcaagtgtcacggtgggcttctgatgcccgttttcatcagatgggtccttctggggcagcaaagcatcctctggggtcgactcctctctatccttgagggtcttttgtaccagcatcttgagaaaattcatcacttggactgcatacatcagtgcagtcaaaggatctgccatctgcattgtaagcgtgctatagttagcatcattgtgatgggtgaagtatatattgatagtttgctaatcgctatcgtatcagcacaatgcaatacctgagtcatatttggtgcgaagaccatagcaatattgcgatcgttcatcttgtttatgtgttcttcttggactacgtcggccatcagattcacagcccagtcaagcaaagctgcttcagctggtggaaggcatttcgctacgcgagcacagtcctcttcagattggcattgcatcacctgttcaggtgggatagggtccagtacacccctcggcatttctctaaaccaggcctgaaaaaaaatgaaaatttaaattggatgaaaacatactttttgtcttgccaagaagtgactagctagcgagcaaaaaaaaaacaacgtgcgggggtaagaaaaagaccttctcatacagaccaagaaaacctccaaacctctaccccacccttacacaacgacaccgtagcccatgtgagaacgactgggaccgggaccaaaccttagacctatgccgagtcgaactcaagaccaaaggaat

SEQ ID NO: 3210 - DNA, 1178 bp, Zea mays
  misc_feature (1144)..(1144): n is a, c, g, or t
  misc_feature (1152)..(1153): n is a, c, g, or t
  misc_feature (1155)..(1155): n is a, c, g, or t
acagacacagctgagccgatctcttgaaaggagaggcagagagcatctgaaagtagacaggagtacctagcaatcaaagaggaggcagcaatacaagaagggcgagctaaacagtttgaagaagagatgaaggagcttagagctaggcacaaggaggagctgcaagaagcagcagaacacagggacctgcttgagaaggaccttgaaagggaaaaggctgccagggcagaaattgagaaaacatcttcccgtgaagcgcctaaagctccacttcccgatcaaacaagaaatgcccctctcagaaagctgtctagttctggcagtataaatagtctagaagaaagccattttcttcaagcatcgttggatttatctgacaatgcttcattagagaggcgaatgtcttcagaaagtaatatgtcatattatctgaggaccatgactccaagtgcttttgagtcagcacttcgtcaaaaggatggagagcttgcttcttacatgtctcgcttggcctcattggaatctattcggaattcactagcagaggagttggtaaaactgacagaacaatgtgaaaagttacggactgaagccactgctgtgcctggcttaagggctgaattggaagctctgaaacaaaggcactttcaagctctagaactcatgggggaacgtgatgaagagttggaggagctaagaaatgatattgttgacttaaaagagatgtacagagagcaggtggatcttcttgttagccagctccaggcattgggtgctcgtgtatagcgctgcctgcgctggtatgaatttgtcataccatctaattcttgtccagtgcatcgcggccaggccaagataccaggtccgtgacttgagcatgttttgtttcaaattttgtaacaccatacaacggcactgaatgttttcgtttgtatacatcggaacacagttgttgggtttaggaggatacgttgttgtatactagtaggttgagtagtttcacagctttacgtgtattctttgtgatttgtttccgttgaaatgtatcaaatttgaatccatttgcaagtgtacctcagaggaatgcaatcaataatatcgagagctccttttgtcccaaaaaaaaaaaaacaaaaacacaaanaataaatnntnttcttataatatattcccctttt

SEQ ID NO: 3211 - DNA, 982 bp, Zea mays
ggccgcgtcgacttttttttttttttttcttttttcttggacggaagtacttccctattctaaattcaagcttttcttgcgatcacaatagacggtattgttttgtttttactatgtacacaatagatatctacacgtaactagagctactgtacgattaggattagtcaccaagaatttttgtcacaaagcattcatcgtctagacagctgtaacatttttgtgtaaattcgaaggtatattccttcctgatatttacatcttttctctgctattgtcaaccatctacatctgttttttgttgacctccggaaggggaacaaaaacaggatagtaggtattcagttcaaggtgctccaggatctgctgggcagctgacaggtacgaagaatgaccatcaacaagctcggtaacatccacgttctcaacaccaggtacatcaatggcctggatgccagccagtccttgggtaagcaggcttgctcggaaggttacaccgagaatccagtcatctctcgagtacacattcacaaatctccctgcaaccatcttcctggcaggctcccacctctcacctttcactgaaaccggtgcaccaaggagtacaaccctctcgacaagtccctcattgtcacttgataaagctagctcctgtaagcacttgaatatgactcgcgctccaagcgagaacccaacaagagtcacaggcctgtttccttgcagtcccttaagaagcacttctgcaagcatttttcctgctttatctgatctgtcgatggcaacagaccatttactatcaataaaatctgtagcggcaagcaacgtagcaggccaagcaaatgctgcaagaaggccacttaagacagttctcatagcaccttgtttcatcaattccattgcaggggggggggcctacgtagcgactcgtgctgtactcactgcaattatgtgcttggactcccattgaaggatgtacttctct

SEQ ID NO: 3212 - DNA, 2409 bp, Zea mays
attcggctccgggaatgttccagtgaaacgcctaggcctcattttaaggaacctgttgtggacagctctgggttaacatcagcagcacctgaaagtttaacagctaagcaacatgtccactcaccagatgcctttataccaccaaagcctggtgctccaactggggaattaggtgatgtaaaatcagattttaaaggtgaagaaattattcaaaaagaacaatattgtgaaagcgaacctattgttgctacaagagagaatttgctaattgatctttcctgtggtgccgagtcgatagatgtgtcagatgtattggaatctttaatggaagaaaggagtggaacttcgtacgtgccagtatcaatagaggacttcctagccgcttcagcagtggaagaaccacaatactctagccctatagcgttatctccttggggtgaacctagttactaccaaggtgatgctggtgattctgcgctatggggtattcaagattcgatcaatgatatgtggtcattgctttcaccaagacctatgctccaagcttcatctggtattggaactgaggggaaggaaacttttgatatcaacggaggtggctgtgacccatgttaaatagtgattttttccaaagaggatcgatgcttggggaggaaaatatgaatcaggcaaacttgagtgttgctgcagataggatgctgctgcctgagcaggtcccatcaataccaaatggtatgtcaacatcatcagtagacgagggcaccagagttataggttctcaagcatcaatcaatcagagcttagactggggtactacatggaggactagtcagaatctcagcgtgtatagcaatgaaatagcagggccctcgagtaaaagctattgggaagaatcaaggaagcaggaagccaccaattcgggcgtttctatttcaggggaagccattagaaacaagcgcttgaaccctcctgataatgctattcggggcagccatcatcaccgtggcaggtactcccaaatcagtgaatcttggctactcagttcaaatcactctaggagtagttctgctagatttggcagcggtgggtcatcaagatcaacttcaaagggtcaaactaggggctaatgtaaattctcaggtgcaggagaaaggatgcatcttgtagctacctgcatccttgatctctgcagcaggaataggttttaaaattctctgttatatctttgcagtttgtataggctaattaaaattaagtcaacagagagcgtaaatgaccatctctgctccactcaactcaactgtagcaaggagcatatgtttagcatagaggtttgactgaatggccctgcccaagaagtagattcagctcttgggcatggtctgtatcatcctgacattctgttggatggaactgcaattgtgcaaccggcatctcttgacaccgaaacgcccctgatgtgttggaatatctgatcgattggtttagcttttgaatgttctggatttgatggaacgatttaacttgctgatgatcattgttcagtatttgtggtgaggatactttgtaaaattcatttgcagtttacgatgtgataatcgaactctatccaactcacttttcgggtcagcaaaggccaaacaatctctaagatcaaatatatattaatacaaataattataatacagaataactattatcagattaatctcttgttggacggaagtacttccctattctagattcaagcttttcttgcgatcacaatagacggtattgttttgtttttactatgtacacaatagatatctacacgtaactagagctactgtacgattaggattagtcaccaagaatttttgtcacaaagcattcatcgtctagacagctgtaacatttttgtgtaaattcgaaggtatattccttcctgatatttacatcttttctctgctattgtcaaccatctacatctgttttttgttgacctccggcaggggaacaacaacaggatagtaggtattcagttcaaggtgctccaggatctgctgggcagctgacaggtacgaagaatgaccatcaacaagctcggtaacatccacctgtaaatcgtgcacagtaaaaataatggaacctcgctaaaaacatgagaattgtcacccacaaatgcttacgttctcaacaccaggtacatcaatggcctggatgccagccagtccttgggtaagcaggctacatcagagaattagcaagtcagcaaagatatcgacttaactgttccagcactgactatcaatcaatttgaaatcaatcccactttgttcaccttgctcggaaggttacaccgagaatccagtcatctctcgagtacacattcacaaatctccctgcaaccatctgcaggtcgactct

SEQ ID NO: 3213 - DNA, 2514 bp, Zea mays
gaatcagcaaagactaattgaagcggatgcatcaaatgcttcacttaatcagcctcgcattttcgctgtatcttctgataataaagatatagagcgtgaatgtcctagcccaactccaaggtctgaatgcaaggaatctcttatgaagaactcagtattaacatcagcggcgcctgccccgcgtccgagatcttctgcatccgcttctgatacatgcaaaatggaggagtttgtgaatcagcaaagaccaattgaagtggatgcatcgaatgcttcacttaatcagcctcctcgttgtcacattttcactgcttcttccaataatcaagatattgagcgtgaatgtcctagctcaactccaaggtctgacagtaaggaaccttttgtggacaacttagtgttaacatcagcagtgcctggaaatctactgacaagttctgcagttgcctctgatacatgcaagatggagatcttcaataagaaaataacacttgaagcagatgcatcaaatgctccacttaatcagcctcctctctctagcgttttcgcttcatcttctggtgatgaccaagataatgtgtgtggacgtcctagtccaaatccaagacctgagggtgagcagcctctcatgggtaactcagggttaatatcaacagtgcctcgaaatctaacttctacttctgcatctgcttccgacatatgcaaaatggagatcttgaatgagaaaagaacacttgaagcaaacccatcaaatggtttgattactcaatctcctcaacccaaggttttccttgtaccatctcctgatatcctagagcctcgaggctcccggcatgcaccccggcctgagtttaaggaacctgttgcggacagctctgggttaacttcagcagcacatgaaaatttagggactaagccacatgtccactcaccagatgcctttgtaccaccaaagtctggtgctctaactggggaattaggtgacacgaaatcagattttaaaggtgaagaaactattcaaaaagagcaatattttggaagtgaatctattgccgctacaagagagaatttgttaattgatccttcctctggtgttgagtcgatagatgtgtcagatgtactggattctttaatggaagaaaggagtggaacttcgtacatgccaggatcaatagaggacttcctagccgaagaagaaccacaatactctagccctatcgcattatctccttggggtgaacctagttactaccaaggtgatgctgttgattctgcgctatggggtactcaagatttgatcaatgatatgtggtcattgctttcaccaagacctatgctccaaccttcatctggtattggaactgaggggaaggaaacttttgatatcaacgaggtggctgtgacccatgttagtagtgattattttcaaaaaggatcaatgtttggggaggaaaatgtgaaccaggcaaacttgagtgctgctgcagactggatgctgcctgagcaggtcccatcaataccaaatggtatgtcaacatcgtcagtagatgagagcaccatagttttaggttctcagccatcaaccaatcagagcttagactggggtggtactacatggagtattggccagaatgccagcgtgtatagcaatgaaaaagcagagccctcgagtaaaagctattgggaagaaccaaggaagcaggaaaccgccaaatccagtgtttctatttcaggacaggccattgcaaacaacaagggcttggaccctcgtgataatgctgctaatcggggcagccggctgagtcatcatcaccgtggcaggtactcccaaatcagtgaatcttggctacttagttcaagtcactctaggagtaggtctgatagatttggcagcggtgggtcatcaagatcaacttcaaaggggcaatctaggggctaatgtaaattgtcaagtgcaggagagaaaggatgcatcttgtagctaacctgcatccttgatctctgcagcaggaatagttttctttttaaaattctttgtcatatctttgcagtttgtataggctaattacagtttagtccactcagactgtagcaaggagcatatatgtttagcatagagggtatttgactgcccaaggagtagattcggctcttgggcatggtctgtatcatcctgacattctgttggatggagctgcaattgtaccaccggcatctctcttgacaccgaaacgcctgatgcgttggaaacatttatatctgattgattggtttaacttcgtggaatccctattttcgaagatcacgaaacgacagagctactgtacgttaatcatcatagcacttggttcctcttattccccgccacgtcggatgattatcagagcttcatctgactccccgccaccaccagcatgagcatgcccagtacctacgtgagtgtgtgtcacggtctactagactactagtctacagctttccttccggcgcccaacaaactccggccgtgctgca

SEQ ID NO: 3214 - DNA, 1970 bp, Zea mays
gcaagaattgaagcaatattgcctccttttattgaggcttctatttctggttttggattggattacagtgaactcagagagtacactcatggtttctttagtaacgttgctgaaattttgggtgatagttttacacagtatcttcctcatgttgtccctctcgtattttcttcctgcaacttggatgatggttctgctgtggacattgatgatgccgatagcattgaaaatggatttggcggtgtttcatctgatgacgatgttaatgatgaaccaagagttagaaatatcagtgtgaggactggagtattagatgagaaagctgctgcaacacaggctattggttttttcgcactacacacgaagagtgcctatgctccgtatctggaggagtcactgaagattttgatccggcacagtggttatttccatgaagatgtcaggctgcaggcagtcatatctttgaaacatattctaactgcagttagggcaatacctcctgcacatgctgatgtactagagaaacagaaggatgtccttgatactgttctgaacatctacatcaagactatgacagaggatgacgataaagaggtagttgcacaagcttgcatgagtgtagcagacattgtgaaggactgtggttttgctgcaattgagccttacatgctgaggcttgctgaggtaacactggtccttttacgccaagaatcaagctgtcagcaagtagagtcagatggtgaggatgatggcgacattgaccatgatgaagtcctcatggatgcagtttcagatcttttgcctgcttttgcaaaagtgatgggatcttattttgatcccatatttgcaaaattatttgatccgttgatgaaatttgctaaatctccccatcctccccaagataagactatggttgttgcaaccttagctgaggttgctcaggaaatgggtgctccaatatctgcttatgttgataagataatgcctttggtgttgaaagagcttgcatcatctgatgctactaataggagaaatgctgctttctgtgctggcgagatatgcaagaatgggggtgctgcagcactgaaatactatggtgatatacttcgttctctgcataatttgtttagtaactcagaatcagatgatgcagtaagagataacgctgctggtgctattgctaggatgataatggtgcagcctcagtcgattcctctcaaccaggttcttccagtttttatcaaagctttgccactaaaagaagatcatgaagaatcaatgactgtctatggttgcgtctgcggtttattattatcatcacatccccagatcctccctctggtgcctgacgtcatacatgtctttgcccaagtggtggtatccccagatgagagcgatgaagtgaaaacaaatattggcaaggctatttctcacttgatatctgtctatggccagcaaatgcagccaatactgagtgcccttccaccagcccatgcaaacgcgctggcttcatttgcgagtagaagatgaccttggaggaccagcttttctttggttccttgttctgcttgattttgttttggttttgtcgacgattgccattttctgaggatctggtcacatggatcaggccagatggagtgcttgcattgcacattggcaagggcgagcggagttgtcaggttggcgcatgattgattatatggtgagcttggtttctctttgagatacacagttgtgcttgctttggagccctgtacagcgcatctgtgagtgcctgcctgtattcaggttccggatttggttatttatgctcttgttttttatatttttttgcctgtatttgcaattcattgattgctgttgtatatagaagagagttttaaatagagagaatgtacgactctgcaactggcaaattttgtatacatactgctcataccccttgctaatgtttatccggattgcgt

SEQ ID NO: 3215 - DNA, 1653 bp, Zea mays
cgaagagtgcctatgctccgtatctggaggagtcactgaagattttgatccggcacagtggttatttccatgaagatgtcaggctgcaggcagtcatatctttgaaacatattctaactgcagttagggcaatacctcctgcacatgctgatgtactagagaaacagaaggatgtccttgatactgttctgaacatctacatcaagactatgacagaggatgacgataaagaggtagttgcacaagcttgcatgagtgtagcagacattgtgaaggactgtggttttgctgcaattgagccttacatgctgaggcttgctgaggtaacactggtccttttacgccaagaatcaagctgtcagcaagtagagtcagatggtgaggatgatggcgacattgaccatgatgaagtcctcatggatgcagtttcagatcttttgcctgcttttgcaaaagtgatgggatcttattttgatcccatatttgcaaaattatttgatccgttgatgaaatttgctaaatctccccatcctccccaagataagactatggttgttgcaaccttagctgaggttgctcaggaaatgggtgctccaatatctgcttatgttgataagataatgcctttggtgttgaaagagcttgctgcatctgatgctactaataggagaaatgctgctttctgtgctggcgagatatgcaagaatgggggtgctgcagcactgaaatactatggtgatatacttcgttctctgcataatttgtttagtaactcagaatcagatgatgcagtaagagataacgctgctggtgctattgctaggaggagaatggtgcagcctctgtcgattcctctcaaccaggttcttccagtttttatcaaagctttgccactaaaagaagatcatgaagaatcaatgactgtctatggttgcgtctgcggtttattattatcatcacatccccagatcctccctctggtgcctgacgtcatacatgtctttgcccaagtggtggtatccccagatgagagcgatgaagtgaaaacaaatattggcaaggctatttctcacttgatatctgtctatggccagcaaatgcagccaatactgagtgcccttccaccagcccatgcaaacgcgctggcttcatttgcgagtagaagatgacctcggaggaccagcttttctttggttccttgttctgcttgagtttgttttggttttgtcgacgattgccattttctgaggatctggtcacatggatcaggccagatggagtgcttgcattgcacattggcaagggcgagcggagttgtcaggttggcgcatgattgattatatggtgagcttggtttctctttgagatacacagttgtgcttgctttggagccctgtacggttaaaggcagaccttggtcgacagcgcatctgtgagtgcctgcctgtattcaggttccggatttggttatttatgctcttgtttttttatatttttttgcctgtatttgcaattcattgattgctgttgtatatagaagagagttttaaatagagagaatgtacgactctgcaactggcaaattttgtatacatactgctcataccacttgctaatgtttatccggattgcggcccgcggccccaacacaat

SEQ ID NO: 3216 - DNA, 2311 bp, Zea mays
  misc_feature (2)..(3): n is a, c, g, or t
  misc_feature (25)..(25): n is a, c, g, or t
  misc_feature (27)..(29): n is a, c, g, or t
cnnaactaatgggtccccccggctncnnngcccccccccccccccccccttttctttgtgaagatgaagcatgcttggcaaagaagtttgttgtctttctgagtgaagcagagctgaagaggcataatgctatggagcacggtgggcgaatgtctcgttcccagaggaatgctgcacttcagatacctaccagttttatatatcgcagaaatgagcaagcacaacggcgtggcagaggtagggggcgtaatgctctccatgaccgatttgacagtcatatctcatcatctgcacaaaacggccaagcaactgccgatcgccgtcttgatagtgtttcagggtcatttcagtcattaagcattggatctagttctgggggagctgaagttggccaaggctcgaggactggacaagtgctcgaacagttgtccttcccacctcttttagacccagatattcctgacaacaacgttgattcttttcatgatgaaacctcatttccttcattatccgagcagcaatcaaggtatgcactagctctcagtcagagtgcaaggggcactgcgaggcttggggatgagtcactattcccccctttgcctgggtctagtgggtctaataacaataggggtgctggttcagtccaacagggactacaaagtctagccaagagcacacttgcagcaagacttcaacaacgtagcaagggccctgtgaaggtacttaatactgctcggccacgtccccctgaaaatgttgaagccctctctagttccacccagacatggcctacacctgatcagggcctagtcctgtctggatattctcagcttcgatctggaactcaaccaacaagggaaaatgccatgccaactatctccagtaacacagtgtggaatcctgttgctccaaacaagatgaagcactctgtttctacgcctaatcttgtgtctggtggatcctctgcccaagtatcattgagtacagcttatggtagcaacaaaagtcaggatcctcctcaaggtaaccaaactttgcctgttccagaggatttccgtgctgcaaacaaaactctggttgaaagaatgcgttctgctctgggaatggacgaggacaggtactctgcattcaaagagattgctggtgaataccgtcaaggtatcataggtactctggagtatctttcatatgtcgagcagtttggactgtcacaccttgttcctgaaatggctaggctattgcctgatcctcaaaaacagagggaacttgctgatgcatattatacaaatactcgatttaaaagcctacaagaaaacggaggtggaactagctcacaagagggcaaccgtaaaaagaaggggaaggggaaagctcctgtcacagaaagcagtgctgctaatgatgtgaatagtgcactagcagataacattctggagactgtaagaaggcttcaatcaaaccagcaggctcgggaaggaggagctgaggtgctgtcgaaggatgggtatcgaccttccaagggggtccaaccggcagctggatcttcatctaatctggacagtgatactagttccaactcaaaatcatctggtgcaaaagataacataggcaagggaggaggcaataagcaaccgaagaagacagcaaagtttctcagagctcgtttaggtgacaactcattagccacacttgatttaagtcgtccaagtgcaagccctgaacgtccagaaagggaattgcaaggccctgagacagggttgccagcgcgaggtgcttggaagaatggcggggggcagaaactcttttcgagcaatggacggaaataagtcattccaactgcatagccgtggggacggggttgacagcgccaggtgcttggaagaaatggtggccagaaactcgtttttgagcaatggacaaagtgagtcactgcaactacatttaggtgtgtccatatacctgatcaacaattaggcaatgccctgttcattgctaccggcagactgcgcaaatttcatagtcatccatttcaaattcgtaatgatgtggtggtcaacatttaatgtggtacaaatatactactagattttctgtgcattacaacgggaacatgtttggtagtattgtccaaaaaaaacttgtcaagctaaaaccaagatacagagggtccgtgtcaacatgttactatgtgttttcagtgctttgtttttttaaaggaaatatcttgctgaagtatgcaaaccgtaatgtctaattaaacttatgattccatatttttttcttagcccgttgtatcgtgaattggcgatag

SEQ ID NO: 3217 - DNA, 1442 bp, Zea mays
atctcgcgcaggttggagggtgaccgaaatgttctcccaactcccaagtgtggtcctgacttcggccatctgtataacctccatcaaagcggacagccggacacctgtgttggaaaaaaaacccctgctgggccgtccgctcccgttcccatcagatcggatcgatcactcgacgagacatctcgcctcctcggccaatcggcatggcggcgctgctgctccgtagactcgccggaacccaccgcggccgcgtcccgctgggggccgccgccgccgccgcctgcggtggagcgacgctcttctacgcgtcgtcttcccccaccgttgcgcacttggaggagacgggcaaagccgctgagcaagttgcacttaaccctgataagtggctagagttcaagctccaagagaaggcaacagtcagtcacaactcacagttattcaggttttcatttgatccatcaactaaactgggacttgatgttgcctcgtgcctcatcacaagggcacctataggcgaggaagctgagggaagaaggaaatatgtgattcgcccgtacacacctatctctgatccagactctaaagggtattttgacctattgatcaaggtttatcctgatggaaaaatgagtcagtattttgcaagtttgaagccaggagatgttgttgaagtcaaagggcccattgaaaagctcagatacaacccgaacatgaaaaaacaaattgggatgatcgctggtggttctggtataacaccaatgctgcaggttgtcagggctatcctcaaaaaccctaatgacaacactcaggtctccttaatttacgccaatgtgtcaccagatgatatcttgctcaaaagagaactggatagacttgccagtagctatcctaacttcaaggtattttatacagttgataaaccgtcaactgactggaggggtggtgttggttttgtatcaaaggacatggttttgaaaggtttgccaggcccagcggaggactctctgattcttgtttgtggtccaccaggaatgatgaatcacatatctggagacaaggccaaggatagatcacagggcgagctctctggcgttctgaaagacttaggatacaccgcagagatggtatacaaattctgagaagacagtagtagactctgctgacgcacacacattcttgctgccctgcagtcaataaaccacacctgaactttttgttgttgctgctgcatctggctctgaactggaaaccgttttgacttgtttcctgatgtaataataattttcatccgagaattctaggtgtagcttcgggtgttctgcagatgccacgctgcgatgtttgcgaaaattctagtatgctggcacttgagataagagctatcgagttctactggataaaaaaaaaaaaaaaaaatatgttggaagttggaacccaaaaaa

SEQ ID NO: 3218 - DNA, 5217 bp, Zea mays
ctgcattcatgtactagacctatatgacttcgtcttcattgcgacatttctttgtcaaattctttcggatagtgattgctgtaccatctgatctctagtgcacgcacccccacccaccgaggtagtgttagttatggccacttatgctatgataggccattactgctgcaagcacaaggaaagatgaagctatctttaataaaatccagggccagctgaagcacaacaatgtgactgtggatgcgaaagcaacttcagaatcaaaagtaagtggaaatatctgttattactggcctattaccaaggccattcactaatatcaatcttcccgagacagttacactgtcttctgtaaaataatcataattttcccttttgccaggtgacagctacaatcacagttcacgagctagccacaccaggcctgaaggcatttttatgcattcctttcccgtacaagaaatctgcaaaggtatatattccctttcatttctaggtcaagcaccgtctgtactggattcggactccaattaaatctcttttctcttttatggttttaggctgaactccagtacttgcaccaccatgctggtgttgccgcaagtgttggcctaaatgcaaaccctgtcgttaagctttctggtgtattcggaactaaaactgttgctgttggtgctgatgctgcatttgatacttcatccgggaacttaaccaaatacaatgctggactgagctactccacgtctgacttcgttgctgcagctactttgtaagtggtttgttcctatgtttaacagtttctgtttgtgactgttatttgtgtcctagggatccggttcgtccctagcactagcaccaatgatatctctagggaatttatgaagtaaaaaaattgtgcatgtcaaggtgcataccttgtttctgcttctttgactgtcctccgcatgatgtatcttttagtagcacatgttgtgacaatgtgcgtcgaccataaataatacgcggtggttatgacagtaaaccgattctgcatttcaggaacaacaaaggagacaagatcgccgcttcctactaccactcggtaagtccaaccacagctgttgcacgagagctgagccacagcttctcgaccaacgggaacaccatcaccttcgggacgcagcatgccctggaccgtctgaccactgtgaaggcacgattcaacaactgcggcatggcaagcgcactgatccaacacaagtggaggcccaagtctttggtcaccatctccatggaggtggacaccaaggccatcgagaagagctccaagattgggctctccctcgtcctgaagccctgaggtcaccgccagcttcttgttttgggatatactaggtctattttttttaatctgcagctgaagtctccagcaaacaagattggactaaacctgtcaactttggtgccgatcccacaaactcaagttcacggtctctttggtggaaaactatgcggttttgtataccactgggtgatgatgtttggagaaagttcagtatggctcaccagtcaccactgtctctcagattttaactgtttgatttgtcgattctttattcatacagatcgcaatttttctcatgcctcgctctgctgacatggattcacggatcaatcttgatgtctttctcaagctccttacggtagttcttcgttgcttgtcgggcctgtgattcggcagagatgataccgaaccgaacagacagaacatgcagctggctgtgatttggcagagaagatacggaacaggcagaaacatgcagctgggattttccatggttaacctttgccggtcaggtggaacgtgcgtgcgaaagggaaactagcagctggaaatttgaaaattttcattacacaaaattaaggcaactattgcagagaaggcatgttgccaaacccactccagccatccagcccctcgccgtcgtagcacgcggcgatgtctccatggaacccagcaacccgcgcgtggccgccgccgccgccgccgcctgacgagaagaggtcgcacatgtccggaggcgcctctccctggaaaaagttgtggtactcgtaggcgtctcctggccctggatgaccactaccagcagcagcagccgcctccccgtccccggcgccctcctcggcgtcggagttcttctcgaccagctgccggaacatggacgacttgagcaggaggctgagcgcggtggaggagcctcgcctcctcatgccgccgggagacaccgtggacatggaggcctcctggccgccgccgctactggtcatgtggtccagcaggaacgggttgcctcgcgggagcatctgggccgtctctgccgggtggtggtggagctgcagctgctcggccggcgctgcctgcgccacgagcgcctcccggttgaaggcggccggcggagcgctgggcttcagccacgtgatgtaggacctcaggtcgaagttggtcaccgcgttcacgcccttgtactctatcgccgcgatgtcgtatgcgcgggcggcttcttcttgcgtgcctagatagatcggagcagtttttttttctttgttgttaatctacgagtcacgatgacgacgacgacggcggcggaatttgtatgataagttgcattgtgttggggatgtgatgtgctcactgtaagttcctaggtagaggtacttgttgccgaagacgcgcccgattctcgcttcccatctcccgttctgatgatgtctgaacgaaacatgcgtgcactgtcttgagcatctaacacatcaacagatgcatgcaaccttggagctactgatttatggagagacacttggagcaattttattttttatctcttttgttgttaaaaaaaaccgtacctggcaacccctctgtacttagacactcctcttgaaaagccactgctcttcctgtggtcaagacaaactcctttcagaatttcgaactgtaacggtttcagtcctgaaaaaaaaacgattttttttctttgcccctccagggccaggggcagcagcagcgtgcacgcacctcctcagcgatgcaaggtactcttccttggtgaggttctccatcaccttcagctccttctcgtagtccatgacctgagagacacaaatacaaactcaaccaagtcactagcacagtcatgtgtcaaaacaaatgccgaaattcacttgtccagtgtggctctggctcactaactgctgctgctcgcagacgcagacagtgaagaagaagacgctcgaagtttataccgtaccgggaagttcgtgtaggtggtaggcccccagtacttgagagcagcgaggtcgtaggccctcgcagcagcctcctcctcgtcataagctcccagatacactgtcggtacggtgatcaagcaacgtatgtaagtgtctcctatactatgcatccagcatttgatcagatcatctaccctgctgctgttccagagagcgagaaaagaacacctaccctgtttgcctttcttccgctgcgtcggattccacgagttcttgtcccacagatgcgcctcaaaccgacccgtccatcgatgcctgcaacaacaatcgtctgcacctcggctccatgcctagcagctagcagtgcagtgagtgaccagcgcgtgatagcttcgctcttttcagtgcgagttactgaggtgagctgtccagtccagctatagctacctgctgaccccacggaacctggagctcctcttgacggtgatgctcggcagcggcttgccaatgccgccgccgccgccgatgggcgcgaggagaggcggctccctcctcctcctcctcaccacctgatgacgatggcccccctcgacgccgtccggcgctcccccgatcaccacgctgggtgccgccgccgacggccccgggtagcagctctcgatctcgctcttcaccagcatcatgccgctgctctccatcagttccctgccgccgccgctactactccgctcctcgtcctccctgtgctcagcgacgacgtgcggcagcttccaacgcagcactgacagacagacagacagaacgaacgaacgtactcgaggcgagacgccggaacccgccggtgcggcgcgccttatataggcagccgtcgcccgccgaggctcgcgcgcgcgcgactgcctcgccctcgcgccgtgacacagggctttgtccgcaggcgagcgcacgacaagggcgttcgtggtattcacgccgccacggtccacgccccgtctgtctccactatgccgctttgtcctcgcccgcgtttgggaacatcgagctgagcctgagctctgcggctgtcctttgtcgtcaggtggcggccgcgacgatcgatcaattcgggcgccgcgtcatggcgactacaagatagtgccaaccgatctgagaaacctgtgctgggattttggctgggctacgcttgtccgcggctgcccacacgtcttgtacagttcaccggggcgagcagtcggcgcacactcgtcgtccttacactagaatatctgtttgagctctctctctctctctctcgtcaagtcgtcacttaacaacttcagtgacctacaaatacattttcaaactttatgaatttaagtggtatcctttaaccgttcaaaggtactcttaacaagtttatgaatttcatggcaacgactgaagatcgctcagttggatgaatcttcacctatgatgataaatagcatatgtatatactcccttcttctaataaaataagcgtgcatgtttttaaaaaagtcaacgtttaaactttaaccaacaatttagcaaaaaaacatatgtttttagtgtatacatgttatatatttgaatttgtcttcaaaatacttaaatatgatgctcaatttgtatttatcgatgtcatcttttaaaagaaattaatggtcaaagtattactgcaaagactttacaaaaaaaaaatatataccctattttatgggatggagagagtatatagaaatgagatactacgagcttagaggtttcaatagttatataaaagtctaagagcatctccaatagttatgtaaatttagcaccctaaattatagatttaagaagttgctaaaacactttaaggagtagaaaaatgtatgtgctccaacagtttcttatttattggttgctaattttgaaatttgtttatgtcaacataaaataagcgagaat

SEQ ID NO: 3219 - DNA, 1059 bp, Zea mays
ccggccgggaccggcctctcgcaacagccgccgcgccttcccgacccgacccttgcacctgtcgtccccaccgtccgcgacaccggcctcacgcaatatccgccgcacatgccaggcccggcctcgcgcccgcggtatccgtgcccggctgttgtgggaggcgccgtcccatccgaatctccccctcccttagatataaaggttcatcctcctcagcagtcctcttggacgcgactcctccaggctccagcggcgcctcggtcgcgtgccccctggtctccagccatcgtgcggttcgaaaagctgaacggaataggacgagtcgctgctttctcttcaaggaaacgtcacgtcaccaccacacacctcttcggctcttcctcttctcctccgtatagcggcgggcctccgtcggcccccttccaccccgttttgccgccccacaggccacagcccaaaatcctcctcgtcgctggtgccctctccgcggcctcctccgccagccatggccgccgctgggcccgggctctactccgacatcgggaagaaggcaagaggtctcctgtacaaggactaccacactgaccggaagttcacgctcaccacttacgccgccaacggagctttcaaggcgcgtgtcaccatggacatgaagcaccgcgtcgtccgcgccatgatcgcgggtagcatgggagacggtgatggcgcacccgtgcatgtccaggataagaccgagtcggtacgtgacgcgacacggcgcgagcatcatcgtcttcctcttaccatcaaatatgatgattgtatgccgtcgtaatgcacgggcattgtactagtttcttatgtaccaccttactagcattctggtatgcttgatgtcagatgactgctaaatttttttatcttactggtgggtgcttcaggtggttgtgcatatcggttgtcatgctgcaagtctgcagctgcatttatgtcctaattcatatatgtcttcgtcttcattgtgacagttctttgtcaaattctttgcggccgcaaaaaaaaaaaaaaaaatttgcggcc

SEQ ID NO: 3220 - DNA, 1341 bp, Zea mays
  misc_feature (1322)..(1322): n is a, c, g, or t
  misc_feature (1341)..(1341): n is a, c, g, or t
gcacgagaccattacctagaacatcctaatcgaaaaaaaccaaaagcagagcacgcagcccagctccacgagattccgtgactgcgacggcgaggatgggcggcgaggcaaagaagctcccaaggatcgacttctccgaggtggacccgtctgcgccgggcggccaggcatggggcacggcgcgcggcgaggtgatggacgcgctggccaccttcggctgcttcgaggcgcactgcccggctctgacccctaggctccgcgccgagctcttcgacggagccgtgaggccgctcttcgcgctgcccgccgacgccaagcgccgcaactgttacggcgccgataggccgttccacggctacctcggcgacgtcccggggttccctggctacgagagcctggccatcgtggacggcaccaaggacgagtccgtccgcggcttcgcccgccttatgtggcccgacggcggtgacaacagcgacagtttctgcggtactgtcgttgaggcggcgcagcggatcttccagctggaggaggccgtgcggcggatggtgatggaagggctcggggtggccaagcaccacgacgcgctgagcgcgtccatgtggcacctgttccggatggcggagtacaaggcgcccaacgccgcggagaaggtggtcaggtacggggcgcatcaggacaccaactggctcagcgtcgtctgccagcacgaggtggccgggctggaggtgcagagcagggacggcgagtggatcgtcgtccagccgtcgcccacgtcgctggttttcatggtcggcaacgagctccgggcatggacgaacgaccgtctatatgctccatttcaccggatcaccgtcgctggggacgtccccagatactccgcgatgctgttctcggtccccagcttccaggttcaggtggcagacgagctcgtggacgacgaacaccctccccgtttcaagccccatgacaacaacgacttcgtctgcttctgcgtttccgaagaaggcgctctccatcaagataaactcaaggccttctgtggagtgtaacgagcagcagaacatatcagccgtccggcatctgtgttattatacttttacctcagccttgcatgcagcagaggccaggccacccctgtagactagtacgtacaatttttagaacacgcgtgagatgataactcgtctgcatttcttatattctgaacatgaacaacaaagcattctgctagccatgaaaagaacacgcgtgagaagataactcagctccttgcacttgctttcaactagtttcgactggttgtaaaaaaaaaaaaaaangaaaaaaaaaaaaaaaaan

SEQ ID NO: 3221 - DNA, 2551 bp, Zea mays
  misc_feature (942)..(942): n is a, c, g, or t
  misc_feature (975)..(975): n is a, c, g, or t
  misc_feature (1070)..(1070): n is a, c, g, or t
aaagctggagctccccgcggtggcggccgcgccttcctccgggactacgcgcggcgcgggaccaacgcgctgctgtgggcgggcctcctcgccgtcacctggctcctgctcctccgcgtcgccgcgcttctccgcctctgggcgctcggctcccgcatcccggggccccgcgcgctaatcgccgaccccgggctcgcctccgtcttgcgcaacggcggcgacatctccggctttctatcataattgcatgggagatatggcccagttgttcgcgctgtgggtgggaccctcccagctacttgtatcagtcgtagatcctactctaaggtaaagaggtgctatcaaaggctaaagataagttaccattggactgggaggacatataatttagcttgtggaagacttgcccttgtttgtgtcctcattccagaaggtgaaaaggacaagagattctctgaaaatattcttgaatgaaagacttacagttggtactggtcaaagctcattcaaaattattgatgctgtcctgaatagaatcgactctattaggtccaaggattttatggacactagatctttctcccagcacatggcatttaatattatcagtgcaactcttctgggtgatgccttcttcgattggtctgatgctgctgcgtatgaggaacttcttatgttggtcgctaaagatggttgcttctgggcttcttacacattcctccctttttggggccctagctatacgaggtatcagaccctatgtgctaagctgaagatattacagagagcgtcatcagaaaatcaagataccaaaatagttcgcttcaccattttgatcagagatcttgtcagaaaagtgaggggacagatcacatagaagtgttttagacaacatgatgcgaagtcattgcctccatggggctgctaaaggaccacttaatntagaagaggaaacatgtggaaacatcatggttnttgatgttgcatggtatttccacttctgctaacttgattggtaacattttgacaaggcttgtcttgtttcctgaattgcaagatcagctcataangagacgttcggcacccgccattcccgcgcctaaggtgggaggtttgtatgatctgcttaagaatgcaagttctacttgctactgtatgtgaatctgctcgccttttgcctgctggacctcttctgcgagcgatgttctttgaaacatgatttgactcttgcctcaggtgtcactgtgccagcgcgatcaatattaagtagttcctctgcatctcgtgcaaatggatgcttctgtttggggtgatgatgctgaccaggttaatcctcatcggttccttaaaagggacattgatcttggagaaatattaggagcacctaaaggatcaactaggataaatatttccagtgagtgtaccaaggccgaatcatttcttccatttggttctggaagtcgagcatgtgttgggcagaagtttgtggttctggcaatatcgatgttgattgccagtctgctccgcagctatgaggtacagcctcatccaagtttgtctaaagaaatggacacaacagttgatagcagccaccttcatcttccaaaccctaagatcatcctcaccaaaagaaggatctgaagggagagtttggcaaacgaaaatctggcacgtttgctttcactgtattgtttttcactggtgttacaccagtatatgatctttagtttcctaccgtcgtttggaccatgctgaagtttggaaaggcgaccttgacgatgcggaagtgccttttttcctccggatttttgacagaccctgtgtgcttcgttggatctaagtttttgtcaggtttttggagcacctgcagggctgttagatcacaggagacgtatgctgatgtgtataaacagactcgttttttcagttggggttttctcctatctgtggagaatgtaattaatgtccaacgcatgatgtcgctcgccacatatattttattgtatcttacttgcatataaacatgtgagcttattgtttggaccataatttgtgataaatctgtgggagtatctcatgttttcctttcttccgtattgcgcactggaaaggttctgagttttgaagagtgagaagccgagggccaacggtttgttggtggggaaaatgttgagcgcaaaccatctattagaaccatctattagagctagtttggaatccacaaaactgccactcattagagtggctaaaattctttattaaaaatattgaataagaagaagattttagtctattcaatctcctcaggtattctcgctcccaaatagagatggcaacgggtacaaacccgctgggttttgccgtcccaaacccgtacccgtgaaaaatatctatgcccattaaaaaacccgcacccatgacgggtttgagattttgcccaaacccgtacccatcgggttagcgggtacccatgggttacccgcgggtttcatctcaaatatacttgttcttctcataatcaataagtatcgtaatgattaatgagatcatg

SEQ ID NO: 3222 - DNA, 883 bp, Zea mays
gccggccggttctacggtcatcgcccttgtcttcttcttcttcttcttcttcatctcaccaacctttcccttcccgtcccaaccgccgtccgcctgctcccttccgctcacctgcttcatctgttttgaagaaaaaaaggaaaacagaaggaagagagtaaaagaggcctgcgctgccctgcgccccagagtatgcgcttctaacacttgcatatttggatggatgatgtatatggacggatagaggtcttcccccaacactttgtaccatcaaaagaagctatggagacacctgacggtctatcaacaagtaagaatagcctggatagtccaccaagttcatgtaagcgttcctggactccaagacgagttaagggagctgcatccattttgcatttattgtccattccccgcataagatggtctacaagcaatgaggatgatgacaagattgaattatctagagccgaagtagaaactttacgaaccgaaatagcgggtgctgaagaaagggaatctcacttaaaagctcggttggaaaacattgatgaagttttgagatatgcacggctttctggctatctctacattagaagtcgatggacccaactccctggtgaaccacctatattagatgatgctgatgtggatgactggcttcctcgctttgttgttctacaagggcagtgtttatactattatctgaaatgtacagatctgagcccacaggaatctacactcttatgtgatgttgttgaagtagggcagcttccagactttgtgccagaagatgaaaagacgagatatgcgttttacctgttgacccgtcaagggttgagggtttgatgctccagtacctcccgaatacaggttgattcatggg

SEQ ID NO: 3223 - DNA, 3213 bp, Zea mays
tcttaaaaaacttcttgtcttatccacattagacaaaatgaactatagaagaatttagaatttaagtatctttcagtatctttcagtatctaagtataaatactaagaaaaaacagaaagaaggattgatttgtggcaatagatgtctttcacatacaactagaaaaaagtaattccctttttgaatggcagttccaaaaaaacgtacttcgatgtcaaaaaagcgtattcgtaaaaatctttggaaaaaaaagacttatttttccatagtacaatcttattctttagcaaaatcaagatcattttctaggggcaacgagcatccaaaaccaaaaggtttttctgggcaacaagcaaacaaataataagattttgaaataatctgaattgaactatccaaaagaaattccaattatttaatatgaatgaataattcggattaattaataaatgtacttttatgtgtcgaattcctcggtacaatattcttagaacgaatccctccattatcattatatagaacaaaagtttttggtatattgtgtcctcagtattcttttcctatcaaagaacttttttttataatagaattctcataaaaacgaggattctattataaaaagtagactattcttgcaataggacttacaacctccacctaatcttatccaaaattcccatttgcgtgggcgcggccctggtacatcatattaataagagtgtaaaggctttcattctatcaatttttctaaaatacaaaatgcatttcattgtagttaatgatgaacttctaatgatgaacttctaatgttcctaaattctatggcttctcccagtctcgacgattcacgataaaataactattattcttttaagttaactattattttaaattagccgccatggtgaaattggtagacacgctgctcttaggaagcagtgctcaagcatctcggttcgaatccgagtggcggcattctcgaaaaagaatacaataaattagaaaatggattcaattcgaaatttccaattttgtaatgggaccttatcgttatgctatttgcaactttagaacatatactaactcatatctctttctcaaccatttcaattgtgattacgattcatttgataaccttattagttcgtgaacttaggggattacgtgattcgtcagaaaaaggaatgatagctacttttttctctataacaggatttttagtctctcgttgggtttcttcgggacattttccattaagtaatttatatgagtcattgatcttcctttcatggactctgtatattcttcatactattcctaagatacagaactcgaaaaatgatttaagcacaataactacgccaagtacctcccccgcggaaggctttgccacgtcgggtcttttaactgaaatcgagcggccccccgggcaggtacctgctctacaatctcagtggttaatgatgcatgtcagtatgatgttactaagctatgcaactcttttgtgtggatccttattatccgccgctcttctaatcattagatttcgaaagaatttcgatttcttttcactaaagaaaaatgtttttcttaaaacatttttctttagtgagattgaatatttatatgcaaaaagaagtgctttaaaaaacacctcttttcccgtatttccaaattattacaaatatcaattaactgagcgtttggattcttggagttatcgtgtcattagtctagggtttactcttttaaccgtgggtattctttgtggagcagtatgggctaatgaggcatggggatcctattggaattgggatcctaaggaaacttgggcatttattacctggaccatatttgcaatatatttacatagtagaaaaaatccaaattggaagggtacgaattccgcacttgtagcttcgataggatttcttataatttggatctgctattttggtatcaatctgttaggaataggtttacatagttacggttcatttacattaccatctaaataattacataacataaaaccttcggtttttttcctttttagtttgatttgagaaccctttgaaaagacgttcaaggggttctcaaaaattcgagatagatctaattagacttttttacttttttctgaattttttatttttccactctggaatatagagcggactggttaaaaaaagaaaatcctatttagtataataattggataatagaacctctaccctatcaacggatagcgagagaaccaaatctggataaataccaattcctattactggtaaaaagatacagattaaaagaaagagttctcgtggtccagaatctacaaaatttttgtttggaacatgaaatagcttgtatccatagaacatctggcgtaacatagataataaataaataggagttaatatcattcctattgccattacaaaagtaattagcatttttggcattaacataaatttaggactagtaattagtccaaaaaatactactaattctgcaacaaaaccgctcattcccggcaaggcaagagaagccattgaaaagctactaaacatggtaaaaatttttggcattgggatagatattccccccagttcttcgagataaacaagacgcattctatcacaagccgttcccgccaagaaaaaaagtgtagcaccgataaatccatgagataatatttgtaaaatagctccatttagtccaatgttggttatggaaccaattcctataattatgaaacccatgtgagatacggaggagtaggctattctttttttgaaatttcgttgaccaagagaagttgaagctgcatagattatttgcaccgctcctattattaccaaccaaggggaaaatagataatgagcatgcggtaacaattccatattgacccgaatcaatccgtatgctcccatctttaatagaattccggctaaaagcatacatgtactgtaatgcgcttccccatgggtatctggtaaccacgtatgtaaaggtataatcggcaatttgacagcataagcaataaggaagccaaaatacagtagtatttccaatgttgtagggtatgattgattaatcaatctttctaaatctaatccgggttcattggaaccatataatcccatacccagaactccaaaaaaaaaaaaagaaaaaaaaaaaaagtactctgcgttgttaccactgct

SEQ ID NO: 3224 - DNA, 1988 bp, Zea mays
gggaccctcgaggccggccggggattcgccgctcaccacacccatctgccctcccggtttccctttcccccctcctcctcctcagcgtcatgatgtcctcgacgccgctgtcgcagccggccaccgccggcgacgacgacgatatggagtccctcccccttgccgccgcctccgactacgcctcagtcgcctccacctttgaccccctcttctcctccacctccgccaccgccaccgccacctcgccccgctcccctcccacgcgcgccgccgctttcaccctctccccgaccttttcctcctccttcgttgacccgccctcctacgccgacgccaccggcgccggcgccggcgccgtctcctcctccccgtgctccgcctcctcgccctcctccgcgtcgccgagatccgcgcgcgtggcggcctccgagtactccttcctcgccgtctccgacccggagactgaagcagagcctgccgccacctcgctcgtccccggatccgcgcccacctacgtctcctacctcgtcaccagcgtccgccggggggaccccgaccagcgccgccattcagtgcgccgccgcttccgcgacttcgtcacgcttgcagaccgcctcgccgacgccttccggggccatttcgtgccgccgcgcccggacaagaacaccgtcgagagccaggtcatgcagcgggacgagttcgtggctcagcgccgtgctgcgctcgagcggtatctctggcgactcgccgagcacccggccatcggccccagcgacgagctgcgcgtctttctgcaggccgagggcaagatgccactgcccggcaccactgatatggcatcgcggatgctggatggtgcggcaaggctgccgcggcagctcattgctggggaagacaccgtcaccgcaccacaggaagtcgtgcagcctgccaagggcggcagggacctgcttaggatattcaaggagctcaagcagtcgggggtaactgactgggctggtgtcaagccacccttggtagaggaggatagggagttcctggagaagaaagagaagctgcaggagtgggagcagcagctcaccagtgcgtcacaacaggcagaagcacttgtcaaggctcaacaagatatggctgaaacaatgggagcgcttgggttggcattcgttagactaacaaagtttgaaaccgaggaggcaatgtatgactctcagaggatgagagcagctgacagcaggcgtgtagccactgcagctgttaaagctagcagggcatgtcgagatttgaatgcgcaaactgttaaatatctggatacgctgcatgaacatttaagcataatgttgtctgtccgcactgcattttctgatcgggcaagtgcattattgactgtgcaaacacttatgtcggatttggcatcattagagtccaggatcgagaaactcgaggctgcatccttgaagatatttggtggtgataaagctaggactcgcaaagttgaagagctaagggaaacaattagggctactgaagatgctaagttctgtgctttaagagagtacgagagaattaaggaaaataacaggagcgaactccagcgactagacagcgaaaggaaagaagaattcatgaggatgctaaaaggatttgttgcaagtcaggcggcctacgcggacaaaatcgtggatggatgggagacggtagcggaggagacgagcggttatgttggtgtgcgtggatctgatagcatgacttcgtagcttcgtttggttggatgtcaagtgtttgtacaatgtaatctaggttatggatttgggaatagaagaaaggtgcgccaggttcgatttgtttgtataatcaaataaaggtactgccatggagccacgatttcacgtcctggatgtcaagtatacgttgttcttctgtggatatcacaaatacatcattgctccggttcgttccagagcaggattcggcggggatgttcatgtgtg

SEQ ID NO: 3225 - DNA, 1158 bp, Zea mays
  misc_feature (1)..(1): n is a, c, g, or t
ntactgtaatgcgcttccccatgggtatctggtaaccacgtatgtaaaggtataatcggcaatttgacagcataagcaataaggaagccaaaatacagtagtatttccaatgttgtagggtatgattgattaatcaatctttctaaatctaatccgggttcattggaaccatataatcccatacccagaactccaattaagaaaaaaatggaaccgcctgcagtatacaaaataaacttggtagctgaatacagacgcctctttcccccccacatggataaaagtaagtaaacaggaattaattctaactcccacatgataaaaaaaagtaaaaggtctcgtgaagaaaataatcctatttgaccgctatacattgctagcatcaggaaatagaataattgcgaattccgagtaaccggccaagccgctaaagtagctaaagtagtgataaatcctgtcaataaaatagatcctaatgaaagtccatcgattcccaatctccagtggaaatcgaaaacatctatccatttagaatcctcctttaattggattaaaggatcctccaattggaaatgataacagaatgcataagtcattagaaggaattctaataaacaaatagctatagtataccacctaacgattttatttcctttatgaggtaaaaagaaaattaatgaacctgcaaatatcggcaaaacaacaagtattgttaaccaaggaaaataactcatgataaagtaataaagacaagatacgttttgaccagaaaagcccatgctcgattatttcgagcacaggcttcttcggtaaagaggaatcagacgattcaagtggagttttttgtaacgtatcaataagatagagccatgctgcgggttgtttcaggccctaaataaacgcggacacttaaaaaatccgttggacaggcggattcgcatctcttacaacccacacaatcttcggttctcggcgcggaagcaatttgcttggctttacatccatcccaaggtatcatttctaatacatctgttgggcaagctcgtacacattgagtgcatcctatacatgtatcataaatttttacagaatgtgacattggatctctcccgcgtccttttcaacataaaaattttcgatctggtaaaaatgaaatta

SEQ ID NO: 3226 - DNA, 2570 bp, Zea mays
  misc_feature (1968)..(1968): n is a, c, g, or t
ggtggtaaagtagattagactgtggtcacgtcgtcctttgttgactttggcgccttcagtgaggcaggtggtcatatggactacatcagtttacgcgcgttctggggtcggagtggttgggcaaggcgggcatgtcccgaagcgttgcccgagaggccctcggcgagtcagaaatgtgtttcctgcccgaggttggcctcggacgagtcgtgattttaggttccgcgtgcccttggagcatgtttgcttgtgaccccttcttacccaagctctaggcactttagggttgtgatctgggtactgggtatccctaattatggtacccgaatcgaggtcaatacaaacatatacattgaagcaatgcatcttgaaaatccctaatgatgcagaatagatttatatagatggaatgcaatctgtagctcgctacataggcgacagaggtccttccatccccattcgagcggtggcgatccatttgtaaaaaaagaaaattttcatttatgtccctgacgctcgctcacccgacgacaggcacctgtaacctaataagcgtaatatttagaagtcgagatatcaaattgaaatttcaaatatttcaatatataagggctagtttggaaactacattttttcgatagattctcatttttcctagagaaaatgaaataattttcttgaaaattagaaatccataaaaaaatcaaagaaaaaaaggataaaagaatggaagggcaaccgtgagctagttggtcattcaaggccgaagaggcccagcaggcagcaaagctgaagggctaggtaacttttttccttttcaggctagtttggcaaccatatttgctgaaatttctttttttcttttttttcggtatctctttttcgtttttagagataaaccctacaaatttcattattcagacagcagcttcatataatataacagactgcaagatatatgagctccgaccactatgcaagattcttgcttttgtctacttcgatgcagaaacaactaaattagtgtgcaatgatacacagcatccgcagctgccacatggttctgcacgttccctggcgctaccgtccacacagcaccgtctatgaaaggaggcggaagagggcatgcccgccagcactcgtcagcccatatcagatcgactgctaagagagtcgtcccagactatcccgccgggtagctaaccttatcttcccatggagccagcgaagctcgcagctttccttgccgtcgctgccgtcgcctacgctgttgccgtcgcaccggctgccgcggaatactccggcggcgcgaccgccccagaaagctgccagacgcaaatcatgtacttcaccaactgcctggcccgtgatgagatccgcgggcagtgctgtagcgtggtcgagagccgcgagtgcctctgccagctgaagcgggaggtggcgctgccctgcagcctgcatcgccaccatcaacgcagatgctccaaggaagggtcgcctccacggtcggtgaagctggccgagctgcagcgcctcccatgcttcaagacactcaagtgctaggagccgttacgagttcgtatttttgttttgtgtacgtgtgcttttgtttgtttcacaattgttccttgttactgtttatttccattcagcttgctatggatgtaggtacctgtgcttgtccgttgagaattccttgcgtgctcttaaagaacgtttttgaaaaattagaagatttggttttaaaaaaaaaaaaaaaaaaaaaaaaaaaaaaaccccaaagccatacataaagcgaatagatctaaatatatgtgcattattatgccgattaagattaaaatttgatttaacagaaccatgtctaatcagattagacataaacagtacgaaaacattatgaggaagatggttgtatatttgtttcttcccgacgatggtgtagagcacatgacgtcgatattcaanattgtctcgttggtcacgacgatttaagacgccaatgcgatgagaaagcagacaccaaactcggtggaccattcacacgcatgtcgagcgctcgtgcccttcgcacagcgcggcaaggcgagcgagtacacatgttctttcttctatctctcctccaatacattaaaaaacatgaacaagattcaactatttaagttgggttcctgcacctcaaatataaacatggaactaatgttttcacactcttctaaattgtttccatgcacctcttcataaataggccttcgagattttttaggaattattttaaaaattaaatgggctcggtccaataattccaacaatccccaccggatcttaaagtctcaatcatgactttgcctcaacccatctatactactattaagatcgtaagggaggcgtgcacaccctgccgcgcccccgcctgcgcgtgcccgccataggcttcgtactatctgaggtgaacccatcgcccgaccctaacccggcgctcctcggcggcatgtccagtggcctctatggccgcgtccccgccaccctcgccctactccaccgcgccaacagcatcatcctcacaggca

SEQ ID NO: 3227 - DNA, 753 bp, Zea mays
cattgggtacctcgaggccgcccggccgcctcttctctccccagattcactcaccgtccgtccgtccagggagccatggcagcagcagcagcagcctgcatctgtctgcagctctctctcccaagcaaccattcttcctctgcatgtcctccagcatacaggaagcgtgtcgcgctagccccagggagaggaaaccgtcttctctgcactgcatctggcgcctcttcttcttcttctgtggtggtgaccaaggagcaggaggaaggatctcctgagcccgaaatctttagctacaaagacgaccccaacttcaggggctgcaagggctgcggcagggacgagcttcagaggggctgcaatggacaaggccggatccagggcggcatagccgccgtcccgggcttcggctggtggcccatcaaggcgtaccggccgtgccccggcttcgtcgcgtccggcggccgctaccggcgccagggccaaagcatggacgacgttgcatccggcagggggaaaaagaaaccctctcccgccaaaaaacaagcttaacccctctagctagtttatgttcatcaggtgaattcagaatctacccaagatgggagggaactgggggaagctcaagttattcaggaacagcagtttgtttggggtcgttggtccacaatgccaatgtatatgcactagttgggagtactttttgcagaaacaacaattgtatagaaaaaaaaaaaaaaaaaagcccctagggcc

SEQ ID NO: 3228 - DNA, 4940 bp, Zea mays
  misc_feature (49)..(49): n is a, c, g, or t
gcaccatatagcgacatcatccagcgcacgcattgaagtcaaggaagtngaggtcgtggggagggaggatgcgagagtggggctgagtggctgaccgagcggttgggctctccgtcgtgcgtgcggacggccgaggaagaagaccgctctcctgagggtcgcgtgacgccgcaccaaatgggccgtccgcacgacactcagcaaatgggccgcgcgggtccaagggatgatgggccgaggaagaaccgctctcctgctgtcttgcaaaaacttagtaccatactggctactaaaggagacatggagcggcttataagcgttggcgcggacttaacagtaagaactctgttggtggctgaattggttaggttcaactcttgcgcaggcatgataatttttgctggagacctgtgtgtacggctgtgggggcacgtagatggcagaaccggtcagaggcagaacggtcagaggcagactactattgcttacttaataagtagtatatatatatatatatatatgtgtgtgtgtgtgtgtatttttctgtatagtgtccattgttttccctttccttctcttttcttttctatttcattttcaaattctagatttcaaattaggttaatccccaatttcagtattaacatattattattattcttattactgtgatcattaagtgcacaaacaaataacctccaacatgatgcataggttatttatgtttcattagttaatttaatcactttaaatatgattattcatatattctaatgaatagagggcaatacatataaggagattaactcttccattttattgtccacaatttggatatgacattagtagaggtcaattcaatgctctagtaagcttgcaagaaaacctaagtgaagtttagtctctttttagtgtatctcttttcagtttttaagcaagtgaccatagggcaatggaaagatctgatacggcgttatatgtcttataggttgcaaatcctaatataataaaacataaccacgagggagattatgaatattccaagcaaatacatctcaggccagtaatctagctaaggatagatgaaatcgagtaaaacatcaagaagcaaacgagttctcaagtggcgagataaagctttgtataactgttgtctttttcatatatacatatgtagaaagggtatagccgaggagttttgaattcgaagagcaggcatactgataataactggataagtgagtagttttatttttacctcagtactgtttcatgcgcttttgccttctagcgagtgagttccccctaggtagggctatagattaaaagatatctgtcaatggtagaacaatagatttctttcttttaagagttctcttacttgttttgattttgtttattgtattctgaagttagttcatcaccttacttttcgtgttgggctccatctaggactgttgatttatacatggatcatattctagaatagaacgtgtatctactactttctcatccaagtaagccacagtgaaggaaggtggaatcatgtctaatatatataaatttatttataaaaatatgtcagtatagtgtttcggttagtgatgtctttttatgttactgattggatttaatttaagatataaaaatcaagacatatttttcacgtgtcactaattaacctaaaaacacgttactaaaagcatatttttttacgtagtggacgtatgagtgctgaatggtatcacattggcattgcagcggcgggcggggcgagtgtgggaatgcgagcagccacacaacagggttagcgtgcggctgcgcaacacagtggcggctagatacggaggtgcatatgggatacgtagtgtgcagcatagcaaggcccaggggcggacgcagaggagggcaaagtgggccatggcccttctaatttttatgaccttatataacttatgtttaattactattaaatatattaaaaaattgaaggtttgaattggctaaaatagccttgttctgtgccttctcgtcgaattggcctagttctctcgactcccgtccttctaatcggtctgaccctcacatctattcaccctgtcttattcttctcgacaccgtcatagcgagagacggacccaagaagggcaaagtgggctatgtccctcctcaatttttttataatcttttataactaatgtttacttactgtaaagtatataaaaactgaatgcttgagtaggctaaagttgccctgtgcacttctctcaactttcctcatctttggtctagtcctcgcatctattcattgggtccattttttttctgatgccaccggagccaatccaccctgatgcctcgtgcctgacatcgtcgcctccttcccgacgctcgacgctacctgacctcaccccctttctagcgtcctggccctcatccggagacgtcgtctgaccctgtctcttttttggcgccccgcacttcgaggagatcgacattcgacaatttacacacaacttttattcgattagaaagagcttagttgtgtatttacttcttttttcatatactttttcttctttaaacttgtatggtgtattgatacatatggaatttgaatttcatggaagtagtttttaccgtcttgcttgattttataatgtggttttttggtccccacgaatttcggtcctgcttccgccactggctcggccgcgagtccagagacgctaggcctttttattgtaacccaaatagataaatattgttttaatttttgtttctaggtatacatgcgcattacgcactatatatatttaatgttttcaaaaaaaatcttaggtatttatttgaatacccatgaatgacgtgagcccgtccttcgtggagagttccaactctccaatacattagaaaaatatcgaagagtttctaatcttgctttagtttaagcatttatatttatgcaattatattatttaagtatttacattattaaaactgccatgctagaccagaatcgaaacttaaaatgcaaaattttaagtgtaagatagaaaaaaacacttatagacacaagaagtgaagcggtttttaataggctttaatttgtgtaagaaattttagataaatttagttcattttcctaagcatcttgaccctttcacacgaaacatcgcaacttcagacaatgccgaaacttctgatggcaacctctcctgagatgtgggagccatgcaactacgacctttcaatgggttttggaagtttctacatctcaactttctaattcccatttggacgtatatattggagcatggaattaagaactggaatcaactttttagaactctatcatttggttgcacatggaattaagctttggaatcagaaaaccaatcccctaaaattggactataactaaaaactctctctcacaatactgagcatcacccatcagtattgtgtggaattggaccacacaattccaaactctaattcagtgacatccaaacaataaattggaattacgtctaatttcaatagcattgttgatttgatatttaccccaattaaatttcatgtcgtccattgtcgacatccaaatggagataagtgaatttgtaaccttctctaacaccttttttgtggtcaatattcatttgttgagttttgaaatactagatatttataaaaaaaataaaatatcaagaacagattgtcccacaaaggaacacatgaaaaatgagcgaaaaattaatatgtggtatgagaagctgcaggtggatggtatcattctggccagtcatcgatgcagcaggtactgcttgtacttactagccttccgagaagaggacgcacgtgaaggcaacaacgaatcagcccaatggagccgcagtgcaacgtcggtatgttcacgcgcgccgagctgctggaggccagcgtggagcttcgtcatcacgccctcggctgcgtcaagtccacggccctccggtgcgctgtcaagctcggcgtcgccaacgccatccagcgccgtggcggcagggcctccgtcgaggacctgctcaccgagctctctctggacgcgagcagactccgctgcctgcacagcgtcatgcgcgcgctcgccgcgttgggcgtcttcaaggaggggagcgacggcgagtacggcctcactgccatttcctcgctgctcgtggacgacgacagcagcgtccgaggtagcctccggccgatcacgctcttgtacctggagcctgcattcgtggcgccagtgctcaacctggcagattgggcccttgctggtgtcgatggtagcgacgacgacaacaactgcagtgctcgaggaacggcgttcaagatgacgcacggcgaggacgtctgggatgtcctcgcgcgcgacgcctttctgggcgacttcttcaacggcgcgctcgcgtcagagactcggttcctcatggacatagccatccgcggatccccccaggtgttcgagggaatagcatcgctagtggacgccggcggtggcaccggcgcagcagcccaagcggtggctgcagcattcccggacacccggtgcacggtgctggagcttccgcaggtggtagacgctgctccgattgatgggccggttcgctttgtcggaggtgacatgacgaagttcatccctcctgctgatgccgttcttctaaaggtgatatgcaatctttacttggtacttattacggaaaatcgaatgggatgagaataattacttgtgaaaatgattacaaattaattaaactctgccaatatgattttttggtaaaatctaaaacgtggcctgcataggtcagagaccgtcgaagcttcctctagctctatacgcattccaagtttaaagaacaaattaaatcccattagtcagatatgatagaaagattaagctgacgccagattca

SEQ ID NO: 3229 - DNA, 1374 bp, Zea mays
gcacgagaccattacctagaacatcctgccaaaaacagaagtactaacgccccgcccctgcctggggttttaaccctacccaaccgccgcccatggcgtccatctcggagcccgctgctagggagaagcccatcgtcgtccgggtcaagcgcaaaccttcgcaaaaccgcccggacgctttctggctagagattaatgagaggccggcaaagaaggcggcgattgatttctcccgcctttccatctccgaaccctcctcgtcctctgccagtgtcaaagcttcagaggaaccacgggttaagaaaattcttgtccagcacatcgagacagtacaccactctgaagctgtcgaagatgttttacaatctcttttgcttgttgactcaaattccaaggagacaaagagcaagacaaaggagtggaatgacagaatcaagcaagacaaaaaaccagagcaactacgatcagctgccagacagaggcatgaggatatgggaagaaatgctcggtttgcacaaatatggaagagtcgaaaaggagaaaaggctgatgctggtgactcattgagagaaatatgccatctttatgatgctgtccaagtagatcccgatgatgagaagcatccagcagaaccacggattacatcttttgaagagggtgctgttctatgcaactttcttccacttatacgggaatacttgccatcaactgccgaggaaattgaggcggatataatttcattggcgcaatcagaagattctgaagtttatgatatctatactgtcaaggaggtggatgacacaatggaggccacgtcagcagcttcatatccaaggttacaagtggatgatggagaagatgaatgctacgaagattgtccatatgacacagatgattcgaatgccgaagacaatcctctttttgattatcctgatgaatcttccgaggacgaggatgatggtaggaacgacgaggatccttttggagacaaagaaggttctgactcagattacgagaaggaagaagtagaggtggaagaggatgagtaacggtgaagggaagttgtgatgaaacgtgcggttgtagaatgtagatgcagggcagcaggggagctgactgatgaatgtttgtgttgctttatgctgtctaagaaacgggacttgtctcgacgctttgtgccagttagcatagcacatcgtgtgcagtatccggaggaagaattgggaaaaaacaatatttggaagcgtcagctagacacaggcgaatcgtaataattggtattttgccacttgaaaagttgcatccttctgtaattaccgtttgtgtagccttgtgtgttcttgctctcgtattatataggagtaatacatgtgg

SEQ ID NO: 3230 - DNA, 1650 bp, Zea mays
tgaatcgggctccttatttatcatcactagtcgcgagttattctaacccatagtagtatgagtgatgagtttgggacatctgagacatagggcgtaagcgcagtttgtgaagtaaaaaaagcgggatgggagaaactctccactgcccggttagtatgtggaagtggacgaaaaaattggtggaaagaatttttgcctcttcaatattaggtataggtttagcattttgcttacatctgctgtacttctctaggttagtccatgtacagagcgagctgtacttgatcaacttgttggttacctggaatctcgattggctggatatccaacaactttggatgaagatgaagctatggtaatgagctttgtgtgtgtgtttttaagttgtttcttggtcactctatggacatgctgaatggtatatcattgctttggtcattgccagttggcagatggcaatttggaaccaaagaaggaagttgctactaggcttgtaaggttggagaagaagatgctccatgcctgtctgcaggccacaaatgagtttataaacgacttgccagaccacacagtgtcaccttgccctgctccatatgcccctgaattgaaatgaggtaccactggcgatgatctacattttatcagtttatcaattataatgctgtagcatgtaatttccatttttctggcagattgcatgttttcttttcccagatggtcataccattaagaatgtcaaaatttgatcaatttgcatatctatatgaagaccatatatgctgcaaggtggatatactatttgaaagaatctgctgcttgtttcctttagagattacagatcttaattgcatgctagaaggtaaatgaggcagaccgaagttgtattaaattatatcatgccaaaaagcctgctacatataatacaaatttactgttcattgatccgaacgtgcttatggttacaacttgcgtgttccaggaaatcgcatttcttgctgttcgttcaagttaataaggatatgattggtctccagcgggatatggctatggtctccaaagggatgtggtcatgttgtagttagttgcgatgcacggaaggtatcacttttgttaacctagttggtgttgtattaacaacccccttttgctgataatcttgggcaggaatgccaatcaacaatcatgattcatgtacatgatggctgactgatcactttttttttcacgagatggtcagtagttattgttgtagttgtctttaggattacttacagaaaccgaatttgggcagaactggattcaatcggccatgctgctatgccagttttcattctagattgggcactactccttctgaggcattgtatggctacagctatttcgggttggaacttggaagcgaatacaaagtagcgtagagaagtttcttagcattgatttacccgatctgttagaggcttttgaggtgtctaaataggtatttgtaaaaaaattgtggagtcgtcttgtcgtaaagagacatctctagctcgtaactcaagtagtcaagtagtaacagatcacagatgtcttcacttctcttactaacacatcgtctgctatattgattcgatgctttatagacacattacttctaaaaaaaaaaaatat

SEQ ID NO: 3231 - DNA, 2496 bp, Zea mays
  misc_feature (107)..(107): n is a, c, g, or t
aggtcgtcacgctggagcgggtgctcggggacgaatcaatagctgagttgttgacaaacaacaagttatctgagttggcatgtttggcattatatctcatgtatgangaaaaagcaaggaaaggattcattttggtacccctacattaaggaacttgaccgacatcgaggaagggggcagctagctgttgaatcaccacttctatggactgaaagtgaactggactaccttagtggaagccccttgaaggatgaagttgttgctagagatgaggcaataaggagagagtataatgagcttgacacattgtggtttatggcaggttcactatttcagcaatatccttttgacatacctactgaggcttttccgtttgaaatattcaagcaggcttttgttgcagtacagtcttgtgttgttcatttgcagaaagttagtcttgctcgaaggttcgcactagttcccttggggccgccactattgacttacaggagcaactgcaaagcgatgttgacagctgatggtgattctgttcgattggtggtggatcggccatataaagctggagagccaataatcatctggtgtggaccccaaacaaactccaggcttgttctgaattatggttttgttgatgaagataatccctttgatcgtgtagcaattgaggcatctttaaatacagaagatcctcaataccaagaaaagagaatggttgctcagaggaatggaaaacttgctatccaaaattttaatgtctatgtaggtaaagagaaacaaactgttgcagaaatgctgccttatttgagactaggttacatatcaaatcctgatgaaatgcagtctatactctcttctgaaggagatacatgtccagttagtccatgtacagagcgagctgtacttgatcaacttgttggttacctggaatctcgattggctggatatccaacaactttggatgaagatgaagctatgttggcagatggcaatttggaaccaaagaaggaagttgctactaggcttgtaaggttggagaagaagatgctccatgcctgtctgcaggccacaaatgagtttataaacgacttgccagaccacacagtgtcaccttgccctgctccatatgcccctgaattgaaatgaggtaccactggcgatgatctacattttatcagtttatcaattataatgctgtagcatgtaatttccatttttctggcagattgcatgttttcttttcccagatggtcataccattaagagtgtcaaattttgatcaatttgcatatctatatgaagaccatatatgctgcaaggtggatatactatttgaaagaatctgctgcttgtttcctttagagattacagatcttaattgcatgctagaaggtaaatgaggcagaccgaagttgtattaaattatatcatgccaaaaagcctgctacatataatacaaatttactgttcattgatccgaacgtgcttatggttacaccttgcgtgttccaggaaatcgcatttcttgctgttcgttcaagttaataaggatatgattggtctccagcgggatatggctatggtctccaaagggatgtggtcatgttgtagttagttgcgatgcacggaaggtatcacttttgtcaacctagttggtgttgtattaacaacccccttttgctgataatcttgggcaggaatgccaatcaacaatcatgattcatgtacatgatggctgactgataactttttttttcacgagatggtcagtagttattgttgtagttgtctttaggattacttacagaaaccgaatttgggcagaactggattcaatcggccatgctgctatgccagttttcattctagattgggcactactccttctgaggcattgtatggctacagctatttcgggttggaagcgagtacaaagtagcgtagagaagtttcttagcattgatttacccgatccgttagaggcttttaaggtgtctaaatagttatttgtaaaaaatcgtggagtcgtctcttcgtaaagagacatctctaactcgtaacaagtggtcaagtagtaacagatgtcttcactttctttactaatacgtcgtctgctatattgatctgatgctttatagatacatttacttctatatttattagtagactacatttatagacactattatataataaagttttttagttgtcttttatatttgaagaactgttttagtatctctccattgcatatgtccttgagagtgactccagcgagaacaaagagttcctgccccaattggcttaaatatattatctttgttcgagatgatattgggcaactgatgcaattggtatgtatatcaaagaaaaagaccctggtcaatttagctaaagtgaaattgttatttagggggtaagaatggttgtatttggaggggttgttcgaaaaccactacaacatagttgatgcgttcgggctgcaggtcgactcga

SEQ ID NO: 3232 - DNA, 904 bp, Zea mays
aatgcagtctatactctcttctgaaggagatacatgtccagcgtaggccccccccccagtccatgtacagagcgagctgtacttgatcaacttgttggttacctggaatctcgattggctggatatccaacaactttggatgaagatgaagctatgttggcagatggcaatttggaaccaaagaaggaagttgctactaggcttgtaaggttggagaagaagatgctccatgcctgtctgcaggccacaaatgagtttataaacgacttgccagaccacacagtgtcaccttgccctgctccatatgcccctgaattgaaatgagattgcatgttttcttttcccagatggtcataccattaagaatgtcaaaatttgatcaatttgcatatctatatgaagaccatatatgctgcaaggtggatatactatttgaaagaatctgctgcttgtttcctttagagattacagatcttaattgcatgctagaaggaaatcgcatttcttgctgttcgttcaagttaataaggatatgattggtctccagcgggatatggctatggtctcgaaagggatgtggtcatgttgtagttagttgcgatgcacagaaggtatcacttttgttaatctagttggtgttgtattaacaacctccttttgctgataatcttgggcaggaatgccaatcaacaatcatgattcatgtacatgattgctgactgatcactttttttttcacgagatggtcagtagttattgttgtagttgtctttaggattacttacagaaaccgaatttgggcagaactggattcaatcggccatgctgctatgccagttttcattctagattgggcactaaaaaaaaaaaaaaaaaaaaaactcaagggggggcccggtaccca

SEQ ID NO: 3233 - DNA, 1454 bp, Zea mays
tcaagtgcatgtacaaagtaatccgagtactggatgcatacattaggggaggtcattctatatctgtgtccttaaagactaccatttcttttagtgaattgtgtagtctttgaagagaatgagtttctctggatcgtttaaagaggataagtttctatttgaaatgtcaagcctatcaaaagctaagatggaaattcatgattataatggagaccatgtggcgtagaacaaaggtgtgtcactccatgaactattgtattacattttttgtatctaggctcttacatgctagtgtgtgcatgtatatgcaatatcttaagtctcaccataaggttgcactagtggtgatgattatagaatctctagatatttgattaatacctcttgtggtgatgtcataagtttgtcttaagtcatcttagtgaggtatgagtcaaacatgctaacttctcaagaatcttggcttaaaatattgtatatcacgtctattagtatacctttttattatgagtaattccttcaattggtgcaatttcacattttcatactttatctgtaccaaggttcaaattgtagaacttaatcccctgacctcacaagttcaagtgcataagctaaacaagtattcaacacttgtatgcacacatttagggggagaatggtctataatttgaatctttgagactaacttcatttccaagtctattatgtgtgtagtctcaaattagaaaggaatcttcgggcaaagacaatcgcttccactgcaaattttgatgggtatcaaaaattctttgctccaataaatgtatcttttatacatttcataagataatgagtttctcttgtatatgctactccaacatcatctaaaattggtaaacatgtatcacatccttttggattgcaaatgtctaaagtagcatagcttataaattctcctgtctagaacttaattgattaaatagtgcacatgtttcttatgttgcatgattatgttcaattgatactcctttaatgccaatggtattttaagttgcaaataagtactctcaacagatatcaattgaattcatatatatgtgtgcactaaaacttgaggagaacttagtgtaatatgctattagtgatctgcttatctatcaaattgtatcaattgatatttttcatacatgatcactagttgcataatccatacttgtgcaattttcatgttgcctcttgttgtgataagaaaatgctaggtgacatctagactctaggtatcaagtttcaccttcgatttagtatgacaatcttcatttaatatcttggacctatgtcacaactataccaacaagagcttgcaaatgaattgtaaatccaacacaagtttggaactccccttgaaaaggtaaaatgcaaaggtacatcacttcatgtcacttctccattacctttgtgccatctaaggaccc

SEQ ID NO: 3234 - DNA, 2559 bp, Zea mays
  misc_feature (1694)..(1694): n is a, c, g, or t
gggcacgccgtgagctttcaagatggattcaaaatctacaaaaaatgactgtaaatcaagatcacttggttggatgaaatcacaaagagaaaagagatcacagtgaatcaagaagggagttacatttttttttgtcaaccaaataatgaagatgtagtgacatatttatatgatatccttcattatgaggttgaggttcatattagcatgctttaccctctaagatttcaattgatatacttttagttcttaaacttttaattggtttaattttcatcttctatgtaaagcatgttatgttaaaccaagatatagtgcaaacatctcctttaacctcgtattgttaatgtgcataagtgtactttgtgtactcttgcatgcacaaattgaggaagagtttagcctatatcttgtgaggctaatgatttcttcaagttcatgttttgtagtctcacaccttggagaacatcaaatgaggatgagtggttccaaggaaatgatcaaatatttaccacatgtcaccccatggattagttctattggggaacgatatgtgttctctagcataaattcaattgtttcaaatatattatgccttgaccaagatatatgatgaactcctctaagaatcttaattgaatcaagtgcatgttacaagtaattcaagtacttgatgcatacatttagggggagctcattctatatcttgtgtccttaaagactaacattttcttttagtgaatttgtgtagttctttgaagagaatgagtttctcttgatcgtttaaagaggataagtttctctttgaaatgtcaagcctatcaaaagctaagatagaaattcatgattataatgaagaccatatggcatggaacaaaggtgtgtcactccatgaaactattgtattacatttgtgtatctggggctcttacaagttagtgtatgcatgtatatgcaatatcttaagtcacatcataaggttgcacttgaatcttggcttaaaatattgcatatcatgtctattagtataccgtttgattatgagtaattccttaaattggtgcaatttcatattttcatactttatttgtaccaaggttcaaattgtagaacttaatcccctgacctcacaattccaagtgcataaggtaaacaagtattcatcacttgtatgcacacatttagggggagaatggtctataatttgaatctttgagactaacttcattttcaagtctattatgtgtgtagtctcaaattagaaaggaatcttcaagcaaagacaatcgcttccactgcaaattttgatgggtatcaaagattctttgctccaataaatgtatcttctatacatttcataagagaatgagtttctcttatatatgctactccaacgtcatctaaaattggtaaatatgtatcacatccttttggattgcaaatatctgaagtagcatagcttataaattctcctgtctagcacttaattgattaaatagtgtgcatgttccctatgttacatgattatgttcaattgatactccttgtatgccaatggtactttaagttgcaaataagtactctcaacaggtatcaattgaattcatatatatgtgtgcactaaaacttgaggagaacttagtgtaatatgcaattagtgatctgattatctctcaaattgtatcaattggtgntttttaattgatattttttgaacatgatcactagttgtataatccatacttgtgcaattttcatgttgtctcttgttatgataagaaaatgctagatgacatctagactccaggtatcaagatttatctttcaattagtatgacaatattcagctgatatcttggacctatgtcacaattatgccaacaagagattgcaaaatgaactttaaatacaacacaagtgtggaacacccctttgaaaaggtaaaacgcaaaggtacatcacttatggcacttctccattacctttgtgccatataaggacccttttcatgatagtgaaagttgcctagagggggggtgaataggcaagttaaaactttttcaacaaaaactataagcaaactaggtaaaactgaattgatctcgaaattcacccagataactttggaaatgagatgttctaaatgatccacagggttcaaagtagtagatctgagaagggcacttctcaaaatccacacaccaaaaagatataaacaaatcttccacgcaatggtgagagaacgaagaacacaaacaaacacaatgagcaagaacacaagggacacaagatttatcccgaggttcggtcacaccaccaaggtgccctacttcctcgttgaggcgcccacaaagagccgggtctctttcaaccctaatcctccctttgccgaccacaaaggtcaagcccacacaataatctttgctcaaacgagcgggtaatacaaactttcttgtggtcttccacaagatttggagactcacaagagacacctagtcgtctaggagctagaagctccaagagtaatgaatccacaaagaactcgatgtagtaccaaag

SEQ ID NO: 3235 - DNA, 2708 bp, Zea mays
ctgcacacaaatttttgcatattatgtatgtgaaaccaacaagaatttttttgcatactatgtatgtgagatcaactagaaaattgttgtacattttttcctgggcctctttagatccttttgttttaaagaaattaaaatctattttatagattctgctattttgtttaaaaaattgcatcttacgatttttcaaaaatcaaatataaatattaatctatcttaaatttgacaacaactgttgtgtaatcaagatttttctataatcgttgtgcaatcgaactactaaaaacataaaaatcgatgtacttcattatttattgtatcaatatataaaattttaaattctaattcacttatgttaaagataaaatggagataattttatcaatagaacttttttacatatcttaatatatggtgatttaaaacttaaaatttgatatatttatgtactaaataataaaatatatttacagttttctaagattttttaataaattttaaccgtataaaggtatgtaaatcttaattgcataatatttttgtttttagaattttagaacaataagatacaaataattacatagattcttatatttacctacaatttatcctataaaaaataaatatattatctatttacctatcgtaataagtaatatcttcgttgtcgaatatttatcgttgtatcgtttatttttaactaaattgagaccaataaaaaaagagtacaattaaagaaatataaaatatatattaatatcagatagatgccgattaatatagattattttccgattcctcccgatttttggaaagcgaaggaaaactttcgattgtatttgtgcattgggtaccgcccggccggcgcttctccgatcctatcacatcgcgcactaccttccagcgaatccatcacggaagaaattgttccccacccaccctagactcgccgccgtcgcaactcccacccgatccccaaattctccggcggtgatggccagcctgtggcgcgccgtgatggatagcgtcagcggctcctccccctcggcgctggacgcggccccaggtagcggcgtcgagttctggcacggcgcagagcgcgctgggtggctaaataagcagggcgagtacatcaagacgtggaggcggcggtggttcgtgctgaagcaggggaggcttttctggttcaaggaccctgcggtgacacgggcctcggtgccccgcggcgtcatccccgtcgccacctgcctcacagtcaagggcgccgaggacgtgctcaaccgccagttcgccttcgagctctccacgcctgccgagaccatgtatttcattgcggactccgagaaggacaaggaggagtggattaactccatcggtcgctccatcgtccagcactcccgctccgtcaccgacgcagaggtcgttgactacgacagccgcccccagcccccgccgcagcttatgaccagcgaagagagtgcaccagcagcttaatggcgtggtgattcctgtgaactctctcgatatggatctgacttgtagcatatgtatttccaattccatgtgattgtggccttgtgccgacgttcctcactcttgattatgtagcagtatattaactatcaacgacatggtctggtatggtaataagcgagttaataagctgtgctttcgtttatagtttgttttatatgtatatactatactacgatttgatcttggtataccctaatttacaaggtggttgaagtctggctagtttttattttttttaacagttttgaagttttggccccaatttcagaaattgtaagagattttaatcattcagtatcccattcctctcgccttttgttgtgtttgacttgttctattctaatggaattgtattgagtcgcataggattgcttaactgactccgcatttttgcagaagattccccagttttggctagtttggcaacaacattttctcaagggattaccattttcccaaatgaaaacgaactaatttctcttgggaaaatgaaaatccattggaaaaatgaggttgtcaaactagcatttagatcctagctctgactctagcgctcttatgaagtttctgtcctagaagtagaaacacaaacactgatgaagtgctgaatgtgctataatatgcttattaaccatgaagtaaaactgttaaagaaccatgtatcatgatgtcttatgttgtaatctgaagtggaagttttctgtagtgaattggtgtatgcagtactcctcgagtgccaacatgcgctgtgtttatttgtgcagttatggaaattttatgtcattaggctatctctagcagcttactcatccccgtctcttattttaaactccactctataaacagtgctttgcacagccatatgcacgatcttctggctatagccttagaaactacagtaaaaggatggatccttcctctatcctttgtgaattatgtttaaaagtcaactggtgctaatattgcacagtatcttatatgttatccttctattcatcagtggcctgtgatcatgtttatttgtttcctgccttgtaggttgatgacgctgcttggtaataagtctggttttcttatgcatttctgttagctcgttctttcatatctgtgttggccttgcaatagcataatttactaactgttttgttatattacactccaaaggc

SEQ ID NO: 3236 - DNA, 910 bp, Zea mays
tagctggcacaaagaagcggggtatgatataatcagtgaaaagaaaatgctgacaccagttgaggtcctctgtaaatcgcatccatcagagttcagtgcctgcttccttggccccccccccccccgatttgaagataaaccagattactcctatttgaagagactcttccgtgacttatttctccgcaaggggtaccaactagattatgtatttgactggaccattatgaagtatcctcagtttagagataaaaacaaatttcagtctagcggcaagactagtgggttggcaggcccttctgcagaaaggaccaatagaactgcagctgaagctttgtttagaagaactagatccggttccggtcacaatcgagaacacaccaagcacagaagtcttctagagtcactgatgccatccaagactgttgattcggataaaataaggccatcgtcatcatcgcgcaatggaagcacgtcaagaagagctgtgctttcatcaagcaaaccaagctcttctggagatccaagcgacccaaaccgcgtgggcggcttggccccgagtagcagcatacgcccattgagtgcccaaagggcacatcattcaggtggaacagagatcaaatcattatcttggtcaaaaatgggaaggtcttcacatgatgacgctatcaggaacttcgagttgctctcactttgtgctgacaagagaaaaataaggaactaacgaaatgggctaggatctggactctggatgatgacgattgattgctgggggtattatgagcaggcagctccagtatttctatgttggaaaatgttcttttaaaaataaaaaatgatttaacttatgagattgttcaaaaacaaaaaaaaaaaaaaaaaaaaaaaaaaaactagttctagatcgcga

SEQ ID NO: 3237 - DNA, 1418 bp, Zea mays
caagttcaagctcgggaagaagatcgggagtggatcatttggggaactttacctcgccgtgaacgtgcagaatggcgaggaggtggctgtcaaactggaatcagtcacatcacgacatccacagcttcactatgaatcaaaactatacatgcttttgcagggtggaactgggattccacatcttaagtggttcggggtggaggggctgtatcaatgtcatggtgattgatctgcttggtccaagtctggaggacttatttaactactgcagcagaaagttctcccttaaaacagtactaatgcttgctgatcagatgatcagtagagtagaatacatgcacacaagggggtttctacatcgtgacatcaagcctgataattttctcatgggtttaggacgtaaagcaaaccaggtatttgtcatcgactatggccttgcgaagaagtatcgagatctccaaactcataagcacataccatacagggaaaacaaaaatctcacaggaacagcacgatatgccagtgtaaatacccaccttggagttgagcaaagcagaagagatgatctggaatctcttggttatgtgctcatgtatttcttaagaggaagtctcccttggcaaggcctgaaagctggcacaaagaagcagaagtatgataggatcagtgaaaagaaaatgctgacgccagttgaggtcctctgtaaatcatatccatcagagtttacggcatactttcattactgtagatcactacgattcgaagataaaccagattactcctatttgaagagactcttccgtgacttatttatccgcgaggggtacctccgccgcgacctctttgactggaccattatgaaatatcctcagtttagagataaaagcaaaattcagtctagcggcaagatgagtgggttggcaggcccttctgcagaaaggactgatagaactgcagctgaagctttgtttagaaggactggatctggttctggtcacaatcgagagcacaccaagcacagaagtcttctggagtcactgatgccatccaaggctgttgattcggataaagcaaggccacaatcatcgtcgcgcaacgggagcacatcaagaagagctgtcatttcatcaagcaaaccaagctcttctggggatctaagcgacccgaaccgcttggggggccgcctggcccctagtagcagcagccgcccaccgactgcccaaagggagatcagaaaaaaaaaaatgtcaaaaatcggaaggtcttcacatgacgacgctatcaggaacctcgagctgctctcacttggtgctgacaagagaaaataagggaaccgacgaaatgggctagggtctggactctggatgatgacgatgcagggctcagcaggcagctccattatctgtatgttgaaaata

SEQ ID NO: 3238 - DNA, 1498 bp, Zea mays
cggacgcgtgggcggtcgcgtgggcggtcgcgtgggcggacgcgtgggtgggattccacatcttaagtggttcggggtggaggggcagtacaatgtcatggtgattgatctgcttggtccaagtctggaggacttatttaactactgcagcagaaagttctcccttaaaacagtactaatgcttgctgatcagatgatcagtagagtagaatacatgcacacaaggggggttctacatcgcgacatcaagcctgataattttctcatgggtttaggacgtaaagcaaaccaggtatttgtcatcgactatggccttgcgaagaagtatcgagatctccaaactcataagcacataccatacagggaaaacaaaaatctcacaggaacagcacgatatgccagtgtaaatacccatcttggagttgagcaaagcagaagagatgatctggaatctcttggttatgtgctcatggggttcctcggggccggccgcccttggcatggcctgaaagctggcacaaagaagcagaagtatgataggatcagtgaaaagaaaatgctgacgccagttgaggtcctctgtaaatcatatccatcagagtttactgcatactttcattactgtagatcactacgattcgaagataaaccagattactcctatttgaagagactcttccgtgacttatttatccgcgaggggtaccaactagattatgtatttgactggaccattatgaaatatcctcagtttagagataaaagcaaaattcagtctagcggcaagattagtgggttggcaggcccttctgcagaaaggactgatagaactgcagctgaagctttgtttagaaggactggatctggttctggtcacaatcgagagcacaccaagcacagaagtcttctggagtcactgatgccatccaaggctgttgattcggataaagcaaggccacaatcatcgtcgcgcaacgggagcacatcaagaagagctgtcatttcatcaagcaaaccaagctcttctggggatctaagcgacccgaaccgcttggggggccgcctggcccctagtagcagcagccgcccaccgactgcccaaagggagatcagatcctcgtctttgtcaaaaatcggaaggtcttcacatgacgacgctatcaggaacctcgagctgctctcacttggtgctgacaagagaaaataagggaaccgacgaaatgggctagggtctggactctggatgatgacgatgcagggctgagcaggcagctccattatctgtatgttgaaaatattcttttcggaataaaagagattataatataacttatgggattgtttcccggagctgtgctgctcaaatccaataacccgcaagagttacgtagcaaagctaaattatgctgtcctagtagatcactgtatatctgaggacagccggtgagacaacgaaggggagttgatagcaaaaaaaaaaaaaagtcgacgcggccgc

SEQ ID NO: 3239 - DNA, 1199 bp, Zea mays
  misc_feature (901)..(901): n is a, c, g, or t
gccgggacctccccttcgtctctccccgtcccccgccccggacgagtccccacgactttggcggcgaaactccaccgccgtcgcctccgatggcgatgctctgcaggaccacgcgcgtcctccgcaaggtgtgcgaactgggacccgcggcggcggcgcgacggctctccgccgctgaagccttcgccgcgtgtgagggctcactcctgcgccctctacccgggctggacctcccgccgtgcctccctgacaacctgagccgcagccccacccggatcaccacgctccctaacggcctcagagtcgccaccgaggacgtcccgggtccttctgcgtgcatcggtttcttcgtcgactccggctccatctacgagtccggggagaccaccggcgtatcgcacctgctggagaggatggccttcaaggacaccaagcaccggagccacctcaacatagtgagcgagctcgagcttgccgggggcaacgtcggcgcttcagcctccagggagcagatggtctacagctatgacacgctcaagggatacatgccagaggctctcgagatcctcatcgactgcatgcgcaacccgctcttcctccaggaagaagtcgaacggcagctggttcttgctcgagaagaagtaaaggagctacaaaagaaccctgagaagtttcttcatgaacagcttaaccttgttggatattcgggtgctcttgcaaatccgctaatagctcctgaggatgcccttgctagaatcaatgacaaaattattcaaaagttctatcatgaaaattttactgctgatcgcgtggttctagcagcatcaggtgttgatcacgaacacttgctaggctatgcagatttgttgttgaaagattggcacaaggggaccccaatggnaaaagccaaagtctacatatgttggtgggagattccagacacagagcagattcagatatgacacatgttgcattagcttttgaagtgccagggggctggcttcaagagagagacgctacaattatgactgtcatacagactttaatgggtgggtggtggttcattctcatctggcggtcctggaaaaggaatgcattcacggctttatcgacgtgtcctaaataaatatcacttggttgattctttttctgcatttaacaatgtatatgacagcagtggcctctttggtatctacttg

SEQ ID NO: 3240 - DNA, 1635 bp, Zea mays
attgattctgaagcttatttacggagctcgtctccggccgggtccttctgcgtgcatcggtttcttcgtcgactccggctccatctacgagtccggggagaccaccggcgtatcgcacctgctggagaggatggccttcaaggacaccaagcaccggagccacctcaacatagtgagcgagctcgagcttgccgggggcaacgtcggcgcttcagcctccagggagcagatggtctacagctatgacacgctcaagggatacatgccagaggctctcgagatcctcatcgactgcatgcgcaacccgctcttcctccaggaagaagtcgaacggcagaagtaaatgagctacaaaagaaccctgagaagtttcttcatgaacagcttaaccttgttggatattcgggtgctcttgcaaatccgctaatagctcctgaggatgcccttgctagaatcaatgacaaaattattcaaaagttctatcatgaaaattttactgctgatcgcgtggttctagcagcatcaggtgttgatcacgaacacttgctaggctatgcagatttgttgttgaaagattggcacaaggggaccccaatggaaaagccaaagtctacatatgttggtggagattccagacacagagcagattcagatatgacacatgttgcattagcttttgaagtgccagggggctggcttcaagagagagacgctacaattatgactgtcatacagactttaatgggtggtggtggttcattctcatctggcggtcctggaaaaggaatgcattcacggctttatcgacgtgtcctaaataaatatcacttggttgattctttttctgcatttaacaatgtatatgacagcagtggcctctttggtatctacttgaccacgccatcagattttgtggcaaaggctgtcgacatcgcagtaagtgaattaattgctgtcgcaactcctggagaagtgacagaggttgaactgcaacgagcaaaaaattcaacgatttcatctgtattaatgaatcttgaatctagggtagttgttgccgaagatattggaaggcagctgttatcttatggttgcaggaagcctattgactacttccttcaatgtatggaagaaattactctagatgatgttgcaacatttgccaggaagatgctagctacgcaacccacaatggctagctggggaaatgttgacaaagttcccccatatgaatttatttgcaagcggctacaatagtacccctacacaatgacctctggactctggtggtcttgaaggatcctttcgtggaaaactaaacaatcacttgtatgaagtgccctagcttagaaactgcttttctttcagacatgcagtttagtgagtttaggatttcaacagctatgttcaattgtaactgttcaagcaacacatagtaaatgagaggctgatgaatggcaaatatcaacagtttctccatggcccattagcattttattgtcatgttcagtgtttttatgtacattttctgcgattatggatagcaggagtattctgttgcccttaatttcatgtataattggcttctggcgccctgaatcattgatgcattaaaagaaaaaaaaaaaaaaaaaaaag

SEQ ID NO: 3241 - DNA, 1284 bp, Zea mays
ggagaggggaagggctagagagagaaacaaaggtggccgtcggtgccagccggccgcgcggcatccctcgtcaacttctcctaccaacttctttttcctcccccaccccttccttaccgtctcgcgcccgctccgcagcctcgcaccacccgccgccgccggccgaccggccggcaccgccggtggcatttgaagtatggttagcttgaggcgacgccgactattgggtctttgttctgggaaagactcattgccagttgatcttcctaagccgattgaaaatgaaaaaactgtggaagttgcacactccaatgtgaagccattcagtgtgcatccactacccttggcaaagacttctgatgtgctcataaaatcctcaaatggttctgatgattcaaaggaagagaaaacccagtactatccaggcaaggaaatcaagtgcagaaaacggcatagaagaaagcagtatgtggatcaagagccatgcattatgaggggggtttatttcaaaaatatgaaatggcaggctgccataaaagttgacaagaaacagattcacttgggtactgttgggacacaggacgaagcagcccggctttatgatagggctgcttttatgtgtggaagggagccaaacttcgtgctttctgaggaagagaagcaggagctacggaggtacacctgggaggacttcttagcagtgactcgcaacacgataaccagcaaaaaacaaaggaaagtcggatcactaaggcgtagcaaggcagacctgttcatgggacagagtgacggcgacaccgagatggccaatggtggcggttcatcgaattccgacaatggcgacgcggggacgtcggcgtcatagatcgctcccaggggttctgccgttgtggcaactcaaagtggagtcctccagcacattcatcccggtcatgcatgatacgagctccgtctaggattttgttctctcaataattaatttccatgtgcataaggccccgttggtctaatcaaatcaaaggttagggaaaccatgccatctcagacgagaattagaggtggtccattgttagaaaacagttcatctgaatagtaatgtataccggttctgaaaactgtgtatatctaccgataggttcaccttacattttgcccagtgtaattagtttaccttataatttaccaaaaaggaataatttttccctttccgttaataccatctctatactagtgggaagaaaaaaaaaaaaaaaaaagcggccaaaaaaaaaaaaaaaagcggcc

SEQ ID NO: 3242 - DNA, 1160 bp, Zea mays
gagcgagcaggtgtgggcgtggcgtgggggaggcgccgaggcggtcgggcccgccgttgggcgtcggcgctcctcctcggccggccggggcatcgcacgagaggagaaggagaggggaagggctagagagagaaacaaaggtggtagtagatgtgagccaccctctttgtatccctcgtcaacttctcctaccaacttctttttcctcccccaccccttccttaccgtctcgcgcccgctccgcagcctcgcaccacccgccgccgccggccgaccggccggcaccgccggtggcatttgaagtatggttagcttgaggcgacgccgactattgggtctttgttctgggaaagactcattgccagttgatcttcctaagccgattgaaaatgaaaaaactgtggaagttgcacactccaatgtgaagccattcagtgtgcatccactacccttggcaaagacttctgatgtgctcataaaatcctcaaatggttctgatgattcaaaggaagagaaaacccagtactatccaggcaaggaaatcaagtgcagaaaacggcatagaagaaagcagtatgtggatcaagagccatgcattatgaggggggtttatttcaaaaatatgaaatggcaggctgccataaaagttgacaagaaacagattcacttgggtactgttgggacacaggacgaagcagcccggctttatgatagggctgcttttatgtgtggaagggagccaaacttcgtgctttctgaggaagagaagcaggagctacggaggtacacctggggaggacttcttagcagtgactcgcaacacgataaccagcaaaaaacaaaggaaagtcggatcactaaggcgtagcaaggcatacctgtttatgggacagagtgacggcaacacctagatggacaatggtggctgttcatagaattgcgacaatggcgacgcggcgacgtcagcgtgatagatcgataccagaggttctgccgttgagacaactcacagtggagtgctgcaacacattcattccgggcatgcatgatacaagactgcgctaagatatgtgtctctcaataattaatttccatgtgcataaggcccagctggtctaatcaaatcaaaggttagggaaaccatgccatcttagacgaga

SEQ ID NO: 3243 - DNA, 937 bp, Zea mays
gccggccggcccccgcggaccgaaccgaatagcgaaggcataagccatcagtttccaccgcacgtccgcaccccctctccggcgtgccgacggtatccatggcggcggtggtgcgcggcgtcttgaggggcatcaaggagaagggactcaccaacttcatccgcgacgtccgcgacgaaggatacttcaaatgccttctggacgggaaccttttgcaaacgaaaatccacaatattggcgcaacacttgtaggagttgacaagtttggtaacaaatattatgagaaactacatgacactcagtatggaaggcataggtgggtagaatatgcagagaaaggtcgttacaatgcatcccaagtgcctgctgaatggcatggatggctgcaccacatcacagatagcaccggggataagctgctgaaccagaagactgctaggtaccttgtagagcacaagcagaactactccggtgagggtgaagagcttatctaccactccaaggggcatgctttgaatccgggacaaagggactggacgaggtatcagccctgggagccaaagaaagagcaagcctagctcgtgagtacattgtggggaagctgctgaatgttttgcgttttcttgcattgcgctgggtcaggtatcaccgagctgaatagcctctgggttattgcctggacgggacccaaataatgttgttctgaataccaatatattgtatatttgatcatcttttgacattgaaatgttgttgctgttgtaaaagcagctttgaggaatatctcatgcaggtgttactgacttcggttacgagacattgggtctatttgtttcagttttttttttgctgattctgaccgtcagaagttgttgtagaccaaacactaagcttttcagtcagcttttatatgaatccctttagtattaaaaaaaaa

SEQ ID NO: 3244 - DNA, 916 bp, Zea mays
attgggtacctcgccgccggccgattgggtacctcgaggccgggccggggagccgaacccgaccgaatagccaacaagccaaggcaggcagcagcgaccagtttgcaccgcaccccttttcgcccttcgttccggtcaggcgagttagtcgtcgtgccgccggtgccctgtatccatggcggcggcgttgcgtgccgtcttgagaggcatcaaggagaaggggctcaccaacttcatccgcgacgtccgcgacgaaggatacttcaaatgccttctggacgggaaccttttgcaaacgaaaattcacaatattggagcaacacttgtaggagttgacaagtttggaaacaaatactatgagaaactacatgacactcagtacggaaggcataggtgggtagaatatgcagagaaaggtcgctacaatgcatcccaagtgcctcctgaatggcatggatggctgcaccacatcacagatagcactggggataagctgctgaaccagaagactgctaggtaccttgtagagcacaagcagaactactccggtgagggtgaagagctgatctaccactccaaggggcatgctttgaatccgggacaaagggactggacgaggtatcagccctgggagccaaagaaagagcaagcctagctattgagtacattgtggggaagctactgaaatgtttgcatggcgttgggtcaggtatcaccgagctgaatggactctgagttatgtttgaactgggcccaaataatgttgtcctgaatatcaatatcatctttggacatgaagtgttgttgttactgctgtaaaaacagctttggggaaaatctcatgcatttgttactaccttcggttatatttgaaagtatacgagagattatacacaaaaaaaaaaaaaagcgggcc

SEQ ID NO: 3245 - DNA, 675 bp, Zea mays
ataagctctgctaggtcgtcgatcgcatgtgcatgtgtactttttaacttgttcgatcgatcatcatctccatccaccgcccgccgtagctagctagatctgctgccatggcttcctttggcgaggctcccggcggtgacgccggcagcggcgagaagatcttccgcaccaagtgcgcgcagtgccataccgtggagcgaggtggcgcgcacaggcagggacccaacctgcacggcctcttcggtcgtcagtcaggcaccaccctcggctatgcctactccacggccaacaagaacatggccgtcgtctgggaggagggcaccctgtacgactacctcttcaaccccaagaagtacattccaggcacaaagatggtcttcccggggctcaagaagcctaaggagcgaaccgatctcatcgcctacctcaaggaatccacggcttaacttcttctagctatcttaattaattcaccatgcacgcacgcacatcaataaatcaaggtaggaatctacttttccatttcttttaccttttaagtacatccatctatatattacatcggtctctgtgagttgattccacttttgttgttctttgctacggtttttatatattatataaattgatattgagatatttatccaaatataattattgtttatttttcatcct

SEQ ID NO: 3246 - DNA, 1133 bp, Zea mays
  misc_feature (1012)..(1014): n is a, c, g, or t
  misc_feature (1017)..(1019): n is a, c, g, or t
  misc_feature (1034)..(1036): n is a, c, g, or t
gaggcatcataggggcctggttataaaaactatttgtaaacctttgttgtacatgcccagattggggaagactttacagtcgataactttactatatacccttcttgtcaaggctttgatgataagccaatggttaaaagggttgtcattgtaacccccacaagcttagttagcaactgggaatctgagataattaagtggttgaaaggcagagtgcaggtgctggccatctgtgaaagcacacgtgctgatgttctttccggaattgaaagtttcttaaaacccttgagccgtctccatgttttcttttgcttactaattatttgttaatatacactatactaaatgaaaatgtagctgcaagttaatgacaatttctgtggtgcatgaataatcttcaggtacttatcatatcttatgagactttccgcatgcattcttcatgcgcgcaccaagtgcgcgcagtgccataccgtggagcgaggtggcgcgcacaggcaggggcccaacctgcacggcctcttcggtcgtcagtcaggcaccaccctcggctaagcctactccacgaccaacaagaacatggtcatcgtctgggaggagggcaccctgtacgactacctcttcaaccccaagaagtacattctaggcacaaagatggtcttcccggggctcaagaagcccaaggagcgaaccgatctcatcgcctacttgacctatcgacgcaacaggggatactcacactgtcatccttagctctgtggcaataagtcgttcgtctgcaacacagccgacagaaaactgagcatgtgcttcagagaccaggcattattgaactttgctgccactaatttacattagatgaactgagttacagcagaatgaatttcctggatcctaaatgcagagaataaataattaaaaatatttaaagggaaaaaaaaaaaaaaaaaaaaaaaaaaaaaaaaaaaaaaaaaaaaaagaaaaccggaacaaaaaaaaaaaaaaaaaaaannnaannngggaaagggggggannnccccgggggcgcccccggggccccccccccccacccggggccccccaaagggggggggggtttataatatttccgggggggcggttttttaaaccgg

SEQ ID NO: 3247 - DNA, 6101 bp, Zea mays
  misc_feature (876)..(876): n is a, c, g, or t
  misc_feature (1449)..(1449): n is a, c, g, or t
  misc_feature (1963)..(1963): n is a, c, g, or t
  misc_feature (2568)..(2568): n is a, c, g, or t
  misc_feature (3896)..(3896): n is a, c, g, or t
ttttatgctatctttataaactatttacgttattttgcgtaaaaaacagaatcgcaatttatagcaggaggttagttgttggatcatgaatttgcctaatgcacgtgagttgacctagtacataagcgagggacgcacttcacagcctgatgtgggatgtagttaaacgtactggtgtgatttagtcaggtcgaaagtggtcgatcagtgtctcctcgaacatttggaaggcagagtatatataagtggttaaagtcaaagacgtccatactgaggacagattcagattcagagaggccggaccggacgcctcgctgtacgccgtagatacacgtccctaatcggctaatcccgtaatccgggcccgtgggtacagtggcggtggccgtagcggtacgtgccgcgctgcccaattctcgccggctgcatcattaaagtctgggggccccgtggcatggggacgggacgggttcacccacccctgccgctgtcggccgatgcattgcaccgcggaccgccctcgactcgcctcgccgcagggggtcacggtcacgccgcctccctccgctgccggcctgctcagcctccctccgccggtcctttcccacggtccacacgcgatcaaaagcgcaaaagccaaccccgacgaaacgacgagacggatacgagtgatagactgatagctaacgctacccacagcagcaactataccagccagcggaccccgacgccgcccccagcccccaagccaggctgcagcccctgcgacatagtgggggagcgggtcttcttgagcggcgtcgctctcacgtacggcgtcgggtactcgtcgcggcggcagggagctaggggcaggcatgcgctgatggaattcangggccaggaggaggaggagcagcccgtctcggaggagatgggcgccagctccgcgccgtcgtccgcccccacccccgccccggggaaccaggaccacgccgccgaggcgaggtaccacgagtgcctgcggaaccacgcggcggcgctgggcggccacgtcgtcgacggctgcggggagttcatgcccggggacggcgacagtctcaagtgcgccgcatgcggctgccaccgcagcttccaccgcaaggacgacgcgcgccgccgccaccaccaactcatgctcccggcgaccgcgacgtcctctcgcgtcccgctgctcctgcctccgccccacccgcactacgcgccgccgccgttcccgtaccacggcacgcccagcggcggcggcggcggcaccgccaccgagtcgtccagcgaggagcgcggcccgccgtccggggccgccgccgtgcaggcgcagggccacgtccggcggaagcggttccggaccaagttcacgccggagcagaaggagcagatgctggcgttcgcggagcgcctcggctggcggttgcagaagcaggacgacgcgcntggtgcagcacttctgcgaccaggtcggcgtgcgccgccaggtattcaaggtctggatgcacaacaacaagcacaccggcaggaggcagcagccgcacctgccgccaccgcaggggcagcaacagccccaacagcagccgaagtagccacggtgggagacaaggctcagcagtcagcagcaccatcacagccacgccaccatttgcttaatcccccgcctcatttttttatgggctccgagaggtgtgggattaaacaagggaagtgaaggagggctcctatcctctcttcccttccgtttttgggtttcaccttatccttcattttttgtagtcacttctttcaccattgtcttttgcctcaccattcttgtctgcacatctttgatttcttctgttcctagttcgggggatcaattggaaggaggaagaggcactgtgcatgcttcgtagctacattcctgctaccttgttgccatttgaccccccctcggacagcaagattaaccgaatcntaataagatctctctactttgctctgaaattcttccgtatcttcacttaatcactagagggtgtagctggtggtctctcctcccttctaatattgcaacatttccatttagttaagcttgaaacccagcataaactaatggccatataatggtatgataatcttgagttctcttctgccagttgctaattagagagtagcagccaacatctgtggctaggatattctagaggagaaaaggctggatggaatgcagtggagattggagaacaacgcttgcatgcacgccattagagagacgtactcggaggttgcatcaaatgctcgttgctttgtctttgcgcgtgcgtgtgtgtttgccattcaattggaggtgtacttgcctgctgcagggactctagactgagactgtacttggctgtagttgcatcccattactgccatgcatggaggagggagtgtcattttccagacctgattgattccattaatggaggcctggagctccatgtcagtctggtccgagacgggcggccggccggtcacgtactcacatggctgctgtcgcatgctttactcgcctctatcactctaccttccagaagntaaaggattttacaaggatttcgtttcatcaaatcgtgaggcccatgctgcaagagaggaggcccatgctgcaagagatgaggcggttgagaggcagataaggatgtaacggctgcgctccaagaaaattgcaatccatgaaagaggaagaaaaaaaaacggataatgagaaacgtggcatcacaggattttggttctctggtaccattcgctccagtttcgcgcacgagtccgcaaatctggtttctttttgtcctgttttattcgaaagctaatcgccaaatctggacagcagttttgccaaaccagttgaaaaggacatggagaacacatagtaccactaaacctcctacatccagatgtgatactggaatttttttttcttcgacaacataccctactgcggcggtactattagggaacaagttgtggcatagaaaagttactgctgtggggaaaagaaagtagagatatgtcttcttactgataataataggctgggcccctcgccctcggaaatttggataaagatgcatctgttatttactgtgttcttcaactattcagctcatttgttgggcttaacatcgatttgatgtgcagaagcaggtgatgatttctccctatcaaaggtcagtcagttttggtgtctggcaggcacggaactcagtgcccctggacttgtgcacagctgttgaactttagcccatcatggtgcttctgaatgatcgatcagtcccatcagtctctgttaagttttgtcttctcatctgcacttctgtcaggtcttaataataacccaggatgacgctgagagcgctgaaactgttgaaaggatcaggagctgtttgctgttcctccgtgcctacacacagtactgcgatgtttcagagctgtttggcgatcgctgcagtccctgtcccagcatttgtggcaaacggacgtacggccaaagagactgacaacgataattcagacctaatcaactattcagctgacacaatgacgcccaggaagtactgtttaactgtttgcctcgtttaggccctgtttgtgttaccgtgcagactacaagttgcagtactctgctacagtctgcaatgccaagtaagtgcactagtatttagtcgggatatagtaattatgtgtacctagattacacccttaaaacatatttaacccatagaccaccgtcgaagtatgttccatgaagacgaaggatcatatataagtcatgtttcgccttaggctccctcaggggtcatcatagatgaaaatctgggactatccacagagttaactgagtgaaagctttgctctcgcgtggncattagcttgtgcaccttgaagctaccggtgacagtcattaatgctattgattgtatcataaaggactgtctctggcgcgcggtaatagtgaaaatgcacaccgaaactctatggacaaagtgtgctgccgcaggaatggatggtgcttgggtatcctcgatcaatttgaagattcagaacacaacggtacacttatccgaatcgcctagaccacgcacgttacgataggtaaacataggtttgggttattcaataggcgagggtgggcaccaagagcacaaaagacagtttgaagttcatggcacgtaggccaaagttcatagcaggccctggcacgccacgcatggtggccaaggacagcaaccacacagactaaacgcttagaccagagaaaaccagggagggggttatggttgtctctaacgcatgacaatcattctaggatagggggcaccatgccaatatctaaagcagccttgcatcacaggccgactgctttgaccagcttccggaggacggcaatataatggagatgggcttcttgttcttctcaagcagcttgtgttgttgcaccgttttctggacggcatgcatgggagcatggaagcagggcgtcccatagggccctccgggtggaggctttggctgtagcatgggagtagttgttgcaggattgagctaccaggcgagagctcctacaagtaggcaagtcgttttttttttttgcgcaggcgttttaaattttgggctggggtgggtcattgcatgtggttgtcgcagtcagcggggatgcgggagtggccgaagcattatgcaaccgacacacttgattctggaaataattagtagagaagcgtcctggtttggaaacttgcctcatctcaaactcttcatccgatttaaacgagtaactttctcggttctcacgccccaaaccgtagttcaattgttgtgatttgtgagcggaattcagataataatgctcaagcctaagatccaagatgtcctggcggcctcgttgtcacactatcctgcaaaagcaaccgtgcggtcatgctccagtgtacattttaactagattcataggtgtgaaacaagccaattggtacccctgagccctgagtaccattaataaaccagcaacagcaacgcggcaagccgatgaatccaacacatgaaccaccatcaggaggggaagaactcgaaatcgaatcatcatcagtcatattcccataataatcaacaaataaacccatagcaaccacgcctcatagtctcagacaatggatgatgcaatgacctagctagtgttcctagagaaatttaaaggcgggcatggataatgcgggatgcggaactcacctaccggttggacgaggagtaggatgcctgcccggcaacaaatcgatccccgctcttccttgcttcgatccgagacggtgtctccaagacaccaagcgctgccccgatcggatcaccgggcgggcctcggcgacgacgggcgtggctacgccgggggcggctgcggaggcgtcgccggcccacccggaccccctgtgggtccgccactgggcgtcgcgtgggcggatcggaggttggtgccgtcgtgcgaggccacggctccgcgagcacaacaatccggaaaacacacggacttcggagtgcggtggcttggcagcgagcgagatggaacatggaagcacggagagcgcgagggaaactgcgagaggcaggcggtccgggaaccactgcggtgcgtgttgctgccgacgatgggctctgttctggtgaatgacaccgacgtgttagagtcgtgggccttttgagccgcgctctgtttggcgcctgacttgctcaggctggtccctgcgcacctccggcccagataggcaatgctttgtgcggtttatttgtccggcggcagtactttcataatacttttttttctaaggtcttttgctctatcaattgttttttatgaatatcatatatgaggtattatttttatataatgtaccttatttaaaaaataaatcacatctaggatttaaatttttgctctattgggttgtctcggagtattttgttttcacagatttatcatccctgctgaataaacctctagctgcaaggttttttttttgagtggtttgttccttaaaaatatggaccaaactttgtctttttctcttatgtaaattacg

SEQ ID NO: 3248 - DNA, 3142 bp, Zea mays
caaaagcacgagaccattacctagaacatcctaatcgaaaaacccctaggaaacgacgaccgcaactacataccagccagccgacccgacccccagcagtcttgcaggctacagcccctgcggcaccagagggagcggccgcggcagggcgtcctcgtcgccgcggcagggcgctagggcaggcaggcatgcgctgatggaattcacggcccaggagggggaggagcccgtctcggaggagatgggcgcgagctccgcgccgccgccctgcctcggccccggccgcggcacggggaaccagaaccacgccgccgaggcgacgtaccacgagtgtctgcgcaaccacgcggcggcgctgggcggacacgtcgtcgatggctgcggcgagttcatgcccgaggacgccgacaggctcaagtgcgcagcctgcggctgccaccgcagcttccaccgcaagggcgacgcggggcgccgccaccagctcctgctgccgccgcccgccgcggcggtcccgcgcgtcccgctgctcctgcctccgccccacccctacgcggccggctgctgcccacccccactacgcgtcgccgccgctgttcccgtaccacggcacgcccagcggcaccacgaccgagtcgtccagcgaggagcgtggcccgccgtccgggttcgccgccgcgccgcacgcgcacgcgcagggccacgtccggcggaagcggatccggaccaagttcacgccggagcagaaggagcagatgctggcgttcgcggaacgcctcggctggcggatgcagaagcaggacgacgcgctggtgcagcacttctgcgaccaggtcggcgtccggcggcaggtcttcaaggtctggatgcacaacaacaagcacatcggcagcggcggcaggaggcagccgccgccgcacctgccgcctcccgaggggcagcaacagccccagcagccccagtagccacggtgggagacaaggctcagcagtcagcagcaccaccaccaccaccaccatttgcttaatcccccgcctcatttttttatgggctccgagagggggtgtgggattaaacaagggaagtcaggaggggttcctatcctttcttcccttccgtttttgggttcaccttatccttgattttttgtagtcacttcacgtcttcaccatcctcttttgcttcacgattcttgcttgcatatctttggttttattctgttcttactagcttgggggatcaattggaaggaggaggaggcactgtgcatgttttgtagctacaatcctgctaccttattgccatttagcccccttcggcgagcaaggttaaccaatctaaattccgatctatatttccatcttcacttaatctgttaatcaatagcgaatatagccggtggtctctcctcccttctaatgcagcacttttttccatttagctcaagcttccaacccagcataaactaatggccaaaatggcatgagttcatgataagctattaatcttgagttctcttcagccaattgctaattagagagcagcatgcaatacctgtagctaggatatactgtgtgtgtgtgtggaggggggcctggatgaaatatagtggaaaacaatgcttgcatgcagattttattatctgtgacaccgccattagagagactcgaggttgcatgaaatactcgtacctttcacacactctctctctctctgtttgccattcaattggaggtgtacttgcatgctgtggtgtttaagcttaaactgtacttggctctagatgcatcccatgctgccatgcatggagcgagtgtcattgtccagacctgattgattccattaatggagggctggagctccaagtcacgtactcacatggctgctgtagtgctgtcgccgcctctaccttccagaacctaaggatttacaaggatttcgattcatgatgatagggccatcacccatgctgctgcaagagatgaggcggtgagaggcagataaggatgcaatgaatgcgctccaagaaaattgcaaggcatggggataaacggataactgggaaatttggcatatccagatgtgatactggatattttgatcaacaatatattcaactacggtatcgagtaacaagttttagcatagaaaggttcccgccgtgaaaaaaaagtagaacgcaattaactagctgtgtgagctgcagacttgtaagcaatgttactcacaggcagtagcgccgcggtgttgagaagcaagccaactcgtgcgcttccttggcccttaggagttgagatatgccatcgtgctgaaaaataggatgattaacagcaataacgcagcaagctaacaatgttgagtgagctggattttgtaggggcataggccttggattgggtacgaattcttaacatatttccattagattcagagattccagaatgtaaccagttccgatgggattatatataggatcgaacgaaactcaagacggatgtcattaagggtgactaaccttctttctcgcttgcaggcattgaggcatgtgcttgctgaagttgatttggaccggtttgaccacgttgagcgcatgccagaccctatgccaaagccagcttgctaattgtgttgctctctctcaccacagtctagaccatgactttgtagtttgcaagcatctgttcatcacatgtttgactagtaaccgaaaatgtcaacaacggctgctgaggccaagatattgctctggctccgccttatctacaggcaggtgttatttactgtgttttacacctatccagctcaatttgctacctggagcttgaattgcccaaactaatagaaaatggtgaaaagatcacatgttaatacctacctaatgtattgatctcatctgcagaatcaggtgaattgctgagatgatttctcccaacaaaaaatcagtttagatacatgacacagaatgcactgaccttggacttttgcacagttgttgaactttagcccatcatggtgctactgaatgatcagtcctgtcagttctgatagttttgtcttttcatctacacttctgacaggtcttattaatagcccaagatgctgaaagcgctgaactattcaaagaatcaaagagctgtttggtgtg

SEQ ID NO: 3249 - DNA, 5280 bp, Zea mays
gagaacttatttgatgctcttgatgtcgatgcatcctttttttatatagatttggtcgatacgaagaaacttgatttagcacgaagttagagtgaactataatcctaaacagagggagcacgtgcgtgtatgaacattccaaaagataaccatgccacacaaattggcagagcttgacaacaactttaagggggaccaatttttttttaaaaaatcatgctcaatttgattaacgtagatataaaatgcctaaataaaggtgttgtagtggaaatgacgagaagattgtgaggcggtgttacatgtgatggatatttcgtatggtcaaacaaaaaagaaaacagacatgcgtcgtggtttgaatctatgaccacacttgcgctgactcctggctgtctgggtctgtactctgttgtaaaggagggaaaaccgtctggacaatccaagctgtatattgtcagcagcatctatgtatctatctctaagctaaccggtagcatttcattaaattcttgtagttgtgagatggtattcaatttccctatagttgatgccaactgtataacaacggcttacagatgccataccgtgacgtcgttacggctacagttcacacatcccgggtccaaccaacacctcccccaaaggagagaaagaaaaatgtcacatttttctttagatgcgccggtgccattgatcctcgatccagtggtctacatgcaccctttgcccggccaccacagcaatattccaacggattcgagcccatgtcgtcactgatctatctctatacgatagagtatcgtccaaagaaattgtttttttttctggctcgctaagtaaaaattaaatgagctcgtccccttcctccttgtggatctctcacacacactagtgactagccttcctgctgccctttttattcttatctcctcaccctcgcgctctcttcacctcccttgacccgtcgtcccatgctaaaagcccagggttaggagctagaggtaatctctctcccgtctctccccagtgggcgtgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcccgcccccgcccccgccgccgcgtcgctccaaaccccagccgccggcgccggcgctgctgcagcaccgtcattccacccgtccaggatcacccctccccctcccgtcctcacctcgtccccgacggccgccaccggcttcaacatcaacggcgccgcctcgtcggcgcccaccgtcgccaccgactacaccacggacaacgccaacggagcttcgtcgccgcactccgcttgaactagagaagggagaagagaggaggggggaagggaagggagagcggagagagagaaacatttagcttaatttcagtgatcactcgttttttttttctttagacttcttgccatctactaagaaattaaccccaagaaaaagcatgccgctgtgcgccatgcctagaaatccaagcttcttcctcccctgtactagtactgtatgctcttgggatccgatgatgatgctgatgctgatttaggattagaccaaaaaaaaaaaaaaaaaaccaaaaaagaggtagtagccttcttggtggttgttcttgtcctctttgattgagctcaaccaagagccgtgctcgtggtcgggagcaaggcaagagagagacagggttcttccttctagactcctaggaggatcccatgctgttgtgctgtggcatgttgcgcgaaacggaagcagcctcccgtcttgctcctccgagcactgttccgcccgcaagctcattgacttggcgctgtacttgcgattgcgattaggagtaggatagcccatgattagcaggcgcactgttttatcctattatataatacttgcatgcatggtttggtactaagattccattaactaaacatacgtggtcctagtagactgacggctgaagctaagctaagctaacctaggattaataacgctctcacacctctactcctgcgatgcatgccgagctccatagtgtccccatacaagtactagtgctacagcgctggccacaacatcagcagaaaaaaagtgtatgagtttctcctctgctaactcttccactaaggttaggaagccatgaaaagtgctttgcttcgcaacaactcttaccaccgaaaaagagctagagggccagagatggccgtcaggacgtacggttagggactgatctgacggccggataagggtccagagcagggtcggtcaggcaattaggcagcgatggtttgccctaaggatggttttttagcgctaaaaagggcaagtaagaaacggcgtggcctcgtaccgccggcactgtgggtgatgggatggaatatgaggagggaagcgatgctttttgtcgcgctggggcgggggcgccaaaagctgccgccattgacgctgaaaaggccgctcggaggccatgggggcggggggcggggctctccggcttggctggcctggcctggcctgcccttgcccggccgtgacaagccaaatcatgcagtgagctactagcatagcatagcagcctgcgctcgtgatggcattagcctaggcatggcgccctgacaggcgcaggcgcaggccacaggcgcaggcaggggtgaaaaagatgtgtgtttttttttcctttggatttttttcccccagctgccgcggccggcatgctgctttggcgatctttcctgcccaattcccaaaggacgcaatcgatgggtgcacctgcgctgggctgcttgaacgaacgcatgatttcctctcaaacgcatgatgtgcaccacattgtggtgccgcgcctctttttggttctttctacagaaccgtcaattatacgggggtatatctgctgatgggggtgggtgtgtctccgcgctcggcggtgctacctcataattcacatatataaataatttattattatggtttccacgtaaaatgaaccgttgtgttattttgtcccttgtggtcaaacattaattaatgtgctcaaaacgacacattaatttatatttggagcctgctggatagatttatcgtttcagaaattttcacaggaattagttttaaaacacaggaacaacaacatatgattctcaaaggactaaccatctatatctggatagctatgtcatgtgtgtgctcctgtggagagggagagagacggggctactctttcgaagagcatctctcatactcttatccataataattaattatcatatgtatatctttttatcgaccataaaaaaaagggttgagcctctatattccgaagcgatattttttgaaacgctgcgtgcgcctcacactgctggatactgaacattccatcatcgaggctgaagaaaccttttttttggtttaaatttcgagagaacatgaagactttgttaatgtgatcggtgatgctggtgcctctttaaggggaactcatcatatggatgctcctcatcatcatgctttatcctgtgctcgtgatgggattcaaagatctgcttgctgggttgttggggttcatgagttggcaaaaaaaaaaaaaaatatgaacccctccctgccttgcttgctgctgcctgcactagcactgcatgcactcccgatgcgttgccagcttagattcctcatttccctatcctgatctatctttggctaagttccccagatgaagtatatacatttgttaatctaatgatgacaaggatgttcctgctattagaaggtgccttccctggtaatataatcatgctactacacctgggactataaaataatacagatttgctgctggcatggggcatggggatcgcacatggaagctggatctgcattagattagtgggttggaacatgttacctttgtcatcgctcaattctttattcttaggattaacctgtacctagtaaaatatgcacagccagcgcgttggtggagcacacagattccagaagaaaaatggctgccctttatctctcgtgctgaatcatgtcccctttctcgcaaaacaaatgacagttttgtatgcatcgcattctactatagtccaaaaatggtataaagttttagcggtataataatcacatacaagcgtttgtcgtcttagaaaaattaaactttcttatacatttgttgtatagaaaaattaaactttcttatacatttgttgatgtcattaaatattttaaaaataaaataaaatttcagtagcatattaattgcacaggagaacttgtcacatcacaaaaaaccatatatttgttgtatggagaccgacagtggtggacgcaggacaagaattcttgggggaccgaaaaaatcacgacaaaatcaaacaagaccataaaaactattgttgcatagaaaggagtcgaacagataaatggaggacgga

SEQ ID NO: 3250 - DNA, 877 bp, Zea mays
  misc_feature (5)..(5): n is a, c, g, or t
  misc_feature (11)..(11): n is a, c, g, or t
  misc_feature (14)..(14): n is a, c, g, or t
  misc_feature (21)..(21): n is a, c, g, or t
  misc_feature (24)..(24): n is a, c, g, or t
cgagngccatnacntagaacntcntaatcgaaaaaggctcgccacgtcctctgttccgtgggtaccccgaggccggccgggaatccccgattccagaggaggcagcggcggcgggactctagaaccttccgagaatccgagttccttctgcgtcccttcacccttctcgttgcgctcaccacaggcaattcgaccgttcacagagaattgaatcatggaaggagggggtagcaacacgcccttctaccgcggcaacagcaccgcactcgccaccaacccttctgctgctgctgctgctgctgctgcgaatggggcacagaaaggggacagggaggctgccatcgatgccgagatagtgagggttaacgacctaccagctcatagttcctacgccatacaccgcatgaaggtgctaaacaaacttcgtcatctgctgtccatcaagaggactacatctcaagatgaggagctcgaacttctcttcgcaagcctttcaatctaaagtgtatccttgataagccagtattttaaccctgctaggggagcccactcttctgcctatctctactgttatgtcgttacctctcatagcatgcttccttatagtttcgaagtgcaaggagatcccgttacttgtctgtatcataactcataaattgttcgaaactttgattgaggatgtggcgtgctctgctcctctaaacctggacgatgtggaatggtgggaaaaccccccctactattgtgttgtttgtgaatgtaccgttgtaaccacaagtgaacttgctgtctcggacaagaattattagctaaataaccatggtactgtttgttttgttaaaaaaaaaaaaaaaaacaaaaaaaaaaaaaaaaagct

SEQ ID NO: 3251 - DNA, 1299 bp, Zea mays
atagtatagttgtcgatcgaggcgtggcgtggtgtggcgcgtgacgttcggagatgtcccggaagaggcagccgcaggcgagcgccggcccgcggcgcgccggcggtggtggagggtgtgagcctagtgggagcacatcgtgcttctccctgccccagcgccccgccgagccgaagcggcagaggatcgcccttcgcgatgtcaacacggaggtgatgcagaacaccattgcgctcgagcccctcgccaggagagtggaagaatttgacaagggcaattggaccgaagaaaatacacagatactctgtgatcttgttgttgaacagattagggaaggaaactatcttcatggccacatgaaaaatacagcttacaaggtcatggctcaaaagtattatgaatgcactaaccttttccatgcaccaaagcaacttgaaaatagataccaccagtgcgaggctatgtaccagtggatcaattgggccgatggtgaacctggattatgtcggggagacaatggaagcataatagcagatgatggttggtgggaaaactatacacagggaaagtactctgagtgtaaaaaattcaaatatggcatgccttcttacattgaccaactagcagagatgttcggtgtaacaacagttgatgtttggacttcatatgttgctggagaaagtgaggaaccaacatatggtaatttggacatgggtgaggaggaggatgaagtagatattaggagtccattgagcagcagtagtaagaagaggactggcagcaatactgatacagccagtagtcctcctaggaagcataaaagtccaatgattgaatgcgaagctttgatagacaccctacaatctttaaactccaaagacttggatgtggccaaacagatacaagaagaccacatagctaaaaataagaagttagaacaggaaaaagagaataaggagatagataaatgtttcgaactggccaaagaatgtggagcaactgaggagacagaggagttctatgtagccactaggatctttgcagaaagatactaccgttatgtcttcatcaaaatgactacaaatgcagggagaatggcttggttgaagaagtggtgcagggactggactggttgaagcatgtttcagttatattttatttgtgttgagcatcatttgtcatgttgtgaaccatttgtgttaagaacctttattcctatcatcatgctgtgaaccatctttaagatagtttatgggcttgagcttgtgtaccgttctgcaaacaaaaaaaaaaaaaaaa

SEQ ID NO: 3252 - DNA, 1761 bp, Zea mays
gcacgagaccattaccgtcctgtctggtcaggtctcgaaccggcccgagagcgcaatgcaccagcaatggaggcgagcggcagtcgggtccggagggggagcccggtccccaagcgccgcagaggcgtcggcgtggctactggcttcgggtctacggcgcagtcgctgaacgacgacatcctccggtccgtcttctcccggctggacgaccacttcgacctcgcccgctgctccgccgtctgcggctcatggaataggataattgaaacagctcatctcatgagggatatgtattacaaaaggaacccaccagcaagaggttcaagctctaatatttcagtaaaaagttactttgagatgcttgccatggatgagcatgcatctgctttctctagaggacctgctgaagcttttcagtggattgggcacccaatgagggctaccttgtgccgtatgaagagtggtttaattttaactggagttggagataagattctccgcctttggtctgctgaaagctgcaaattcatgaatgagtacaatgtgccaaattctaaaacattagtcgactttgattttgatgaaaataagattgtaggtttgaccagctcccagatttgcatatggagacgcagtgaaccaagaagcatatttcaatctggtggagcctcattcaatcatgggttatgcatgagttttgctgatccggaggttgtaattggttgtgaggatggtcgagcctttgtatatgatatgtacagcaggagttgctcacgtatttatcggcttcactcctctcctgtgacatgtttgatgataacggatgaccagctgattgttggtggatcaacttttggaaatgtagctattgcagatcaaacctcagggcagaagttaggtgttctaaaatcagatcatggaccattggcaataagatccttatcttcctgcacaaattcacacatgatatttgctggttcgtcagctggttatgcacattgctgggacttaaggactttgaggcctctctgggaaaaaagagtcagcccaaatgtcatctacagcacacgtcatttgcccggtgacacggcaacgctggcagttggaggcattgacggcgtgctccgcgttatatgccaaaggactggtgacatcattcgcagtcttgtcgttgacgcagatctcccagcagaagccacatctagatcccggcagcaaatagagaagaaacgtgttcgaaggattgaccctgatgcacagttggacggtatcccgaggcgtttgcgccctcagattaccagcctatcggttgggatgaagaagattgtgaccacgcatggtgaaaactacattagggtttggaagtttcgcatgaaaagttcgtaaaaagggcgagatgatggtaatctagttatctggtgtaacctgtactgtagtctactgaataagatggcgtggtaccgtggtgtgtcacctgcgcttgtaataatagcctgaaacatagttcatttgtacacttgtagtcctctttaggatactattagcaattaaaaaaatgtttgtgctcggttcttttttttttaaaaaaaaaaaaaaaaaaaaaaaaagtctgtactcagcttacggtagagatgcctggtaagctaatgcgtggatgaaagctgaacttaaccttatcaacacattcaaaccgttgtagtttgaacctgaatgtatccaaacattgtcggcaacaggattgcttcaaaagaaagaagtgat

SEQ ID NO: 3253 - DNA, 2248 bp, Zea mays
gcacgtggtctgtgcttgcacagcatacgctcccgccgataagaccattgcttggttccgccccgagaaaacggacgcccgccacgaaagcggagggaaaagcgagggaggcagccttctattttctgtcaaaacaagggcgatactcctcctactccagcgcacacgcagatcagcgtcgaaatccgtcgcatcgtgcccgcctcgctgtctccgctgggcgctggtggtcatggcccgcagggcgctggagctcgcggcggttctgctcgcgctggcggcgctggcggccgtggcggccggaggggacatcgtgcaccaggacgacgaggcgcccaagatccccggctgctccaacgacttcgtgctggtaaaagtgcagacctggatcaacaaaaaagataaagatgagtttgttggtgttggtgctcgatttggccccaagatagagtcaaaggaaaagcatgccaactggacaaacttgctgttagcagacccttctgattgctgcacccctccaagagagaaggttgctggagatattttgttagtggagaggggaaactgtaagttcactacaaaagctaaggtggctgaatctgctggtgcttctgcgattataattatcaatgataagcacgagttatacaagatggtatgtgagaccaatgaaacaaatttagatattggcatacatgctgttcttctgccaaaagatgcaggctcttctttacaaaggtctctctctagtggtgaagtcttagtggagctgtactctccagatcgtcctctggttgatactgcagaggtgtttctgtggcttatggcagttggtaccattctttgtgcatcatactggtcagcatggagtgcccgagaagcagatattgaacaagagaagcttctgaaggatggtcgtgaagtagcaccaaactttgagcctggaggttctagtggtatggtagatatcaacatggtatccgcaatactgtttgtggtgattgcatcatgcttcttgataacactctacaagctgatgtcccattggtttgtggagcttctggtggttatcttttgcataggtggtgtggagggtctgcaaacatgcttggtggccttactgtcaatgtcaaggcggtttaaacctgctgcagaatcgtatgtgaaagtgccattttttggagctgtttcataccttacattggcagtttgtccgttttgcattctgtttgctgttctgtggggtgtttatcgtcggttgccttatgcttggattgggcaagatattcttggtattaccttgatcgttacagtcatccaaattgttagaatacctaaccttaaggtgggttcagccctcctgggttgtgccttcttatatgacatcttctgggtttttatctccaagatgttgttccatgaaagtgtgatgattgtggttgcacgtggtgacaagactgatgaggatggtgtacccatgctgttaaagattcctcggatgtttgatccatggggtggatacagcatcataggctttggtgatatccttcttcctgggctgttggttgcttttgcattaaggtatgattgggctgccaagaagaccttgcaatctggctactttttgtggtcaatggtggcatatggttccggtctcctaattacatacgttgccttgaaccttatggatggccatggccagccggctctcctttacatcgtgcctttcacaatcggcaccttcttagcactgggcatgaagagaggcgagctcagaaacctgtggacaaaaggacagcccgagagagtgtgcacgcacatgcacccatcccccaaggattcgcctgttgcggtcagctcgctgtcgtagacaaggctaacgaccttacctgatgttgcctggccccggagaatgttgctgatgaccaaaaaaagtttccagggttaatgaaggagtctactgatttgtaatgaaccttacatagggataagccaagatcccctgatcgtgatcctcgttgtacagtaggtggtgtatttgtatagtgagtgatgactattgagatgtgcggctgacactggataaaaaaggcgcaggagcttgatgtgggagcagcactgcatctgcatcatgtggctggtgtatggttttgaatgatctctgccgcctcattcttgttcttgacatggacctgttcctggtcttatgaggcgcacacgtggcaagacgctgctggttttgtcggtg

SEQ ID NO: 3254 - DNA, 2039 bp, Zea mays
ggtgataatttaatatgtgcaccatgtgcactaaacttctatttgcactagatatgttctcttccaataaaaaaacaagaagaagaagaaccagcagttgaatttggaatttggatacacgatacgatatcgacgacacaagtcagtgggtaaacaacaacgcacgcatccgcccgccgaagacgaaacggaagggcccggacagttttgcgcacaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgtcctgggacgccgccgtcggctgcccccgcgtccgcgccaagctcgccgccgcggggctggggctgggcccgggcctgccgctgccgagtgcgagcgccagcgccagcgctaacggcaccgcggaggaccctgcggcggcgtccgtcagcggcggcgccgcgtggcgcggagccgcgaggtgcgaggacctggcagcgcgccacgtcggggtgctcgtcaagggctggacctggatccctgacgcgctcgacggcgtctacacctgccgctgcggggttagctgcgtctggagcaagtctgccgccgccgtcgaccgtcccgacgcgctgctctttgagggcgccacgcctccgccgcagagaatgaaaggtttgcctcttcgtgtttacctggatctggaggccagtaggaagccaactggttttgaggacatttttgtcgggtaccatgccagtgatgatgtgcaagtaacatatgctggaaaatcatttcacaccagccgaagttaccatatatcaactgaaaagagaaacgatgcacttatctactggtcatcttcaaggtgtcttcctcatagagataagctcgcaaaagacttcctctcgctggttcctcaccattccttcggaagatgtttgaacaatgtcggcggtcctgacatggcgctatccatgtatccagtctgctccaccaacgataacggcacgccacactggtgggatcaccttacactgtgcgatgtcacattccaagttcgttcttgcaatcgagaacaccaaagaccgaaagctacgtgaccgagaagctgttctacgctttggaggctgggtcggtgccgatatactttggggcgcccaatgtctgggatttcgtccctcctaattctatcatagacgcctccaaattcagttcactcagaaagctggcatcgtatgtgaagacgctggcaaatgaccccgtagcctacgctgaataccacgcgtggaggcgttgtggtgcgttgggtaacttcggcagggcacgcgagatgagcctcgacacgctgccttgccgactctgcgaggtggttagcaagagaggtggtaagggtgcagatgcattgtgagatggatcggtgttttgtatggcttgtataccttgatccggacatgtgaaatagatgtaaatggtacgtcgaacgaagtgctcatgctattccgttcaggaaaaaagtgtctagtgtgttattcatgtcaagatcaagcacacattgtcgaaagaaatagtgcagctattcttttttttacaccatctctcttttatctgttgaatttggagggttgtacagttgttggagcagagagagttcgtgtttttaggtagagaagtatacagatgggatttcttgctgttgctatgatatgaaccatataaccatctgtcggccccgcaaacacacccccttcgaggaaaaaaaaaaaaaaaaagcggcc

SEQ ID NO: 3255 - DNA, 2694 bp, Zea mays
  misc_feature (2315)..(2315): n is a, c, g, or t
agaccagaggacggctggaaagggtaacttcgcctcctgatttcctcccccgcccgcgctcacccggtgaccgcatctcgggcgcagccacctcccaatctccgatggcgctccaaaccctaaacccctaccggcacgcggcggccgtctccccggtcccgtcgcccgtcccgcaccgcggccacccgccgccgcatgccgtcctgcacctccctccccgccgccgcctagcgggcggcgccgcccggccgctcgccgtcgctgccgccgtctcgggggccgtcaacgaggccaggaggcgtggggttcctcaagagggcggggaggacgggaggaaggacacggacctcgccacgctcggaaacctatgcgtcgacgtcgtgctcagcgtgccccagctcccgccggcgcagcaggaggagcggaaggcctacatggagcgactcgccgcctcaccgcccgatcagaaattttgggaggctggtggaaactgcaatttagcatttgctgcagctaggcttgggcttaactgttccactctgggacatgtaggagaggaaatatatggaaaatttcttcttgatgtgcttcaagcagagggcattagtgttgttgggatgcttgaaaataccaatgctgctgcatgccgccaggcctatgaaacacttctatgctgggttcttgtagacccatttcagaaacatggtttttgcagccgtgcagacttcagtaaagagcctgctttcagttggatacgtaaactcccagcagatatcaggacagctattcatcactccaaaaactgttttgtaatggctacgcttttgatgagttcttccctgatgtgatcgcatcctctattgactgtgcgatttgttcggggacagcagtgttttttgatcctggtccccgtggaaaatctctcttacatgggaccttgggtgagcagagagcacttgagcatgcactgaggcttagtgatgtcctcctcttgacatcagacgaggctgaatcgctaaccaacatcagaaacccagttcaggctgggcaagagttgctaaagaggggaatccgcacaaagcaggttgtcatcaaaatgggctccaggggttcgatcatgatcactaagaacacaatatcctgtgcgcctgctttcaagatcgacgttgtggacacagttggatgtggagatagctttacggctgctatagcttttgggttcctccatgacttgccagcagttaacacattaaccctggcaaatgcagttggtgccgcaaccgctactggctgtggggctggcagaaatgttgctcgcctggataaagtactacagctcgtgagagaagccgatctcaatgaagacgtcacgttgtggactgagctgactgaaggaaactctctccgtatagaggtctcgattctgtctgggatagcaagaaatggttttagtgagaacattgtggctgttcctgttaccaaagtggtttctgaacttttgccaatgttcgaagcagtgccagtgcgaagcgctgtccaggcttgattccatactgagctgactgaaggaaactctccacgctgaggtctcaattctgtctgggatgacaagaaatggttttagcgagcacgttgtggatgttcctattaccggagtagtttctgaacttttgcctacgttcgaagcagtgccagacgaagggctgtccaggcttgattccatactgaatagttgatggttgtattcattttgtcattcacatagattcttattttacctccacgattacacgctgttttctggtgatgagtggtagttgggggctagcctccaggtaaagatactttctgaacagaatatggttgctgaagctattgatagctgtacagttatggccgcttgggatggtgtgccatctggagttttgtgctaacatgcatgtgatttgacgctgcaatgtgtactagcaacagacttggttttcttgatgatttcaggcattcgacgcaagcgtgctgtgaatgtggtgcagcctgcaggctcggcatgcgtcccaggtctaagcaaactcatgtaccatgaatccatgatcaccaactaaccgaactggtctcaacaaaacctgacgattttaattgcactgacaaactagctcctaacaagcaacaaccaccacaaccagatgatgagatgatacaagaattatccgtttctcagtagtaaactagtccgagacatcaccagtgcctttttttttgtcaaatctccgagatatgtatgttctgcgctccatgtcgtgcaaaatcacatctgngtgaatgctctaccgctgccatttgtcaaatctccgagctgaagcatcatgctaccatgaagtttgtcagcaatgtgagagaaccaaccagtcccaagtgaatgcgtcggcccaatgtccgtgtgcaggccgaagtgagcctaaacgtgtgtgtggcgtagcgcctgcgtgcgcgaactggtgtggcgtctgtgtgtacataatgaacctgatacatatatcttgcctagggaaggaaacacattcactgaatattgaagaatagaactgcttcctgttgccttcgttctcctctctctactaccttcgtcttcctctcattcttccctagatctctcctcttctcccattcctagcagtagctaaacaattggtatca

SEQ ID NO: 3256 - DNA, 1856 bp, Zea mays
  misc_feature (1797)..(1797): n is a, c, g, or t
  misc_feature (1829)..(1829): n is a, c, g, or t
  misc_feature (1838)..(1839): n is a, c, g, or t
atctcttcctcttatattatatcttagagtccgtgagcaacagttcgctttcattctctcttcattttttttctttcatatcatcacaaatctgatgtgttatatcctacagctcgcctacatcaccttattatacttgcttttaggatctagtttggaaactcaaatcccgatcacgtttcaaacgaaccttcccccatccaccagctccagaatctccgtcgcccgccgcccaactcaaaagtggattccaaaatccttcgtccagctgctgactagcgcagtcccgtcgctctcccactccttttcctccttaaatttccacacgaaaaattctcggtggacagaaaaaacaaggcaaagatcagaagagaacgcggaagtgatggccatggatccaagcgtcgcggcgcgccagagcgaggaggcggcggaggccttcttccgcgcggcgccgccgctccgtgaccgcgaccgtctcgccgccagcctcgccgatttcctcgcccgccactccgccgggggtggtggagtggtgtgcgtcacctccggcggcactacggtgcccctggagcagcgttgcgtgcgctacatcgacaattttagctccggccagcgcggtgccgcctccaccgagtattttcttaaggccggctacgctgtcatcttcatccatcgccgtgggagcaagcagccttactgtaggtttcttccagaggattcctttctcgatctttttgagctcggggaagactcagagatccaagttccacagtctcattcatcggtggtcaaggcagcaattagcaattaccggaaggcaatcgatgaatgccttcttctcaaactgcctttcacaacaatttttgagtaccttcagttactacaaatggtggctacttctatgaattgcttggggcaccgtggaatgttttatcttgctgctgcagtttccgacttctatgttccatgggaaagtatggctaaacataaaattgagtcagcaggcggccctttgaacatgcaactcaaccaagtccctaagatgcttttcatcctccggaaaaactgggcccctgctgcattttgtgtatccttcaagctcgaaacagatcctaacattctcctacagaaggcagagatggctttgaagaagtacggtatgaacgtcgtggtggcaaatgaactcgcaaactacaaagatgtagtggtgatggtcacaagcaacggggggaggacgaccgtgagcaggaggagcaaggcggaagacctggaagcgcagctaaccgacctcctggtgaagatgcactcggagcacattgcacagcccaattcgtaggaccatcgagcgagcgagatggttaaattaaatcagacatgccggcggcaagtatgagcgattctacttctactcgcctagcaaattgtgatatacagagttcaccgggtttgtcataaagacgctcatcaatgtgctgcagcagattaattcaaaaaattatagctgaatagctcacaccaggtacatgcaagtttttgaacataacctaggtaagggcatgtacagtggtgtttaatgtggaggctcttaaggtgtttaagggggttatttgaaaaaaaaatcttagagccgtctctccgtgaagagacgcttctggctcgtaaaccaagtagcaacagacgcttcacttcccactgtacgaatttgtcgtctgttctatcgatctaatgctatacaaatacatttaattatgtatttattaatagactacatttataaaatgtgcaactgtgacnaaaaaaaaaaaaaaaaaaaaaaaaaaaaaaanaaaaaaaannaacaataataaaaaaaa

SEQ ID NO: 3257 - DNA, 2566 bp, Zea mays
ccacgcgtccgctttgccgggggaaaagaaaacaaccgccccgcccccgcccccgcccctacgagcacgacggcctccggatgagggtcctgccgcgtcttttaccgtcagctggatgtcaaatcacaacgcgccctgtgacatccccaagccggcctccgtcgacgagttcctcgccaagaatggcaagaagaagaagtccttcatgtcgggcctcttccgcaagaaagggaggggcgcggacaagaagctgctctcgcggcgggacatcgtcttcgatttggaaggcagaagcggcgacaggatggacctcttggagacgtccgccgctgtccgcaagagcttctcagatcggcactgcacgacgcggatcgagaacctgacgctgagctgcctggattctcccaggagacccaatgtcgacacccgggagtaccgggtgtttgtaggcacatggaacgtgggagggaagcctcctgacagcagcgttaacctccaagagtttctgcagatcgaaggcttgcccgatatatatgtcttggggtttcaggagatcgtgcctctgaacgcgggcaacgtgctggtcgtggaggacaacgagccggcgggcaagtggatggacctcatctaccaggccctgaacaggccgccgccccaccaggacggccagtcctccggcgacgagctctcgccgccgccgtccacctcctcctcccactaccccagccggccgcaaggtgccgcccgcgaccccagcaacgccgccgccatccccaagacctccagcggcggcatgctctgcgcgcagaagccgccgccgccgctcaagatggtcagcaagtgctaccgcgtcgacaacgcgctggtgaagacgtgcacctgcatgtccgacccgtccaccatgcagctccgggcgcgtgagatgcgcgagttcctctgccgcgtcgaggccgccgccgcctcgccgggccgcggcgccgacgacgacgcgctggcctccatcgaaggcggcgaccagaggggcggcggcggcggcatgaactactgcctcgtcgcgaggaagcagatggtcgggatcttcctgtcagtgtgggtgcgccgggagctagtgcagtacgtcggccacctccgggtcgactgcatcggccggggcatcatgggccgcctcgggaacaagggatgcatcgccatgagcatgacgctgcaccacacgagcatctgcttcgtgtgctgccacctggcgtccggcgagaaggaaggcgacgaggtgcggaggaactccgacgtcgccgagatcctcaagaacgcgcagttcccgcgcatctgcaaggtgcccggccagcgcgtccccgagaagatcattgaccacgaccggatcatctggcttggggatttgaattaccgagtctcgttgagctacgaggaaactaagacgctcctggaggataatgagtgggacatcttattggagaaagatcagctcgcgatggagagacaagccgggagagtgttcaaagggtggaaggagggcaagatctacttcgcccctacatacaagtacaagcagaactccgactcgtatctatgggagaccgccaaatcgaagaagaaacgacgaacgcccgcatggtgtgaccggatactgtggcacggccaaggcatcgagcagctgcagtacatcaggggcgagttcaggctctccgaccacaggccggtctgcagcgtgttcgtgatcgaagccgatgtagatagcgggagcaagatcaggaagggctactcaacgctggacgctaggatccactgcgagtcccccgagatacccaagagacacagcttctacgatgacttctgaaattttggcccgtgatgctagttttgtctataacatagcagcttacaaagatcaggcacgtttgtagcgaaaaggctcaggtttctcaagcctaacacctgtcttaatttgtaccaagcggtatactaactgaaagtcaatggtggttactgcacagaacacaagtgaacaatggtattatttagggcacccccctacagtaatttcatgtcaaaaaaaaaacaatggtacgatttgacccaacagcaactttctgctggtggaagtgaaaagcacctgtgtccttgctattgactatagaaaaaatgctatccagataggagtgcaatattatttttccagtaaatgaaagggcatagcagaaactcaacaccggatcatattctctcatgaaaattgaaaactgaggaaaacattatggtattagttcgttaccatctcgtataacctattatcatgaaaaggttcctcaaataagatcgcgaggacagagaaactggtgtctcctacaaaacatgtcatgccaatttgcaaagagtttctcgtcgcctttcatgttcaactcttagtgaaatgtggtagagctccctatcatgtttcgcgggtacgttttcctggtgctactcagatcaagttgaaaggcccaatttgatatgctggggatattatctttctcctggcaaggtttcctgatgaactgtgctcgattcagcc

SEQ ID NO: 3258 - DNA, 3469 bp, Zea mays
  misc_feature (3038)..(3038): n is a, c, g, or t
acatattcagtatccgaaatgcccatttatttttgtttagagcctgattgaaagcacccaaatattaagaacctgttttatgaaaattaaggtggttccaaacataatagtttatatcccagtctatgtctatagaacctgaattctttcttaaaaaaacccagaaactagtctcctaactaaaacctgtttatgaaaattatggtggttccaaacactattaactagtttttttttataaaccagtttctaaaaactagagatataaattagattttttaaaaaaacattagattaaaaaaacatatcgatttatatatcagtttataggaattagattattattttcttaaaaaccaaaaagctggtctaaaaaataaaactggtttttaaaaaactaggtccaggtcgcatcccaatgtttccgttccctttcggcctgcatatgcttctgctatatatatggcggatgttgtatttgttcaaatattcgtcaaactccattaaggaaaataattcagaactaccggtaactaatctcacggtttttattgttttggaaaacacgacaactaatcattggtaccggaggccctgaactactgggcctaatccgattcaatatctcggcccacgatgcaacgggtgatcagtttttcccgttcgaatttcggagccctcctctcctccccgctccagcgcccctgcagttctcgctccactgacagctcgccgaggggccgcgccgcgctcgagacccgtcgatggcgaggcggagcctggcggtcgacgcaaccgcaggcgccgcatcccgggttcggttcgcgcccacctccaataacctgctcgtctcctcatgggattcggggctgcggttgtacgatgccgacgagggcacgctcagggtcaacgtggagtcagaggcggcattcctcgactgctgcttcgaggatgagtctgcagcgtttgcctgcggctctgatggatctgtgagaaggtacgacttccactcaggttcgcaggatacggtggggctccatgaagatgcactagcctgcattgagttctcttcactgaccggtcagattatgacaggcagccttgacaagaagctaaagctttgggattcaaaaacaagaaatgtaagcccgagcggcaccataaccttaaattcagatgtggcctcaatttctatatgcggcatttacatattagctgcagttgagagaaatgtttatctttatgacatgaggaatctaacaagaccagttgatgaaaaagactgtcctctggattatcaaattcgatgccttcatacttctctagagtggaatgcttatgttgctggctctgtggatggagttgttgcattgaagtatcttgatcgtggaacagatagagatttgggatatgcatttcgttgtcatccaaattccagaaacggaaaatggaatctggtccctgtaaattgcatctcagttcatccctgcaacagaactttcgttacgggagatgataaaggatgcactattgtttgggatgctcaattgaaaaagaagctgattgagcttccaatgtatttgggcagtgtggcgtcagtggcatacaaccataatggccaacttctggcggttgcctcaaactattttttagaagtggataaagaggagcaacaccaccaggtattcattgaaactgtggagaacttcaaaggcaagtcccgtgtgggatagagccttctaacaaaacatgttctgttcatctgttgtattgtattttgtctaccatacatgttaaaggtcaccaagatgtgacagcatgttgtattatgttgtatgactaagcattttttttaggaaacgacataatatggctaagcaatacttgtatatattggttacatctagtctgagacagctgtggtgtgttgtaactcttttgagcttttgcaaccagtattgctgttctggtaaaaaaaaaaaaaaaactatccctgctgtgttaatgaactgttatttgctttcaataaaaccactaacgaactcctctctctctctctctctctaaaaagtatagtacctaagttctgaaatatacttcactttagtttagtcttaaataaaaattctttgatcaagttttctgaaaaaatatagtagcaaatataagctcaaataaatacgcaattatatctcatgaatacacaattattttggttgagccgacgacctttttgacttgctttgaaagattctggctcacccgggctagcaaaggaaggcttgcttgcacaggtgaggcgaggcaagccagccaaagaaccaaaatctgtccttgggttcgtgctagatggctggaagtgaaactgtgatttttcttttcgctgaagtctataaaagatggccggaagcaggaaaggggtattgcaggctatgtccgtggcagcggcaggcgatgtttccttcgtctggaatctttgtcgcgtttcagactttcagtgcagtggggatccagcagatgtgcactagtccgagcgtgcggctaacagccgttttcagcctcgaatgaagatgatcaggcctccacctcttcctccattgttgagaaagaaacaataaacaaatttagaaggtgatgaagacgattcacaagacaaatctaattgacgtgctcatccaaccaagttggagacatccaggtcacagttgaaaaaaacaggaaaaaaagaagggatgttatggttatggcaagaaggggaattttataaaggattgtccaaacaacccaaggataagaaaaagagatgtaaggctaagtctcttacaacaattaagacttgagatgattcatttagtgaagatgaatcctaatatcagagacacaatcacaaacattcatcatcacgttcttctcacaagcgtcttatagcatgaggtaaaactaaagactcatcctctagtgagagtgatagtagtagtgatagtgatgatgaaaaaccttctacgaagaacttgcctgtgccatcaaattcttcaaanaagtttgcactaagtaaaaacataaaataaaagtgctaaaataaaagctagatagctcataaatggcttatcaaaatttgttgaacaatatgaaacaactgcaaatcttaatgttgagctaactaataaaaatgagcaacttgaagctagtgcaagctcacatatcgatgagaaactaaataaggaaaatgataaactagtagtaaatgttagacatatacgggcgcgtcccacgcgcacggacgcccgcgcatcacgcgctgccgttgtcagcgcaattggcaagtctagattagacagatgcaatcaatctctcctgtaatctctcctgtaatctctccctcgattgtatctctcctgtatgtatgcctgatggccaatggaagtgatatcgcgtgaactttcttccgctttcatggtatcgcgagacc

SEQ ID NO: 3259 - DNA, 10535 bp, Zea mays
  misc_feature (8877)..(8877): n is a, c, g, or t
tgagaaccttttacacaggatacattgcctatatatatatatacaatattggctaataattaatttacgactagtgtatatttacatccttgaattatgaatcgattaggttgataaatttatcttataaactagtcacgacttgtacgacaagttttacgataatattataattagcctttctaaaaatcagcctcaaacattcaaagtgaccggaataaaatttagatctaaggatcccatggctagtagttccggagggaaaaaattctgatggagacaccagcaggtggggggtgggaaaacaagtgtctgtctgttttatttccatttattctggcgaggaatgggtggggagcgtagagatggggggataaaagtgggcgaggatcagcagaggagagagagaatacaaagaccagatgtcaacaaatctgcctgtccttgcacgtagtttagatacaaggtctcgttccattcccttcctcagaggagagagagagagagcaaaagagagaggcagtaggcaacgcccccacagaggcagagagaaagccagaggcagtagtaggcagagcacataaccaaacaacacccatccaaaaaccccaaaaggaagagagaaaggagtgagaaaaccacgcagtcgtttgtccagacaaaacaagaacaagaacccagcagcagtacgcacttcctcctcctcctcctcctctctctctcgctctctctcctcttgctctcgctccctctcgctcccccagtccgcctccctggcccatcagatccaattccttccccgacccccatcccggatccgccgcaattcctccgtgcgtcgagctcgattgctccccgcccgtggaatttgctcctttctcccgcaagaatcccacctcggccggcgacttggggggacctgccaaggtttgggcgcgcgctcctgcttggcgtagcgggccatgggcgtgctgttgccagctaggctgttcgtgcgccggatgctcagggttgtcaggctcaacccgttgcagcgcagcgccaagagtggatgaggtgaaaatttttactccgctggtcttagctcgcttcttgtgaaaaagacgcagcttttttccgcctttttttttctttcctttcttctttgagccgtccaaggttccgttttcttttcttttcttttctagagattgggtttctgctgcagttagttcgcgtgtcaaattcgggttcgattggcggcaggaagctgttaattgcatctaaccttcgcggcctttcggtttccacgtttggtaatgataggcccagttgtgagggaactggttcttaggatttatcaagtgcgttcaactgtcgggggttgacttgtcttctcttcttcacttccagtctcgcgagttggcatccaaacagctgcacatgtatagattctttttcgttgttttgggccttctgtcatgtttcttttgatcttctgcgtgtttgcttgatcatggaaaggggtagcgtgtatcgatcttgcattttgtgtgtgtgtgtgacacaacgcattgtgcatcttgttccttagatcttttaccttactcactgcagtgtcttaatcatttgatgggcaggtaatttctcgcgagcgcattcagcacagcaggttactattggctgctcgtccacttaagcaggttgaggtatccatttggttcgacacagtgaagaactgaagatacgcattgtgcttgcttgtcttgcggggctcacaaacatcctgctggtgtgctgtgctgggaaggtcacataatccacttggctatatgccggggtgggaatgtgaatcggggcttcattagtgcaggcagcaggcttgttaacttggtaattagtcaatgaaacccatactctttaatgacttcttttggccactgttagcctgtgtttgatataatgtagctgttcatttgtgcttccttccaaaagttccatattttgttctttattggagcatcaattttagatggcaatgtatacctgaacatcttcaaactgtctacacaatatgtctgcattgtttttgtgcttatgccagtagaattaacaattaacaagtagtatctgttcattactttagttcatgttttgtgccccatgaaattggtaatggaattgcaaattggagttagacatcatgctttgaaatgcacaaactgccacaataaagccgtgacatccagctgagtgaaactgtcttttcatgcatatactctcagtaatcatcactaaatttatctggaggagtttattgttctattgtaagctgccaatttctttgtttcttctgtcaatcaatgaatattgcacgcttgtctcttttccacatttaggtcgatatttcagaacctttttctgtgatctattttattatacagttgagggtttgattcactagtctcttgcacagttttgcaacaagcatgggggcaaaagttgaaggggaaagctatatgcctggatattatgccacaggggatctcaacgtggaagcaagtggtaggtggtctccatactatgaggagatgacatcaaatggccagttatgcaatggcttcgcaacaaaaccaacaagtggttattcagaatttgacaaagaaatactcaagcatcaaattcttgaacatgaagctgtgttcagacaacaggtgagtttaccctaattctaagaaacaaagtacatcatatcataattatttttttcttatcatatgttttttttcctgtcaagcctcacaacccactcgctatccaggtgtatgaactgcaccgagtttacaaaatacagaaggatatgatgaaacaacatcaaagaaaagaggtatattcatacccaactttggcaggtgcatcacatactaattcaccgtcacaagtgccaccaaacggtgcaaagatgatgtggcagatgccagttcctcctgtgtctacaacatacaggaaagctattggagagcataatgatacaaaccagtcctgcatgaagttccttagagaaggcagtgtgcagtcttctccaaatggatttctatcaagtgatgctgctccaagaaccagacaaggcacttttgaccttcaacttccagccgatcattatatagatgacgatgacacatcagataacaagcccatagatttccttggtttggcatcagatgcaaaaccccagaatgatgctgagcttacattagttagtgcagaacgcttgggcaagttcagtgataatagttcatcctcaggtttgcggactacaaataatcttggaagccgacaagttaccaacctgaatgaatcaaatactggcttctttatgggtagagcaaatggatctgtttccagaggccttccgcataccctcgagaactcgtggcaccaaccgatattgagatcaagcacaactactttcaatttcagtaaagaatactccaaagaaaagcacacaaatgaaggtacaagctcaaatttttttgacacaagtgcgaaactaacacatgacgacaagccaacaatcaataaaggtaaacaagtcagcagtataacttttttagcacccagatataatgatgctgatcccccaaaatacttcaaagctgctgatgggaggcctgccagttataaccaatttctttaccaaggtcagaatagttcagctggatggattgcacgaagtcctctggaaccttctgttatcaataattttgctagagttgaccgtccacatcattcgaatctgggtacatttactgtccccatctctattcctcaaatagacaatccttcaattgtctccccgatgggttcttgcacagcagagccaaggagcagcattgtcaacaatcctgctttaattccaagattcaatgggtcgtcaaccgtgaattcgtacgccagtcttagtgctgtgacacagagcattggaacttcaatcccaaagctgaaaaatgtggataacttagataaacgctatcctggttttccacttgattcgttttctgtgtcccactcacgacatcaggtagcaatttcaagtaacctggagcaaaagaactcccagaagtttgaagattcagatcaacagtcccatggcaagggtatgaagaacttcaatttgaatgagacactgtcagattgtcaggaagatggtcttgtagaacaagatgggagatgtgctgccagttttcagcatggtaaagacggagggtcagtattcgggatctcttggctcaaaaataaagctgtgtctgctgatccaacagctttggagaaggcagggaagatttttggccattcgtttggaactacaatggagctgaaaaatgctaaagaccagaacgaaccagctgtgactattcgaaatttgtcagactctgcttcgacatctcttggctgtggaattaagaaggatgggccttcagaagacattgccactggaactttgctggtttgtaataaagcccaagaggacgctacatgtttacccctttcatgccagaaacatgtgcctaaagatggacaagatgctgatggagtcatcaagataagtggtgcctccatcaggaatttcatcgatctcaatgatgctgtgccaaacgatgacaattctgaagaatcagtagtgtcacatgaatgccaggcggaaccttcacggaacaaccatcctaaacgagcatttgtgattgatctagaggtgccggcttgtgaagaggatgctgcttgggattttgatcaagaatgtgcacagcctaaacctgatgcacaccaggaagttgacggcagatctgatacatctgctctagctgcagctgagaacatcgtagcgttgtcaaggattattccaacagctctagaggcatctgatgatatgttgcagtggtttgcagatctcgctgtattgaacatcaaggaccttgctgagcaagctgaactccaagcttgtaccaatgattccagtaacgacgagtcagattcattcgaatccttgacactgaagctggaagagaccaagattgatgagtactggagcaggccactggaacctgaaatcacaaccgatgaacaattaatttcaactgctcaccttctcaccaagcccagaaggggccagcaaaggaggcgacggcagaagcgggatttccagaaagatatcttgcctggcctttcgtcactttcccggcctgaaatcatagaggatgtccagttgcttgaggggttagtccaggcttctggtggatcctgggagtcgagtttaactaggcgaggacgttatggtgggcggactcgaggtaggaaacctcggaaaactgtagtaactgtaattgtagaagaggaggtcgaggttagcccaccgccgaaacctgttggcactggcgacctcgaagccgatgataggggtatggttggatggggcagaacaacaaggcggtgtcgcagagcgagatgtccgtcaggtaacaacttggctgctgcgtcttgagaaagggtattgccagcaagcattggacctgattaggtacttggtggttcacaattgttatagactccgatggatggactggtataaggtgatcacagtcatgagtgtacatactctgtcggcctattggcctcaccccaactttcatgcttttgggtcgaaacatggtttacgttcttataataagttccgtaaattagctggtaagacatttctgcgacagcattgtattaagctgttccaggttatgaggtccggtataaattcattgtgagaaaaaaaactgcaatgcctgtaaaccaccttgatctctgaagattagctcatcgcatgcgcaacaaagggtgtgaaagacttcgggtctgtattcttttttagcttatatatgctctgcctaattggctagtacatattcagtatccgaaatgcccatttatttttgtttagatactgattggaagcacccaaattttaagaacctgttttatgaaaattaaggtggttccaaacataatagtttatatcccagtctgtctatagaaactgaattctttcttaaaaaaactagaaactagtctcctaactaaaacctgtttatgaaaattatggtggttccaaacactattaactagtttttttataaaccagtttttaaaaattagagatagaaattagattcttaaaaaaacatatcgatttatatatcagtttataggaattagattctcattttcttaaaaaccaagaagctggtctaaaaaataaaaactggttttttaaaaactaggtccaggtcgcatcccaatgtttccgttccctttcggcctgcatatgcttctgctatatatatggcggatgttgtatttgttcaaatattcgtcaaactccattaatgaaaataattcagaactaccggtaactaatctcacggtttttattgttttggaaaacacgacaactaatcattggtaccggaggccctgaactactgggcctaatccgattcaatatctcggcccacgatgcaacgggtgatcagtttttcccgttcgaatttcggagccctcctctcctccccgctccagcgcccctgcagttctcgctccactgacagctcgccgaggggccgcgccgcgctcgagacccgtcgatggcgaggcggagcctggcggtcgacgcaaccgcaggcgccgcatcccgggttcggttcgcgcccacctccaataacctgctcgtctcctcatgggattcggtgagagctctctccccgcctcgcggttcctttcggcttaggcatcctctccttgccagttctgcttgggtcgagtttgagggagatgcgaacagttctaaaatttctttgaggttggggggtggggttgggtgggttgtattttcagtaaatcgcaccgggtccagctcatttcgaattccaatttggggcgcgctcaggtcgatttaaaattttggggagttcgttagcagtgtctgatagggttttgcgtcgtcgtcgcaggggctgcggttgtacgatgccgacgagggcacgctcagggtcaacgtggagtcagaggcggcattcctcgactgctgcttcgaggatgagtctgcagcgtttgcctgcggctctgatggatctgtgagaaggtaagatttaaaatagttgcaattcgttactgtctctggctgcatgatagcatgagtgtgcatcttgtactgacggccaacttccacataatttatgtctttgaagtggtagcaattaagcaaaggtctaccagttacaatctgttaggagtaatcacaaatctacaatttgaacttttgttgacttcttgagatggcatttgatgttaatgcatgacagtgcaaataaggtatgatagttccatttatccatgtttctttgcttcatgacattctttaagtgggacatttataagataaacataaacaataataatacttactccactagcactttttatgtgcaaccgcaactacattgaatcagagacgattgttgttcgccgcctcctcctcctcctgctgcttactctgtcaagtacagccgcattgtccatgttaacttagtttaacttggaaactgtataccatccatttactttacgggcaacattctcaggtacgacttccactcaggttcgcaggatacggtggggctccatgaagatgcactagcctgcattgagttctcttcactgaccggtaaacaatcttatatcttgacgattttgtgtttattacctggatcttttggcaccgaataactctatagcaccctatgtacatgttctcatctcatcacctggtcctgaagtatttgtattgacatgatgtttatttttgcatcaattttttttgggtactcaattttaagaccagtgttgtatctgaaccatctcaaatgggatcactgaaatgtgctgctgaagctaaggggtgtttggttcccaacctcctaaaactttagtcagttcagtcacttttagttcctaaaataccaaatggagtgactaaaataagtcttccgaataggatttctagggactaaagtttagtcccaaaatttaggagtgggactaaaggaacgaaatacccccttactctatccatctcaaaataagcgtacttctcgcttccgaaggagttaatctttttagatttgatcatataaaagagttactaatatatttttacgatgaacttatctagacatatagatattgatagtattttttatatacttagttttaaaagtttaacttcttaaataagagatgtatttttctggaacggaagcgctgcacttccgctttaggtttatctgccttatatttattttagtgcccaaaaccagtttgactactgcgtgtcctggtcagataattgggagggtgtgtgtgtgtgggcatttgtttggttttgggatgacttaagattggttgaatctgttttaggtcaggtttaatttaatttttttgttgttgaaaaggatggatccattttagtttcatgttggttggaagaatattcaggagtaggctgagtcattcacatgcaggacccatttggcaacctctaacggtctaaccctatacatgtccattagtacgtactgggatgatccggcccaagcatggcttggcccgacacggttaagaccgggctgagctcggcacaccaacagttcggtgctgggccaggctgcattacgggctgtgacgaaggtcattaaaacgataaaacattgaaacactcatggatgaagttttgacttctaaacgtttaaatgtaattttaaaaaatataggaaataccaatatatcataatttcngacaataacatgaagttaattaccaaaataaagaggttagtaacttaccaaaatagaggcagagaggatgagaggcgtcgactgctgagtgctgaccaccggctgctagcaaatagaggcgcagagggagagggcagcacaaagggagaggaatgccacgaacaacgcggacggctcacactgcggagaagcggttgcacacaccgcgaaaggagggcacactcgtcgcgaagggagagggcgcacaaggtgtagcagacgacaggaacaacaccttcgggcggcgacgacgataaagagcagagctgtgtgctactagccattgggcttcagggcatgggagtagggcaagcgtgtggagattgggctgcattggacccaaaagtaactaataaactgggcccaaaagtagctaatggtctaaaacgcatgagacaatattttacagtttagaacgccaaaatgcggtttcaacctctaattagcgttttgacgtttaaacgccgtttaaacgtagttttaataacactggccgtgaccaaggcctaggcctggcacgcctaactcgtaattaggtcgggccgtgtcgggggcacgattagcctatccgtgccgggtagcctgacagcccggttagcacagtacacaagacatacatatataacattttcacaaattcagattacatcaaaatcatcccaaaaatcaatatacatgccaaattcatcacaaatccagaatccatatcaagatatcacaaaattcacaacatttagatcaaatcaatatacatgacataataatcacgaatccagattctagctcgacaaaatcaccgtaattcacaacattcagatcaagatcatcacaacacaaagggggcatacccagtgttgtaggcttttcgcactgtgcggggtttgggggaagggtatctttaagcgccaagccttacccacataatatgtagaggatggggctcgaacccgagaccttcaggttacagactgtaggctctaccgctgcaccaggcccgcccttcaagatcatcacaacacgagtgaataataatggagccttagtacaatgttgcctcgttaaaaaccttcctagataaaaactcacatctcgtgagaaaaccctagaaaaaagagtatatccagctccttataggttttagttcaaatgttcaacagtccatgtccaacacttcatagacattacaagaggtctatagaaataaataaaaagaactccaacaggtagcaacaatcctaaaccaccactgcaatgcaccaacactctagcatgcatctttaaagggtcatcactgcttgcttgggtcttcatccaggtacatagcatcaaaggtagcttcaagttctttggtttccttgtccactgtgtgctgcttatgttgttctgctagttcctagtccttgatgcaagagagaacatccaccatgtttgttgttaggcgtcgtcgtcgctcctcgagcaccctgccagctagactaaatgtaccacctactggctggggattggtattcaagcaaaccagtgcaacacgttcaacaatattagtaccagtatgtgctacttcaataggttttagacccaagcaatctcttttctgacaccccaatcagagtaactaa

SEQ ID NO: 3260 - DNA, 4166 bp, Zea mays
  misc_feature (3524)..(3524): n is a, c, g, or t
ctctttcttcaccttcaggtaaacaagtcagcagtgtaacttttttagcacccagatataatgatgctgaccccccaaattgcgtccctcctggccggccggggcctgccactgccagttataaccactttgtttaccaaggtcagaatagttcagttggatggattgcacaaagtcctctggaaccttctgttatcaataattttgctagagttgaccgtccacatcatttgaatatgggtacatttactgcccccgtctctattcctcaaatagacaatccttcaattgtctccccgatgggttcttgcacagcagacccaaggagcagcgttatcaataatcctgctttaattccaagattcaatgggttctcaactgtgaattcgtacaccagtcttagtgctgtgacgcagagcattggaacttcaatcccaaagctgataaatgtggataatgtagataaacgctatcgtggttttccacttgattcgttttccgtgtctcactcacgacatcaggtagcagtttcaagtaacctggagcaaaagaattcccagaagttggaagattcagatcaacagtcccatggcaagggtatgaagaacttcaatttgaatgagacactgtcagattgtcaggaagatggtcttgtagaacaagatgggagatgtgcttccagttttcagcatgataaagatggggggtcagtacttgggatctcttggctcaaaaacaaacctatgtctgctgatccaacagctgtggagaagccagggaagatttttggacattcattgggaactgcaatagagctgaaaaatactaaagaccagaacgaaccagctgtgactattcggaatttgtcagattctgcttctacatctgttggctgtgcaattaagaaggataggccttcggataacattgttaccggaactctgcctgtctgtaataaagcccaagagggtgctacatgtttacctctttcgtgccagaagcatgtgcctaaagatggacaagccgctgaaggagccaccaagaaaagtggcgcccccatcaggaacttcatcgatctcaatgatgatgtaccaaatgatgacaattctgaggaatcagtagtgtcacacgaatgccacgtggaaccttcacggaacaaccatcctaaacgagcatttgtgattgatttagaggtgccggcctgtgaagaggacgcttcgtgggatattgatcaagaatgcgcgcagccgaaacctgatgcgtaccaggaagttgacgacggatctgatacatccgctctagctgcagccgagaacatcgtagcgttgtcaaggaatacgccaacagccgcagaggcatcggacgatacgttgcagtggtttgcagatctcgctgtattaaacatcaacgaccttgctgagcaagctgaactccaagcttgtacgaatgattccagtaactacgagtcggattcattcgagtccttgacactgaagctggaagagaccaagatcgacgatctctggagcaggccactggaacctgaaaccgcaaccgatgaacagacagtttcagctgctcaccttctcaccaagcccagaaggggccagcaaaggagacggcggcagaagcgagatttccagagagatgtcttgcctggcctttcgtcgctttcccggcctgagatcacagaggacgtccagttgctcgaggggttagtccaggcttccgggggatcctgggagtcgagcttgactaggcgaggacgttgtggtgggcgtgctagaggcaggaaacctcggaaaactgtagtaaccgtaattgtagaggaggaggaagaggaggaggtagaggttagcccaccgccaaaacctgctggcactggggaattggaagccgatggcaggggtatgatcgggtggggcagaacaacaaggcggtgtcgcagagcgagatgtccgtcaggtaacagcatggctactgcgtcttgagtgggagggtatttcttggcagcaagcattggacctgattaggtactgggtggttcacaattgttgtattgactccgatggatgggctggtggtataaggtgatcacactcatatgagtgtcggcctactggtctcagcacaactttcgtgcttttgggtcgaaacatggtttacgttcttataataagttcggtaaattagctggcgagacatttctgcgacagcattgtactaagctgttccaggttatgaggcccggtgccccggtatatattcattgtgagaaaaactgcaatgcatgtaaaccaccttgatctctgaagaatagctcatcacatgtgtaacaaaagggtgtgaatgaggctctgagcctgtattctttttgtagctgtatgccctgcctaattggcgctagtatccagcatgcgaattgctaatttagttttataccgtggatatggctcatctcgtgtcccaacgcttttcttccctatgggaatgcatatgccactgctatgtataaggcaaatactgtaattatttgttcaaatatttgccaaactctatctccaatagtgtcttaaactagtgccctattttaaaatatagtttaaaatatagggatcaacctataaaaaatagctccagcaatatcctattttataattttttgtcaaaaaatataggacctatcataaagtgactaaaatatactacactctagactagtgtcatattcttgttttctacattattctcaacatttttctttatgtaatttacttcctaaaatgcatgatctagggctaactgttggagcagaatttgtttttagtattctaaacattttaaataatatagtattttaatttttggggcattattatgagtcactttgttggagatttaaggattgtaattcagaataattggtaacaaatctcacgtctaactatttgttattgctttggagaacacgacaactaattatactagcatatagcacatgctaacacaaagatcccgcggaggggagagaaggggttgatggcggtgtgagtgagggagaggctaggggcggcatggtcgtggggcacagggagggctaaacgatgagggacaatccaaatttattatccgttggttttgagcgagtaggggagagatgcttatccagcgatatgaattgtcgattttcatgtgtgttaagtatgggtgcaatttgttagatggatttagtggagttcatggtcgtggggtgatttggattatatagtgttattagattatagattagtactagaagcctagaactactgggcataacatgttaacccgcttcaatacttcggcccacgatacaacgagagattagtttttctgattcgaattttggagccctccactacccggtcctacagtgcccactcctctaatagcttgccgagggggcgtgtcgcgctcgagacccgtcgatggtgaggagcctggtagtcaacgcaaccgcaggcgttgcatctcggctttggttngcacccacctccaacaacctgtttgtctcctcatgggattcagtgtgagctctctgcccaccttgtcctcgtagttccttgcgacttaggcatcctcgtcttgccacttctagttggaccgagtttgagggagttgcaaacaattctaaaattcgtggaggtcaaagagttctaaatttcttactaacacttttgagtttatcatcacagtttcatgcaaatgaagtgttttgaaaacctcaaatcctttattacacatacttaaaattgtgatgacatcaacactaaaaagggggattgaaagcatttaggcacctaattgtgtttcgatgattacagtgacactagattattgtgactaacatatgctttgtagagacaatataagttaggtcatgttaatgacaattaattgggatacatggatttcatgctcctatggacgatattcatttttttactttcgaaggatgagttggaagtttaaggatttactagttctaagtgtcgagagttaatggacacgtatattagtgatagaatctttattttctttagtcatactataaagaagggtatggaatgctagcttttagactacaccaaaatcccttaagcaaacatgttagtcttaaagggcca

SEQ ID NO: 3261 - DNA, 7628 bp, Zea mays
  misc_feature (3746)..(3746): n is a, c, g, or t
  misc_feature (4759)..(4759): n is a, c, g, or t
cttcatttacctatagaacacagacacattatgcaaatgtttctagtgaagattagtgacttacacgatgtaaaagaatgtttagcaaagaggaaactttatttatatggtttacttattattaggcatcctaaaaaaggtgtggcgtctgaggaaggaatagtcgaggcaagctttttgcagatagtggctgcgtcgaacccaagcacgctaagaaattttgatatatagtggtacaggctgcaagcctttttggacttgaatagtttagttggatacttggatgttgaggaacctcgtggcagttgttatctccaaatattattggttctcatggcctgctaattgcatgctgagtatttaattgctagatatagcttcacgtccttgcacacttgaaattgcatgttttcagcgttagaaaaaagcaggacggggccataaacttatagttcgtttggttttctcactaatttgtttgtttgatttgtagaatggaatgagttgatctatcatcatatcattcttcttagttagttagtattaatatgatgaatgtggtcatcccaccaaatttgatgaatagatctatgatataccacctcattttggatgaagctcatttttagataaagtgttgccccacgtctccctaatcctgcaaatgttgaaattgcccttgactatctccagaagagccgtgggattgaaaagacaaaagagcttgcacgagaacatgctgatcgtgcagtcaaggctatagaatctctacctgatagcgacgacgaggatgttctgacttcaaggcgtgctcttattgatatcacagaaagagtcatcacacggacaaaataggaaggtgttcggcgtccataaggtgaatggagagctgaacctcgcctttggcctagtgtttcacttggattttcttttttgtatacttcggttcattgcattcttttcgcagccaaaaccccaagttttgtgtatcattgctgaaatttaggattaagaaatggccctgcatttctgggaagcttctagaggttttggctgcatgtggcaacaaaatatatgtcaccgattgcaatggcaccagatatcgtgtagccatataagtgtgggagcattgtacccaatatacactcccgtaaagactaagatagtactaccataaaatatctgttaaccgttcctcttcaaattttgactcttcaaattgatggttgtttctcgtgaacacgtgtaaacttggttccgtgtgcaaattgaaaccaatgtattcaatctcccataagggcatgtatagtagagaccaaaatggttctccaaccataacatataactaaaaaactattatacaatggagtgtataaatgtagctcactaataaatactaataaatacagaagtaagactttgtttggtttgagggactaaatgttagtccctttattttagttctaggcaaacaatgggattaaaacagggactacaccgttttagtctctagtctcttaagagatgactaaatgggactaaatcatataaattccacttttgtccctcctttattttagttgcgctaatggcgtaagaatgctaaaggatattttagtcctcttatggttcatttaatgcattttgaatacttttcgtctctagaagcaaacatggcagagactaaactttagtctactaactaaattttagtctctggactaaagtaaccaaacgggccctaaatgcacttgtatagcatcgaatcgataaaacaattgatgaattcgtacaagtgaggtgtctgttgctacttaagttacgagccagagacgtatctttatatagagacgactccacattttttttttgcaaaaaacatctttagacaccttaaaagcctgtatattaggatgccgtttggttcataaaatgtaacgtaaatgataatgattcacacctgaataccggcggtaacaagtttgaataggccggtatttatttctagtgtggtatttgattatagttggatttttttttttttttttttacgttattggttatccattatgtgaaccaaacagtcacataaacgtcactgtacatggcctatgccataacgatggagcgttgcaaactgaaatgtattcaataatgaatggacgttacaaaatggcgccgttgattgacctgacgcatcatcatgattcaaggtctaacgggcctggctccagaatctctctttggcccatgcaatcgcctcatccaccgcagcagcgccgacgctgtcgatgtcgtcgccgtcgtccatcagcagcggcgcccgctccctcacctccatcactacctcctccagtcgccgcggtgccctagccagcgggttggtgaagagcgacgacgacgtggctgacggcggcgagtagtagtacccgtagtcagcgcctgagtagtcggtgatggtggtctcggcggccggtgactgcgccccgcgtgctgcctgccggaagctggtcgcattgctgctggtctccgggttcgacgtgaagcaacagaagctgctgccccctcggtggttccggtggtgtcgcgttgctgccgacccgtcgccgccggctctgctgtggttcgacctgctgccggcggccttggcgtcgtcgccgtagtagtagcgagctgccgggtacggggccgtcgagcacgtggagctgctctggtagtactcccctctcgtcgacgtcgatggcggcgacgagtcatatcgccgcgaagggatcgtcaccggcctgccatgtatacagcggccgcaatcatcttaattagcattaataaagatgatcccgatgcatgctttgtattaggcattttgtgaagcatttttcatcgtccagcttctccactggcacgactgtcaatcagtcattcaatgagctcctacctgagcctagatgtgaaggaggagagcgtggcgtctgcgcggctgccgccgccggcggtggccaccggccggcagaagccggcggatgggaactcgtcggagctgaccgccgacgatgacttggacttggaactcgacctcgacctcatgtgacgacgggcgccgaagatgtcgtcgaagaagccctgctccgtgggcacggccgccgcgcgcccgttggcgtaaggccggcgacagaaggcctcggcaccgccgtagctcgtgtactggtggccgtggcccgtcggggagtggtagtcaaccgcctcgccgccgaagctgcggaggagcaccgtgcgaggtggcccaccgtacacgtcccggaagtcgtcgggggctaggttctggtggccggcggcgtgctggtccgacgaccgctgcctcggcagcaccgagcccatcgtgcacctccacgactcgtccatcctttctctctggcttatctgcgagctagagagctttgtgcgtgcgaatggaggtggtgatctttattcaaaggagagcgatggagctagctatatatataggccaagcaggaaatagcttgacgctttttgtttcgtcagatgcatgtgtatatatactagtagctcgttctgcatgcatgaatgcatctctgtttgtaggtacagaaacggtacgaacatgtactgttagcatcttttcaaactgcacatgttgaccccccaactaatttcctgctgtagggattaagctgaattgttttctgaaactggtgctttgttttgcctccatctggtgaaagtagttnttcccaacagtagtgtctgttataccatacacgtacatacataaacacatggttaaatgtagccagtcaaactttgaaagcatgcatgatgaagtactcaaatggccataatcatgtgtaacagctttgctaatcctgtactgtagttacgctggttcgtacacacatttacgcaacttttgcctacggtttatgatgtagcacatacagccgtgctatgcatagcacactagccaatctctctattgacaggttttgttttatgttgcttagctgttgatgtagtctgggatatgataattagatgaataatgctgtgtgcaacaggtgagtagccaatggattgattgacattaccttttggaggggaggaggcatgtgatgtgggatgattgtgttctgctaccctctttgtagacagagcatcatggtggctgatacatgccctcattcttccaaactcctcactcttcattctcatgcatgttattttttttataaatgcactccctgttccacttcacactactacttttttgtgtgtgttttatttattttggtgctcttgcactgtgtagcactcaaccatgttatcactacgtttagaatttagatgtgctatcgaataattatccatctgaaagctgaacagtctaggaccaatccagtgtccatggaaaaggctactaggtagagacagatcaaagtggttaatcactctagcatcaggcaaaccttttcctttttggaccaaattaacaccaagcatagtgtgtctgcctcaggtttaaacaacactagcaacttgaggcactacaactcaggagcagctcaccattaggctgcaaatcatgtggagtgtgcttaaagctgtaagcttggggtactaaaagtgagctacaacttgtgactgcagatgcccctatacatcgcgcatgtttaaaaactccagcaaaatcttggccagaatcacatggatgtttatttaagttactaccctgcaatcccagatncacatacaactgtgcctccctgtatttgtatgatctatggagatcatgcatgctatatctccacggatccacaacagctcagcatgctcaaaaccatctgcatcagaaatactaagcaaattagacatggatgtttgtcagcttatttcaggcataaaaaactgagatccttcctttgaaaaaaggaacatattttacttttactgcagcctgctggactggaccccgctgtgttcttcctatgatcagtcagtcagtcccaaattcagagcatgcagatcaactgatcaagtatgtctgtccattcattgcccatcatgaatcccagtcaaatgtcgagcttgactccacacgcatacatgcactttccggagttttttcattcacagacaaacataaaagacatttcagagtgaaaaaaatgaggctctagattttatcaagtgcgttagtagtttgtttgggtaatcgattattagccttggtggctataaagtatgaatacgtagccgcatcatcggttgtaattaatgaagcaagaataactggccttgagattcgtgttcatgctctgtcagaagagctttgccatacctgtaactgtaaggctctcaacatctaacgatgaataaaaaaaaacagttaaaaacggcttaaaatactgatttggtaaaaaaatgtggtgatcctttcagattcaggtaggttgcagcaagaacagtggcggcgtagctcggccggtgccagcagcccagcaggcagcttcttgcagttgcaggggcagcagacacagacaggatcaaggacgggaatgattcggtgtcccacaaggcgtgagcaggccaggcaacgatcggagcgagggggcggcggtgatgcgcatgattcgccggtgtccccctcgccggctgcaaaagctcgcggcgccaatatttgtgcgagcaaaggtggagcagcgccgcagcaggctggggcttttgtgctcaagctgattcctgaaaagaagcgtaaagaaggcgagcaggagagcaatctacgcaaagcgccatgataaccactgcaatttgtggggacgtcatggagctaactagtgtaggttcaacataactaaaagacgaaatctttcgcctgaaattcatatgcgcactccttgtgcatgtatttatatgactcgcctctacatatgtttttttttcatttcccttttttgaaagaagaaaaaagaaaagggcaaaaggacgaacattttaggtgtgcatcttcaggtgagacactgaatatgcctgcagaggggattcaaatctagctttgtagattgttaatgatccatggagaacatgtcgagcaaatcggcatactacctgttacgcagctttgagagacaagctcatgatgatgcaccacaaactagcaacatgcattagtggcagaggaatggaacaccatggacttttgagcttctgatacctccttccatcgcaagagtgcatgtggaccaccagctagcaatgttgggagcagaggggagaccaaaccgtgcctgcaaattgctaagctttccaggctttaaaagaagcaagagctcagctttacacacatgtatgtatgtacatgagaccaaactatagctttctcctttttcacttttatatacttatacacaatcatcgcaaaggaatactaataggcggctctggcagcccaaacggcagaggctcaccctgcagttggtgctggcagtaactgaagaattcatgcaagacactgcaaaactatctgcattgctcatgttaacctcacctttcgtccaatcctgtgcatgctcgtgtgctctggcgcagttttgtgagattagtttagtcagtttggttcccagattggccctagaaacgaagttcacgaggttttctttgcaaggatgccttcgtgagtatgtgcaaaggtgaggcagacctgtaaagttcatgcatcggctagaggaaatttgcatgaaaataagactatggaatggaagcctggaatgtggtgatctcatgaaacgagactaagtactagttaagacacatttcgcagatattctaaatctcaaaggaatttttcctagagaaaatattttttatttcctgatgaaacaaatttttttaggagctcaataaaagagactattagagtgtttggtttgaaaaatcattctatctaaaatgaggtgatgcttcacgagtttatttcttaaatttggtatgatgatctcatttcttcatattattactaactaactaactataagaaatggggtagtgatagatcaacccattccattccataaaccaaacaaaaaatgagtaatgaaaagatgatggactagctcaatgctcaaactaaacatcatatatatgctatggtacgctatataatataacacatggggtcttctgtgacgatcatgtattaactttattagagttattttaaccatagtacatctctactatattaaagcatcagtttcatcggtcgtcttgcatcatctttttacaaagaactccttgtattttttcaaaatcaacccgtggtaccagatcatatcccatccctatcctatttattcgcacaacaacattctcacatctgtcgctctagcaacaaaccccgtccatttcgcaacaacctccgaccgcttcttccgccgttgcaccgccaccagcgaggaggattagggcgcttgtctctggataaggatgctcactaggtgataaaagttgcatcgagtctacccaactctagacctcgtcaccaaaagggaccgggagcccgtctgcaagctcactcgtctttcgctccgacacgagctccactccgctcctcccat

SEQ ID NO: 3262 - DNA, 1735 bp, Zea mays
gttccaacccacaaaccgagcggcggccgccgcctcccttttcgtctctgactttttctacaagctcattcttcctcccccgatctcgggagcagccgaagcatgtcctggcggtggactctcgcgcgccgcgtcgccacgctggccgcgatcggtggcggcggtgcccaggcgcagaggctcctgtccacctcgtcagccggcggtggcactggcctcctgggtcggcactacatacccctcgcctcccagattcggagcaaggtagttggttgcagaggagctgctcttgtgagctccagatggttgcatgaggcccaataccaggttcgccaggacggggcttccagggctcaggaacagcaagatccatttgaattagtcgccgatgagctatcacttcttgcaaataggttacgatccatggtggctgctgaggtccccaaactggcatcagcagctgagtactttttcaaggtgggagcagagggaaaaagattccgacctacggttttgttgctcatggcatcagctctgaaatttcctttgtcagagtcaacagaaggaagagttctcagtatattggcagataaactccgcacaaggcaacagaacattgctgagataactgaaatgattcatgtcgcaagccttctgcatgatgatgttcttgatgatgctgatactaggcgtggtgtcagttcattgaatctcatcatggggaacaagctttctgtgctggctggtgatttccttctgtctagagcatgtgtggcccttgcagcacttgggaacacagaggtggtttctctaatggcaactgctgtagaacatctagttactggtgaaactatgcagatctcaacaagcagagagcaacggcgaagcatggagtactacctgcagaagacatactacaaaacggcatcattgatatcaaatagttgcaaggctgttgctattcttgcagggcacacagctgaggtctcggtgcttgcatatgaatatggtcgaaacctgggtctagccttccagttaattgatgatgttcttgatttcaccggcacctctgcatcccttgggaagggttcattgtctgatattcgccacggaattattactgccccgatgctatatgcgatggaggaattcccacaactgcaagaagttgttgaccggggttttgataatcctgcaaatgttgaaattgcccttgactatctccagaagagccgtgggattgaaaagacaaaagagcttgcacgagaacatgctgatcgtgcagtcaaggctatagaatctctacctgatagcgacgacgaggatgttctgacttcaaggcgtgctcttattgatatcacagaaagagtcatcacacggacaaaataggaaggtgttcggcgtccataaggtgaatggagagctgaacctcgcctttggcctagtgtttcacttggattttcttttttgtatacttcggttcattgcattcttttcgcagccaaaaccccaagttttgtgtatcattgctgaaatttaggattaagaaatggccctgcatttctgggaagcttctagaggttttggctgcatgtggcaacaaaatatatgtcaccgattgcaatggcaccagatatcgtgtagccatataagtgtgggagcattgtacccaatatacactcccgtaaagactaagatagtactaccataaaatatctgttaaccgttcctcttc

SEQ ID NO: 3263 - DNA, 1950 bp, Zea mays
aattacaagacgggttgttcatccatgcaaatattgttgcggtgtggagccaaaccagccgaaaagaagggcgataaagatgtagcacgcgaagagcatttatgtacctactcgcacctcctcctccgtcagttctgatctgcttctccagtctccacacaacacaacagagcagaaggcagcacgggcgctgatgtcgatgggggaggcgctgcgggcggctgccgctgacgcggtggtgacattcctgtgggtgctgtgcgtctccacgctgggggcctcgacgacggcggtgacgtcctacctgaggctgcagggcgtccacttcgcgctcctggtcaccgtctccctcctctccgtcctcctcttcgtcttcaatatcctttgcgacgcactcggcggcgctagcttcaaccccaccggcgtcgccgccttctacgccgccggagtcaccagcccctctctcttctccatcgcgctccgattaccggcacaggctgccggcgctgtgggcggtgctcttgccatctcggagctgatgccggcgcagtacaggcacatgcttggggggccctcgctcaaggtggatccccacacaggcgccggcgccgaattagtgcttacttttgtcatcaccctggccgtgctcttgatcatagtcaaggggccccgcaaccccgtcccggcgtcgccgccttctacgccgccggagtcaccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttaaagaaaaaagcacaaccctcaaaatgcagcatatccaatgcagattattctgatgatgaagtttcttcatgtacaagcagagaggaaggccttgattgtccaatatgctgggaatccttcaacctcgtggagaatgttccctatgtcttgtggtgtggccacacaatgtgcaaaaactgcatccttggtcttcactgggcagttgtcaagttcccgtcccttcctatccagctgcctttgttcatctcatgcccctggtgcaacctgctgtctttccgcctggtttacaagggcaacctcaggttcccacgcaagaactactttctgctctggatggtcgagagcatgaacggtgggagagcaaaattccattccactaaccatgacgagcatcattccacgtggcattcaagtgccggcacaagctccagccatcaacagcgaagaaatgctgctgtaggatcagagagctcttctggcagagagacaggcgtaggccgcaacattttccacaccgacaacattagtgcttctctgcaaaagcttatggtgtgcttcatgcagctgacggccaagttcccactcgtgataatctttctgctgatagtcctttatgctgtccctgcaagtgctgctgttctggttctctacgcccttgtcacgtttttgtttgcactgccctcatttttgatcctctactttgcctaccccagcttggattggcttgtcagagagatcttcgcttaattcgtgctgtctgaaatgtccgcgcagtttgtatccctgcgacaaatgatatatattggtatatgtattccatgggccacctgccctcgtaggccctgtatagtttcttcttattctctgtccttgtagcactctatttctgttgtaactaacagcttattaaaaatgctctgcaatgcttttatttgtggttcaaaaaaaaaaagcggccacaaaagagtaaaaaaaaactcgagggggggcccggtacccaattcg

SEQ ID NO: 3264 - DNA, 1213 bp, Zea mays
aattacaagacgggttgttcatccatgcaaatattgttgcggtgtggagccaaaccagccgaaaagaagggcgataaaggggtacctcgcggccggccgggatgtacctactcgcacctcctcctccgtcagttctgatctgcttctccagtctccacacaacacaacagagcagaaggcagcacgggcgctgatggcgatgggggaggcgctgcgggcggctgccgctgacgcggtggtgacattcctgtgggtgctgtgcgtctccacgctgggggcctcgacgacggcggtgacgtcctacctgaggctgcagggcgtccacttcgcgctcctggtcaccgtctccctcctctccgtcctcctcttcgtcttcaatatcctttgcgacgcactcggcggcgctagcttcaaccccaccggcgtcgccgccttctacgccgccggagtcaccagcccctctctcttctccatcgcgctccgattaccggcacaggctgccggcgctgtgggcggtgctcttgccatctcggagctgatgccggcgcagtacaggcacatgcttggggggccctcgctcaaggtggatccccacacaggcgccggcgccgaattagtgcttacttttgtcatcaccctggccgtgctcttgatcatagtcaaggggccccgcaaccccatcatcaagacatggatgatctccatctgcactctgtgcctcgtcctctctggtgcagcatacaccggcccttccatgaacccagccaatgcatttggctgggcatatgttaacaaccgccataatacgtgggagcagttctatgtgtactggatatgtcccttcattggtgccattcttgctgcgtggatcttcagggctatgttcctaacaccgccacctaagcccaaggccaagaaagcatgatgaacatcatttggtcatggatgctggatttgataagtcaacatgaattgctagaataagaggaacgccaataagttcctggttcccagcatgttgaattaaattgattaatgtgatactctattactcgtaccatttatcataaggttctttatgcgaatatgaaatatctacctgtgtatatacacatgtactttcctgttggttgttgcgtcctgacctgtggaccaaaaaggttcaatatgaatggtcaaaaaggatattatgatcacaaaaaaaaaaaaaaaa

SEQ ID NO: 3265 - DNA, 1170 bp, Zea mays
gcgctcggccctcgtgcgagcctcgggtattcaatttctgaaggtcgaggcgtgaaagaaaaactccggaggtcgaatggcggcggcggagaagcccgcggcggtgcggcgagcggaggagctagtggagagggagatgggcgggcgcgacgcctcccacgacgccgcgcacgcgctccgcgtccgagaccttgcgctctcgctcgcagccgaagagggcctctccgctcccgaccgcctcctcaccgtggaactggccgctctcctgcacgacgttggagattacaagtataccaagaacaatgtggaggatatgagcgtcgttgagatgtttcttcaagaggtaggattggatgaaggccaaaaggatgaaatagtggcaattattaaggggatggggttcaaaaatgaagtttcaaataaatctattgttgagcccactcttgaatttgcaattgtacaagatgcagatcgcttggatgcaattggggcaattggtattgcaagatgttttacatatggtggtagcaagaacagcgcattacatgatcctagaattctgccacgtgatagcttgtcgaaagaaaagtacatgtccaaggaagagaagcagacatcaatcaatcattttcatgagaagctttttaaactgaaggacatgatgaagacagaggccgggaaaaggagagctgagaaaaggcataggttcatggaggaatttgtggctgaattctacgaagagtggagtggcagggcttgaggttgaacaaccaggttttgacttgagcctatgtcaaagtgtgcagttggcgaaccatttctcaacaacccatgatgatgttgtctacctgggcctactttttgccgatgaagccacgcaaataaacaatggaaagcctatttagattggctggacaaatcatacggttctgtgataagcaatcaacccactaccaattccgtggatgaagctgaatttttttttcaaacagatgacatggcatcttgctgctgttgtattgaaataatactgctacaatattaccggttacatcacctgaaggtcaagcgttttgccaacacatatacatatgtatctatacatatatataaaagttctatactagatgtaaatgaaacaaatgaagagccctgcttctttcatactgt

SEQ ID NO: 3266 - DNA, 1324 bp, Zea mays
  misc_feature (26)..(26): n is a, c, g, or t
cattgggtacctcgaggccggccggngaaaaaatacaaaaaaggggaaaaaaaaaaaaaaaatttacaaaaaaaactagaactccacttccgtgttagctttgccctcgtgcgagactctggtactcaatttctgaaggtcgaggcgtgaaagaaaaactccggaggtcgaaatggcggcggcggtgcggcgagcggaggagctggtggagagggagatgggcgggcgcgatgcctcccacgacgccgcgcacgcgctccgcgtccgagaccttgcgctctcgctcgcagccgaagagggcctctccgctcccgaccgcctcctcaccgtggaactggccgctctcctgcacgacgttggagattacaagtataccaagaacaatgtggaggatataagcgtcgttgagatgtttcttcaagaggtaggattggatgaaggccaaaaggatgaaatagtggcaattattaaggggatggggttcaaaaatgaagtttcaaataaatctattgttgagcccactcttgaatttgcaattgtacaagatgcagatcgcttggatgcaattggggcaattggtattgcaagatgttttacatatggtggtagcaagaacagcgcattacatgatcctagaattctgccacgtgatagcttgtcgaaggaaaagtacatgtccaaggaagagaagcagacatcaatcaatcattttcatgagaagctttttaaactgaaggacatgatgaagacagaggccgggaaaaggagagctgagaaaaggcataggttcatggaggaatttgtggctgaattctacgaagagtggagtggcagggcttgaggttgaacaaccagattttgagcctgtgtcaaagtgtgcagttggcgaaccatttctcaacaacccatgatgatgttgtctacctggcctacttttttgccgatgaagccaggcaaataaacaatggtttgtccagcctattagattggctggacaaatcatacggtcctgtgataagctatcaacccactaccaattccgtggatgaagctggatttttttttccaaacagatgccatggcatcttgctgctgttgtattgaaataatactgctacaatattaccggttacatcacctgaaggtcaagcgttttgccaacacatatacatatgtatctatacatatatatagaagttctatactagatgtaaatgaaacaaatgaagagccctgcttctttcatactgtatatctctcttcagtctcaaagtcttattggcaagctcggctcggcaccaacagttcaaagcttggtcttgtc

SEQ ID NO: 3267 - DNA, 3575 bp, Zea mays
  misc_feature (1542)..(1542): n is a, c, g, or t
ttgggtaccccctcgagggcccggcccgcagcaaaaagttacctacagctcactcccaacggaagcaagaaccaccgctcactcactcgccattcggcagaggcgtgactgactgaaactgagcactagggctttgagagtgcagcagaggagggcgaaccatgggcgaggaggagaaggcgaaggaggcggcgcccccggccgacaaagtaaaggaggcggaggagaagaagggcgaggggggaggaggggaggagaagaagaacgaggccccgtctcttccaccgccgccgccggaggaggtggtcatgcgggtcttcatgcactgcgagggttgtgcgcgcaaggtcaagaagattctcaagggatttgatggtgttgaagatgttattgcagatacgaaggcacacaaggtggtcgttaaggggaaaaaggcagctgctgacccaatgaaggtggtggaacgggtgcagaagaagacaggccgcaaggtagagcttctctcaccaatgccaccaccgaaagaagagaagaaggaagaggagaaaaaggaagaacctgagccaccaaaaaccgagaagaaagaggaggcaacggtgctcgctgtggtgctcaaggtgcatatgcattgtgaggcttgcacacaagtgatcaagaagagaatcctcaagatgaaaggcgtgcaatctgtagaggcagacctcaaggcttctcaagtcactgtgaagggtgtgttcgaggaggccaagctgtctgattatgtgtataggcgcactggcaagcacgctgctatcgtcaagtctgagccggttgcagctgagaatgttgatgatggaaatgccaaggatgacaagaaggcagccgaaggtggggaggagaagaaggatgatggcaaggaggaaaagaaagatgaagacaagaaagaagcggataaacagaaggatgatggcaatgctggtgatgaagggaaagacaaagaccctggcgccgttgctaacatgtatatgcactacccgaggtccaatcatctgagcgaatacggatatgcctaccagtacccacctcagctcttcagcgacgagaacccgaatgcctgttctctgatgtgagaaagccagaaccaagtgaccttaagcgcgaaaataagaggggattgagttatcccctgattttggaggttcaggaagtttagaacttttcttttctatttctaaggttgaactttctgtctggtacaaagtgaactctgggctggtttgtggacatcatattgtgtatgctactggttagtaggattttgtgttgcacctttcacctttggcttttatttttgtacaaagatgtattatatatgctagttttgaaatagcttgctgctagtactctgtagtctgttgtccggaatagacggagctttctcagttaacattgccagtgatgtcggaaaaatccatattcttggtgtccttttctaactatatgttgttggttgaacataaagcaggttcgtcttgttttgtgtcagtctggcctagttcagcngcattctttcaacagatgccaattgacagcattcattacccagttggcaatggcacttctcatgtctgtgcctcggttgtggaactgaaaattaagggtcatgctcgttgcaaaggctagctgcaattttgaaacctcgaggaaaatgcattagcggttctacttttgcatgcagataaccaaacacataccttgcacgtgtagagcctggttgacaacgatcaaataacagatcattgcatcccgcgatgtaagcacgagcagatatggacaaccaaatggattgttaggtcttgtactttgtatgagatatcacttgggtccccaaagtttgattagcatgctttaacgtggcacgctatgtcgccatttaggttgaccaaatttggttttgaacggttttgtaaggaccgactacgttagagtattcgttttgctggttttctgagtttggtaacccaagtaatatagcatgctaagtttgaggagccctgaggcattttattttatttagaagaaataaatctcatgttttatgtctgatgaagtagcatgaatgtaggaggaggcacactgcctactggtgttctgtgtggtcagggtccaaaggcagaagagaagtgcttctcatgtgcatgggtccatccaccacccatccatccaggtccacggcaccatcatggctacaaacgcagagcacatagctcaggtcgatccttttcacctttgttcgttttttttaaaacacgggtagcatcatgctagcatatgctcaagcaagtgatggtcagtcacattcagcctgcagccatgtgtggcgtggttgctgtaaacggcttccctctgaaccccagtcgaaaagcatgcggcagccttgctgtgaatacccagcagctgcagctcagctctgtggctgtgtttttgccaggacggtgaaagaggcaaggatgcagtgacttgaggctgcaaccatgccatgcccatcactccatcaggtgtattgggtagcatcaaagtctcgtgacgatcccgcccgctctactgctccgcattcaatgcgcctgtagtgtggcatgccaaccgtgccccattcggccagaatttacatgcgctgattgaactacttttctagtacgattgtgcatacgagctttcaaaatattactattttatattatacacaatactgtttatagagtaaaatttaaaataagagataatttaaaataagagacgagatacaatagctgacgaagacagcttaataggactgtttcgaacgcattttcctagagacgaaaaaacatgctagcattaatacaaataatctctatagtgacggttatgaacctattttcacttacgttttttagaaccgtcggtactaagtcccagtagaaatcatcatttttacaggcagctaagtgaggattgccagtgaaaatcgattttcactgcgcgatcgacgtaataaaaccgatggtaaaaattattttcagaaacattaaacgagttttaaaaacaacaaaaaaattatttaaggagaggactcggcccaccccacctgcccgtctccgtcgaagtcgcagtttttcgcgtaaaattcaggcgctatgcggttgttaggaatcaaaccaccgacctcaccatcgcgcgtaccctccactaccattctgactatggcatactttgtgtctactttgtagttttttgtccatatattacaaccaactgagtgtaaattgcttgtttgagaccataaacgaattaaaataaaaaagttgtcaactataaagttgaataacttttgaagttctacaactttcattttgacactttttttcatccaagatagtttgcgaaatttgaattttaaatttgacatacttagattcaatttttgagaactgaaatgagttcaaataaaaaagttgtcaactacaaggtctcataatttttagagatctataacttttttatgattttatcatacgaggtcgttgaaaaactgaaaaattaaggataaaagattc

SEQ ID NO: 3268 - DNA, 2592 bp, Zea mays
gggtaccccctcggggccgcccggcaccaaaatgtaagaaaacgcacgccccggcgctggccgctagtcaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggccgaggcccgcgcgatggcccgcgccgctggcgccacagtctacagtcccgagctcctcgccgcccgctacggctcccgccccttcaaggtggcgctccgggcaggggaggtgctgtccaagttggcgtcgttcggggtgaaggtcctactggacgagcggagaggggagtcgtcatcggagaggaggcgcgccagggcggtggagttgcgcaccatcttcactaggctcggcccaaccttcgtcaaaattggacagggcctgtccacgcgccccgacctctgcccggccgagtacctcgaggagctcgccgagctgcaggattcacttcccacatttccggatgaagaggcatttgcatgtattgagagagagcttggcttcacgcttgattcaatctactcgacaatttcaccttcccccattgcagcggctagtttaggtcaagtttataaagcacggttgaaatactctgggaagctggtagctgtgaaggtgcagagacccagtattgagaaagccattgggcttgatttttatctacttagaggacttggctttcttataaataagtatgttgacattgtaaccagcgatgttgttgccctcatcgatgaatttgctcgaagagtttttcaagagcttaattatgttcaggaaggccaaaatgcaagaaggtttaagaaattatatgccgataagcaagatgtattagtgcctgatatattttgggattacacaagtgcaaaggttctaacaatggagtggattgagggtgtaaaattaaaccaacaagcagttattgaaagtcaaggattgaaggttctggatttggtcaacattggtatccagtgtagcttgagacagcttctggagtatggttactttcatgcagaccctcatcctggtaatatattagcaacgcctcacccgtgacggccggcccgggattttggcatgatgagtgaaacaccagaggatgcgagggtagccattataggacatgttgtccacttagtcaacagggactacgaagcaatggctcgtgattattatgcactagatttcttggaacccgatgtagatgtttccccgattgtgcctgctctcaagaatttttttgatgatgcactaaatgcaacagtgagtgagttgaacttcaagacaatagttgatggcctaggtgctgttctctatcagtacccattcaatgtaccagcatactatgcattgatactgcgatcgctcaccgtactggaaggtttagcactctatgctgaccctgattttaaggtgcttgctgcatcatacccttactttgcgaaaaggctactgactgatcccaacccatatctcagagatgctttaattgagcttgtattcaaggatggaaaattcagatggaataggcttgaaaatcttcttgttcaagggcgccaagatagggagtttgcagccaaagatgcactgcagcctgttctaaagcttctccttggtcctggtggggaggaattgcgtgcgttagttgtgaaagaggcagttcgtgtgacagaagccatcgccattggaacactggtcgattcatacaatgcagctccatcatttttgaagccattaatttccagcggcaatctagctgaaccctttaagtttagtgagactgaacaagaacagatgatggagctccgagaccaggttttcagagtatggggtcttttgagatcctcaaataactttgatccgagccttttgcagccaatcgttcaggttctacaagaaccagaggcccgtgtcttgggttctcgtgtcgcaggtggtgtaacacagcgccttgcggcacgtctgctgcaacagcttctcaggacccctcctgctcctggatcttcttagcagatatatagatataggctcgtatgattgtatgaagcatgtaaattgacacgatatttttcacaggaaatgagaaggaagcacaacccagaattcgagtatatagctagtttcttggttctaagtggataaagacattgtgcatcgagctttgtccagcagaccgtgtatatagttgtgtaaaaaacattgttttgtgctgtagattacactgtttacggagtgaagattgaaatgataaaacatggacgagtgagctgctaagatgtcacgcagctttgttccaaaaagagaaaataataagcggccagaaggatataaggaagaag

SEQ ID NO: 3269 - DNA, 2539 bp, Zea mays
ctctcttaatagagtagtatatattatgaaatttagagtttattgttatccctacttatagtgcactctgcaatagggcattggcgctgccatacgcccatacgttataaacattctaatgttatcacaaggtatatattcagccgcccatctagtgcatcatgaggcttagttatttgttacatctcattttccatatttactttttctatttggacctaagttatttgttgactatgtgtaaattaagtctttttgtttgaaatattttaattttcgttccataaaaataatcttgataatttgtttcctttactgtttttaatttttttgtatgttttttctttgaaacgtttcaatttgccttccataaaaacaatctgctgactaatttgtttgattttgcctttgattttttttgtctgttttatttgctttttctttaaaattttcaaatttgtcttccttagaaagatctggataatatatttcttattttatctatgttttatttggtttgtcttttaaatcattcaatttgtcttccatagaaatattctggttatttattttgtttattttatttaatattttttgtattatgttaataatttttacttagttcatttgatcttgattaaatggttatgagaacccagtgtttgataaattgatagtcttgaaacattgcattatctttatctgaaaagatttgtgcctttgtttattgtagccgtctacactcgagtgtcacgagacaaaccacgttagatgtcatatagcccgagatctgcggatctcagtttcctgttttatttatccatgaccatgagccgacgaagtggatagagctattcttgtgatcggtgatgtacgaccttttgtttctttgcgaatcttgaaccagtatcaatcgcaggcagagctttctggcaccatgcgacatctccgcgccgccccaaagatccaagctccccacccttcctcatggtcatggcggcacctcgtgttctagttctgccttaccccgcccagggccatgtcatccctatgatggagctctcccactgcctcatcgagcacggcgtcaaggtcaccttcgtcaacaccgaggtaaaccaccgtctcattcttggtgccttggcgaccggagacaaagaactcggcggggtcgacatggtgtccataccggacggcctgggctccggcgaagaccggaaggacctcggccgtctcaccgactcgttctccaaggtcatgcccggcgagctggagaagctcattacaagcatcaacgccgatggacgagagcgcgagaaggccagctggttgatcgccgacgtgaacatggcgtgggccttccctgtggcgaagaagcacggcctccgaaccgccgggttctgcccatcgtcggcggcgatgttcgcgatgaggatcagaattcctgagatgataagcgacggcgttcttgacgagagaggctggcccaagcggcgcggcgcgttccagttggctccggcgatgccggccatcgacacttcggagttctcgtggaaccgcgccgccgacgccaaggggaagccgatcatctttcagctgatcctccggaacaacgcggccacgcacctcgccgagaccatcgtctgcaactccatccaagagctggagcccggagccttggcgctcgtccccgacgtcttccccgtgggcccgctctcctccgacaaaccggtcggctgcttctgggccgaagacgcctcctgccccgcgtggctggacgcgcagccggccagctccgtcgtgtacgtcgcgttcggcagcctcgccgcctacgacgccgcgcagctagtcgagctggccgaggggctgctgctgacctcccggccgttcctgtgggtggtcaggccggggtcggcgggcgagcagcaccttgagcagctccgccgccgcgccgcgccgcgcgggcgcgtggtgagctggtgcccgcagcagaacgtgctggcgcaccccgcggtcgcctgtttcctgacgcactgcggctggaactcgacgatggaggcggtgcggaacggcgtgccgctcctgtgctggccgtacttcaccgaccagtttctgaaccagagctacatctgcgacgtgtggaggacgggactgaaggttccattgccgccagggacggcgcacggaacgggactcgtggggagagacgttgttcgggacaagatcgaggagctgctccgtgacagtgagacgaaggcgagggcgctcgcgctgcgggacctcgccagtcgggcagtcggcgatggaggttcgtcgcgccggaatctcaggcagttcttgggccttgtgcgaggatcggagagctaaagctgcaattttggggctactgttgtgtttgcgaatcgcgatgccaggacaaaggtctgcaccctgcagtctgcaccgtgaaaaatcctgtttcgatgttctgaaaaattgaaaaacatgtacaatatatcctgattggaatcactacaagcatctttttttcaaaaaaaaa

SEQ ID NO: 3270 - DNA, 2342 bp, Zea mays
tgagccgcccggcccgggagcgggaccggagtagcgccagcgtcccattcccggccaacctccctgttcatctccatgccgacctgactcggtatgataagatccatgtgatccagagcctgatccgaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatcccagccttttgtttgcttctctgtctcctgctgattggtgtccccgggtccaggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagctttttggtttcattgcttctgaattggccaagtttgttgacgatgatgagaagtgcgctaacatttcgaatggcaagaagcgagaaatagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaaagatgttgtcgctggtgtaatatttggcactggcacaaacgcagcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccgaaaattttgaagaaaacctagagattacaggcacatccttggaggctcgtaagctggtcgttgaaatctgtgacattgtggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgatgacggctcaggaataggtgctgccctgattgcagcttcacagtctcagtacaaaaacgacttagtggccgtcaagcatgcagatgacggttcaggagtcaagtatgcagaagacaagcgtgcagatgacggttcagaaataggtgctgccctgattgcagcctcgcaatctcagtagagagatgtcctgagtggtatagaggtagcaagtagctatgatttgtttccaacgtcttaactgtccagcgtctgcagtttagcatgctagagctggatgcgatctgtaaccaaaaccaggcttggccaactggctgttcataattccaataacagcagggttgcagatgtctcctaaaaaaaaaaaaaaaacaccttcccatccttcccatccctttcattgattattatcgaaaaccccaaaccc

SEQ ID NO: 3271 - DNA, 2059 bp, Zea mays
cattgggtacctcgaggccggccggggtcgagcccaacaccaaatgcagccgagtccaacagagtcatcctcatacatcgatacatcgttcactctcgtcgttctccccgatcggttccggcctcgcgttcgtcgtctccttccccctcgccggccgcgtgatctgcctgccgcgcggacgccgcgggcgcgacgatgcacgacccgtcggagatccgcaacctccccatcgacatcgcctttggccgcctccaggagtggctcgtggaccgcaagcgagtgccgcacgactggcggaagcgcctcgccggtattcgcgcccgcatcgcgcccgctttctccgccctgccgcggaacctgcacccctcactcctcgccctcgatccagaagaaattggctaccttgaagcaaagaagatatacagcattctcctagaatccaacaccgagagtcgcaacatatttggccgcctgacgggatccgcgggtgaatgggagtcaattattaaagcttacgagaaggaccatgtcttccttggagaggcagcgcagatcatggttcaaaatgttaactatgacattccatatcagaggaagcagatgcagaagactcagcagcagcttgcagagcttgatcgaagggaggctgacatcaagcgtcttgcggcattgtcagcgactagatatgtagaagcctgccaggaactcggtttacagggaataaatgtgagggaagaactaatagagtccgcaaaaacactcccatctacttttagcaaaatcttggaggtcctgaacagtgatcctgtctcaaatgctatggagtactacacaacttttgttaaggactgccatactgaggacaagagaaatagtgattctgtgctacccaaactgaaagacttgcaggccaatcctccttctttgcatgtctcagtatataatgagatcaagagttctcttggagaggcatcaaaatctcctgggtttactgtgatcgcgggagaaattgactcaaatgttgctgctgctgatgatattgattgggacatttctgtggatactaatgaaattgattgggacattggtgctgtggaacaacctggtgaagaatctggcgatggctttggatcgtatgaaattattgatgctaatatagagctggccggttctgaaaattataatgttggtgtctcagacaaatcaatgaacaaagaagatcttgcatcatctgagtctggtatttgctgggacatcactgctgatagttctgaagaaattgctagtatacagaatgcttcatctgtattagagcaatctcagtctcaaatgatagctgaagatagaagtttgttgctggagaaagaatataggaataatattctggatgatttactcgaggtaaaatcatttttgactcaacgcttaggggagatgaggaatgcagacacatcatctctacagcatcaagtgcaagctgtctcaccttttgttctccagcagcatgctcctgacagtttggagaacatgcttgtagagatctcgtcagcaatctcattgctaactaatcagaagactcttgaccttataatgatccttaactctaaaaggtttctggatagattagtttcaagcttagaagagaagaagcatcacgaagtaaaactacgggaaggtttaggtgatttatctgttaagcgtatggagctgcaaaacgcactgtcatcatcatggccaaagcaagaggcagcaattacaaaaacaagggaactaaagaagctgtgtgagtcgacactgtcgtctgtttttgatggaagaccagtgtatataattggagagatcaatactttactgagctcaagtgttagtcaattagctggatgactgtatttccgttcctggaccaaataagattgcaaaaatattatcttatggtatatacttctgaatatttatggtttaaaaaaaaaaaaaaaaaaaaaaaaaacggcccccgccaccaagtaatctgctcgacccgccaataattaccgccccggcaccaccagcaggcgcacca

SEQ ID NO: 3272 - DNA, 2073 bp, Zea mays
ggaaagcacgagaccattacctagaacatcctaatcgaaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgccgccaagccgtcgtccgccgtctcgcagcagcaggccggggccgccgccactgtcactgccgccgccgccttcaagaccggcgccgccatccctgacgccggcggccggaccgttgtgtgcgacatgcacggcgccctgctgcgctccaccgcgctcttcccctacttcatgctcgtggcctgcgagggcggcagcctcgtccgcgccatgctgctgctctgcgccttccccctcgtctgggcgctcggggagcgccgcggcgccggcgtccgggtgatggcgttcgtcaccttcgcggggctcaggcccagggacgtggacctcgtggcccgcgccgtcctgcccaagcactacatggagcagctcagcgcgctggcgtacggcagcctctggctcccggccaggaggaaggtggcggtgaccagcgcgccgcgggtcatgtccgagtggttcctcaaggagtacatggccgccgacgcggtggtcgggctcgagctgcagcacgtcaacgtcggccgccgccggtacttcactgggttgctgctgtcgtccggtcacgcgacgggaacggagctgaggcagaaggcgatcacggaggcgttgttaggcgccgaggacgaccccattgccgtcgtgggcatcatcagcgactccagcccgctcgacgacgagctcttcgtcccctactgcaaggaactttacgtcgtgagcagagagagcgcaaagaacgacaagctctcgcgggagaaatacccaaagccgctcatcttccacgacgggcgcctcgccttcctccccacccccgccgccatgctcgccttcttcctcttccttccgctcggcgtcgtcctctccgtcatccgcattaacatcggtatcgttctcccttacaagatcaacttcgcgacagccgcgatcttcggcgtccgcttccgcgcctccggcctccgcgccccgccggcagacggcgagcggcggaggggcgtcctctacgtgtgcacgcaccggacgcttgtcgaccccatcatgctcaccacggcgctgcagaagcccgtgccggccttgacgtacagcctcagccgcctgtccgagctgatcgcgcccatcaagacggtgcggctgacgcgcgaccgcgcgcgggacgccgagaccatgtccaggctgctggcgcagggcgacctcgcggtctgccccgagggaaccacctgccgcgagccttacctcctgcgcttcagcccgctgttcgcggagctcgcggacgacatggagcccgtggcgctggacgctcaggtgacgacgctctacggcaccacggcgagcggacacaagtggctcgaccctgtggcgttcttcgccaacccggtgccctcgtaccgggtggagtttctgggtgccgttccgcgggagtggacgcgcgccgggggcaggacaggcgtcgaggtggctaactgggtgcagcggcggctgggccaggctctggacttcgagtgcaccgggctgtctcgccgcgacaagtacatgatgctcgccggtaacgatggcgtggtcgccaagtagagagagcgcccggcgcgcgctgcaacagctgggtgtgtttttattatgcatacatgctgggtaaattattgtcgaaagctagttcgttactgtaatttgcatggcagtaatggatcttttggttccgctgtgtagagaaaatttgattagctgcaaaactaatcaaatactagatgcttggatttaaattcaaatcaaaatagtatatatatattttgtctaacaaaaaaaaaaaaaaaacggcc

SEQ ID NO: 3273 - DNA, 2071 bp, Zea mays
gaccctcgggcccggccgggatgccctccactgcagcctgcaccacacggcccctggcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttccagctctacaaccgtaggaccgccgccaagccgccgtcgttctccgtctcccagcagcaggccggtgccgccaccttcaagaccgacgccgccatccctgacgccgccggccggaccgtcgtctgtgacgtgcacggagccctgctgcgctcctccgcgctcttcccctacttcatggtcgtggcctacgagggcggcagccttctgcgcgccatgctgctgctctgcgccttccctctcgtctgggcactcggggagcgccgcggcggcgctggcgccgtccgggtgatggcgttcgtcaccttcgcggggctcaggcccagggacatggacctcgtggcccgcgccgtcctgcccaagcactacatggagcagctcaacgcgctggtgtacggcagcctgtggctcccggccaggaggaaggtggcggtgaccggcgcgccgcgggtgatgtccgagtggttcctcaaggagtacctggccgccgacgcagtggtcggcctcgagctgcagctcgtcacggtcggccgctgccggtacttcacgggattgctgtcaggccccgcgacggggccggagctgaggcacaaggcgctcatggaggctctaggcgccgaggacgacaccgtggccgacgtgggcatcatcagcaactccaacccgctcgaccacgtcccatactgcaaggaagtttatgtcgtgaacgcagggaacactgtgtttgactcgccaccgcgggtcaaatacccgaagccgctcatcttccacgacgggcgccttgccttcctgcccacccccgccgccatgcttgccttcttcctcttccttccgctcggcgtcatcctctccgtcatccgcattaacatcggcatcgttctcccttacaaggtcaacttcgtggccggcgcgatcttcggcgtccgcttccgcgcctctgggctccgcgccccgccggccgacggcgagcagcgcaggggcgtcctctacgtgtgcacgcaccggacgctggtcgaccccatcatgctcaccacggccctgcagaagcccgtgcccgccttgacgtacagcctcagccggctgtccgagctgatcgcgcccatcaagacggtgcggctgacgcgcgaccgcgcgcgggacgccgacaccatgtccaggctgctgaagcaaggcgacctcgcggtctgccccgagggcaccacctgccgcgagccgtacctgctgcgcttcagcccgctgttcgcggagctcgcggacgacatggagcccgtggccctggacgctcaggtgacgatgctctacggcacgacggcgagtggccacaagtggctggatcccgtcgcgttcttcgccaacccggtgccatcgtaccgggtggagttcctggggaccgtgccgcgggagtggacgcgcgccgggggcaggaccggcgtggaggtggccaactgggtgcagcggcgactgggcgaggcactggagttcgagtgcaccgagctcactcgccgtgacaagtacatgatgctggcgggcaacgacggcgtggtcgccaagtagagagcgcctgccgtgcatgcgctgcaacagttgggtgtggtttttattatgcatatacatgctgggtatattattgtcaaaagctagttactgtattttgcatggcagcaatggatcctttggttccgttgtgtaaagaatctttgattagctgcacaactcaacgaatactagatgcttgaatttaacttc

SEQ ID NO: 3274 - DNA, 4000 bp, Zea mays
  misc_feature (47)..(47): n is a, c, g, or t
  misc_feature (3938)..(3943): n is a, c, g, or t
  misc_feature (3945)..(3946): n is a, c, g, or t
  misc_feature (3965)..(3968): n is a, c, g, or t
  misc_feature (3984)..(3984): n is a, c, g, or t
  misc_feature (3986)..(3986): n is a, c, g, or t
taagacgtcttctatgattgaaattgtatagataaataattcagtcntcttgattcagctagaataagctagttctactatttggaaaaacaatgtgataatccttgagcctaaagagcctatgaaggaaaataaagtcttagatcatgtggtgatgctataaaattccaatggtaatcaagagagattcaagtcaagatcaatatatacaaatctttcaatcttggggcgcattagtgctaggaatatgggtcgggctttttgggccagcacgagcacgacttaaaaataggagccaaaagcatgacccaacacgaaataatatgggccggactagcacgacccaaaggcgggcctaggccgggcctcaaattctggcccctcgaccgcccaacactgcctgcacgcgtgggccaggcttgggaaaaaacagctcaatgaagctcatattacttaatttctttaatttggtatgatatagactttatatggtgtaatatttaaactttatgttgtcaaatgatgcttgcattgtttaatatctttagtttagtaagttatgcactttatgtggttgtaatattcgaattttatatgattcaaatatatgggtcgggtttgagtcggcacgacccaacgaagacacgatgtgttttagggctgggatggaccactgtttttactcattggactggcacgacacgatccaaaaaaaatttggactttttggacacaaacccgtttgatccgaaacatgatgggttcgagccaggccgggccgacccgggccaattgcgagcactagggcgcatgcccaaactcccgtggataaaataaaatcatccactagtgctattcttcaaacaaggtcaactaggccaactttaaaagtcagccagattgattctaatgctgatgaacaacaaaaatcagcaagaccaattttccaaatcgatcaagctagctgcaaagcatacttgtatattgtatttttaagcatctatagcttgggactaggagattaaggaaactagaatcaccagtcatcgacaacggatcatcaaacatcaaaactttagaattaactggatctagatccatttttcttacactcgttttccaatctacttctctcattcttcattaacgcagtatggttggtagatcagtgagggcaatctataatcatcgcaggttttgattggttttcgagagatctcactgtgacttacatatcttaaacatatatgaagaggcaccatatttgattatcaacattgcttaagcatcgatcgagctaaaaatcgactagacattacgtgcaccggccgatgtatctacttatcgttacggtcaacaacaaggtaagatgtccatctcatctttcaaatgattggagcccctgctgtacggaatggagaatcgggggtaactgcagtagcgtcatgctaaaacgcatgcacatcgtggggcccgtcccagtcatactagattcacgcttccagcaagcaaagcaagctgttctgcgcaccggacgcggacggacagcctgctctgcctctactgaactacttcgccactgcacctcccactccctgcctgcccctctacaaatctctcctgctccactcttctccacgtccatcccgcgccccgaatttcccgagccaactccgccccgccctgtcgctttcccttccacacgcgccgttcgctttgatcgatcaggcaggcatggccgacgagacgaagcaagaagccgccgccccggcggccgaggtggtcgtgacggaggaggagaagaaggcagaagagaccgccccggtggcggaggaaaaggccgtggaggcggctgtagagaaggccgcggaggcggaggcgggggccgaggaaaaggccgcggaagcggactcggaggaggagaagaaggcggaggaggccgaggaggccgccgcgggcgatgaggcggccgtgatcgatggcactgggtcgttcaaggaggagagtaacctggtgtccgagctccccgaccctgagcgcacagcgctcgcgcagctcaaggagctcgtcgccaccgcgctcgctaacggggagttcaacctgccgccgccgccagccaaggaggaggccaagaaggaggagccggcaaaggaagaagctccggcggacaaggaggacgagcccaaggcagaggaggcggctgcccaagagcccgtcaaggaggaggccaagcctgaggagcccaaaacggaggcgccggcggaagcagcgcccgaggaggttaaggacgagacacccgtgccggaagagaccaagactgaggctcccgcgccggaggagcccaaggccgaggagcctgccaaggaggagctcaaggcagaggcggcgacggaagcggtcgccgaggagaccaaaccagctgagccggtgccggaggaggaggagaagacggtcgttgttgccgaggaggaggccaccaaaacggtggaagccatcgaggagacggtcgccgccgccgccgccgcgtccgaggagcccgaggcgggcgagccgaaggaggagctgatctggggcgtgccgctggcgggcgacgacgagcgcacggacacggtgctgctcaagttcctccgcgcgcgcgagttcaaggtgaaggaggcgatggcgatgctcaagtcggcggtgctgtggcgcaagcggttcggcatcgacgagctcctcctggacgccgacctcggcctgcgggagctggagggcgtggtgttctaccgcggcgccgaccgcgagggccacccggtctgctacaacgtgtacggcgagttccaggacaaggagctgtacgagagggccttcggcgacgaggagaagcgggagcgcttcctcaagtggcgcatccagctcctggagcgcggcatccgggagcagctcgacttctcgcccagcggcatctgctccatggtgcaggtcaccgacctcaagaactcgccgcccatgctcggcaagcaccgcgccgtcacgcgccaggctctcgccctgctacaggacaactacccggagttcgtggccaagaaggtgttcatcaacgtgccgtggtggtacctggcggcaaacaaggtgatgagcccattcctgactcagcgcaccaagagcaagatcgtcttctgcagccccggcaagtcggcggagaccctcttcaggtacatcgccccggagcaagtccccgtccagttcggcggcctgtacaaggaggacgacaccgagttctccacctccgacgccgtcaccgagctcaccgtgaaaccgtcctccaaggagaccgtcgagatcccagccaccgagaactccaccgtggtgtgggagctccgcgtgctggggtgggaggtgagctacggcgccgagttcacccccgacgcggagggcggctacaccgtcatcgtgcagaagacgcggaaggtccccgcccacgaggagcccatcatgaagggcagcttcaaggccacggagcccggcaagctggtgctgggcgtgaacaacccggcgtccaggaagaagaagctgctgtgccggttcaaggtgaggagcgccgccgcctgatgagggtcgttggtctgggtcccagcaggtacagcctgccagctgcttgaccaccagcccgacatgtataattcgatcgatcgccaaccaggtccataccgccaccatttgaatgaacatgctgcattgcattacatgataggagagagagagagagagagagaggacaataaagagtttctgcttcctagctaggcccgttccgtgtcctggtcgttctttgattatttgttggcttgctgttcttttttttccttggggggagggtcgcgtttgtatgtgtttattacttgaatgaaaacaaaagtgagcttgttatatgagatagccatggcttgttgaggtcnnnnnnannaaaaaaaaaaaaaaaaaannnnaaaaaaaaaaaaaaananaaaaaaagggccct

SEQ ID NO: 3275 - DNA, 1336 bp, Zea mays
gcacgagcgcgtatgtataacgcgacccccctccccagtccccccagcggcaaggcggcaaccgttctcccgcgtcccgcactcccgccccttttccttttgctccttccttcctcgggaagcctagggcttaggctttaagcgccgcgatgtacggcggcggcggcggcggcgggcactacgacggaggcagcggtggcgccgggaacgctaacgcgctcttcggcggcgggggcttcatgccctcacagtccacggtggtcccggagaacagcggcctctctaagggtcggagcgcgcagacgctgctcccgctcaccgtgaaacagaccatggacgcggcgcaaaccagcggtgacaggtctaatttcgccatcaacggcgttgaggtgtctacgattaggcttgttggacgcatgctaggtaaggttgagcgtgtcacagatgttgtattcactcttgatgatggtactggcaagatagatgtgaatcgctgggaaaatgaggcttccgatgctaaggagatggctgatgctaataacgagaactatgtcatagtcattggcggtttgaaaggttttcaaggaaagcgccatgtagttgcctatgctgtgcggcgtgtgacaaacttcaatgaaataacctgtcactttctgcactgcattcaggtgcatatggagctcacagggttaaagatctattcttcagctgcaacatatggaggagtagcccatgccccatcacagccaaatccggttgatggaaactacatatccaacttggtcttgagtgtttttcatgacccatctgtcatggaccaggagcatggactgcacatcaaagatgtcatagatcgtctcaaactaccagatgatgtagtcagtgcggccatccaaggtcatgttgatgtgggcaacatttacaacacaattgatgacttccactacaaatctgtccggaatggatgaccacgttgcaagtccagcgttcaggctccgtgtaggtatggagccgtttcaaggaagaagaaatgtaaaccctcttcaggatcgcctatattttgcagataggcttcatggtcaacagcttagcatatcggtttaggtgtgtattgctctcatatgtaatgatacataagatgtgagtagactaggtctacctgcaggacatcagtccgttcctacggaaatttgttatgaacgttttacattctaagacctatataaccgtgaagcacgcaaatcaagaatagaaccgcaaaaaaaatggcagagggacattgagtaagacttctcctgaaacgaactgactacacggacgaagatttgttcaccag

SEQ ID NO: 3276 - DNA, 2038 bp, Zea mays
  misc_feature (234)..(234): n is a, c, g, or t
tatacagtctgaagaaacaaacgctacatataggaaaaagaggataataaactccataaagattaaacacaatcataagaagcaccacatattttagttatgttgatctccgatagcctttaagaccaatattttattgctataagaaatttgtacatatggttgatccactcttagtaccctactgcataaactcactttaaacattggttcaaagtaccattttttgtggcngttaagaccaatatttatttacttcaatacatgcatgtatccacaccctctgcaagcagcaccattataatattgttgcttctagggtgcttatgttgttatatttatagaatgaactgttttaatactacatactattgttgcttctatacatctaaagctacactttttaaatggtgtaaacaaatcaaccaaagactcgcgcatggcgcgggcaaattactagtgattgtaattcatggcattgttcaagtgtcgagcttcatatcctgtaagttcagttggtatagtaatgcaatgtatttttacaattatgaagcggtcacatttatgttttccttcaaaacttcattaaacatcgagtctctagagatataattttttgttttagtatgacataatttctcacatgcaatggtaatgtaaaatttgtttgtatttttatgtatgaacacttatgaattctttatcttttacatttgctttattattcaaatatttgcaactgacatacgtcgaattatcttgggatctttatattggtgcccttactttggactgccttctcattgctacccctaattttactttgtgctcagttttgcccctccacgagctaactgacctcagggggacacttatacgcggtttacatctgatttccgtccactttattgtgcttgacagtggggccccaaaaaaactttccccaatctcattctgaatcaaacagcagcttcttgctcccgagtcggccagcacgcgccgccgggccgcatctcgtctccctcctcgaagcacctcctctccctggctccacgacgcggcggcctgctagctctctgggcgggctactaattctccggatggtgtcgactgctacttctccgatgccgcgcgcgcggcccgtgcggtccgctgcgcctccgtcggatgcgcaagcaggaggcggacgcgcggcccgctgtgcctccttgcgcccccatcgcccgaggcagaccgtcgtgctcgcctgctccatccggtcccgtcgtcgaggagtcctcttcgccggcgtcgcgcccgtctctgtgtttcccatgtcgtggcggcgtgctcctctgcgccggcgccgcacaacctcatgtcagctttcgtcgctgcgatgcccacggccggcggtgtgctcctccctactccacgcccaccttcgcccgaccttcagctgcgcgtcgtgatgcagcgagactcgagctgcgtgttcctgtacgcgtcgatctgctgcttccttcggcttcgtcaggactccggccttgtcgagctcctctcctcgcgtcgcgctcctgctccatcgaacaacagagctgttcatgccccgtccgcggcactatccgtctccgtcaagcggggacattagcaacttctgcggcctcctcccctcgcggtggggtttcagtgaacgacagtaggcttgtaggctcattgtgttgtaggagctttgctgaaatgacagaaatttgcatgtgttgtaagagcttcgcggactgaattgatgtgatgcatgtgcttgaaatcagtgtgttgttgcatcttgttgctaaaatctgaaactgaaacagattgaggtgttgttgccgaaatctgaaactgaaacagattgaggtgttgttgctgaaatctgaaactgaaacgcggccagattgaggtgtttttgctgctaaactgaggtccatattcatgctgcagtctgaaatagagacagaaatctgaaattgaaacatgcacatggcgcagtggttgttggatccaatccgaaactgaaact

SEQ ID NO: 3277 - DNA, 854 bp, Zea mays
attgggtacctcgaggccggccgggaagaagaggccggccgggtccggggggaatcggctcagaaacgcaggcagcccagcccacgccgcgaggaagcctgaggccgagagaggactgagcaagcgtcccgcgagaaactggtgttccggaccaccacgcggatgggctcgggcgacccggcggccgaccccctttcttccttcctccgccaccccggcgcgttctccttctcccgtcgcgtcgccatggcgcgcgacgccaccgccacatccgtgccagcgctccgcccctggctcgttgacctcctcccgctcctcgtcgtcctcctcatcgccgcccacgtcctcgccctcggttactggatctacaggctcgccacggacgggtccaggcagcccgcgcggagcaagaagcactaaggggacggcgcccgcggccggatgcttgaaaccagtttgttatttcagtcctgcatccttggcttgttgatctccaagccttccaacgtcagatgatggcgtggaaagttcctgaaagaactaggacagggaaccgatcttatccaatggtttgttcagatgttggtgtcaaaagtgacgatagctgaatagctgatatgtggaaggaggcccttttgagcataaatagttttcggttgctggataggtttgacatctctcgacctctccgtgtaaagaacagtagctagacagatgtgccgtttcatatgttgtggcctggtgggcttttgtaattcatgagcagcattttattactgggcaattaagttaacgaggcatactataatgttaaaaaagagagcaaaaaaaaaaaaaaaacaagcggcccccta

SEQ ID NO: 3278 - DNA, 2350 bp, Zea mays
ttctcgaccatcatagaattgtcatgaatatttcttccattaacgagtgcactttgattagggaaaaccattttagggaggttttcagcaagcctattagccaatatcttggtgacaatcttggcaaaactgtgtattaaactaatcggtctaaaatcctttacctccacggcctcagccttttttgtaagagagtcacataagcggagtcaatgagataaagcttggatctgattatttattttccagacttgcagtccacgtgtacctattaactcaaattatcccaccaaatatccaagtccaaattatatcttgcttccaaactccttttcaagacaaatcggaatacacgagtgagcaagtcatgggtgcaaggcaaatccctaatccccatttctaaatctctaaccctagcgtaccgagcttggcgtggcggcggcagtgtcccgggctcccagcggcacagttgtgcggcacgagcgcagcctctgtgcctaggctgcgcctgcacgtcggccggcggcacgcggtggctaataggctggaggcaccgtctgagcggctgcccaccaggcactagcaagggagtacccaaggttaaaatcctggctttggcactgttcgggaattgtggtgattctgcctgttctttatctatctaatagatttgaggtgtgttggtgatttttagtttgtttgctgttcctgaactaaaatttaagttttgtgtgtctttgtaacaatgatctcagcagagatggaccaaatacaaatagagggtgcatttgtcggttcaaaccaagacctgtttccgtaagggccacttcgttttattctcaatccatgtgttttggacgagattgagtaggtttaaattcctagcaagtcaaaattcttccgatcctatccaattcatatgggatgagaataatcgaacaaggcctaatagagttttccttagattttaaaatctgcaataaaagaagacaacatgcattgcgttatattcattcacaatgaagaactgtttgggcatatattacatccaagaaccaaaatttgctgggtatattttacacttactgtttttttacccctgcatacagtggtccagctcccactatggttctaaccagcaatatttcggttcagaagaccttgtacgaggttttatctgtgagtgaagacgctacatacgatgagatccgcgcagcatacaggtctgccgctctgaacacgcaccctgacaaagcgcagacaactctcgagtcatcatccgtgccttccactgcccggctcgaacccccgcgcccgcagaaggctggggaagtcctacgacatcctacatccagagcatattatgacaagcagctgcagtcatccagacaaagcatcgagatcatcgcatctgaaatccaagtcggggacatgatcgtcgagagcgctgctggtgctctagagctgctgtacccatgcaggtgtggcgattatttctccatcacttcgggtgaacttagcgggatggggattgtcgtcactggggatggagaagaggtagaagggctgcaggcgtcggattccgggtcggcttctgtcgttctgggctgtggctcctgttctctcaaaatacggctggttatagatggaagctcatgatcacatttcaggctctggttgcacgctgttcagcagtgtggtcagtttgaatgcttaacaaccacctccacatgtttgtcaaacagtatgcaattcccggtctgctgaaaatcttgcagcttatcccgatggtggttgcattgtgataaatggcattttgaccgttgttatcagctaacgaccatcgtcaagtccagctgctgggagttcaaagatgttccggtggtggttattcggtagatgtttagttaatgttgtttttctaggccaatttaatggtctcatcggtcagccattcacctaaacgatggctaaactaacgggttttttatttggtatcagctgaatgaatgctgggtgtttttgatagctgctgatgagaaagaagtgttggctgtggctgttggtgttgtattgaataacttgtgaccgtatctgtactgctaaacatgggcagcatcccatgcagaagtagaacggctatgtatctgtatctttagaatttgatattcgtaaaactgtacctgccgttaccgccgagtctggcatgttcggctcctggattggtatccggaacgatttatataaggatcagctgaaatgattatgggtgaattccggcacaaacgaacatgtccttaggccttgttcgtttacatcagattgtgcccgggatcgttccagctaatca

SEQ ID NO: 3279 - DNA, 1371 bp, Zea mays
  misc_feature (1326)..(1327): n is a, c, g, or t
gcccgcccggccgggaaaatcccctagttcctagtttctcttccaaatttcagacctctacgcacgcaggtcgtaggctatcctcaatccccgatcccgtgcggcggcggttccatagcaacacagtacggcaagacggcaagtccaagtttgcagcgattgcagctccactgctccccaccttctcgccgtgcacgcctgcgcagcgcgcggcgaacggttcgtcggtgccgtggtcgtggtcgtgcgcgagcgcctgtccacggcgggcccacggcgaggtgcgaagccgctacagggcccacggcgagcactgaccgccgagcgggcgaggccgtgacaagcacccactaggtgtccagcacaacagcacgccaggaacagtggtccagctcccactatggttctaaccagcaatatttcggttcagaagaccttgtacgaggttttatctgtgagtgaagacgctacatacgatgagatccgcgcagcatacaggtctgccgctctgaacacgcaccctgacaaagcgcagacaactctcgagtcatcatccgtgccttccactgagcaacaggaattttctagcgtgcagaaagcatgggaagtcctacgacatcctacatccagagcatattatgacaagcagctgcagtcatccagacaaagcatcgagatcatcgcatctgaaatccaagtcggggacatgatcgtcgagagcgctgctggtgctctagagctgctgtacccatgcaggtgtggcgattatttctccatcacttcgggtgaacttagcgggatggggattgtcgtcactggggatggagaagaggtagaagggctgcaggcgtcggattccgggtcggcttctgtcgttctgggctgtggctcctgttctctcaaaatacggctggttatagatggaacctcatgatcacatttcaggctctggttgcgcgctattcagcagtgtggtcagtttgaatgcttaacaaccaccaccacatgtttgtcaaacagtatgcaattcctgctctgctgaaaatcgtgcagcttatcccaatggtggttgcattgtgataaatggcgttttgaccgttgttatcagctaaccaccatcgtcaagtccagctgctgggagttcaaagccggtggtggttattcggtagatgtttagttaatgttgttttttctaggccaatttaatggtctcatctgtcagccattcacttaaacgatggctaaactaacggttttttttatttggtatcagctgaatgaatgcctgttgtttttgatagctgctgatgagaaagaagtgttggnngcggccgttggtgttgtaaaaaaaaaataaaaaaaaaaaaaaaa

SEQ ID NO: 3280 - DNA, 1282 bp, Zea mays
cattgggtacctcgaggccggccggggttcccgcaaacagttctcctctagggacggatcccctttcccccaactcccccaagcagccgcgaagagagatcccgcgctcaaccaccgcttctcggccgcggcccccttcggccctccttccctcctttcctccggtggccgccggggacggggaacgaagaagcctccatcactcctttcctccgttggtcgccggggacggggagcgaataagcctccctccctccttccctccggtggttgccggggacggggagcgaatcctccattcctccttccctccggtggtcgccggggaccgggatcgaagatgttctatggggccatggtttgggatccgtggctgatcgtgtcgcagatcgtgtgcctgcagtgcctctactacctgtcgctgggcgtcgccatggcgctcctcgtcggcacccgcgtcccgcgactcacccttctctacttcttcgacttcgccacgctcaccccgcgcacccccacgggttggtgcgccatcgcatcattcattcttgccgctgtcgcaggtgctgggttcatgctttatgtgattgagagagccaagaagtgcctggactttgcagcaacactctacataatccatctcttcatttgcattgtttatggtggatggccagcttccattacatggtgggttgttaatatcactggtttggcaatcatggctctcctaggtgaatacctatgcatccggcgggagttgaaagaaattccaatatcacggcttcgtgcaagtgtttaatctcacatggtaaaagagtacaggtgtttcaaattgtgttgcccctggaggtgtttgttaatatgttacttaaggaatacaatgaatgccttgttccgtggtttgcaatttgatacttagcaaacttcccatagagcgttcatctgatacccaatctcccagtaggccatgataaactgattggtctcagagttcccaccaacggaaatggcacctcagtttctaaatcattcattcaagtcctctttatgaaaaaaagcctgccctgcctcttatgaaaagaagtgttcctcccttgcctatgttctagtgacagctcgctgcttgacaacgtatgactagatatcaacatgtgcattctttagtgatatattgttcttacttcttaatgcactcatggactcttgtctagatgtatcttgcaaataatatatctagtgttatatgctaatccatgctttgctaataaaaaaaaaaaaaaaa

SEQ ID NO: 3281 - DNA, 1274 bp, Zea mays
ggtgcctcccgcccggccggcccggaccaaatcttaaaatttgtctcctttcccacaagtcccgagagcagccgcgaagagagatcccgcgctcaaccaccgattctcggccgcggcctccctcggctcctccttgatcccttcctccttccattggtggtcgccggggacggggagcgaagaagcctcccttccttccctccgttggtcgccgggaggagtgaagaagcctcccttcctcttcccctccggtggtcgccaaagacggggagcgaagaagcctgttttcctccttccgtccggtggtcgccagggacgaggagcaaagatgttctatggggccatggtgtgggatccgtggctgatcgtgtcgcagatcgtgtgcctgcagtgcctctactacttgtcgctgggcgtcgccatggcgctgctcgtcggcacccgcgtcccgcgactcaccctcctctacctcttcgacttctccacgctcaccccgcgcacccccacaggttggtgcgccatcgcatcattcctcctcgccgccgtcactggagctgggttcatgctttatgtgattgagcgagccaaaaagtgcctggactttgcagcaacactctacataatccatctcttcatttgcattgtttatggtggatggccagcttcagttacatggtgggttcttaatataactggtttggcaaccatggctctcctgggtgaatacctatgcatccggcgggagttgaaagaaattccaatatcacggcttcgtgcaagtgtttaagctcacatgctaaaagattataggtgatttcaaatggtgttatcccaggaggtgcttgttaatatgttccttaaggaatacagtgactcacaatgaatgctttattctgtgatttccaatggatacttctcaaacttcgcatagagcgttcatctgatgcccaacctcccagttgaccatgatgaactgattgatcctagaggttccaccaacggaaatggcagctcactttctaaatcctacattcaacaagtcctcccttgccccttataaaaaagagttcctggcctgcctctcatgaaagaaaacttcctcccttgcctaagttctagctacagtttgctgcttgataatgtacgactagataccaacatgtgcattcttcagtaatatattgttcttaatacaaaaaaaaaaaaaaaaatctcttgtctgtatcttgcaaatgatatttgcagtgttatatgctaattctgtaattcatgct

SEQ ID NO: 3282 - DNA, 1755 bp, Zea mays
catgccacagattattataaaagatttcagtcctccatggacgacacgacgaaggtcgtccgacacaaaggtacagctggagagccctgtcgcacccgcacccgcacccgcacgcagcggcggcagcgcagctgcgcagatcgccatctcaattctcgacccaacccccacgctggccgctgcactgagcagcaaccaccagtccttctgtccgcagcctaccacacacgccacgcctcgcctccggtctacatggccggcgaactgcgccaccgccgcgcgccgtcggaggacgagggcgtcgcctcctctcaaagactcgactccgcccccgcaggcaacggcaaggctggcacttcgtccggcggcggcgagggggcggagccgcggggcgggaagagggacgcgctagggtggctggagtggtgccgcggttggatggccatcgtgggggagttcctcttccagcgcatcgccgccagccacctggccaacccgctcgagttgcccccgctcgatggcgtctccatcgtcgtcaccggcgccaccagcggcatcgggctcgagatcgcaaggcaactcgctctcgctggggcacatgttgttatggctgtaaggagacccaaggtggcacaagagttgattcagaagtggcagaatgaaaattcagaaacaggaagaccactaaatgccgaggtgatggaacttgacctgctctccctcgactcggtcgtaaaatttgctgatgcttggaatgctcgtatggcaccgctgcacgtgttgatcaacaatgctggcatcttcgctataggagaaccccaacatttttcgaaggatggacatgaagaacacatgcaagtgaaccatcttgcacctgcattactggcgatgctgcttataccttcccttctccgaggttctcccagcagaatcgttaacgttaattcaatcatgcacagtgtaggttttgttgatgctgaagatttcaacttgagaaaacataaatatagaagttggttggcgtattcaaatagcaagttggcacaggtaaaatttagtagcatgcttcataagagaattcctgcagaagctggcatcagcataatttgtgcttctcctggaattgtcgacacgaatgttacaagagaccttcctaagattgttgtagctgcataccgttttcttccctacttcatattcgatggtcaagaaggttctaggagtgcactgtttgcagcatgtgacccccaagttccagagtactgtgagatgctcaagtcggaagactggccagtctgtgcttgcattaactacgactgtaatccgatgaacgcgtctgaagaagcgcacagccttgaaacctcgcagctggtctgggagaagacgctcgagatgatcggccttccgccggacgccctggacaagctcatcgccggagaaacagtgccgtgccgttatggacaataggatgtcgtcgcacagatccaaacaacaccacttttaagttaacagtttagaggtggtttgttccagcctttgattagagcacctctgttgtatccttttttatcctaaatttgcagggggggggggggacaccgtggaaggaagaaaaagaaactgttaacagctacaacctttgctcttttttgtgtgtgcgcaaaatgttgtaaaagagtcgtagaaacacctctccccccgttatttgactttcctaatcaatgatatactttagacacaaaaaaaaaaaaaaaa

SEQ ID NO: 3283 - DNA, 1546 bp, Zea mays
tcgacccacgccgtgcggtccacaaaccgccacgcctctcaaagattcgattccctcctccctcccactcccactcccacatggccggcgagctgcgccaccgccgcgtgccgtcggaggacggggacgagggcgccgccgcctctcaaggacccgatcccgccgccggcaacggcaaggccggcacggcgtccgagggggcggagccgcggcgcggcaagagggacgcgctcgggtggctggagtggggccgcgggtggatggccgtcgtgggggagttcctattccagcgcatcgccgccagccacctcgccaacccgctcgagctgcccccgctcgacggcgtctccgtcgtcgtcaccggcgccaccagcggcatcgggctcgagatcgcaaggcagctcgctctcgctggggcacacgttgtgatggctgttagaaggcccaaggtggcacaagacttgattcagaggtggcagaaccaaaattcagaaacaggaaggccactaaacgctgaggtgatggaacttgacctactctccctcgactcggtcgcaaattttgctgacgcttggaatgctcgtatggcacccctacacgtgctgatcaacaacgccggcatctttgctataggagaaccccagcgtttctcaaaggacggacatgaagaacacatgcaagtgaaccatcttgcacctgcgttactggcgatgctgcttataccttcccttctccgaggttctcccagcagaattgttaacgttaattcgatcatgcacactgtaggttttgtcgacgctgaagatatgaacttgagaaaacataaatatagaagttggttaggatactcaaatagcaagctggcacaggtaaaattcagtagcatgcttcacaagaaaattcctgcagaggctggcatcggtgtagtttgcgcttctcctggaattgtcgacacgaacgttgcaagagatcttcctaagattgtcgtagccgcgtaccatttgattccctacttcatatttgacgctcaagaaggttctaggagtgcactgtttgcagcatccgatccccaagtcccggaatactgcgagacgctcaagtcggaggactggccagtttgtgcctgcattaactatgactgtagtccgatgaatgcgtctgaagaagcgcacaatcttgagacctcgcagctggtctgggagaagacactggagatggtcggccttccgccggatgccctggagaagctcatcgccggagaatcagttcagtgccgttacggacaacaggatacaactttttagttagcagtttagaggtggtttgttcggttgttatgtcattttgatcctaaatttgcagggaggaaaacacagggaagggagaaaaagaatttgttgacagctaccaatctttgctctttttctgtatgtgtgcaagatgttgtgaaggaggcgtagaaacacatctcccccattatttgactattcctaatcaatgatatacttgagacagaaattaagagatacgaaaaaaaaaaaaaaaa

SEQ ID NO: 3284 - DNA, 1264 bp, Zea mays
ccggccggggaacgagaacgacgaagccaaagcaacacaccagcgcgcacgctacgaacgatgggtggcgggagccgagccctttccctctcctccctctgcgccaccaccctcgccgccgccaagcccccacagcaccccgtccccttcgccccggctcaccgcgcgctcccccaccgcctcgccgccgccatgtcctcctcttcctccccgacccccgccgcatcggtggacgccggtgccccggccccttcggcgtccaacgccatcgacttcctcacgctctgctaccgcctcaagacgaccaagagggcggggtgggtgaagcgcggggtgcaggcgcccgagtcggtggccgaccacatgtaccggatgggcgtcatggcgctcgtcgcggccgatctacccggcgtcaaccgcgacaggtgtgtcaagatggcgattgtgcacgacattgcagaagcaattgttggtgacatcaccccttctgataatgtacccaaggaagagaagaaccgcagggagaaagaagcattggaccatatgtgcgagctgcttggtggtggttcaagagcacaagaaattcgtgaactttggatggagtatgaggagaatgcgtctttggaagcgaaggttgtcaaagattttgacaaggttgagatgatacttcaagctctggagtatgaaaaggagcaaggacgggaccttgaagaattcttccaatcaacagcaggcaaatttcagacagacttgggaaaagcatgggcagcggagattgcatcgagaagaaaaacaaagtgatcaaacgatgctcattttaccacgtcggttccaagacaacttgctggcacagcatttctgttgaactttgcttttactagatgatacttcgaggtggcattgagacgtagggttgccttgggaatgtgaacttcaccacatttcttggtcctgccctgaccctgaggcatattgggcttgcgataccagggctctagataagtaagataacccactttgggtattggttgtagatgctcctgccaagggcagttagctggatccaacgggaaggttcagcaccagctggtggtgatgtaaaatccttcacttcatgaattactgtaccattaccgtttctcttgttaatccagcctcacggtttcggccttttttaatgtaattctattgttttcaagtataatgagcctgaatatttgctatatccattttggttgttgatgatgaaaaaaaaaaaaaaaaa

SEQ ID NO: 3285 - DNA, 953 bp, Zea mays
agtaccagtagcaggataactaaacgaaaataaatgaatgaatgaatgaacaagagtaagtaaaggggcgggttgccgctgaagactttcccaaacccaaactaacccttctaatccaaggctgtgaagggagctgctagccgccaccagccgccatgtctggagggatcgcgcgcggccgcctcgccgaggagcgcaaggcctggcgcaagaatcacccccacggtttcgtggcgaggccggagtcgctgaccgacgggtccgtgaacctcatggtctggaactgtaccatccccggcaagcacgggaccgattgggaaggtgggtactacccacttacccttcatttcagtgaagattacccaagcaaacctcccaaatgcaagtttccacagggttttttccatccaaatgtttatccatcaggaacagtctgcctctcaattctgaacgaggatagcgattggagacctgctatcactgttaagcagattctagttggaatacaggacttgcttgatcagcccaatccagctgatcctgctcagactgatggttatcacctattcatccaggatcctgcagaatataagcgacgtgttcgtctgcaggccaagcaatatcctgctctggtctgaggatgttggcatactagagatccatgatccatcctgcaaatctgcatggtagttgcaaaatgtatcgtctcaatttggatttgacaggatacaagttatctggcggattgcccagtgtaaacctgaaccttttatgatgtgtggtgtccggtattggcagcaaaaaacaattcgtttactgctgtaagtgctgcagccactgatattttgtctatttaacttgactgtttgtgtgttggtagtctatcttgaagacaaatgtttatcaagaaagttatatgcttagaagatgtattatgtagataactattagct

SEQ ID NO: 3286 - DNA, 4917 bp, Zea mays
  misc_feature (96)..(96): n is a, c, g, or t
  misc_feature (606)..(606): n is a, c, g, or t
  misc_feature (740)..(740): n is a, c, g, or t
  misc_feature (2215)..(2215): n is a, c, g, or t
tgaaagtaggaggttgtgatcgccaagatcaacatcatgcacatgaagatctattgtgtaaacgagtttcgaaccctaaacctaaccttccatacntcatacttgcattccgttttgccaaacaactagaactcgaccagaattttagtacaatagaaagttgccaatttggtttcttttcctataggtttgtttagatacttgctttatgacctttttcccaccaaaagattgcctaagcattgtgttatttttgaaggaaataattggaacgacttaagcccttaggctattggctgtgcttattatatattttgtttatggctacggggtggaggaccaggattccttaggtggtggtcgtggactcgtggtccgtttcaggccgaggtttgacaccccttcaccctgtagtggaagagaaggattaggcagaagggagaggtaggagaagactattgcacttcttgatcccactaagtacattggcttcgtttacaaggacatatgccaatacaagcaaggggctagtttccctctattagaccctataccttcctagcctctattgctaatcatctagctacttgcctttcgtgcctctanactgatatgcctttcccacataacatattgggcacaattggtacatgtcttggcccaaataggacttggtacatgactaagtaggactctaggtccacatgtggtattatataagttgtactaggtctgaacgnattataattctatcttcatatccagattttgtacacggcttcaattacttctaagattcctccttagtcatggtaggagcaaaccaaacaattactactagatttgaagtcttgtgattctgccatgttctttgtctcactatccctggtcctagcttgtcttggcctagagccaaaataaaactaggggccttggtataacaagcgctcacaatcacaacttgtagtgactaatgagaccaagtacatgataatagaccgagaatagtctttaggcctatgaaatgatctattagatgctttacaaaatcacaatttagatcaactcatgtacaactatgcggtatgttccctaatggactgcttctcaattaataatttataaattacaataaggaaaagggagcctacgatgcttgctttagcttgtgtggactggtgccttgctattagaaaagggaacatgtggtgcttgctctataatgcttgctttaatcttgtgtgggctagtgccctactgtcactaagttgctcgcctgcacggagtcatcaactcatcacgaagatggttggcgattagcaagttgaagcacaatcgaagtcttggtaaggcaagttgtcgtgacttgctttaggtagtgttgcttaggcgacgtcaattggtgatacgccttggtggactcattcatatgccaagtgttaatattatatattacgtacctaggtggtgtccttcctttttggggcctagagcggcaccccttttcccttatgcctcaccaccatcatctttctgacgacaatgatgacacatgttttgaccggagttgttaccaatgacttgttatagacacaacacttagttgttgaagtcgaggtaaccgatcatgataatctagtagttgtcttgatgtagtaatggttgacgtcgccgctcattgttgaaggcacaaaaaacttgagatatattgtagataaagttgtagtgcatagaaataggcctcttgcatcagaggataccattgggggcattttgcatatgttagaggacatcatagtcttgcatatgtcaagaggatgttgagcaatattgtagataagagttgtagttcataggagggacatcttgcttatgttagaggatgccattggtagcctttgacatatctgatttggagtgtcttgcatatgccagaggacattattattgcaaatgtgcactatgttacatatatcaaggacatcatagtcttgcatatgttagaggaagtggtcctcaatggcaagccaggcgtcgaggtgggtggcatgagtctcctggttgcctaagaagtgctcctcgatggtgagccaggcatcttgggctgtgccgccatagatgtgaaccatgtcttgcagcttgacagtgatggcgccaaagagccaagacagtacaatgatgtccatatgtcgccatacaagggtgacggcgtcgncgatgtcgaagaggacgtggctattgagggcgtagcactatagggtgaggaggacgagatcgcgccaccacaggtagttgctggagaggggggtccaagatgaccgacacgagcgattgaatgttggacaccatcagcctacgcgtggaggttgatgacgatgcatgcctcatggatcgcagcggcatcggcgttggaaaatgaggcgagggggctgcaccagtttgagagtggcgacaactgcacactctagggcagtgacgtctacttgttcgttcgccagggcttcgactgcggtgaggacaggggcacaacacaggcgtcgacagtagccttggcggcgacgtcagctttagcgaccaagttggccctctccttctcaacgatggcaacatcctccttggtgcggtgcacaacctcctcttgggcacgagcagcggcgagcttggcctcactggggactggcgactggcgacgccagcgacatggtggagatgagacaccgatgggaaaggagaggagggtggagcgcgactgctaggcccggtggctacggtagagttaggcggaagcgagggctataggattgtgaccataccatgatagaaaggctatctattgtaattgtatgagatatggtgttacacttacacatatataggcaaggatagccaagggtttatagaaacataagttacataaccaattaacggagatccttgcctaatagagaccgatctatttgtcaacgtagatccttgcctaatagagatcgatctatttgtcaatggagatccttgtctaatagagatagacctatctatcctttttttttctcgaaagcgcaggagaactgcgcctcataatatattaagaagaggtaaaaagaggccaagaaaagccagtacaaaacagcctccttacggaggccagtaggaagcatacaaaaaagaatccattagactctacttagctctcagctaacggtagctagatggcagagccccttggcaccagcgatctcccattgcatcctttcctcattagcagctttaagactcatggcaacactggggcctgcagccatcaaatacgcatttgtttctatgcttccacaaggtccaggctcccagaatgataagggaatcaagcccttttctagagagcccagcagcaatattccccaccgattcccaccagcctagatatgatccaacatcaggttgaggagtcaaagaatgcaggccaaaattccgtaacagcaggtaccagaattccctggagaaggaacaggtaacaaggagatgatcaatattttcatcttcttgatcacaaaaggggcacttctcaggatgactcagccctcttttagccagtctatccgctgtccagagacgattttgtgcaaccagccagatgaagaaacgacattttggcaaggcccaagttttccaaattttcttgtaatgagggaaaattacagaccccaaaaagaagccctcgtaagcaatctttgctgagtagatgccattaggagcaatactgaaaacatgtttatcctcaacctcaggctgcagctgccactctgaagtcatgtcccacaactgaagatactctgttaagactcccactgtcagaggacctttaatatcagagatccattttctgtctgtaattgcctcatagactgtcctgctattgataatcctcttgggtataatattatataaacttggagtaaggtctttaattcgcttaccatataaccacttatccttccaaaactttgtatttgtgccatctcccacctcagtaatgaccacctccatgaagaaagctctagcttttccaggaacttttatgtggagatcagaccaaggacgagtaggatcagtcttctgcagccagcgccaacgcattcgaagggcccaacataattctagaaaactagatatgccaagacctccaagctgcagtggtcggcaaactcgaccccaggctacaagacaatgacctcctcttgcctccttccggcccctccaaagaaaacccctgcgaattttatcaattgcatctagaccccattttggaatgtcaactgccatagcaaggtagaccaacatgcttgtgagaacatgctgaacctgcactctcctcccagctcgagtcatgagatctgccttccaattggggagctgatcagcaatcttctcaacaattggttggaactgctgtttggccagcttgtgtaaggaaagaggcagccccaaataagtgcaggggaatgctgaaataccccctggaatcatgttctgggcagggggatcctatagagccgagcaccttataggatagacatttgacttctgtgcattattgtgcaacccagatgcagccccaaacagttttaaaatatcaagagagagggccatatcagctgtggatggatgtaagaagagagcaacatcatctgcatacatggagaccctgtgaagtttctttctatacgaaagctgttgcagtagcccctcttcttcagccttcgaaaacaggaaacctaggacatccattactaaaataaacaacatgggtgagagaggatctccctgacgaaggcccctcttatgtataatacgacaacctggaaaaccattcaacagaacttgagtagaggaggtggcgaacaacccactaatgagatc

SEQ ID NO: 3287 - DNA, 1659 bp, Zea mays
cctttgtttgtaattaccctcccttctatgcagaccgattgggaaggtgggtactacccacttacccttcatttcagtgaagattacccaagcaaacctcccaaatgcaagtttccacagggttttttccatccaaatgtttatccatcaggaacagtctgcctctcaattctgaacgaggatagcgtaagtgctcgaagtgtattcactggctttgtttagcgttatgcctgctgaaaactttcatttcaaattgtacaatttcaggattggagacctgctatcactgttaagcagattctagttggaatacaggacttgcttgatcagcccaatccagctgatcctgctcagactgatggttatcacctattcatccaggttagaagaaaaaacaatgatcattctgctatttattttttagtttctctcaagattaatgagtttttttccacaaaaaaatacaggatcctgcagaatataagcgacgtgttccgtcgcaggccaagcaatatcctgctctggtctgaggatgttggcatactagagatccatgatccatcctgcaaatctgcatagtagttgcaaaatgtatcgtctcaatttggatttgacaggatacaagttatctggcggattgcccagtgtaaacctgaaccttttatgatgtgtggtgtccggtattggcagcaaaaaacaattcgtttactgctgtaagtgctgcagccactgatattttgtctatttaacttgactgtttgtgtgttggtagtctatcttgaagacaaatgtttatcaagaaagttatatgcttagaagatgtattatgtatataacttttagcttttttgcccccgtctgttgtcatttcaaattgcagtatggcacttacacaagtgattgtccagttttgtgggattctttctttttttttttaaaaaaacaaaactttagagtatctccaaaagttatcaaaacctactgtcttgagtttttgtttttgcacgattaagaaaaactgctgttcaataatatcttagcttcaaacaatctttgcgcacttgaaaaaattgactctattgtttggaaatatatgcgtgagtatccatcagccaatcaggaattggaaggatgtggtgaagagtaagtagaatgtggtttccaataaaaatataatactccctctggtcttttttattttttatttgttgtgttttagtttaaatgaacttgcggacaataaatatttgataatgaaggcagtacaagataaaaaaatgttaaaatggttagagtgatttaggaatagtttagtatattttacaagctagatttcatcctggccattcttgattgaagtattgcgacacctggtctttggttaaatttagagagatatcattagtgggttgttagtcacctcctctactcacgttctgttgaatggttttccaggttgtcgtattatacataggaggggccttcgtcagggagatcctctctcacccatgctgtttattttagtaatggatgtcctaggttttctgttttcgaaggctgaagaagaggggctgctgcaacagctttcatgtagaaagaaacttcatcgggtctccatgtatgtagatgatgttgctctcttcttgcatccatccacag

SEQ ID NO: 3288 - DNA, 949 bp, Zea mays
tcgaggccggccggcaaatcaacgaacaaagagaaagttagaggcggtttgtcattagactcacttcccccaaacccaaggtgcgagagctgcgaccgccgcagccgccatgtcgggaggaatcgcgcgcggccgcctcgccgaggagcgcaaggcctggcgcaagaaccacccccacggtttcgtggcgaggccggaaacgctggccgacgggtcggcgaacctcatggtctggagctgtaccatccccggcaagcaggggactgattgggaaagtgggtactacccacttacccttcatttcagtgaagattacccaagcaagcctcccaaatgcaagttcccacagggttttttccacccaaatgtttatccttcaggaacagtctgcctctcaattctcaatgaggatagtggttggagacctgctatcactgttaagcagattctagttggaatacaagacttgcttgatcagcccaatccagctgatcctgcccaaactgatggttatcacctattcatccaggatccaacagaatataagcgacgtgttcgtctgcaggccaagcaatatcctgctctggtctgaggatgttggcataccagagatccatgatccatcctgcacatccgcatagtagttgcaaatgttaaaattatggtctcaaattggatttgacaagacataagttgtctggaggattgtccagtgtaaacctgaaccttctatgatgtgtatgagtccagtattgatagcaagaacagattcgtttactgctgggagtgctgcagccactgatattttgtctatttaacttaaactatttgttgtgttggtgctctatcttgaagacatgtttcgtttgtttatcgaaggaggttatccgcttttgtcaaaaaaaaaaaaaaaaaggcccctaaaagggcgccgctcgcggacgcgtgg

SEQ ID NO: 3289 - DNA, 998 bp, Zea mays
gaagctaacacccccgcgccccccagggccatagccatggacacaccaccgcagtcacgcgcacgtccacctcaacagtccaagccaagcccaccttcggctcccccaccgctgcccttctccgccaccacctccccctcccacggcttctcatccccctctcccttcggcggccacctgcgcccgctctccatgtcccgcacccccgtcggccgcgtcggcagcgacctcagccacgccagagcgaaccatcatcacgccaccacgagcgacggcaccagcagcaaggacagggacagtagggccaagagcaaggcctcgcctttcttctctggcctcggcggcgcgtggaggaaggagaccaccagcagcagcagcagcgacgtgcccgggaagcaggccgaggagaagaggaagggaaggcccaagcccaggagagcggcgctggacgtgggccagtgggtgaagcgacacatggcatccatggtggagcagctgcgtgcctccttctcccggcactcggagcgggagcagcggcgccggccgcactcgttctcgggccacggcccgggcgccgccagggagatgagggagcgggagcactggaggcggcggcgcggccagctgtcgtccgcgccggcgtcgctgcgcgtgtcgcctgcgaacagcgggcacctctccgttggcggctcggtcaaggtgtccacgtcgtcggaggagagcaccatggaggagctgcagagcgccatcgaggccgccatcgcgcactgcaagaattccatctccgtggccaagcagacggcgccgaccggggacgacggcaccaagcttcagtaaaccagagtagttggtaggggtgctggctgcacttatggattcttaatttgatcgaaatttcagaagcccagtcgttttgggtcgatctcacacaggcgcatgtaaattaagatgcatgtaagaagagatatataagagcgatatatatacatttttttttc

SEQ ID NO: 3290 - DNA, 4949 bp, Zea mays
  misc_feature (1754)..(1754): n is a, c, g, or t
gttatcttaaaagtatattccctctctaaaatagttgtcgttttagaaaattagtatgttcatacaattctttatgcatgtgttttttatatgtgtctagattcatctttcattcatttaagtatagacataaaaatcaatagttaaaacgactactattttgaaatagatagagtattattgtcttattggtatgtacacaaatcacacatggatatatagagagctgcccatgtgtactccccaaatcccctaccctattcccttttttagaattgttggtacaatagaataaaacagttaaagttaaaaacttaaaagtaaaggtctacaaataaagcctaaaaattaactgcatcaacagtaatcaaacattaatagtgtgagaaaacataaagtgaaattaaaaatatatagtagtataaaaggaaacgtaaaatgataaactagtaaaagaataaatgtggtactccctcgttagaattactaactattgcaggaaaatagttaaagttaaaaaaaattaatataaagctgtaaaaaagcctaaaaggatggactgccttggcattagaaggaatcaaacatgaacagtgtgagaataaacgaaaattaaaatttagctgcaaataaaaaaagataaatgaataaacgtgacagacaaaaatgaaataatagggaagaaaaggaagggaatgaaaaaacacgtggtcggcaggattcgaacctgcgcgggcaaagcccacatgatttctagtcatgcccgataaccactccggcacgaccactttgatgtctgggtaagtatacaaatatacaaagctaattattaatgccatgccagtggaattaatcttttgcatgctataaaattaagtttcccctaacatgtagcttcctagtatcacgcagatagtactatagcatggattttttcaaaaactagatgcaatacatggccccattctcatccaaatcctgaattcagtttctgccagatatgttggattgaaagaatgtttctagacagatacatcatgtagattcatactaattacatggaaatcatgaagcttgttttcttctttagtgttcgagaacgagaagctgtagaacagttgttttgagtgctgactgctgagaatccaaatgctgaacgaaataataatcagcccagttttgtaggaaccggtggcattttagcataaatctatcatagccatgacacatcgcgttttgtgtttccccacttttcagaccgtccaaacatacgcaaaagtcccagtaaggtcactccgaacaacctttttctaaagatatactgcaaaattgtagatgtagtgactcaaaactagatcagaggtgatgaaatgagcccagcacataatctaacttccacgtgtattgatttatgggtaagggcccgttcggttgtaccggaatgagccaggatttatttcagctcatcaaaatctatataaattagagaagtaatccggctaagaattaatccggggctccaatccggaacaaccgaacagggcctaagggtaatcgtcatatacatgatacatcacactacatatagatagttgggtactcagtactcaatcgtttacatctccagcacataagtcgatgatacaaggattcagaaaatagaaatataaacatgggtggctatacacaaaagaagcataagctagatcaggcctaaatatcattctgcatgaacggaagcttgcaaggtcttncacaagtgcgtggtttcgaattacaagcagccagtacatctgctgctgggcattgcataatatgccggcctgtagcaagtgtgagcgtctctgcagggcttggggcagctgtattattagctctatcacgtcactgatcacacatctcacaggtgccccagcacaggccatggagtcactccattggcaggaagcataggttttatgaaaggagttcggcgcatcatcgtcgtggattcattcagacgtgacgattggccgttgaattgggaggccttctgcggagacgtataagcccaagaaaaaactttcagtcagtaagagtctaatagagaattaagcatcgcaaagtgcaaagtgaggtaagcaatacagaatgggaaaactaggaaacatggataaggatttcctcaattggagcatataatcccaacattgcaaccaattatttgttgaatcttcgatctaggaatactctgatattacatctcctctgccattcataatccgttcacgttctataacaaagtcctagaagctgaagcaaccacacatgcgattgtgggagtagggaggcaagcttacatcgataatgttttgtttcttttctgtaatttggcttcagcataaacagcacaagagcatctccaaaagacagtcagccagtgtgagacagcacatcgtttattcagtgaaaaatatatacagcgagcagccaagcaccaagctcgcaagtaagctagttcgaagaaattaatcttttgccaaacttacggatcagtgagtggtgatttggtgccatccctaaggatggcaaaaaaaaagtgtcccaactagttatggccttagaccatcttcaaccattcttcccacatttccccgcctatctgtactttctattatactttactatgttaccccataaaatattcccccatatccaggacatttccaaccattcactatatccaactccctatatactataattcagttatttaacatttttatcagttttcaaaatttcaaaaaatcatagactatttgtactactataatacacattattatcaggttatgatacttaaaaaaggttaatatcacaaagaaatggggtaattaaagtatgggggagattgaactcaccccattttatatagggagctgcctctctcccccatatggggtattgggtgagctgtgggagcatcgttggaggggattttcaccccaaaacgcaccctacctagggtgggggagttatgggggcattgttggagctggccttacgggtaagctcagtatgtatcagtttctacaagcgactcaggaaaaaccggcgtgtgtagaaggcaaattccacaaagtcagaggcagggaagggaagaggatggaaaggcgtcaccttttcgtcgaatacgaggcggacgcgcgcggcggctttgctctggcggcgcatcctgtacagccggcgcccgagcacggcgaatccgagcagcgcgacggcgaacggcaccgaccaggcgctcctcgccgcgcgcatcgcccaaacacgcagcgcgtcgagcggcagcttccaccaccggacgtgttctcctcccttcgccacggccccctccaccccatcagcctcggccgccgtggccccgccctcctccctggcccgccccacgggatcggtggcctcgacctcgggcctctccccgtcggaggacgagtccgaccatagcgccgcgcggtcgcggccggggaagagaaggtcgtcagggtccggctccacccagctcgcgttgtccgacgccctgagaagcccctcctccgcgccctcctcctcgtcccccgtagacagcgacgccctccgggggtacttggcgtcggagccgaggtcgaagtagtcgtgcttgatggcgccggcgtcgtcctccccgcctccggcgtacggctcggccgccgaggccgccttgggggacgcgaggaggagctcccagtcgtcgtccatctcgcggaaggctggctagggttcgcgagcgggattcggagggaaaaaagggaggggaggggaagggaaggagggagggagagtggtgtgccgtgtcgggtggggaagggagacgaagattcgcgggctgcaaggaaacggtggttattttgcggttgcttggagttcagcgttcggagggaattcgattcgtgtaatgccacgagtcatctcaatatagtgcatcatcggtgattcagtggtcgtcagtaaacgggccaattttatagttacttatttcatcttaacggtgtttaaatgtactaagctaatagttaactaaaaattgctataggaattagctagagcatctacaagagattagttaaaagaattagctagattagccagatttcacgcataaaagagttggctactccaacactctaaaattcagagtctccatattaaaaaaaatgccacgtcaatagtattctttagattgtagaggctttcagcaccacgcatgattttttttcttgccggtcgatgctgcctccggcgccgcccaacattttgttgctagctgatgctgttgctggtcgccgaacaaagcaagcagggatagcctatgtccactagccggaaagcacgcattagcagacgtctggataatttgaggctagcatatgatctcctgttgctcagcggtgttcatggtactcagaggcgagctacatgacgtgatggtaggaaaaacacaagaaaaaaaaatcttcggcctccagcaggtgtggtcttgtggcggcgggagtgaaggcacgtgcgcgaaacaggcatgccaagcaagaacaccgaaatagcgttgaaggaaaaatgaaaaacgagaagagcctattggattctatatgtagcctcgaatttctaaatcggacttctcatgtcgagattattgccaacaagttgctctaacaaataattagctattttatatgttttaactaattttagtagctaactattaactctactatattgaaacattacataaggttatgtatggaacctctagaactaatagttagatattaaaaattagttgttgggttccaaatattctcaagctaattgttagctacttcacatctaataatttgttcattagctggctgtagggagccttcggcttccgaaggtcctcaaaaacatgattgaca

SEQ ID NO: 3291 - DNA, 2015 bp, Zea mays
  misc_feature (810)..(810): n is a, c, g, or t
  misc_feature (1441)..(1441): n is a, c, g, or t
actaaaaaaaagcctatcgtcttgccgatttgctcccactcggccgctggaacgcacctgcgccctacgcctccatccgccctccatcgcctccaccgcaggccatagagcccgtcgtccgccgcacctagcgccttcggctccggtcacaggccccgccggaccgccccaggctgcagcgccgcgccgccggccgccgcagcagtcccgcgcggtcgcgcagttctggtcgtctggtctggcctgatgcccgtagcgctgcgtgcccgcctgagaccctgagtaggactgtaggagactaggaggtagtagcaagcagcagcgtgctccgcggctccgcactccgctggtctgcttgagatttgaagagttatttcggtcaaggttctagtggaagtggaccaaacactcgtgctagtggagtttgcaatgaacccgaaatacaagttcaagttcaagagaataatagtgaagatgccaatggtgaaaatgttaatgatcaagtcaaagattttattcgctatatgtcatttggttgtaaatggattgcaatcaagattactattaaataaggggaacttttacttggctgatggcgggtacgctgtggggccaggaatactaccagtctaccaccatatcatggaggagcaagccgaagatttggcctgctcaggacaaactatttcggcagtgtaaatttcctttggttcatcgtccgaactactttgattatgttctactatatggacattatgatgaattgttttgactagttctttgcttcggctttcacaagccgaagctttntgatgtaattgtgctagcgtaaagaactggatgccttctaattttctcttttaaataatagcgcaatccatcaaaggctatccccgccagttatttatttgttaaatgaatttgaaaacatcagtttctcatatcccggaatctccggatgtaatcattaaccgattcatcctttttcttgtcgtagggccactaagtctactaaatctagcttgtaatcgccagagaagaaatgttcatgaaatttttgttctaagtctccccatgacaaaatagaattaggagggagcgtggcataccatgtgaatgcagtccctgttaaagataatgaaaataaacgcacacggaatgcttcggtgttggccaattctcctaattatgctaagaactggtctatatgctcacgcgtgctctttccttggtcacccgaaaactttgcgaattcgggtattctgctccactgtgggtatgggagacggtcaaaatggctaccataaggtctccgatatgactgccccccggggactatactaactccgagcttatctcagaacgccccagctatttcctctcttactatatcgatggcagccggtgggagaccaccggctcttgatccaatatgggtgangtcgtttggatgttggtatgttgttttcctcccccattggtttgggttttgcggtgcgtcaatacatgccctatgaggcttataggactggccattcctttctggccttctggaggccggaaagtactcactctcacatgtttggtaggttatattatggtgctggtgtgtcgcatggtgagatggggagtttagctgggacggatgcggagttggaaatccatcctccttaaaaaaactttgtgccggaccatccggttaaatgcgcggactgtccggttacgtgcgcgggctatccggccatgtggtcggaccgtctggcattatattcagactgtctggcgtcatacgcggacggttcaaatgagttatctagggtttgcacggtatgtggcggcttgggtgcaggcctcggtaattcgcttctaaaaatgggatcggtcgccactggcccagacggtccgcgctcacgtgcggacggtctggacatgcgcagatcgacaaatttatcgccgatgtgcatgggaggctattgttgcctagggtacatgtctatcggcctcccataaagggg

SEQ ID NO: 3292 - DNA, 1089 bp, Zea mays
ccattacctagaccatccgccgcgagtcgtgtctcctctcttcttcctccgctccacttcctgcacccgcttcttcccccaaaggccaaaaccctaaatctcctccctccctccctccaaacacctagctgccgccggttcccgcgtatgggagggtcgcggcgcaaattgaagcgctcgcgcactaaggtccgcgtggggcttccccgccggaaacccaatgaattcaaggcggccttcgaactccccgaggcactcgccgccgccgccggggccggggcgggctgggacgcggagggcagcgtagtgaagaactacgccgcgttcggggtggtggccaacccaaacctactcggtgcgcactcccgcggcacgccgcggctcgtccagagcgcggcgctgcaggcgcccgacgtcgccgccgcgcatgcacccgtcccggagttcgagccaatcgataccggcagcgatctcgagaacgacgacctgaagtctgctcttgggaagaaaaggaaggatggcaaatctgcaccgttgcaaccacttactaaagttcaacgtgtttgcattggcagattaatagagaagtacggtgatgactacaaggccatgttcatggataccaagctgaacgcgatgcagcactctgtgggtacattgaagaaactatgcgaaagacaccacgttgatggcaagatcttcgtctatccactgtagtattgtgctggcacctacttcagcctcagtgtactcttttcgccccgttaatggaacaagaacaattttgcaatgtgccccaaagaggaagccgcaattcagaactattgtgtacttaataaacaaaaaaaaaaaaaaaaaaaaaaaaaaaaaaaaaaaaaaaaaaaaaaaaaaaaaaaaaaaaaaaaaaaaaaaaaaaaaaaaaaagggggggaagaagattttttaaaaaaaaaaaaatttttttccccccccccccccggggggggggggcgggccccctttccccctttggggggggtttttccccgccccccgggggggggtttttaccccggggggggggggaaaccccggggggccccccttttt

SEQ ID NO: 3293 - DNA, 1659 bp, Zea mays
  misc_feature (1636)..(1636): n is a, c, g, or t
  misc_feature (1659)..(1659): n is a, c, g, or t
tttggcagtgacacagtggcattttaccgcgcctgcgcctgtgcgcctgcgcctgtgcgcccaccagtcacaaggcccatatcctcctccgctccttcctctccgtctctcccctccagcattgcggtggagagggaagcaagaggtatcggagatagagagagaaagggcgaaaaacagaagggaacagcaacggagcagctgatcaggggctgacgcgcgcgacaatgctgctcaagagggtggcggcggacgacggctccggcgccggcgccggcgccggcgtagggaggccacggctcttcgccatgccaaggctgctggtcgggctcgaggcgcccaggtgcggcgcaccagactgcgactcgccgatgacggcgcgcagcccgacgtcgccgctcgatctcaggcccttcgcctcgctgctccgctcgccgcgctcacccagaaccaggagctgggattcgcaccgccttggcctcggcggcctcgtcgacgacacgctcgccgaacccgtcgcatgcgccaggagccgcctgctcggcctcgggccccaagcgcggcagccgttcaagctgccgcaacgcctcgccaagcccctggccacccagccgagggactgctcccacgcatcctcggagctcgggaatgtggggaccgctgccggctgcaagccgctgccgtgcagcaggtcctacggggatgtgaagtctggtccagaggtcaccgtgcccggcggcgctccgcccggcgcgagcagccaccctgccgatgttggcaagttccccgcgccggggtccctgccggtgtccatcggcggcccgcgctggtacatcgggtccgtgtccgcgacggaggtggagcagtccgaggactacacctgcatcatcgcgcacggtcctaacccgaagaccactcgcatcttcggggactgcatcttggagccctgcactcctagtgtgtctgacggtgacggcatggatgccatggaagtcaaggaaggagcagagtcctactggttggtcaagtgcttcgatgccagcgagcctggagagttcttagactcctgcatctcttgctagaagaagctggatggcaatgacccctgcgtttatcgtggtgtgagggcattctgccgtgggaactggaggaatcaggaagtccttgctgagcaggaagacaacattccagctgtgtccttcagctcggctggctcatcatcttccttcaacgatgaagtagtcatggctgaaatggttgtggtggctgcaccagttgacgtccactaccctgaatctggcaaaccagggtagctgatcaataatgtcaattgtcgcagttttcatcttcgccgccatcattattttgctggttttgtaagttaagttccagcatttggtagcattgatcattttatgagaattgaggctccatctagaatttgctgagatgtgatctctcagcctttagaacggagagcttccatgccttaagcattgtaattttgaaccgaggctattggcaatgcaggttccccaattttcatccaaaaaaaaaaaaaaaaaaaaaaaaaatacgagggggggcccggtacccaaaaaaaaaaaaaaaaaaaaaaaaaaaaaaaaaaaaaaanaaaaaaaaaaaaaaaaaattttn

SEQ ID NO: 3294 - DNA, 614 bp, Zea mays
ctctccgtctctcccctccagcattgcggtggagagggaagcaagaggtatcggagatagagagagaaagggcgaaaaacagaagggaacagcaacggagcagctgatcaggggctgacgcgcgcgacaatgctgctcaggagggtggcggcggacgacggctctggcgccggcgccggcgtagggaggccacggctcttcgccatgccaaggctgctggtcgggctcgaggcgcccaggtgcggcgcacagactgcgactcgccgatgacggtgcgcagcccgacgtcgccgctcgatctcaggcccttcgcctcgctgctccgctcgccgcgctcacccagaaccaggagctgggattcgcaccgccttggcctcggcggcctcgtcgacgacacgctcgccgaacccgccgcatgcgccaggagccgcctgctcggcctcggcccccaggcgcgggaaccggttcaagctgccccaacccccccgtaagccccggccccccaaggggggggatggcccccccctccccggctcctggaaaaagggggggccccctcccctattaaaccctgcggggaaaaattctacagggggtggggacctctcccaacc

SEQ ID NO: 3295 - DNA, 2269 bp, Zea mays
  misc_feature (2157)..(2157): n is a, c, g, or t
  misc_feature (2168)..(2168): n is a, c, g, or t
  misc_feature (2217)..(2217): n is a, c, g, or t
  misc_feature (2243)..(2243): n is a, c, g, or t
ctctctcaagcttctctccccgctaccgctccgagtcccaagtcccacccggccagcctccatcgctagtaccactcctagtcccaagtcccagccttccatcgacggcgagggagggagaggcgacctccatccgggctggttagattcatcgcttttcttgtcgctgtccctcggcctttccccctactgtgctccgagtctgggagaagcgactcgcgcacgcgctcggccaaaccaattaagcacagagcggggctctcgggcgagaacgcgctgaggcagtgctgggtttgcagttcgtgccgtagcgtttttttttgtgtgtgtgccgaagcggagaggcgatggctgcgccgaggaaggggacggcgacgccgctgggcaccgtgttctcgccggaggagacgaagagggccgtggcgagggtggccgagtccgtcgctgggcgccgcgccgagctcgcccgcctccagggtttcgccgccgacaacgccgccctcgtctccctcgtcaacaggctccccgacgaactctctcacgatatcatggttccctttggtggcgccgcctttttcccagggcgtttaatacacacaaatgaactcttggtgcttctgggtgagggggtactatgcagagaggtcggctaagcagacgactaatatattgcacaggagggggcaggaattggaagctcaagtcgaagcaatgaaggcaactatcgctgaccttgaagctgaggccaaattctttgaattcacggccaccgaggcttcagagggtcttgttgaaatcagggaagagtatgatgaggacttagagacgaattcatcaagatcagaggcttcagttgctactgtggttatgtccgataaagacagggaacatgctcgaatcatggcaaggttagatgaacttgaaagggaagaaaaggatgctggaagtgcctgtgaagatgataatgatggcgacgatgatgatggagatgctggaacaagtgatgatggcgaggaaaataaggaatctggaaatgctttaagtgatgtcaatgaagactacagttctggttttggcgcttcattttctggaagtggcggcaatgataggagtcatgggaatattaagagtgcactgaagaagcctggaggagatgaaatgctgataggcatttctcataagccatcatcccatacatctcatctagcatttcctggccaaacctctgcaacaaattctgatgtccgagttcacactaaagctgttacttttgaagacgacaaatatgtagttagttcgtcaaagtctcctcccttgctactggattctatacagtctgatcctgtgctcaagaattcttcagaccccgctctatctcgtgacagaaagataatatcaagtggacgaaaggcctttacaggatctatcattgagcacgacgacaatgtttccaccattgaaccttctgtggctagttcgttggcaaaacctggtacttgtgcttcttcaaggcccgtgtcaaggttcaagatgcagaaaggagggcggtgagtctggacactcgggtggacctttggtgtctgatagattgcatcttgaacacgttcaaattgtctgtgctgtctgaactcctggacgctagacatgttgtggatcctggacgctagacatgttgtggatcctggacgctagacatgttctggagtgattgtcttctgccgactgtagagtgaaaccgggacgtccaagcgaagaagggaattaaaaacgaggttttttttggtcggttaattattagtatcacaggacgtccaagcatcgcattagttagccactgcacacagagcctgtcggccaataaggtcagttaattacagatttagtggtgctagcttgctgttcctacttgtgctgtagcagagtgtcatgacatggtcagtagcagccggtgagcgccgcgaagtcagcagggcggctgcgtggtggtgtctcttctccttccctgggcggcgccgtggagcaccagattgtctctctcacgtatttcagcggcagcaagggacgaagaacctgccctctgcatgtcagctccacctgccattatatgtgtatattatttcattcattcagtgggtaatcgtcacaaacagctatatnagatccagtanaatgttgaataatctgaatctgatacacacgcacacacacgagtattanacacaagtatttgtaagtaacctaanaaaaaaaaaaaaaagcccctagggcc

SEQ ID NO: 3296 - DNA, 1433 bp, Zea mays
gagcgttttttttgtgtgtgtgccgaagcgaagaggcgatggctgcgccgaggaaggggacggcgacgccgctgggcaccgtgttctcgccggaggagacgaagagggccgtggcgagggtggccgagtccgtcgctgggcgccgcgccgagctcgcccgcctccagggtttcgccgccgacaacgccgccctcgtctccctcgtcaacaggctccccgacgaactctctcacgatatcatggttccctttggtggcgccgcctttttcccagggcgtttaatacacacaaatgaactcttggtgcttctgggtgaggggtactatgcagagaggtcggctaagcagacgactaatatattgcacaggagggggcaggaattggaagctcaagtcgaagcaatgaaggcaactatcgctgaccttgaagctgaggccaaattctttgaatccacggccaccgaggcttcagagggtcttgttgaaatcagggaagagtatgatgaggacttagagacgaattcatcaagatcagaggcttcagttgctactgtggttatgtccgataaagacagggaacatgctcgaatcatggcaaggttagatgaacttgaaagggaagaaaaggatgctggaagtgcctgtgaagatgataatgatggcgacgatgatgatggagatgctggaacaagtgatgatggcgaggaaaataaggaatctggaaatgctttaagtgatgtcaatgaagactacagttctggttttggcgcttcattttctggaagtggcggcaatgataggagtcatgggaatattaagagtgcactgaagaagcctggaggagatgaaatgctgataggcatttctcataagccatcatcccatacatctcatctagcatttcctggccaaacctctgcaacaaattctgatgtccgagttcacactaaagctgttacttttgaagacgacaaatatgtagttagttcgtcaaagtctcctcccttgctactggattctatacagtctgatcctgtgctcaagaattcttcagaccccgctctatctcgtgccagaaagataatatcaagtggacgaaaggcctttacaggatctatcattgagcacgacgacaatgtttccaccattgaaccttctgtggctagtccgttggcaaaacctggtacttgtgcttcttcaaggcccgtgtcaaggttcaagatgcagaaaggagggcggtgagtctggacactcgggtggacctttggtgtctgatagattgcatcttggacacgttcaaattgtctgtgcggtctgaactcctggacgctagacatgttctagagtgatttgtcttctgccgactgtagagtgaaaccgggacgtccaagcaaagaagggaattaaaaacaacgaggttctttttggttggtg

SEQ ID NO: 3297 - DNA, 1833 bp, Zea mays
ctttattttcctcctctttttttttctttttttttctttttttttttttttttttttttttttttttttttttttttttttttttttttttttggcaaaattaccatatatcttgaatttgtgatatatgtgaatgaagaaacaagttgagagggagatacagatatatcacaaaaacaatgaaaaaaaatacaggagtcctgggccagttgaaagaacagattgcaaaagtccaactctacacaggggaaaaaagaataatcaaacggcaacaatggagagagctcaactggtagcttatatgaaccgccatagatacacaatatatatataatcacaagctagcagcatccacgtaccaccctgaaaatttgataaccatacctaacttgacaagatattttatacacaccacacctctggtgtcttctgaggatcacctgagcctggcatcacctcccttgcttcggaatgttgacagggagaagaaagaacgcggcgctttaagagaacttccagtcagctgatcctccctcaatctgaaatttgcaggtgggtttggaatggagctgcgtagtgattgttcttgttcagaaaaaacctcgttctcaacaaaaccgtcatatgaagcaagataacccattcgagactttctgaaatcatcagaagatcctactaccagatcccgtccatcttccatgtcatcatcacattctgaggcagtggaagcagatacccaatcatttactaaaccgtcaccgcctctagtcttcctaccaaatttccacagtttcttcaatcctttggaaacatctttgcgtggctgttgaggtgcattgacaccagcaaaaggcatctgtgcactgccccactttttccgcatccgagatacatcagcatctgttatttcatccagtgaatgagaattccatggtgatggacttcccgatggtgaatcagcaaaggcgtcaccatctgaattatcattcgtgtaagggaacagctgtggaagacgagaactccagggtgctggaacatcaccagctggattgtggacatttcctgtaaaagcagtgaacttagtaccaccaatggcaggtgctttgcttggaaaatcagcatcaccgttttctgaccctgggtcatctgaatttccaaattcatgactcactcttgggttctcactgtcagaatcagcaggaaagtcactttctctaagattttcttccatgctttcatattcttcctcttctttggcatcatcaggggaatcctcttgctgatcttcaaaatcaccactgtcaccatgatggagggcattcgccatcatggcagctgcagcctgaaatccagatataccaataacagggtgagtcccattgcctttcctaagaaaaggctttggtggacccgatctacgggtactgtaagcaaaaggtccctctgattgattcttggaaattcttgagggagcccaattgtaaatatcatcattccctgacgaaatgtcctttagctcatcaggaatttggttcttcctcatagattgtgacctcctcgattgatcttctttcaatatgctctttgactcttcaataatactcttgctacgggcaaaagacttttgctgaactcttgcactcgctctactgactccaggtgaaggctttgtattttcttttctcaagtcagagaaactggggacagactgtgcgagaggattttctggtggattcctgcgattagcatacccggcccgccccgtgcttgatgaacgtttatggataggaccagcagatgccttttgggtagaagcaactttatttgaaaaat

SEQ ID NO: 3298 - DNA, 2926 bp, Zea mays
  misc_feature (1716)..(1716): n is a, c, g, or t
  misc_feature (1728)..(1728): n is a, c, g, or t
gcttaaatccagctattccaataacagggtgagtcccattgcctttcctaagaaaaggctttggtggacccgatctacgggtactgtaagcaaaaggtccctctgattgattcttggaaattcttgagggagcccaattgtaaatatcatcattccctgacgaaatgtcctttagctcatcaggaatttggttcttcctcatagattgtgacctcctcgattgatcttctttcaatatgctctttgactcttcaataatactcttgctacgggcaaaagacttttgctgaactcttgcactcgctctactgactccaggtgaaggctttgtattttcttttctcaagtcagagaaactagggacagactgtgcgagaggattttctggtggattcctgcgattagcataaccagagcttgcagttcttgatgaacgcttatggataggaccagcagatgccttttgggtagaagcaactttatttgaaaaatgcttcctggaatcagcactcctggaagaaccgtcaccagataggtagtcactattcatttcctcttccaccaagaatgagccaaccccctgatctttattttttcttgctgatcgcgaaggaggaatcttctgagaacaatgggaaacataagttgagtcagggacatctgcagaccgagagaattttgttagcaactcagccttgctccgttctaggctgtcatgcatagcctttaacattgcttccttctcctctctctgcagcttccagccttccttcagttttgcatccctcttctgcatataatgctcataaaacttccctctcgactcttctaaacttagaatgccaagtttttgtggtgtgctaatgttaaattcttgattattcaccatcttcagaagctcaccggcatcaaaatcattgacagttatactctcctttacaacttgttttgtatgaattgtctcatgaagaaccattgtcggctttacctcactcaccataggtgtgctttcaacctgcacatctgtaggtttacctcgtcgggaggatgttaacttgtgttcagcaaataatttctccaactcattggccttcatttgcaattcaccatgccgatcttggttcccttttcctggtcttgtcactctagcctgcaagtttagttcctgatcggtaatggatgattgcctgctcaaattttttccctgacgaccagagcaatctgaatcagaaccagctgtaacctttttccctacatcttctgacttccgtggtagacgattccgctgcaaactaacgtcacggaactcagtttctgtagaggcaatcgcatccctaacagatgagcctttagcattagctcgggaattggatgaggcttttggtttaggattaacaccaccagatacccttccaaatgatcgtgaaggctgatccttccttccagtcacttctgcttcagtgtgaatatcttttgtatggagacctctaatatcattctggggaatctgttcacttgcaactggtacttcatgagcaacagctgtgatttccttgtctatcatgcagacatgctcctctgacaatgcactagttacaataactttatttttcagcaaggcttcttcaactggctttgcagaagattttagacggtcttgagtggaaacatttgaagtagcatgatttgacatccttgtgtgtccttgaataaccnccggttctttcncaaaggatgcttcactttcaatgctagagttcataaccatgtcgttttctgcaccatcaccatatatactctctttatgaggagcaagtgtattacttaaaattgagggtgggcacaaatctgtggtggccagatccattggtacattatccttttgacaaggccaagagtgtgacgtgattgaatccttctgtccattagagtcctcattagctcttactttagagtcggcctccaaatcagtagatgttggagtcccggcaggagttccattatcctttttgtcatttaagctactactctcattgttgctgaggtcaatactcatgtcgctaacactgctcccaccttctacctaacttctccatggaggcgccagaaggaaccctgcggtgctcacctttccctggaaccactctaccagtaccggcagagttgctgttaccagaacttggagtctgctcctttttctggctctcaaacatgtttatcctgtccttcacactcagccgccttgaaagctctcctttagaaggtgcaggagacgcatctgtttctgcttcttgtttatctactgcttgttggatggttggcttgggttgctgtgctgcagcagattctaaaccttggatgttgcttagtctgtgggcctgggggccactcccacgcacggtagattggttctgggattcacggggatcaactagtggttcatctatacccaggtctgaactcgaagaaccacggacattcccatcgtcaaagaccttccagtgtgatgaaactgctggctgtgcagtttgaggactgatgtcaggacgccgctggcaaagtgacatgaactttgtgcatgcttcgctcagccgactggcaccaaaatggttagcaaaaagaataagctcagatacacttgtaggattgaacccagcagaggatgctcgagaacaagctgcggccagatcttgtttaagggaacttagacgcacatcaattgccctaagaagttctttcttcgtaatatctgctgccaccgccgctgctgagcctgtaacattttcagcagttccaccttaggtagggttttcagtacctccctgcgcatatatcttcctagccccttccagctgtgacatctgtaaatcataggtgctcgtcaactcgagcacctctcgcgtgctcacgaagcgcacgaacctgg

SEQ ID NO: 3299 - DNA, 3289 bp, Zea mays
  misc_feature (293)..(293): n is a, c, g, or t
aaacattacagctctagcacctttttccctgccgccgtcaaaatccacacattcgaaatgttgcatccactaacatgatctagggagcgacataacatgtgcatcatcaatgcagacaagtgcattaacagaggaacgtccaccaggtcactcactctcaacaaactgaagtatgaacaatatactgaactactcaagccataaggcagaaccaatggcccagggttagtgcgcataacatcagccaagaataagaggttatatcctaggaatacctcatcgagagtgagtantaatgctcagaatagctgttccaacagtttcaattttgttcgggtagatggagaacagaaatcttaagttatcaattaaattgtttgccaactcatagacatggttggaaccttcagatacttttttttgaattttaggagtgtgatgaccatattagaaaggcccatttctttaaactttatctagtgcaaataaattgtgggaatagtattttgagaagcatactaactaatttaatgacaacgagaagaccttttacagaattagaaggtcaaataccttgttcagaaaaaacctcgttctcaacaaaaccgtcatatgaagcaagataacccattcgagactttctgaaatcatcagaagatcctactaccagatcccgtccatcttccatgtcatcatcacattctgaggcagtggaggcagatacccaatcatttactaaaccgtcaccgcctctagtcttcctaccaaatttccacagtttcttcaatcctttggaaacatctttgcgtggctgttgaggtgcattgacaccagcaaaaggcatctgtgcactgccccactttttccgcatccgagatacatcagcatctgttatttcatccagtgaatgagaattccatggtgatggacttcccgatggtgaatcagcaaaggcgtcaccatctgaattatcattcgtgtaagggaacagctgtggaagacgagaactccagggtgctggaacatcaccagctggattgtgaacatttcctgtaaaagcagtgaacttagtaccgccaatggcaggtgctttgcttggaaaatcagcatcaccgttttctgaccctgggtcatctgaatttccaaattcatgactcactcttgggttctcactgtcagaatcagcaggaaagtcactttctctaaaattttcttcaatactttcatattcttcttcttctttggcatcatcaggagaatcctcttggtgatcttcaaaatcaccactgtcaccattctggagggcattcgccatcatagccgctgcagcctgaaatccagctatacctataacggggtgagtcccattgcctttcctaagaaatggctttggtggacccgttctacgggcactgtaagcaaaagctccctctgattgattcttggaaattcttgatggagcccaattgtaaatatcctcattccctgatgaaatgtccttcaactcatccggaatttggctcttcctcatagattgtgacctcctcgattgatcttctttcaatatactctttgactcttcaataatgctcttgctacgggcaaaagacttttgctgaactcttgcagccgctctactgagtccaggtgaaggctttgtattttcttttcttaagtcagagaaactggggacaggctgtgcgataggattttctggtagattcctgcgattgccataaccggagcttgcagtccttgaagaacgcttatggataggaccaacagatgccttttgggtggaagcaactttatttggaaaatgcttcctagaatcagcactcctggaagaaccgtcaccagataggtagtcactattcaattccttcttcaaccaagaatgagtcaaccccctgcaaatggcaaagaaaattaaatgcaagaaagtaaactccatattctgcattattccattactccacaacattgtgtgcaactataagattctaagatttgcaaattgcatttaaagagtgaatcatttacacaaatacttcataaggcattacttttagagatcaaagaaagcaacatctgaagtaaaatgaatatctcatagttatgtacataaggtgcacgttaagcattttcagttaccaaaaaatatttagtccctttttaagtgtattaagttaaatatccaatacctgatcattatttcttcttgctgatcgcgaaggaggaatcttctgagaacaatgataaacataagttgagtcagaaacatctccagactgagagaatttagctcgcatctcagccttgctccgttctaggctctcatgcatagcctttaacattgcttccttctcccccctctgcagtttccagtcttccttcagttttgcatccctcttctgcatataatgctcataaaacttccctctcgactcttctaagcttagaatgccaagtttttgtggtgtgctaatgttaaatccttgattactcaccatcttcagaagctcactggcatcaaaatcattggttgttatactctcctttacaacttgttttgtatgaattgtctcatgaagaactgttatcggctttacctcactcaccgtacgtgtgctatcaacctgcacatctgtaggtttgcctcgtcgggaggatattaacttgtgttcagcaaataatttctccaactcattagccttcatttgcaattcgccatgccgatcttggttcccttttcctggtcccatcactctagcctgcaagtttagttcctggttggtaatggatgattgcctgctcaaatttgttccctggcgaccagaagaatctgaatcagaaccacctgtaacctttctccctacatcctctgccttccgtggtagacgattccgctgcaaactaacatcacggaactcagtttctgtaaaggtaatctcatccctaccagatgagcctttgacattagccctaccagatgagcctttaacattagctcgggaattggatgatgtttttggtttaggattaacaccaccagatacctttccaaatgatcgtgaaggctgatccttccttccagtcacttcagattcagtgtgaatatcttttgtatggagacctctaatatcattctggggaatctgttcacttgcaactaatacttcatgaggaacagctgttatttccttatctatcatgcgaacatgctcctctaacgatgtgctggataaaatatccttatttttcagcaagccttcctcaactggcttgc

SEQ ID NO: 3300 - DNA, 691 bp, Zea mays
caaaattaccatatatctggaatttgtgatatatgtgaatgaagaaacaagagggagatacatatatatcacaaaaacaacgaaaatacagtagttttgggccagttggaagaacagactgcaaaaagatctctaagtccaactctacacaggaggtaaaagaatattacggaaaaagaataatcaaacagtaacaatggggggctcaactggtagcttatatgaattgccatagatacacaacatatatatttatatatttataatcacaagctagcagcgtccgcgtaccgccctgaaaatttgatactcatacctaacctcggaagatattttatacactccacctctggggtcttctgtctttctgaggatcacctgagcctggcatcacctcccttgcttcggaatgttgacagggagaagaaagaacgtggcgctcttccagtcagttgatcttctctcggtctgaaatttgcaggtgggtttggaattgagctgcgtagtgattgttctgcgaattgagaatcttcatcaaactcttgtgcatatgaagaaagataacccattcgagactttttgaaatcatcagaagatcctactaccagatcccgcccatcttccatgtcttcatcgtattctgaggcagtggaagcagatacccaatcatttactaaaccatcacccccac

SEQ ID NO: 3301 - DNA, 1446 bp, Zea mays
  misc_feature (5)..(5): n is a, c, g, or t
acggnttcccctacgaccggggcagcgtatatccttgtcgctcttcgtcgtctccccccacaactgttatattcccaccggcgccgccggctcttcgtcgtcctcctccgggtgtgccccagttcgctgcccgttccccagccgccgatccctcgatctccgctagcttcgttccttcgtacaggaacggtcgagcagaaactagcagccactcccgagtcccgactcccgatcgcgattacttgccgcggcaccagtactccagcggccaccatgagcagcgggaagcgatccttcttcgcgcccaagaagaaggccaccaacccgttcgattccgactccgacgacgacaaaccgcagcagcggccagcgcgggcgtcctccgtgcctcccccggacgagcagcggggctcctcctctctcttcggcgccggcgacagaggcgggctcttctcttccgcggccaaccatcactaccggaacgacttccgcgacgctggcggccttgagggccagtccgtgcaggagctggagggctacgcggcgtacaaggccgaggagaccacgcgccggacgcgggggtgcgtcaggatcgccgaggagatgagggacaccgcatccaagacgctcgtcaccgtccaccagcaggggcagcagatccaccgcacgcacatgatggccgtcgacatcgaccaggatctctccaggagtgagaagctattgggcgatcttgggggtctattttccaaaaagtggaagccaaagaagaatggcgccatcaggggtcctatgctaactagagatgattccttcataaggaaggggagtcatttggagcaaaggcagaaactagggctggcagatcatccacctccatcaaatgcgcgccaattccgttctgaaccctcatcagcacttgagaaagttgagatagagaaggcaaagcaggatgatgatctgtctgatctaagcaacatactgacggagctgaaagggatggccgttgacatgggctctgagatcgagaggcaaacaaaagcaatgggggatgcagagaaggattatgacgagctgaacttcagggtcaagggagcaaacactcgagctcgccgtctcctcgggagataaaaaaatgcatatattcttgtctcttggatggtccataacacattaactatatgggggcatcaaattctgatgattttgtgcatcagattttgattagcattgttaccgtggacatgtcggcgtgtatggtagttgagacatattttatatgtttgcttcttttttctatttttttagcattgcacgagcttaggatttcagtggattttacatggaaaaccttgtctgattagaaacttcttttcgggtaaataatgctgatacatagtgatttgtcgcgacagcaacgaaaaaaaaaaaaaaaaaaaaaaaaaaaaa

SEQ ID NO: 3302 - DNA, 4382 bp, Zea mays
  misc_feature (655)..(655): n is a, c, g, or t
ttgccgccatgtgcgctctccaggtgaacagaacacggagcatcaccaccaaccagagcacacttccacattgtgatacatatatacacacacgcacacgcacagacgcttccgaggacagatgcacagtagcagtagcaagtagcagcatactctcctacgcgaatcgattaacgggcggcactcacccaccgtgtggcctgccaaactgtcccctaggccccggccccgcccgcgcctggccagtggccatccatcccttcccttcgcttcgacgcaccaatcttgtcccggcgcctgccaaatccagcaaggccacacagcccgaggcaggaagggcagcgcaggaacagggagcgagcagcgcacgggcaatggcggcttcttccgggacgcgctccgtgcgcctgctggtgctgctgctctgccttctcgggttctgcgtcgcgctgagccaccaggagtcggcggcggactcgtgcgccagggccaaggtcgcggtcgccagcctcgtgcccttcgactccacgtccttccgctgcaccgccgcctgggagcagcaggacttcgtcctcagggtatgcctgctgctggagcatttctgtgatccatctccttcttttttcacatacgttctagactagatcccactacncattgcactcactgcccaccgtgggctacttagtcaatcaataaccccgatctgacccgaaccacgcatcgtccgtgccggtcgccagtacaagaacacggggcccagcgagtggagcttcatcctctcggcgccggtcaggggctcgtacgtggcggtcggcttctcgggcaagggcgccatggtggggagcagcgccgtcgtcgggtgggcggccaacggcaggggcaccgtcaagcagtactacctcggcgggaagagccccgaggagtgcgcccccaacaggggcctcctcaagctcgtcaggaacaggaccgccgtcgcctcgcgctccggccgcctctacctcgccttccagctcagcaccgactacccgcagccgtacctgatctacgccgtcgggccggacggcagcctgccgcagtccgactcgctgcggctgccggcgcaccagaacatggcctcccgctccttcaactacacctccggtacgtccccggcccccggcccccgaattaatccacgcggtttttacatttttttttctccacccccggtgtgtgtgtgtgtcgaatcgacaaatgcgtgcgtgtgcgcagggctgtcgtacaacgtcgccgggtccggcgacgccgcgttcccgccggagaggaagcacgggctgctgggcatgatggggtggggcgtgctgatgcccatcggcatgatcaccgcgcgctacttccggcagctggacccgtgctggttctacacccacatggccatccaggtggctggctacgccgtcggcatcgcgggcatcgtcctcggcttccgcctcagcgaggacgggctcaggaacgtggacgtgcacaaggcgctcggcatcgccatcttggccatggcgtctcttcaggtacgcttttttttaggcaaagaaaaaaatatagaaaattgtctgagttactcgtagataacacgggggaaattgaatacagatcattgataatttgtattggtatccactttcggtttgctcggcacatgcgtacgctgtagattggaatatatagatctgccgcgatggccaggctggataaagcagcgtagttttacgggtgtttgtttgtagtggttgaccgtgattaagtacactatagcactgaagaagagaggacgtcttgagtcactcacatgccccgtgaaagcgagaagcctgcaaccagaatatagagggttccatttttgttgacagcagaggctagacagacaatgcgcggcgtagcctctgcacgttcttgagctggcaggtgacgggttccgagaaagcggctggagtagtttttatgcttggaagcttcggtcgccaacggaagtatggctcaacaactcgacaactcaagtgtgcatgtgaaagctgtcgatcactcaagttaacattgaacctagggaaaccgcagtactaccagtggagtaaaaagtccctaacgaagggccgagcgtcgtaaaaagtccatttttttcagatgaactagtggagtgagcgtctatattgttgcctttccgtgcgtgcttatggctgatgctgatgcgtgctttggtcttccgccaggtgatggcgatcctggcgcggccggacaagacgtccaaggtgcggcggttctggaactggtaccaccacaacatcgggcgcgcggcgatcctgctggccatcggcaacatcttcctgggcctctccatcgcgcaggagaccagcgcctacatcgtctcctacggcgtgttcgtcgccgtctgggtgctcgccgtcgccgccttcgagatgaagcgctgctacgccgacgacgactgatgagctagcgacacgtaagagtcacagttcggtcccaacagctgacggcgaagtttggtgtcgttaaactgagcgttccacggccagctgggacgtgacagacacacgagcgccgagcgcgcgcgcgcacacacacacaccattcttgttgttccgtagctcgcagctggacagtgcattattggttcggggaggtcgtgctttggttggctaatttaaaaaaaaaattgtttttttttgaggtataggatgtgaggaaggggacggtctgctgtttctaggctagctggacgctctgattcataaatttgtacattgattggtacgtggtcgtgttgtgttgtaccctttttggacgatagcatgttcttcgcccttttcttctaaaaaaaaaaaaaacggccgccgcccccgcggcggtatgcgtcgtttcagaacagcaccaaccaggatgctgtggtgtggtgcgtaccagcaccgaccacagatggaagtatcaaacccggattcgccgctgggggcgcccggcgcggcgacattccataccgtgatgcggcggtcggacgcacgcccaagtgttgtgttgtgtctcaacgaaggcaggcgaagttggatgcggggaagggaaccagtgcggtccgcggaatttcgctgtcgtccgggactccgcgggggcatctggacagccgcggccgaagcgccacgcggcgcgcacgtccggaaccccagcagcagccaggccccagccgacagccgcggcccgcgggctgagtccatggccggccggcacgtccgcacgcacggcgaggacgcgcggctgaatggccgtgctcagcggttgagcgcacgccgacgccgggtgcaaaagttgccgacgagtcacatcgaatcagcccgtgcttgtcgaggctcatcgccttcagagtcgcatcgaatcagctagtaatgcttatcgaggatcatcgtcttcggatggtggtgactaggatccggcgacacctcaccagtcaccacgactcgcagacgttgtcgccatcaccacaattctgaccccaagtaaccccaacggagtgcgcagcttaggccacaatttgaaccagacagctagcaccagcaacaggctaaggtggtccagaccatcatgtttagctgtttacgggtcaagcggacagcaacgttttcgtccatgccatttttttttgctgaagctgggggcttatagaccttgcgctaaggttcatctcgagcttggattctcggttaacagacacgtggtcttgacgccgatctggcaccaaatactagatgtgaaccgcctaacgatgctctctttgaaagcgctgacggtccgtggtcttagatcagacggttcggaatctcgacgtagtagcggatttctcaacgcacttgcacgctttcggacggtccacgtctgggggcggacggtccgcgcgcgcgtagatggactttttctccgcgaagaacctgaatcatctcgtctcccggaagggactccgtcgggaggaagagatccagtggttgttttagggtcgacagaccacataagacgtctctagatgacaccaaaccaaagagaggtgaagtaataggtcggggaagactaatagtagagctagactaagtctaaattactcctactcctaaggaattgaaaaaacggtgcaaataaggtaaatacgaataataggttttattggattaattgtgaaggctttgatgggtcattacccttcatctatataaaaaagaggtctgtagctgttacaaatcagtccccgagcttatcccatgattttgctaacaaaatcccgtaagaaatccaaaggtatgattggttacctgtactatcttatcatgagctatcgtatgtattgactt

SEQ ID NO: 3303 - DNA, 1855 bp, Zea mays
attgggaccctcgaggccggccggctgaggacagtagcagtagcaagtagcagcatactgtcctacgcgaatcgattaacgggcggcactcacccaccgtgtggcctgccaaactgtccccccggccccggcccccgcgcccgcgcctggccagtggccatccatcccttcccttcgcttcgacgcaccaatcttgtcccggcgcctgccaaatccagcaaggccacacagcccgaggcaggaagggcagcgcaggaacagggagcgagcagcgcacgggcaatggcggcttcttccgggacgcgctccgtgcgcctgctggtgctgctgctctgccttctcgggttctgcgtcgcgctgagccaccaggagtcggcggcggactcgtgcgccagggccaaggtcgcggtcgccagcctcgtgcccttcgactccacgtccttccgctgcaccgccgcctggaagcagcaggacttcgtcctcaggtacaagaacacggggcccagcgagtggagcttcatcctctcggcgccggacaggggctcgtacgtggcggtcggcttctcgggcaagggcgccatggtggggagcagcgccgtcgtcgggtgggcggccaacggcaggggcaccgtcaagcagtactacctcggcgggaagagccccgaggagtgcgcccccaacaggggcctcctcaagctcgtcaggaacaggaccgccgtcgcctcgcgctccggccgcctctacctcgccttccagctcagcaccgactacccgcagccgtacctgatctacgccgtcgggccggacggcagcctgccgcagtccgactcgctgcggctgccggcgcaccagaacatggcctcccgctccttcaactacacctccgggctgtcgtacaacgtcgccgggtccggcgacgccgcgttcccgccggagaggaagcacgggctgctgggcatgatggggtggggcgtgctgatgcccatcggcatgatcaccgcgcgctacttccggcagctggacccgtgctggttctacacccacatggccatccaggtggctggctacgccgtcggcatcgcgggcatcgtcctcggcttccgcctcagcgaggacgggctcaggaacgtggacgtgcacaaggcgctcggcatcgccatcttggccatggcgtctcttcaggtgatggcgatcctggcgcggccggacaagacgtccaaggtgcggcggttctggaactggtaccaccacaacatcgggcgcgcggcgatcctgctggccatcggcaacatcttcctgggcctctccatcgcgcaggagaccagcgcctacatcgtctcctacggcgtgttcgtcgccgtctgggtgctcgccgtcgccgccttcgagatgaagcgctgctacgccgacgacgactgatgagctagcgacacgtaagagtcacagttcggtcccaacagctgacggcgaagtttggtgtcgttaaactgagcgttccacggccagctgggacgtgacagacacacgagcgccgagcgcgcgcgcgcacacacacacaccattcttgttgttccgtagctcgcagctggacagtgcattattggttcggggaggtcgtgctttggttggctaatttaaaaaaaaaattgtttttttttgaggtataggatgtgaggaaggggacggtctgctgtttctaggctagctggacgctctgattcataaatttgtacattgattggtacgtggtcgtgttgtgttgtaccctttttggacgatagcatgttcttcgcccttttcttcttcttttgtctccaccgtgcattgatcaatgataattttattcgctgattct

SEQ ID NO: 3304 - DNA, 611 bp, Zea mays
  misc_feature (604)..(609): n is a, c, g, or t
cgggtcgaaagctagccacaggcaagggcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggagggtcggagggagatgctgctggctgccattgcctgtattcggttggattccgtttatatatatatttaagtactttaatttgggtctgaacatgtcgattgatccattcattttatttgctttgccatttctcccctttctgttaatttcgatatgtaaagaggggagaatgggagacactattcgtttggacatgacaattggaaattaatcaatacccatttgttagttaaaaaaaaagaaataaaaaaaaaaaaggaggnnnnnnaa

SEQ ID NO: 3305 - DNA, 2050 bp, Zea mays
atttcattcattatttcgtagaacagaaaaatggagggggcgtcaaggtctacaatttatttttagtgttttatagaggtcgttgcaagcggttggttcatactgcgcgtgagaataggtggcatctgaagccttcaaatacagtgagatcaactaacctcaatacacattattcaaagtttgaaaaccccgctaacaacatcaaccagattgacgatggcgaccaccacctacctctccgttctgcacatgcccacacgtcgcgcgcccggtgcgggttcctccacatggcgattggcgatggcgaccaccacctacctctcctcacctcccgttgccgtgtccacctaagattagccggctaccccccctaagggcgattgggttcctcgagcccggccgggaagctagccacaggcaagggcgcaaccaataatagcaagtgtgatcatccgttgatccatcttgctaataagcctgcgtgcccttcgttcttcctcgtctcgatcccgacgacgctccgttcggctccggcaaaccacatcaagtcgcgatggagatgaagaaggtcgcctgcgccgtcctcgccgccgccgcctccgccaccgtggtcctcgccgccgaggccccggcgcccgcccccaccagcgcctcctcggccgcgttcccggccgtcggcgccgtgctgggcgcctccgtgctctccttcttcgcctactacctgcagtaaaattaaaggaggatcggagggagaggctgctggctgccattgcctgtattcggttggattccgtttatatatatatttaagtactttaatttgggtctgaacatgtcgattgatccattcattttatttgctttgccatttctcccttttctgttaatttcgatatgtaaagaggggagaatgggagacactattcgtttggacatgacaattggaaattaatcaatacccattgttagttaaaaaaaaaaaaaaaaaaaggcggccaaaaaagcagcgacctatttccggcctctgattttcaaaatcgagggttatattggagaggatgaggcagtaataaatactccttgtttaaactggttttttttctcgtaatcaaatggcacaaattaagaataaaaactaatcttttcatcaaaaagaagaaaaactattcttcaataatggttatagttgtgtgttgcccgcatacctaacacatccaagattatttccagaagtgtaaccttttgcggagaacggttaaccatgagtgccaggccaaggcacatgctagccgtgcgcgctcatacaacatatgttagcacctatttttattaacaccatgtcgattgtgctgaagcggaactaccaagcgccgcattaaaaaaatgaattaaaaaatgagtctttatatgatcctaacataggtcttctcgtcaacgaaggttctctaaactaaagctactagatttatatttgtattctactatggtacaacaaaaacatattatttagccacaatagcactcaagagcgaagctttagagaaaattgaatataagtatattatagaaaattttatttaatacctactaaaaaacgatgttatttaagtaaaatagatatgtttctttatatattacattacattgtatgttattgtaagtggtagatttttattaatcattttaataaaaatatagatcctacccttttaaatttggcacagggcctcaattttttctgacccggcactgttaaccattaataaaaaaaatcaaagaaggtaatatggtcttcttcgctcatcatatgtatggcaaagtgggtcgttctaaatagggtaacactaaacacgacatgatccatagtgtttcggcacgacataaatatggtttatatagtgtcagtaccgacatgacatgggcctagtgtcgtgtttggaccgtcactccagtaggataggccggcacgagcacgatatgattaattggtcgacacgatttgtcacgacttggaccaaccgatggtctatagatgttattatgatgtgtg

SEQ ID NO: 3306 - DNA, 715 bp, Zea mays
ccccgggcccggccgggccgggaagtagccacaggcaagggcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcgcccaccagcgcctcctcggctgcgttcccggccgtcggcgccgtgctgagcgcctccgtgctctccttcttcgcctactacctgcagtaaaattaaaggaggatcggagggagaggctgctggctgccattgcctgtattcggttggatcccgtttatatatatatatatatatttaagtactttaatttgggtctgaacatgtcgattgatccattcattttatttgctttgccatttctcccctttctgttaatttcgatatgtaaagaggggagaatgggagacactattcgtttggacatgacaatcggaaattaatcaatacccatttgttagttaaaaaaaaaaaaaaaaagccacctcccaacgcaatttggccccttgggccttctttactctgattttcaaaatcgagggttatattgggagagggtgaggcaggaataaatactccttggtt

SEQ ID NO: 3307 - DNA, 1257 bp, Zea mays
attgggtccctcgaggccggccgggctctttttgttccctctttcctctcctctttccccatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtcggtccaccacgtgctgggcggcggcaaatccgccgacgtgctgctgtggcggaacaagaagatctcgtccagcgtgctgggcgtggcgacgctggtgtgggtgttcttcgagtggctggactaccacttcctcaccatcctctgcttcgtgctcgcgctcggcatggccgtccagttcgcctggtccatcttctcgtccagcgtgcctcgcgtgcagctgccggaggagctgttcgcgagcgccggcgcggccgccggcgcccaggtgaacagggcgctgggcttcctccaggacgtggcctgcggacgcgacctcaagcggctggtcatcgtgatcgccgggttcttcgctgcggcggtcgtcggcagcttctgcaacctcctgacggtcatctacatcgggttcgtgtgcgcgcacaccctgccggtgctgtacgagaggtaccaggaccaggtggacgagttcctgtacaacatgctagggctggtgcagagccagtacagcaagctggacagcaagggcatcctcaaggggggcgtcaagttcaggaagagcgactagctgatttcctcccatctacgactacgatttgattcatcctgggagtcttgatcgatcgacacttgttctgttctgtacagcgagtaacaaccgctgctgctagctacattctttactgtactgtacttgtgtgatgacatcatatcttcgcgtcgcgtgtactgaagaactacacattgcactaaggttgctttcgtacgtgtacgtgctcatctttcttccttggtaaaaaaaaaaaaaaaacgccctttgcaaaatgaagcgatcccttgtttttcttct

SEQ ID NO: 3308 - DNA, 877 bp, Zea mays
ctgtgcggcgctcccgccgcggcggcggacctccttgttctctgttccccgggcccgtccgggatccgtccatcaaccgggctgctctgctgcctctccggcgccattgacgagcaagagaatcctcatcctccgacacctggtccgtcgcgtgccgtgcggcccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcggcggcggcgagagcaggaagaagtcggtccaccacgtgctgggcggcggcaaatccgccgacgtgctgctgtggcggaacaagaagatctcgtccagcgtgctgggcgtggcgacgctggtgtgggtgttcttcgagtggctggactaccacttcctcaccatcctctgcttcatgctcgcgctcggcatggccgtccagttcgcctggtccatcttctcgtccagcgtgccccgcgtgcagctgccggaggagctgttcgcgagcgccggcgcggccgccggcgcccaggtgaacagggccctgggcttcctccaggacgtggcctgtggacgcgacctcaagcggctggtcatcgtgatcgccgggttcttcgcggcggcggtcgtcggcagcttctgcaacctcctgacggtcatctacatcgggttcctgtgcgcgcacaccctgccggtgctgtacgagaggtacca

SEQ ID NO: 3309 - DNA, 1144 bp, Zea mays
  misc_feature (1128)..(1129): n is a, c, g, or t
  misc_feature (1131)..(1131): n is a, c, g, or t
actcctatagggcattgggtccctcgaggccggccgggatccgtccaatcaacccgaccgggctgctctgctgcctctccggcgccattgacgagcaagagagtcctcatcctccggcacctggtccgtcgcgtgccgtgcccacccgctaaggccagggcgccccgacttgagctcaccgcgccgaactcgaaccgctgctgttcctcgggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcggcggcggcgagagcaggaagaagtcggtccaccacgtgctgggcggcggcaaatccgccgacgtgctgctgtggcggaacaagaagatctcgtccagcgtgctgggcgtggcgacgctggtgtgggtcttcttcgagtggctggactaccacttcctcaccatcctctgcttcatgctcgcgctcggcatggccgtccagttcgcctggtccatcttctcgtccagcgtgccccgcgtgcagctgccggaggagctgttcgcgagcgccggcgcggccgccggcgcccaggtgaacagggcgctgggcttcctccaggacgtggcctgtggacgcgacctcaagcggctggtcatcgtgatcgccgggttcttcgcggcggcggtcgtcggcagcttctgcaacctcctgacggtcatctacatcgggttcgtgtgcgcgcacaccctgcctgtgctgtacgagaggtaccaggaccaggtggacgagttcctgtacaacatgctagggctggtgcagagccagtacagcaagctggacagcaagggcatcctcaaggggggcgtcaagttcaggaagagcgactagctgatttcctcccatctacaatttgattcagcttgcgagtcttggtcgatcgacacttgtttctgtacagcgagtaacaaccgctgctgctacattctttactgtacttgcgtgatgacatcatatcttcgcgtcgcgtgtactcaagacccacactttgcccttttnngnaaaagaataaaat

SEQ ID NO: 3310 - DNA, 634 bp, Zea mays
cattgggtacctcgaggccggccgggatccgttcttcaaccgggctgctctgctgcctctccggcgccattgacgagcaagataatcctcatcctccgacacctggtccgtcgcgtgccgtgcccacccgctaaggccagggcgccccgactcgagctcaccgcgtcgaactcgaaccgctgctgttcctcgggggcagggtcgtcgaggatgccggtgcactcagagaacgcggcggcggacctgatgggcaacatcatggagaccattgcggagaacctcccgaggcagaagtccgtgcggttcgacgacggcgacggctcctccatctccgagcaggccaagaagctgttcggcggcggcgagagcaggaagaagtcggtccaccacgtgctgggcggcggcaaatccgccgacgtgctgctgtggcggaacaagaagatctcgtccagcgtgctgggcgtggcgacgctgggtgtgggtgttcttcgagtggctggactaccacttcctcaccatcctctgcttcatgctcgcgctcggcatggccgtccagttcgcctggtccatcttctcgtccagcgtgcctcgcgtgcagctggcggaggagctgttcgcgagcgccggcgcggcc

SEQ ID NO: 3311 - DNA, 1514 bp, Zea mays
aaatagcctcctccgagcagtgtagccaaaacactcttctcttccacttgactcccagtctcccactgtgcgcagttcgcttggtccccggagccccaaaggcggcggtgagccggagcccggagacgacggcgcggcgcgactcccccctaagcgacagcggcggcgtcgacgtaagcggctgcgtggcgccaccgacggaggctacgagcggttgtggaggcagatatgagaggtggaggtggctacaacgggtcggcggctgtgagatactgaaatccgcactgcagttctcttcttcccccaatcagtaccacctctccaagtggcaatcaccatgggagatcaatctggctctagaaatggaccacaacagaagtacgtttcaggagcccagaatgcctgggatatgttctctgatgagctgtcacagaaacacatcactactggttctggtgacctcaatgacatacttggtggcgggattcactgcaaagaagttactgagatcggtggcgtcccaggggttggtaaaactcaactggggattcaactagcaatcaatgtacaaatcccagtggaatgtggtggccttggtgggaaagcagtttatatagatacagagggcagtttcatggttgaacgtgtctaccagattgctgaagggtgtattagggacatactggagcactttccgcacagccatgagaagtcctcttctgtccaaaaacaattacagcctgagcgtttcctggcggatatctattacttccggatatgcagttacaccgaacaaattgcagtcataaactacatggagaagttcctcagagagcataaagatgtgcgtatagttattattgatagtgttactttccactttcgacaagattttgaagatctggcactgaggaccagagtgctaagtggattatcattgaagttaatgaagattgcaaagacatataacttggcagttgtcttgttgaaccaagtcactactaaatttacagaagggtcatttcaattgactcttgctctaggtgacagctggtcccactcatgcacgaaccggttgattctgcactggaatgggaacgaacgatacgcacatcttgataagtctccttcacttccagtagcctcagcaccgtatgcagtgacaggcaaagggattagagatgctgtgagctcaaaccacaagcgagcccgagtaacgtagcattcttggtgtcaagcacttgtatgtccactacgctcctgcagctttcttcgccatggatcttttggactagtgaggtgagactggagaatagtaccattttgttgattctcagttgctttgtgccgttggctaccaaccaaccttaagagagaagtaaatacaacagaacaggctaatatagtgttttgtatctgaacatctggcccatcgtacattcagtaaagcctataatagcgggcaaaaaaaaaaaaaaaagatcaccgatcacccgaggcggggcccggtaccc

SEQ ID NO: 3312 - DNA, 6565 bp, Zea mays
  misc_feature (1562)..(1562): n is a, c, g, or t
  misc_feature (3267)..(3267): n is a, c, g, or t
  misc_feature (3565)..(3565): n is a, c, g, or t
  misc_feature (3627)..(3627): n is a, c, g, or t
tgctggtcttgcaaatatgcgtgccaggaactatggcatccaagaggttgacaagctgaaggcaaaaattattgcaggaaggagcatcccagctattgcaacttcaactgccatggcgacaggactagtgtgccttgagctttacaaagttctggccagagggcacccaatcgaagactaccgcaatacatttgctaacctggccctaccgatgctcaccacatctgaacctcttccccccactgtgatcaagcatggagatatgacgtggaccgtatgggatcggtggtctatcgagggagacatcacagttgcagagctcctgaagtggttaagcgacaagggcctgagtgcgtacagtgtctcctgcggcacatcgttgctctacaacataatgttcacaaggcacaaggatcgactgagcaagaagatcagagacgtagccaaggaggtggcaaaggtagacattccagaatacaggaagcatctggatgtcgtcgttgcttgtgaggatgacaacgggaaagatgtcgacatccctcttatctccatttatttccggtaggttgcactgtggaaagagttgaatgggaaaaaagagggtcccgtgaaaaagagatttgggtagattcataagttctgtcaataatattctctctcttgtaactagaaatcggtagcgaagtgatcacagctggagttgcttgtggtgcgtctccttacggttgtgtacgagtgcttggggtcctgctgttgcatgccaactatttgcaggtgtgcaatgtgatgtggatatttttgatgaatgaatcttcggagcttcagaatatatttacgcagcacttcactgcaatcgtcaatgtcagatagcaatttcagtctcttcaattgttaacatggttcatactcacatatgatactgatacatgtctattccatccttttttaacttctcagcgtgccttgaaggcaacgcggttaattctctgaatgagcagggagttgccagagcgcttttgatacaacgctgtcaccattgagattgcgattcttgactgtgaccttaagggggccttggtgagtgcaggccagcagtttgcggtggcggtgcgtcgtcggtgcgcagcggtgaagtaaactgtaaggtgcacggcggccgtgttcatttcattgcggcttggttcagtccattccattccacgcgtttccctcatgagggatgaggctgggcagtggcgagtggcgacggaggtgtccgtcccgtggccggtgcgcgggccggcaaggtcaccccagcgtcatcttattgcctccgccctctggcacatgcctgtgtctctggccgaggccaggccaggaccaggaaacgctgtctctcgctttcgcctcactccagcactcgaggcaccagcaccacggcccatccctccccccgcgacggcacatggatggatcaggatggcccgtgtcttacactccaagtcaccgggcgatgatgcccgttccccggctccgctgcctgcctgcctgccgccgccgcattccgctccactagccaaagnaacaactcgccacgggacagtaggccacgcgcggacgcggtagcgcccctcctcccccgtcaccaggcaccgaaaggacggcacggcaatatcttaacctccggaaagtcgttgcattgcctttgccacacacgtatccgatcgcgatcgtatattcagtaggtgtggtggacaataaacaaaccgggatcgggcgggcgatgtattggtattggggactcagcgagcgttcgtcaccgtcacgcggcaaggcagcgcaacatgcacctcacgacttcctgcagctgcaccgcagtgcagggtctgcagatccgcctgcgcggcgtttatccgtcaccgcagtgcagggagacagcaggcgatcaggccagcttattggctgcctacatacctaacccgacaagaatatccatcagtttttcctagctaacgctaataatggaacgagaacaacagcgccccgggttcgcaattgcagctggcaggcgctaatcatccgatccgagacctctcaactcccccaggaagctagagctagctcctgcagcactgctgctacacatgctcatcatgatcaaggagaagcagaagccaccgaccgacccagcgaggccggcctgtctgtccgtgtccgtgtccgtgtccccgtccccgtcgcacggcacggtcgcgcgtccccgtcgccacaccctccaccgtcacttcctgtcgccgcacggccgcgcgcgcgctcccccacctggttcgctgctctccgcccagcgccagcggcggaaacgaccgggcagctctcggcccggccgcatgggaattgggaatcaggcaggtcgccgccgttggacgcaataagggttaacaaacaccacctcttttgtaaatcctgctgcatgcgctgcgttcgttgatcgccggcaacggtcgagaagaacgtgagcatccgatccgatgcgcttgggggatcacccaaacccccctatcccctctgcccgtctgagatcgcagttgactgcgaattcatgagcgtccaattaagtggcctgtgttcgtctggggctgctgctggggcggtttaccggtcgcggtcaactggatgaggcgtccccgtccccctcgctcgcctgcgatcagggcccgactgggggtttaatggcgattgtggcatcccgtcccgtgcgttgcttcacgtgatgctgctggtatagtagacctcgacgtgcacgtcggcatcggcgcagatgcctgtaggctgtagccctcggaagggcgcgcgtcagatagagattgccaaagacatgtacaccctccatattccttctaatggttatatagtaataacaaatatttctttgaacaattttttatttgattatctaaatatagccatcttttgttttgaattcctggctagttaaaatagaaaacagaaataactacctagaccgcaaataaaaatatagaaacaaaccatgcattgaaagagtaaaaagtaaagcacacataaaatatagaaaaaatattgaaatcttaaaaatatagaacacaactttttttacatacaaatagacctctaaataataatgatttatataataaattttataaagactcatgaagatacttaaacctgactgagccttctcaacaagctgatagattaccatgacataagccttgtcatgtcacaacttgttacatacaccacaantattttaggcgagcatttgatttaacgtcataacctactatttctttattctcgacaccccgtcccgtgtgtccagggtcctaaaccctccttttttgaggaaaaaatatagccaccaagaaacatccaagcaggtgacgtttggttcatatattggtaacataatgagtaaccgataacgttaaatcatgtttgtttaaatctaaccataattaataccacattagaaatagatactgtcttattcaaatttgttaccgctaatattcgagcgtgaatcgttaacattaccattttngttacatttcgtaaaccaaatgtaccatagcgatgtgactgtggattcaaagcccgatgtcntttcgaaaccacataaaatttataacgttgtcgtgtcaaagattgagcaacagaggcgtggcaagttttcaaaccccctaacgcagagccatgtctctaggaattattgggtaagcttagattaacctgggattcatatctgcgaaatgattacaacaacaaccaaaacatttttaatttataaaaattaaaaaaaggaattctgaaagcccttcagttgtgtggtcgccttcgtgccgcctcctttccctgtcttccgccccaccagaccagaccagaccaccaccctccggctgctacttttgcgcctccaccgcccatccccaaagccccaaccgactgcgcgtcccctctcctcccaaacgcattccatcctctctcctccagtgacagcctccggcgcctcctcgggctgccatccagcccgtgccactgccactgccactgcacttgctgtgccgacccgagctgcggtcgagtgagcaatggagcggcggcggcggcggccaccgaggctgccgctccttgtgttcgtcttagttgccaccacttgccccctcgggagctcaggtttgtttcttctccttggactttggatttcgtcggagtaattgaggtcatcgggtgcgcatttgggcttatggtgttctgctgctgcctccctgctcgcagcagggattggaagcttcggagtcggtgcggagagcaatggagcttcgtctagttttaggttagtgtgctcagattcttaaaattacatcttcatgttgttactttttatactctcggaaatatgtttattactcgctagaaatgggtacagctgtttttttttatattcagcttggaggcttggatgcttttttgggtttggcgtgttgtcacacatgggctagcaaatggggaaaaaaaaagttgtgaatttggttttttgaccttgtaaagagttgcctctcaggctctgggttgaattgaactggcatcagaatcagccaccgggtatttggatctttttaactgttgtcatgcttctttttgtactggatccagcagtaaagctttggagtaaaagccatatagtgaaggatggctaggtcaaaaagaaaaccccgtttcaacttcaattctgatttctgaagcacaattgaccgtttagaaagtaaaaaaataattaggtgaataaaaattaatcaagtgaattattttttcatactgccatctatagaaaatgtgtcttcttggcttgccaatatgactaatccttctgtagaaattccagggagagagctcactagtcccccccccccagaaacgaagatggcctatttcatctgccacatacacgggctctcacgcacaagagcagatctcatagaaaagttccaacacccgcaccagcaccagcgtctgctccagcaccctcaccatccatgtctccaccggacagctcaccgtctccgtcaccacatggttcacacccaatgccacgccaatcaactccacatcgtcatccatccataacacctccacatttggtcaggcctgggcctaggcaagatggaaatgatcctttggttgatactccagctcattctcggcataaacatttttggacaacctatggtttagttgcagcagggattgcggttttccttttggtatcagcagctagtattctctgcttccgagctaagaaaatgggaaccgtaaggccatgggcgacaggtctaagtggacaattgcagaaagcttttgtaactggtgtaccttcgctgaaacgatcagagctggaaacggcatgcgaggatttcagcaacataattggttctacctctacctgcatgctgtacaagggaactttatctagtggagttgaaatcgctgtggcctcaagcttggtaacatctgcaaaggattggtcgaaagaaaatgaatcacagtacaggaaaaagatcacaaacttgtccaaagtgagtcacaagaattttatgaacttgcttggctactgtgaggaagagcatccctttaccagagtgatggtatttgaatatgctccaaatgggacactttttgagcatctccatgtcagggaagcagagaagcttgactggatggcacggctcaggatatccatgggcattgcttactgtcttgagcacatgcatcagctgcaaacaccagctgcgctgaggaactttgactcgactacagtataccttactgatgacttcgctgcaaaagtctcggatcttgaattttggaacgacgcaaagggacataattctactaccaacaatgaactggctttctccccagacatggaggacattgtgcgcaagtacggcatggtgttgttggagatattgaccggaagagttccttcctccgaggatgacggaccactggaaaattgggtgtctcgctattttgaaggcgggatgcgtcttgaggagctgattgaccctagcatcggcttcttccccgaggacactgcacgagccctttgtgaggttgtgaggtcctgcatcgatcgggatccaaagaagagaccgcagatgaaagaggtcgcagctcggatgagagagatcaccgcgctggggcctgatggggcaactccgaaggtgtcaccgctctggtgggctgagcttgagattatgacttctgagagctgagttcgacgcatgccagatgatattgtttctcctagtgtgactgagaattctttgagctactactggctgctgctaatcttgtttgtggaagtggtgattaggtagaatttgttatgtgtgcagaattgcatatagggattggtattgtacttgtacatgtcaagaaggtttaacacacaacatactgatacgcaggcattccagccaggtgagcaatagaaagcatgtgtggcttgtttttgctgcaaaaaaaaaaaaaaaaaaaa

SEQ ID NO: 3313 - DNA, 2702 bp, Zea mays
cttcgagggtctacaccgtagaatttgagataaatacaaagtagcacaaacaaaaaaacaaacaaacaaggcctaaagagaaaacatataagtgctgatcccattacctacacactacgatgcaggcaaaagccccgtctcactttttgtcccagcccagcacccagcctaaaccagtgattgaaagcagaagcccaccaccaccgttcatcctcacgatcgcgtcacatgcgctccatcaccccgcgcctaacctggggtccaccgccgtcggcgcgttggccacccctcctccggcacacgacgctgccccactgtcactggtcaccagtgaccagcctctgtccatcgcatcaactcggcggcaagctagtggtagcagtggcagaccgccgcgccactcatcccgttcggggacgtggccccggaggtccccgcggcggcgcacgatggccgccgacacggcgcacaggcgccccctgcccgagggccgaggcgagaagcacccagccgagccacggccacccaggtcaggtcagagccagaggccactgctggtcccccggccgccaaaacctaacttctcgcagtggcagcacctgtagccgcagttccgcgccagcactacaccgacgggtgggaccggggcaggtacagtgatggttgttggtccacgaggcagttatcgcgcgcgggctcggtacggcaccggtaggtaacgggtagaccggcggaggcgcggtgcccgtggcacctgtggggtcgcggtcgcgcctgcccgcctggccccgccgtgcgcgcggtacggcaccgccccgcacagtacaaattctcggcgattgctgctggcctgtcgctccaagccgggcgccactgtgccgcggtcaaagacgagtgacgcgtgcgatcgggagccaccctcaccaactccacagtcgacaccaccttcaccgccccgacgcgcgccactgacgcgccggccaggcggtaaataaaagccaacccaaccggaccggaactgctccaccgacccggcgccgatgcccataaacttcgagagcgaccaccagctgaaacaccccgtcatctcctactgtctatgccatacggcggccgccgcgacgctccctaggctccgagtccgagctgggaaggaagagcccgcgttgctcgctcgctcgctcgcatgcagctttcccacacggcgccacgcatgcaggagcccgggcgccggcccgtaccgccgttcgcgggcgtcgacctccgccgccccaggggctaccccgctccggcggcgaaggaggcggaggaggagccggccccagctccggcgccgggcggcgacccgtgcccgcggtgcgggtcgcgggacaccaagttctgctactacaacaactacaacacgtcgcagccgcgccacttctgcaagtcgtgccgccgctactggaccaagggcgggtccctccgtaacgtccccgtcgggggcggcacccgcaagagcggctcctcgtcctcggcctcggcaacggcaacgccaaccccgacctcgaccggcgccgcacccaagagcccgaggtcgtccaagaactccaagcgtcgccgcgtcggcccggccccggcgccggaccccgcccctgccaccgccaccgccaccgctgacgtcgcgaacacggcaccgtcgacggaagccgcagcagcaacgcgtgccgcctcggagaagccggccgcggcggaacccgcagcggcaacgggtgccgcctcggagaagccggccgcgacggagctcgcagcagccgttgtctccacggagaaaccgccggcggccgtcggcggtttcacggacacgtctacggcgcccgagaccgggctcgcagatgtctgcagcggcggcgtgaaggagcttgtgccggacccgggccacttcgagtggccgtcgggctgcgatctggggtcctactggggcaccagcgtgttcgccgacaccgacccggcgctgttcctgaacctgccgtgagccgtgacaacgccacggcgtccatgctcaactaatcaaccatcacacgacccacgagatagatgagatgtgaaccgagcacgctgagcgtcaagctcttgaaggcttgaagctgtgctgtagtttcctgagcttactagcgatctctgcttgtctctgatctgataatctcttactagtcgccgtttgtgctccgatctagtaacggctaacatggtcggctgttacaagtgcatgaacctgtgcttgatcttgagctaaatcatggtgtttttgaggctatgatcgaggatcacaagaacagctgcaaggagaacggcgacttgcaagtcgtgtcattgtaactcttggtttggttggaggcatatattctgaagccgtctaaagcatgctgcgcaagcgctaaactagtattatcgtttataaccaccacctatcgacgtacgatcatgttccggttcattcgccagttgtcgtcgtcacgtatataatacgcagaaaccaattgtaaattgctaatcagtcccagagctgcagagcaacacgacggcatggagacatggagtcgatcgtgtcgtgcatccggccgaggtcacgccacgccacgccacaggccgagcgagaatattaatcggtggacggtggtagggcagaaaggctggctcacgacgtacaaggggcacgccgc

SEQ ID NO: 3314 - DNA, 2697 bp, Zea mays
atcaatagcagttgtgacaaagtacctgcgatgacctcgtccgccttggcttgctttattcgtgatacaaagcagaaacccgccaccatcatcctcagatcctcacgttcgcgtcacatgcgctccaccaccccggcctaacttgggcccactgccgtcggcgcgttggccacccttcctccgccctccggcacacgacgctgcttcactgccactggtcaccagcctctgtgccactgatcctcagacgcggccgccccccgttcgggacctaggcgatcggtctacggtccagtactccggtccgtcgcactaaaactcggcgaacaaatagccattcatccagttcggtgtcgtgaccgcggaaatcccccgccgaccgctgttgcgggcaatggccgccgacgccgacacggcgcggcgcagagcgccactgcccggggcgagaaacacccagcccaggccactggtcccgcggccgctaaaaacccaacttcctgtagccgcagttccgcaccagtactcgaccgacgggcgggaccggggcatgtgcaccgatcgttggtccacgaggcagctaccgcgcgcgggctcggcacggcacacgtagaccgtcgcgggcaaggtgccgtgccaccagtggggtcgcggtcgggggctcggggctggccacctggccccgccgtgtgcgcgcgccacggacgcgtacgggtacggcaccgcccgccccgtacagtacaaactctcggcggttgctgtttgcctgtcgctccccgccggtcgccactgtgccgtgtgcctcggtcaagaagagtgacgcgtgcgccaccctcaccgactccacagtcgacactcgacaccacctcacatccccgcgcaccgctcgacgtgcgcgaccacgagccactgacgcgtcggcccgcccggcggtaaacataagcgaagcggtgagagttacccggaccgaccgggcctggtccaccgacccggcgccggtgcccataaactcgagtccgcgacgccggccggggctagctagcagctgaaactgaaacagcccgtcatctaccattcgcccgccgcaacgctccctgctcggaacagcctgcgttgctcgcccacacgacgccacgcatgcaggaggagccagggcgtcgtcccgtgccgccgttcgcgggcgtggacctccgccgccccaagggctaccccgtggcggttgccaaggaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacgcgcaagagcagcagcagcagcagctcctcatcatcctcggcgacgacgacgtcaacctcgcccggcgccgcgcccaaggccacgaagcggtcgaagaactccaagcgccgccgcgtcgcgcctgccccggaccccgccgcgcccggcacggacgcctccaccgccgacgtcgcgagcacggcaccgtccgcagcgacggtgactgcctcggagaagccgagcgcgacggagcacgcagcggcggctgtcgccacggagaagccgccggccgcgcttccggtgtccgtcggcgctttcgcggacacgtccccggcgccagatgctgggagcggcggcgttagggagctgctgccgcacccgagccgcttcgagtggccgtcgggctgcgacctggggccgccctactggggctggggcaccagcgtgttcgccgacaccgacccggcgctgttcctcaatctgccgtgagtgacccgtgacaacgccatggcgcccatggttaactaatcaaccatgatcacacggtcgacgagatgagaggaacagagcacgcagtgcgtcgggctcttgaagctaggcgctgtagtagtctcctaagcttactgttgtctagaccgatagtctcgcgtacttgtgtagttgtgttgatggtttttaatcgccgctttgtactgcaattctagtaaaaaggctaacatatgggatagccgggctctgcatgaatctgtgcttgctttgacagtttgacctgattgtggtgctttcttagtttaaggccatgagaatcgcaagaacagggaacggcgaacttcgaagaaatcgtgtcgttgcaagtgttggaggcatatattcttaaagccggccacgcatgtaggtagtgtgacgctggttctcgcaaagtgcaaacgctaaactaggcgagtacgaaaatgtacgttgtctgaatgctacagttatgtttagcacgcacgtactcctacactcgccgcgcagcgtggtgctgatggaactcaagccaggccggattcgttcggttgggcgtcggcgtcgcgggggcttttcgaaattccgggccgcggcgggcgccgacaacgcgttgattccgatcgcgacgcgtcgcgattccgacggcgacgggccgtcctgcgcgccgtgtcagcgacggatccgggtcaggtcaggtcgtcaatcgccgccctgtactgcggccgcgatgtgtgtcggggtgcgattcgtcccgcccgcttgggctcggcccccggggttcacgccagcgacagccacgacgcgtcttcg

SEQ ID NO: 3315 - DNA, 4342 bp, Zea mays
  misc_feature (1403)..(1403): n is a, c, g, or t
  misc_feature (3107)..(3107): n is a, c, g, or t
caaatattttaatactttttgtagtttaattacataacaattgtatataaaaaattgactgtacaacatttttcatcattaaaagctaggttggaaattaaaatctccttggaatctccatcattttccaagatgagggggtgtttggtttttagggactaatttttagttcctctatcttattctattttagttcatataaattgttaaatacggaaagttttcgtattggcaatttagggactaaaataaagtggctaaaaattagtccctagaaaccaaacactttctagtaatattcggcagtgatatttgaataagacatttttatatgtgggtttttttctccttgtgtttagcccattgcttctgaaaggtaaagacaatttgtcgggaaaggaaaacatctttcaaaaaaaaaagtgtgccaaccaacatcctcaaagggggacgttattctatccacgctcaatgcacgtgacgacaagatgcggcagtggttttcttctcattgttaccgctaatcacgtggacaggtaatcatggcttgctaacacattttagagtcccacttccaatcagcggagggctaaaacgaagtaatccgcccctagattaattggtggcttactggcttgctttctagtctccggcacaagattccctctccagcggcgcaccaccgctaccatcctccgacccccaacctgaacccgccatgtcaccggcgccgtcgcgcccccgcatccgtccgtggctggtggtgggtgacctggcactggcggccgcgtgggtttgcgcgggcgcgctggtcaagctgctcgtttacggcggactcggcctcgggggacggcccgaggccgaggccgtcaaggtctcgctctccctcgtatacatgttcctcttcgcctggctcgaggctgcctcgggtggggcctcctacaatccgctcaccgtcctcgccgctgcgctcgcctcccacggcggacccgccgtgtacctgttcaccgcgttcgcgcgaatcccagctcaggtgatgttcctgtactacaccgcgatcgggatctgtgtcgtgcttctatttgctggaattggtcttcggtcaatcggtggtgtgtatttactaatgaagcttataacactaacaccatctggtaatttggttgaatgtggttgatcaacaaagattggcctaggtattgaactggataagaaactgagcggtcaccactagacactagttatataatttggttctctcaaaattaatccagtgtacttctaaaaagagaaaacgcacaagtctagctctcattaccataaatactaaggatactaagggggtgtttgaatgcactagagataatagttagctaaatttagctagagatattcaaacacantagctaatagttcagctattagctatttttagtaaattagctactagttagctaactatttattagctagctaattctaccagtatatttttagctaactaactattagctttagtgcattcaaacaccccctaatactattgtagcattcattcatcgcaacatggctgattccataagccattatctttgtcactgtgtctgaaagtctgaaactcacagtatacagtaatggacatttcctttttaatcccgtcaactgctatgactgtttatttatggatacggatctgtgtgtttgtctgttaaattttgtcgtattcgccatgactatcaggtgattggggcggttcttggagtaaagctcattcaagtaactttccctaatgtgggtaaaggagcccgcttaagtgttggtgctcatcatggtgcgttagctgaaggcttagcaactttcatggttgttatggtatcggtgaccctgaaaaagaaggagatgaaaagtttctttatgaagacatggatcacaagcatttggaagaacacaattcatctccttagctcggatataactggagggattatgaaccctgcatctgtaagtcttacacatgaggcatgcacatgtttaatacacaaatgaaccttttggatttgaatgtttgttccttatgaatcaaactgaaaaaagggcagaccttgtggggtttgggaaagggatatatcgaaataagtcttctccctacaaatgtggagaagctccttcgaacctgtgacccggtgattcagctctcatcgctgcaccaggcctgcccaacaccaaatttgttatgattccaacattgtgtgcaccctcttagtttgcatactgatatatttatacccatgtattatcacatcatattatgattgatcgagttatgcactcttctctttggcacatgcaaatagtatgtgatcttgtagttgccaggtggatcatgcagcagaacagtttatatgatggtgtgccttataagatgtagtgcatattcttttttatgttaagtttgttctgcaacagtcattgtagattatgacccctggcttcatgataagatgtttgctcgtattatacctgacgttcattgtttgtcttggttcatgcaattcttgaaaattagtaactcaaattcatttttctgattattgcatgttctggtacatatacgcttctaggcttttgcttgggcgtatgctcgaggagatcatacaacatttgaccacctactggtatattggctggcgcccctgcaagcaaccctgctgggagtatgggcggtgaccttcttcactaaaccgaagaagatcaaggagcaaaaggtagatgaaaacaagataaagaaggaatagactattcttgaattagagctagagcttcataccatcttcttagtcagataacttgtggctacacacaaggcgaaatgtttcgaagctaatctaagaaatggcaacctatcatggtcagcttctgtgaagtctccttgatgtgtattccttgtatctggcttagcttagattgtgcagaagcttgtaagcaactgctccaggcttccattcaagacattgtcgtattggaaacagtatatatggaagctaaagcttctcagaaaaaaaaacaaataaaaaaaaaaaaaaaacagcattgttgaaagtatcttnagttccattatctatgataatgggaaattgcaggtctcatctagtttccaggaaaacgaaccaccagtctgcgctgtgaatgatcgattgaaatattttctgatgcatatttctggaaggtccttagaatcctgcaaatcctttgaaatttggcaaggacattcctggatttctggtgaaggtctatatacctgccagctgcaacagtgcataaaaaataacagcaagacatccaagtacccgaagctgttcgttggtcttcgatcgagaactggtccgatgccaaactttcggtaatcatctgattgcggcatcgcactgatatttgaggataacaatctctatttgattgtgcaaaaagtgaggttgtactcaaaattagaatattgaagctgtgtttcccctctatgataagttgataataagacagatagtaatcactcgctgtcggcagaagttacacatcatggaccttacattgcaaattgcaatcatgcatataagcatggacatgtctgcacgacatgtgagtaaacatgcgattcaatcataccgttaaggcattgatcactcattcatcctgggcctggggctcaccatcatctccgttgtcagaatccaagggactgaaaaacttgccatccagcaggtacgagccgacggcgagccgcacgacccagacgtccttgggcttccgcgccatgatcctgctcgaccaaaaccaccatcaaggcactgtgtacggtccatcgtcatgtgctagagcaactagctggtaccttccgacgtcgccgggcttgacctgaccgctgttgtgccggagcgacggcaccgacgcggcggtcttgagcatcacaggcgcctcgacgatgatgatcggggagcccaccttgagcttcgctttcgtgtcgcccgctgcgggcacgccaccgccgttcggcgcgcaccggacggcgacgccggcaggacgccgtcgtcccagagaagctgggacacgccgcggcggtgagatgaaggacgaatagacggcagcacttactgccgcgagcaacgggtgcggcatgctataccaaatggaacaaacaggcattgtgcagactgtttgtgcagctaggcgcttcaactgccgctctaatcaacgtgtggctccgacgggatggatgaagatgatggggaactcactttttttttggatgaattgaaatgtgcgtgcgtgcttgcgcgctgcagtggcg

SEQ ID NO: 3316 - DNA, 1245 bp, Zea mays
aaaacgaagtaatccgcccctagattaattggtggcttactggcttgctttctagtctccggcacaagattccctctccagcggcgcaccaccgctaccatcctccgacccccaacctgaacccgccatgtcaccggcgccgtcgcgcccccgcatccgtccgtggctggtggtgggtgacctggcactggcggccgcgtgggtttgcgcgggcgcgctggtcaagctgctcgtttacggcggactcggcctcgggggacggcccgaggccgaggccgtcaaggtctcgctctccctcgtatacatgttcctcttcgcctggctcgaggctgcctcgggtggggcctcctacaatccgctcaccgtcctcgccgctgcgctcgcctcccacggcggacccgccgtgtacctgttcaccgcgttcgcgcgaatcccagctcaggtgattggggcggttcttggagtaaagctcattcaagtaactttccctaatgtgggtaaaggagcccgcttaagtgttggtgctcatcatggtgcgttagctgaaggcttagcaactttcatggttgttatggtatcggtgaccctgaaaaagaaggagatgaaaagtttctttatgaagacatggatcacaagcatttggaagaacacaattcatctccttagctcggatataactggagggattatgaaccctgcatctgcttttgcttgggcgtacgctcgaggagatcatacaacatttgaccacctactggtatattggctggcgcccctgcaagcaacccttctgggagtatgggcggtgaccttcttcactaaaccgaagaagatcaaggagcaaaaggtagatgaaaacaagataaagaaggaatagactattcttgaattagagctagagcttcataccatcttcttagtcagataacttgtggctacacacaaggcgaaatgtttcgaagctaatctaagaaatggcaacctatcatggtcagcttctgtgaagtctccttgatgtgtattccttgtatctggcttagcttagattgtgcagaagcttgtaagcaactgctccaggcttccattcaagacattgtcgtattggaaacagtatatatggaagctaaagcttctcagagttgactcacaacctacactaatgttccacagcattgttgaaagtatcttgagttccattatctatgataatgggaaattgcaggtctcatctagtttccaaaaaaa

SEQ ID NO: 3317 - DNA, 2662 bp, Zea mays
gtgatgcaattgaaggaacaactatgtttgccagtaaaaggtattggggaggagaagaaggggacacaatgttccgctggatacgcccaattccggtgggaaccgaggaggggggggggggagcaacaagttcatcatacacctgtgaaatgcaatgacattggcttctacatatctgtcttgtgcaagcctgttagaaatgatggagttgatggttctttagtgtcgactgaagcgattggtcctattataccagggccaccggcgtggcaatctcttgaactagctggctctatggttgaaggtggccgtttgacctttcatgctgtgtatacaggaggtttgcggggaagttgcatccaagaatgggtcagattacatgatgatgggcacaaggacaagttgactgctgatgaatgtctagaccttgatctagctgatatcgattgccggattgaacttatgtatacacctgtacgagaagacggagtgcacgggttaccaaggagtgttacttctgatacaatcttacctggggagcccaagggtgtcaatcttattctacctgagtgttttgaggacaatgaaatttctcccatcaaaacctatttcggtggcaaggaaggcactggcaaatatacatggtttcgaaataaagagaaacttgataacttggaatttgatctggttgctgaatcatcagaagttgttggagaaaccttaaaatataagccttcattgaatgatgttagttcctatctgattctttattgggttcctacacggcgtgatggaaaggttggtgatcctttgatggctatctctgatgatccggtcatggcagcttttccatctgtttcggatgttcacttagagcagaaaagttcagatgtatattgtggactaggcatctattatggtggatatgagggattaagcttgtatagatggtacagggaatctagtgatggaactaggcttcacatagatggtgctgattcagtcacatacgaagtgacagatgctgattacagctgccgtctactgtttggttatactcctgttcgttcagatgggataagtggagaagaaaaactctctgaaccatctgatgtaattttgccagaactactcaaaatcgagacactcaatttcaaggggaatcaggttgaaagagaaacactgactgctgctgaacaaattccgtacagtgagattcaacaacatatatggaaaaattataagaaagagatgaaatatcaatggtttatttccaatgaatcaggaggcgatcagtcttttgaaccattggcaacccagtgttctcgctcatacaaagtgcgctttgaggatattggtcgttgcctgaaatgcgaatgctttgtcactgatgtatttggacgatctagtgaattggtatccgctgtgactgctcctattttgccaggaaggcctaaaattgaaaagctggagattgaaggaagaggtttccacactgacctatatgccgttcagggtacctatagcggaggcaaagaaggcaagagtaaaatacaatggctcagatcgatggttggaagccctgatcttatctccatacctggcgaaactggaagaacgtatgaagctaatgttgatgatgtagggtataggcttgttgcaatttatacacctgtaagagaggatggagttgagggacaacctgtttctgtttcaacagaacagattgcagttgagcctgaactttacagggaagtgaaacagaagctcgatgatggttcagtcaaatttgaggttctgtgtgacaaggaccgaacacccaaaaaggcacaagtaatgggccatttggagcggagggttttggaagtcaaccgaaagaggataaaagtagtaaagcctggatctaagacatcattcccgagtactgaagtacgaggaacctacgctccaccgttccatgtcgagctgtatcgcaatgaccagcaccgcttcaagattgttgtcgacggtgatactgaagttgacttaatggtgcaaacacgacacatgcgagaccgcatcatcctcacgatcagaggcctcgcccagaagttcaacagcacctccctcaacacacttctcaggatcgaggcatgatttgatgggtaggatgcccacatgatagacctgacaagtgtaaaaaccaactattacgggaagctgttccccttgttccgattggttagagtgcgtggttttagtaggattcgtgacatgccagccttttgtgtgtatgggtgtgggacgggccgagcgtgttggattacagtttttttccctgacacatctctcaaatcagagcagcatcagctggttgctctgactggtgccgtcgtgcgtcatgaaatgtacatagggtcgttagagcgagaaagagagtggtgtttcttggtgctgtatttattatgcactggttgggttgggttttttcgactgccattctcatactaagtattggttctttcttttttcggtcgttgggtttgcatatacttgtaccgacaacacagcttcggggtgattgggcgagtcctgttccgttcagaatgcctggtccacatttgtgtatgctgttttacggtcgcaaatgtaaattcacctgcccataaaacgagaatcaaaa

SEQ ID NO: 3318 - DNA, 2818 bp, Zea mays
taccttgggcttccaaaaaaaatttgccgttcatccaagcaggccggtccctggcccacatgccgcgcgcacgcgcgcgcacacacgccgacacgcggcacggccagtagggcaggcgcgggccgtgtgtgtgagaaggagaggacggcaccgcgcaggcggccggagcctcccccatacgcccaccagccaccacacatcctctctcccttccagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccaggcggatgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaccacgtcatcaatccgggccactggaccgaggacatgcgcgacgacgcgctggaacctgccgacctcttcagccgccacctcacggtcgtcgacgtcggcggcggcacggggttcaccacgctcggcatcgtcaagcacgtcaacccggagaacgtcacgctgctcgaccagtccccgcaccagctcgacaaggcccggcagaaggaggccctcaagggggtcaccatcatggagggcgacgccgaggacctcccgttccccaccgactccttcgaccgatacatctccgccggcagcatcgagtactggccagacccacagcgggggatcaaggaagcctacagggtcctgagatttggtgggctagcttgtgtgatcggcccggtctacccggcctgctgcgatgatcgcacattccattagggcctgtttggaagaaggggattaaagggaattaatcatccccttgctcccaaacaagccattagtatgacagctgagctacccaagtacggattgctgattttcctgccctgtcatggtgctttgcagcatcgagtactggccagacccacagcgggggatcaaggaagcctacagggtcctgagatttggtgggctagcttgtgtgatcggcccggtctacccgaccttctggctgtcccgcttcttcgccgacatgtggatgctcttccccaaggaggaagagtacatcgagtggttcaagaaggctgggtttagggatgtcaagctgaagaggattggaccgaagtggtaccgcggtgtccgaaggcatggcctcatcatgggctgctccgtcacaggcgtcaagagagagcgcggtgactctcccttggaggtaccttttccttttcattttgctaataacaatggaaagaggtggcgcttctggttctggcacatctcgttaagactctagattgttcattttcctgcaagtaggtaggcattcaatggctttggtatgagttctccgttttatttcctatgcagcttggtcccaaggcggaggatgtcagcaagccagtgaatccgatcaccttcctcttccgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaattttactcttctctatattagacgcttcctgcctgttttgtattaatacctcttgttttccttctgctatttacttcttgcactgctgttcctgtttgtggtaattaataatactaagacatcgatgttctcctgtttcttgagcatgactggttgcagtggaacctcgaaattaaattatatgatgtgtaatttagttggttaaattatataaatttgtatagtttatttggttcctggttcaacaaaattccttctttcttgtcaccagtacgatttctaagacctgttttgttactctatgctcaatctttgttacccttgttggatttcatctctagcttaatccaacttgcttataattagaatgcttataattagaaggcttcggactttggtgttgttagtattgttacgctaagtggtagagtggtaatatctgacagccttgcataaagatcatgtcttattgggatgctacctggtttggagtcctttttttttaatttggaagttttgctccagaagtgctgacgtggtggtgagagctgtctcatcacaggtttaaagcagcctctatatttgcggggaaggtttatcttggtttatcccttttgcagacgtcaaagcaatctctatatatttgcagcagaaggcttatcttggtttatccctttcgcagaccccgtgtaggagtctccgacaatagatgtgccctctaagagctaatttggtgagagctaatttggtgaaaattgaatagcaagaggattcctctcctatggatcctctcgtaatccttatccaccaaaccagactttaaagttttgttgcatggcctatgtgaccatagtcattttattaaggtgctgcattttgaacgaatttggttgtgtaatatttctacgaactaccagtgtatttgtatatattttctgaacatggccagatacattcatgataaacagccagatagttaggtgttaagtcctgcttgcatatctgtttgttgaagttgaaccg

SEQ ID NO: 3319 - DNA, 1505 bp, Zea mays
atccaatacgcccaccagccaccacacatcctctctccctcccagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccaggcggatgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaccacgtcatcaatccgggccactggaccgaggacatgcgcgacgacgcgctggaacctgccgacctcttcagccgccacctcacggtcgtcgacgtcggcggcggcacggggttcaccacgctcggcatcgtcaagcacgtcaacccggagaacgtcacgctgctcgaccagtccccgcaccagctcgacaaggcccggcagaaggaggccctcaagggggtcaccatcatggagggcgacgccgaggacctcccgttccccaccgactccttcgaccgatacatctccgccggcagcatcgagtactggccagacccacagcgggggatcaaggaagcctacagggtcctgagatttggtgggctagcttgtgtgatcggcccggtctacccgaccttctggctgtcccgcttcttcgccgacatgtggatgctcttccccaaggaggaagagtacatcgagtggttcaagaaggctgggtttagggatgtcaagctgaagaggattggaccgaagtggtaccgcggtgtccgaaggcatggcctcatcatgggctgctccgtcacaggcgtcaagagagagcgcggtgactctcccttggagcttggtcccaaggcggaggatgtcagcaagccagtgaatccgatcaccttcctcttccgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaattttactcttctctatattagacgcttcctgcctgttttgtattaatacctcttgttttccttctgctatttacttcttgcactgctgttcctgtttgtggtaattaataatactaagacatcgatgttctcctgtttcttgagcatgactggttgcagtggaacctcgaaattaaattatatgatgtgtaatttagttggttaaattatataaatttgtatagtttgaaaaaaaaaaaaaaaaaaaaaaaaaaagtacaaaccccggaaaaaccgcaaggggggccggtac

SEQ ID NO: 3320 - DNA, 1950 bp, Zea mays
cttgcatgcctgcagctcaaggatgccgggggcaagggccagggccagccgcccaagaacgcaggcggcaagggtcagccgcccaagaacgccgccggcaagggccagggccagggccagaagcagcagcagcccaagggtggagcgggcggcgccggcgccggcgcgaaagtggtggcgctgccgcactcgcagccgacgccgcagcagctgatgcagatgcagcagcagatgcagatgaacgggatgaagtttgctcatccggagctcatggccatgggcgcaggtcgcatgccgatgccgatgccgttcccggcggcagcgcaggcgcaggcgcaggccgccgcggccaaggaccccaagaccgtcaagttcgacctcccggggggcgaggagttcggggacgacggcagcgacctcgacgacgagttcgacgaactagacgacgtggatttcgaggacgacggcctcgacgacgacgacgacggcgacctgtacgacggccccgggatggtgatgaagcccatgggcatgcccccggccgctgctgccggtggcggcaacggaaacggcggcggcaagaagggtggcggcgggaacgaggtcccggttcagatcaatgggaacgccagcaacggcggcggggcgaagcagaacgggggcggcaaaagcggggccaagaacggcaagggcggcggcggcggcggcggcgtcgttgccccgggcggcgggaaccaggctgggcagggcaagccgaaaggcggcttccccggcggcgccggtctcggcgggccgatgatgggcggcgcgccgccgccgcatgcgggcatgatgatgaggccgccgaacatgatgggcggcgccggtttccccggtggtggcatggggccgggcatgggccagatgggcggcgcgccgatgggccaccctcaccacccgcaccagcaccagcaccagcacatgggtgcgggtggcaatggcatgcagatgcagcctggcggtggcggtggcggtgccgtgcatggcatgccagccggcgccatgccgggacctgctgctgggttctaccaaggtggcggtggtgcagccggcggcggcatgccgtccgggccagagatgttgcaggcggccgggaaccccatggccacgccgccgcagagaatgcggcacgaggcgatgatgcagcaacagcagatgatgaatggtcacggcgccggcggcgccggcgggtacccggcgatggggtacgggtacggccggccggcgatgcagtacccaccgccgccgccgtactactaccacccgatgccgcagcggcacccgcacgacaacatgttcagcgacgagaaccccaacagctgcacggtgatgtgatcatgtccctgtcatgcatgcgaggaggcaaaggtcgctgcggcctgtcgaagctttttctcctgctgcctgctattcttccggaggagggagagaccgatcatgggtcagcgtcaccatggttggaacaaagtccccggattggattggattggatctcagtatacatgagacatgcatgagaagcccccccctaccccttttttcttctttttttttctttttcactactactactagtatttctcttttttttctagcttgtttttcacctttactttctttggacaaagagggggaaaaagaagcaacttccttgaaggcgaaggtaggtatagtagtaattatcaatagtggtgggcataagacatgatggtggtggtggttcatggggtttatagtaaggagtagctcaagaagggtggctctcatggctccccccttcttgttgctccacaatgtgatgatggtatggaggtggcatggtagaaaagcttggtgaatctcaatgtgctttcgagtgcaaaaaaaaaaaaaaaaaaaaaaaaaaaaaactggtgtccccccgttcattta

SEQ ID NO: 3321 - DNA, 1344 bp, Zea mays
  misc_feature (116)..(116): n is a, c, g, or t
cagcaacagccgggcccgggcatgatgatgagaccgccgaacatgatgggcggcgccggtttccccggtggtggcatggggccgggcatgggccagatgggcggcgcgccgatggnccaccctcaccacccgcacccgcaccagcacatgggtccgggtggcaatggcatgcagatgcagcctggcggtggcggtggcggtggcggtggcggtgccgtgcatggcatgccagccggcgccatgccgggacatgctgctgggttctaccaaggcggtggtggtgcagccggcggcggcatgccgtccgggccagacgtgctgtcgggcggccgggaaccccatggccatggcggcgcagcagcagtacatggcgatgatgcagcaacagcagatgatgaatggtcacggcgccggcgggtacccggcgatgggttacgggtacgcccggccggcgatgcagtacccaccgccgccgccgtactactaccacccgatgccgcagcggcacccgcacgacaacatgttcagcgacgagaaccccaacagctgcacggtgatgtgatcatgtccctgtcatgcatgccaggaggcaaaggtcgctgcggcctgtcgaagctttttctcctgcctgctattcttccggaggagggagaagaccgatcatgggtcagcgtcaccaccatggttggaacaaagtccccggattggattggatctcagtatacatgcgacatgcatgagaagccccccctaccccttttttctccttttttttttctttttcactactactactagtatttctctttttttttctagcttgtttttcacctttactttctttggacaaagagggggaaaaagaagcaacttccttgaaggcgaaggtaggtatagtagtaattatcaatagtggtgggcataagacatgatggtggtggtggtggttgttcatggggtttatagtaaggagtagctcaagaaggtggctctcatggctccccccttcttgttgctccacaatgtgatgatggtatggaggtggcatggtagaaaagcttggtgaatctcaatgtgctctcgagtgccgtgtctgtccctagtggaatggaatgtctctggtgtccccgctcattttttttatttaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccctggggggggaccccctttaataaattcccggggcccccttgggggccggaaacttgcaaattgggccccaattgccccttaaggggggcgatttaaaatccccg

SEQ ID NO: 3322 - DNA, 2036 bp, Zea mays
  misc_feature (1944)..(1944): n is a, c, g, or t
  misc_feature (1950)..(1950): n is a, c, g, or t
  misc_feature (1960)..(1960): n is a, c, g, or t
  misc_feature (1981)..(1981): n is a, c, g, or t
  misc_feature (2014)..(2014): n is a, c, g, or t
tgcagcttggcgtcggcggcggcggcggcggcgggaaggacaagcagcccaagggtggcgacggcgggggcaaggggcagcagcccaagggtggcgacggcggcgggaagggccagcagaccaagggaggcggcggcggaggaggaggaggcaagggcgggaaagacgcgaacatggtgctgccgcagccgacaccacagcagatgcagcagcagatgcagatgaagggcatgaagctgcctcctgagctcctcatgggcatgggcggcagcaagatgccgccgttcccgacgcccgcgcctgcgcccggcccgccgccgccggcggccaaggaccccaagcccgccaagttcagctaccccgaggacgacgagttcggggacgaaggcagcgagttcgacgacgagttcgatgacttcgacgatgaggacgacttcgaggacgacggcttcgacgatgacgacctgtacggtgaccccaagatgatggcgaagcccgtggccatgccgccggccgccggcaagaaaggcgggaacggtggcaagaagggcggtggcggtgggaacgagatacccgtgcaggtgaaggggaacgcgcacagcggcggcggcaagaaggactcggccgcgaagcagaaccagggaggcgggaagaacggcggcggcggcggcggctcgcaggcgccgcagaacggcaagggcggcgggaacgggaaccagcagggcaagaagggccgcggcggcggcggtgggccgcctgccggttccggcgccccgatgatgggcggcatggcaatgccagcgcctcggccgccgctgccgcagcagcagcagccgggcccgggcatgatgatgaggccgccgaacatgatgggcggcgccggtttccccggtggtggcatggggccgggcatgggccagatgggcggcgcgccgatgggccaccctcaccacccgcacccgcaccagcacatgggtgcgggtggcaatggcatgcagatgcagcctggcgctggcggtggcggtgccgtgcatggcatgccagccggcgccatgccgggacatgctgctgggttctaccaaggcggtggtggtgcagccggcggcggcatgccgtccgggccagagatgctgcaggcggccgggaaccccatggccatggcggcgcagcagcagcagcagcagtacatggcgatgatgcagcaacaccagatgatgaatggtctcgccgccggcgccggcggccccggcgggtacccggcgatggggtacgggtacggccggccggcgatgcagtacccaccgccgccgccgccgccgtactactaccacccgatgccgcagcggcacccgcacgacaacatgttcagcgacgagagccccaacagctgcacggtggtgtgatcatgtccctgtcatgcatgccaggaggcaaaggtcgctgcggcctgtcgaagctttttctcctgcctgctattcttccggaggagggagaagaccgatcatgggtcagcgtcaccatggttggaacaaagtccccggattggattggatctcagtatacatgagacatgcatgagaagccccctaccccccttttttctcctcttttttttttctttttcacttctactactaggatttatctttctctttttttttctagcttgtttttcacctttactttctttggaaggcaaaagaaccaccaaagaggggggaaaagaagcaacttccttgaaggcgaaggtaggtatagtagtaattatcaatagtggtgggcataagacatgatggtggtggtggtggttgttcatggggtttatagtaagcagtagctcaagaaggtggctctcatggctccccccttcttgttgctccacaatgtgatgatggtatggaggtggcatggtagaaaagcttggtgaatctcaaaaaaaaaaanaaaaanaaaaaaaaanaaaaaaaaaaaaaaaaaaaanaaaaaaaaaaaaaaaaaaaaaaaaaaaaaaaanttaaaaaaaaaaaaaaaatttt

SEQ ID NO: 3323 - DNA, 1131 bp, Zea mays
  misc_feature (1121)..(1121): n is a, c, g, or t
  misc_feature (1125)..(1125): n is a, c, g, or t
  misc_feature (1131)..(1131): n is a, c, g, or t
tcgaggccggcgggtacctcgaggccggccggaaggccctttgaaatgccgaaagagagccgttccctgttgccgaaagcccgaaactagtcttccctcctgctggcggcgtgcggagggccggaggccgggtcgacaagaggagatgacgttggcggcggggctgggttacgccctgatcgcgctgggccccgccttctccctcttctccggcgtcgtcgtcaggaagcccttcctcgtcctcaccctcctctctagcaccttattttggcttataagtttgatagtcctctcgggaatatggagaggatttcttcctataaagtcaggagcttggtgggcatatgtgattctgatccttacatctgtcgcattgcaagaaggcactcgtcttgtgttttggatgctttacaagaaaatggaagagatgctagatgcttttgctgatagaatatctaagccacgtcttagattgactgacaagatgctgatttctttagctggtggtttaggccatggagtggctcatgcagtctttttctgtctcagtcttttgactccagcgtttggtcgagccacattttatactgaaaggtgctcaaagctgccatttttccttgcgtcagcccttattgcacttggattcttggtcatccatacattctcaatgattattgcttttaatgcatatgacgagggaaagaaaagtgatcaagtctttgttccagtaattcatttggctgctgctgcgatgacacttgttaacctcgccccaggaggctgtctcattggtaccccgctgttgttggtcatggctgcgctgaccttgcagcactgctggcgagtggcatgccggagattaactgagcaccggcatcagcagcataacagcagctagttgtaggcttgccatcatgtaattttcccatgtatgtttgactgaatcttctgatgtactatgacagtaaaaatcaggttctgagtcgtgtcgtgtagttagacgaggggttattatagtttgactcgatgttttgcatatgcagtatgtcctccctttcctggagcacttttatatctatctatctatataaccatgattgttaaaaaaaaaaaaaaaaaangaanaaaagn

SEQ ID NO: 3324 - DNA, 1514 bp, Zea mays
gggccctttccccgtccacgtcctcgccgggcggtaccgcggggccggccgggacacacagtctctctgctccacgctcgccgcttttccgctccacccctcctctctttctccctccctctctttctctctcctgccccaaccaaccaatggaggctctcgcgggcgccgcatcctcctccgttctccccgcgcgccacccgccctcccgcgtggccgcgcagtccctcgcgctccgccctagccgctgcggtcccctccgcgcggttagcgccggcggtgtcagtggcaaggacgacgcccacgccgccaacgggtctcccgtcctcaagctgaatagcgattccagtctaaatggagtcctaccgattgcagctgacaagtcacagaaggcttcatcaactaacgttagtactgactctagtggatctagagctggcctgtttagaacacccatatcaggtggtgtgcagagtgcaactttcgcccacggtctacctccgccggctttggctgttcgcaatttgatggaacaggcgcggtttgcccacctgtgctctgtcatgtctggcatgcaccaccgccgtactggatatccgtttggttcacttgtcgactttgctaacgattcaatgggccacccaattttttcgctgtcacccttggcaatccatacgaggaacttactcgctgacccaagatgcacgcttgttgtccaggtgcctggatggagtggactgtcgaacgcgcgagtcaccatatttggtgatgtttaccctttgccagctgaacaacaggaatgggcacataagcaatatgtagcaaaacatcagcagtgggcatcacagcagtggggaaacttttactattacaggatgcacaacataagtgacatatacttcatcgggggcttcggaactgtcgcatggatagatgttaaggagtatgaaacgattcaacctgacaagatagcagttgatggtggtgacttgcaaagtttaaaggagttgaacgctattttctctaaaccacttcgggaggtcctatcatcagaaggggaggttgatgatgctgcgcttatatcagtagatagcaaagggatagatatacgggttcgacagggtgcacagttcaatattcagaggctagcatttgatgtccctcataaggttgagactctggaggaagccaagaaagcactccacaagataatcaaagacaagcagcaaataaagtgaagttgcaggagctggctctacccatttttctggtggtgtaaggtttcattgcaaccggaccaaggattacgtaatggtagcaggtagcatgatacaagtgaaaacgatggctgtttttttaaataatgagagtctcgctctccagctgtggtgaagattgtatatatgctcgtgttgccttattaataattattattgtgcggttgcttcttgaggaaaaaaacaaaaaaaagaaacaaagttcataaataaaaaacgggaagcttatcaacaagc

SEQ ID NO: 3325 - DNA, 2115 bp, Zea mays
gcacgagaccattacctagaacatcctaatcgaaaaaagagaggattttgctaggtttttgcccccaaccgcccaactgcgcgtgctcctgccgacctcccacccctccactccccggcggttggcggctgtctcgccgaagctacccagccggcgcagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaagcgccgcgcctgcgagggcatgtgcttctcgctccccacgcccgacgacccgttcaacgagcgccatggcaggaagcacaagctcgatgacgagccggccgacgacacagccgccgacgccgctgaggacagcggcaaccccaagaagaagggcgcgaacaccaaaaagcagcagccggtggcaaagtatggcgccgaggcgaagtcgaaggcggttcgcgagagggagacgggtgcggaggtggtccgcggggacttcgaccggccgtccaagttcctggtggtctgtctcaacgctatccgggatgcggtggcgcccgaggaaggcggtggcagcatccacggcgccggcgactggggcgtggagctctggcggtgctgctccgcccaggcgccgtccgacgtgctcgacgctagcggcgcgtgcgccacggtggcgcagaccgcgtggctcgtctccaccgcctgcgacatcgtcgctaggaaagagaggcatgggatggtcgtgtcttgccccttcctgctgtacctcgtctcgtcgcaggataaggccgcgcaggtgcgatcgatatgcaaacccctgaagcctcttgggattcattcagtgagcttgcatcctggcgcatccattgaacaccagatctctggactgaaaacttgtgagccggagtttcttattgctacccccgagaggcttcttgaacttgtttcgttaaaggcgattgacatatcaggtgtatcaatgttggtcattgatggactgaaatgtttcgtagaccacaatgttagtgacaaaatattttctattagagacgccatatcaaacaatcttcagattactatcttcaccgatccatctgataaaaatattgcaacaatggctaaaaatctactccgtggaagaattacaaagctttctatcaatgattctgtttcttcacgaagtgcatttatagcccagcatgtacacttctgtccatcggaggagctgaaaacaacaaaggttaaggaaattcttgagcagatattgcaagatcatcctaaaaagacatcaaaggtgcttctagtagctgcaagcgataaaaaagcacggctcatgtcactgtcgctgaagctggaaaattgcacagtgattgatgactcatgtggcaactcctttacaatatgcagcagtgtggggctgatgaatgtcattgtgaaagaccgggagaacatgtcagtgacagatgtagaggcattcgaaaccgtgctggtggtggatctgcctccttcagtcgacgaatacattgagatcctcactggggctgctcttcatgtgattggaggcgaagtgcatagcatattctgtaacactgatgcttctgttgcaaaacctctggctcagcttcttgcagactgcggtcaggtggtgcctgaattcctcaaaagcctgaagtcttcatagcagagacttgtgtacgcaatcagagtagtcagatcacaccgtggcgattcagatcatatcggagcagtgtgtgttctacatgttattctcatttatcagcacagcattggtattcaggcctcgtccttggtatgtactattatgtcgtgcattgtgaaatgtgaatgccttgaggcccttttcctgggagttgtttaaaaaaaattgtgtcaaaggaactgagtcagtcatccctttgctccctccccagcttcccttgtccaaaggcaagcagagacagggccctcccctgagagatcttggccccttcaaagtgcatcaaccaaaatgtcaaagacccagcttcttttaatcaagttatttttcctatctg

SEQ ID NO: 3326 - DNA, 1509 bp, Zea mays
  misc_feature (11)..(11): n is a, c, g, or t
  misc_feature (135)..(138): n is a, c, g, or t
ggtaccctcgnggttcggccggggaacgggtggataacaaagggatagagaagcggcagctgcagaggcagagcgtcagagccatcgtcctcgcctcaccccgtagtcccgtacctagcgcagcgaagccggacnnnngaggccggccggggaacgggtgggcgtcaaagggatagggaagcggcagcccgggcgggagagcgtcagagccatcgtcctcgcctcaccccgtagtcccgtacctagcgcagcgaagccggcacaatgccagccgccgccgtagcctcccctctcctcctctcgctctcctcgtcctcctcccatttcctctcttcctcatccacctcctttttcccaccctcctccgctgccgtcgctccacacgccgccgtcaggacgaaggcggctgtctccgtcctccgcgcgctgcgcgccgaggcggccaccctccccgtgctctcattcaccggagagaaggtcggggaggtaaccctcgacctcaaatccgcgccaccctccaccgcgcgcgctgtcgtgcaccgcgctatcatcaccgaccgccagaacgcgcgccgaggcacggcctccacgctcacccgcggcgaggtcagaggcggagggaggaagccctatcagcagaagaagacggggaaggcgcggcgggggtcgcagcgtaccccgcttcgtcccggcggtggcgtcgtgttcggccccaagccccgcgactggtccatcaagatcaaccgcaaggagaagcgccttgccatctccactgccatcgtgagcgccgccaaggacgccttcgttgtcgaggagttcgaggaggccttcgcgtcggggcccaagaccagggatttcgtggccgctttgcagcggtgggggcttgacccgaagcagaaagccatgttctttgccacggacttcgacgacaatgtgcggctcagcggcaggaacattggttccctcaagatgctcacacccaggacgctgaacctgtacgacatactcgacgcacgcaagctcttctttactcctgctgctgtagactacctcaactccaggtacggagccagtgtttccgatgactactatactgatgacgaggatgatggcgaggaggaactggtcgagcaagaagcagaagaaggcaccacagcagatgctgctccagatgcaactgaagagggcgaggcagacagcagctcctaggcgggaagtgtagatttgttgtttcgtttttgttatgttaccctcaggtgaggatggtggggaattctttcctaacggggagaccttttgtctgcttttattgtaagttgattatgttctcttactgaagcagtatactagatttccaaacctcacataagagcatgttttcaaatacatcatccgttgtcgaccactgcatataaagtgttctttcatctacgctgcaatggtgaagaacagcggacaattatcctggaaaatgccggttatgcgcccgattgctgaaattgctgattt

SEQ ID NO: 3327 - DNA, 2527 bp, Zea mays
ccggccgggatatttatatgaccgtgtaaggaggctttttggctgctttgcaccattgaccggatggaaacatcacctatcttccctgtctgattttcttgagaatggctactcacagtacctccaacatctacaagacagtcaggaaggtggtacgccttccttttttctattacgccagaaaaagatttgccgttatttacatggacctcagaagatgtttcaatgatttgttgttacatgtcccgaaatccagtattctggaagtgaattacgacagtatccttttacttcttaaaatgcttgaagagttcaaccgcacgatgttcaggtatcctgaggatgaaattaggaaagttttcttgtacagtaatgatgaacctgatcagacaaactcgagtgtagtcactcttggcaaaatgaggataaaatgccttgaggaactgagcactctgttaagttgcttgaagcttcctctaacatcctcaaagcctaccattcgtgatttctgcattaaaagcgcttccatagttttctgtactgtatctagctccacaaaaataaccgctaacaaaaaggtagagtttcttgtggttgatgaggctgcccagctgaaagaatgtgaaacactgatccctttgcgtctgtggaccttaaagcatgctgttctaattggtgatgagtgccaattaccagcaacagtcaaaagcaaggtttgcactgatgcattatttggaagaagcctctttgaaaggttgagttcacttggacacgaaaagcatctacttaatatgcaatacagaatgcatccttccattagtattttcccgaacactagcttttatgaagggaggatctcagatgccactaatgtcatggaaaaagaacaccgaaggatgtatcttccaggttctatgtttggtccttactcatttataaatattgaagatggaagggaggaacgtgatgaacttggccatagcaaaagaaactttgtagaagctgctgtcattgaagaaatattataccgtctccgaagagcttgctttaaaaccaaaaggaaagtcacggttggtgtcatatgcccatacaatgctcaagttgtagcaatccaagggaaaatagagaaaatgaggttcgacccattgcaagtaaaaactaattctgtcgatggctttcaaggtggtgaagaagacatcatcattttatcaactgtgaggtcaaactcggttgggaaggtaggttttctttcaaacgcacagcgggcaaatgtgtgtttgacacgggcaagacattgcctttggatcctaggaaatgcaacaactctagcaagcagtggatctatttggtctgatctagttcgtgatgcaaaggataggcggtgtttcttcaatgccagtagcgactatgttatctctcgcgtgattgctaagcaaaggagagatctcgacagagttaatgttgaaaagagcatccatatctcaagttccaaaaactgcagggtttgggttgaaacgcgatccccaaatgacctgaatgaacagggcacttcttcgacgagtgtttcacattacgctggaatcccgtcaagtgacattgttgttgtttctgaattccagcgtccaagcaataaaaatgaggatgttgaggatataactgtcattccaaataaagagaatgataaggatatcaatgctatgcccgttattccagataaagggaatgtcgttgatggcaaccatatcctcgccattccttgcgccatgttgagtaatctagctagatggtgtatccgttcgttccgatcttaattgttcctttatgtctcctatccctttttactcctaagtttacagcattatatataagtgtctctccataacatggtcggatgtttgattttgtaatgtgggtttgaataatgaaaatgtatgtttgggcctttttagcctcccttgactgttgagagaaaaaaacgctagtggtacatgcgatcttgtttgactggttctaaaacacacaataaacataaagagaaaaatatttattatttagtcaaaaatatcacatcacaatacataaagagtaaatttcatacatcatgtaacacaactactatataaatagggacccattggttcaacattttgtactaagcaaggttctaaatcttttgctatagctactgctatctttagatttagttgttttcgtagtctaaactatttgatttgatgtattatttggaaacatgttatgtgcactcatgccaacatgtaaccatgcacccagacatttagagtcattcaattcacatcaactccaactctttgatgttctcttgtagattaatctaacatgtgaggtatgtgtttgaattgtgacttcatggcaaacagacacaactactattgaaccctatttcggtactcacaatatgtgttcattatgaattgttacatctcaatcaactaaccttgcttcactaaagttggaacaactaataagatatgtatagccatccatc

SEQ ID NO: 3328 - DNA, 1478 bp, Zea mays
gccggccggtcccggtccttcgtcagttccgggcttccggccttctatggagaagcttccttcagtgagtcctccctttccgtttaaggcagcaagcaggagcagacaggaggcgccgagagcccagcgtcggagatctccgccgccatggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaggtgctctcggtggaggacaagcttaggaaccttgggtgcaaggcgattggaaggaaaattgttgaggcggagatggacctgaccaaggccaagagcgaggggtacctgtgggggaacaggactgcagctgtggactccgacaagaagcagcagcttcttgccgtcattggagtttacactgggtttggctcccgtctcaagaggaacgtcttccgtggctcctggatgccaagaggtgatgctctgaagaagcttgaggaaaagggtgtagctattcgttttgttattggtcggagtgcaaatcgaggtgatagcttggaccgtaatattgatgatgaaaatcggcagacaaaggacttcttgattcttgaaagtcatgaagaggctgcagaagaattaccgagcaaagcaaaaattttcttcagtgctgcagttgaagcctgggatgcagaattttatgtcaaagttgaagataacattaatcttgacttagctgggttaattgagatgctcgaaggccgtcgaggtagccaaggattgtacatgggttgtatgaaatcagggatggtcataagtgaagagggccaacaatggtatgaacctgagtggtggaaatttggagattcaaaaacgtattttcgacacgcttctggttctttgtttatcctctcaaaaaatttggctcgctacatcaacataaatagtgcgtcactgcagagttatgcacacgatgatatatcagtaggttcatggatgatgggactgaatgcaacttacgtggatgatgaccggttgtgctgcagcagttccagacaagagaaaatctgttccaatgcttgagcggaaggcgtggctgctggcctgttgctgtacatcctgatgaagattttgcacacctgtcattttgtatacactgctttcgtgaaccggaaaaggctactatccagatagaaacggcttgcaccaaaatttaggaacttccatcaaaaagaaaaaaaaagaacaattttttccatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3329 - DNA, 2658 bp, Zea mays
aaggttgacattttggagcttcatcatacataaatgaaataatcaaacaatagaggaatgaaaatgtaacaactcgagactgaactatgatttctgacgagagatctgcgacgaggcgacgacccaaatggggaaaaccatagctaatccaagatctgaactccctcaaatcccgcaaccgggcccctaatcccttccaaacccaatctcccatctccgatccaatgccccctaccggcgacgacccgtcggccgccgccggcatctcattccccgatgcgggtggcggtggcgattctgaagacggcgacttcgccggctcccacctcctcgaccccaccgatccgggcctccccaaccccaccacctcctccgctaccggcctgccccacgcgatccctgcggccggtagcggcggcggcccggtcacctccggcaacggcggggagcggcggcccctgttccagcgcctctggaccgaggaggacgagatcgtgatcctccgcggcttcgcggagttcaccgccgcgcgcggcacggcgttcgcgtcgcaccagtacgacaccgaccccttctacgaggacatgcgccgccgcctccagctcgacttctccaagagccagctcgtggagaagctccgccgcctcaagcgcaagtaccgcaactgcgtctcccgccttcgcgagtccggcgccaccttcaccttccgctccccgcacgagcaggccatctttgagattgcgcgcaacatctggcgccccgcaaacaaacacggccgcgatccctcggctgactccgacgatgaagacgccgccgccgccgccgcgacacagatacatgccaacaccagccccaacggagaagtcaggtccccgtcctctgcacggcagcgtcgccgcaggcgggcgacggaattcacccctgccacaaacatgttgcagccccctcagccagtgccactgtctgtgtcagtgcctgtcaagacggatgactccctcccagcacagccccagaccccaatgccgaccatggatggctcagagcctgtcaggttgccagtcgtgtcgcctcaatcaggagtttctgatgccgagaagacttgcctgactcctctatttagggagataatacatgcagcgatgaatgtcggagcaaacccatttggtgcaaagctgcctgagccgccgcttgggttgcccttgcccatggaaggggagaagtggcggaggcagcggattttggagctggaggtctacttgaagaggatcgagctgctgcaggatcaggcgaaggcaacgcttgaggagctcaagtcctccactcctgggacttaacccgtgataagatgagactctctttcgttttaggattcttgctctgatccttagtgtagatgcttaggcatttttgcatattttacatccataaaagaatattgttaacttggttggggcttggagctttttacttgttgttctaaatgttcatgtgatattagcttccgattatgatcttctttctttccttataacataggttcatgggggtatgatttgagtgaacagtaaggtaccctatacaaagatgaattattacaattagtttattaagattacatatcattgctgctttaaaaaaaaaaaaaaagttgctttttcacttttgcgtctgttgtcagcgaattgttatgattatatcaaagtagcaaacaggtttgtaatgtcgacgatgaatatacgagtacttgtttagaaaggtcatcatggaggttgtgtacggtaaaagggcacgacctatggatgtcgttgagaaaggcgatacaagtggttaagttctatttgtgttgataatggctacctccctcccaaaagaaaatacacacacaccttttgtaaaagaaaatatgcagccttcctatgtcgtatctgcatacaacaaatggtcaatgttctcaccccacatgtgattgcatctgaactcccgccatggcagcatggcaaagctgtaggaagggaatagggtcatgcttattcatcaaaaataagcacggccatcctggaggtcagaggccttttttctgcatcaaatctggagacatcacgatttaacagaaaacctgacacgtgttattttgacgtggatacatggcgattatcaggtgggcgcattacataaaagggtcctgtagtcagcagctctttggtgtctcttgaagccactgcatcaaatccttctggtatgttgttctctgcctccacgtacttatctcccctcccccccggttgtgctcggtttttggagacatgggaagctagtgagggggaaaagtgaaacgaagggggaggaagatgtctgtaaactccatttgctgttgggggaaaactgtcattttgtagtttcgctctgagagaataggttaatggatggtggacgctgttttaatctcagcatggtttgtgttgttttcctttcaattgcaatttgccatataaaacgggagtggatattgaagaactaccattctggccggctgaccgacttggacgactaattgttgatgggtttaacccgacttgaaccatttaatcggacgacttgtaaaccagtgaaaagtaactgtaacctaaaaaggcgtgagcttgaacaatgaccagaatg

SEQ ID NO: 3330 - DNA, 721 bp, Zea mays
  misc_feature (671)..(671): n is a, c, g, or t
aaatcccgcaaccagacccctattcccgtccaaatcccatcaccaatccaatgcctcccaccggcgacgacccgccggcttccgccggcatctccttccccgacgcggacggcggcggcgattctgaagacggcgacttcgccggcgcccacctccttgaccccaccgatccgggcctccccaatcccaccacctcctccgccaccggcctgccccacgcgatccctgcggccgggagcggcggcggcccggtcacctctggcaacggcggggagcggcggcccctgttccagcgcctctggaccgaggaggacgagatcgtgatcctccgcggcttcgcggagttcaccgccgcgcgcggcacggcgttcgcgtcgcaccagtacgacaccgaccccttctacgaggacatgcgccgccgcctccagctcgacttcaccaagagccagctcgtcgagaagctccgccgcctcaagcgcaagtaccgcaactgcgtctctcgcctccgcgaatccggcgccaccttcaccttccgctccccgcacgagcaggccatctttgagattgcgcgcaacatctggcgccccacaaacaaacacggccgggatccctcggctgactctgacgacgaagacgccgccgccgcgacacagatacctgccaacaccagnctcaacggagaagccaagtccccgtcctctacacggcagcgtcgtcgcag

SEQ ID NO: 3331 - DNA, 2667 bp, Zea mays
  misc_feature (1)..(172): n is a, c, g, or t
  misc_feature (178)..(178): n is a, c, g, or t
  misc_feature (186)..(186): n is a, c, g, or t
  misc_feature (218)..(218): n is a, c, g, or t
  misc_feature (226)..(226): n is a, c, g, or t
  misc_feature (232)..(232): n is a, c, g, or t
  misc_feature (234)..(239): n is a, c, g, or t
  misc_feature (241)..(243): n is a, c, g, or t
  misc_feature (245)..(267): n is a, c, g, or t
  misc_feature (270)..(271): n is a, c, g, or t
  misc_feature (273)..(283): n is a, c, g, or t
  misc_feature (285)..(325): n is a, c, g, or t
  misc_feature (327)..(553): n is a, c, g, or t
  misc_feature (555)..(586): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggngggggcgngggggggggggggggggggggggggggggggngggggggngggggngnnnnnngnnngnnnnnnnnnnnnnnnnnnnnnnnggnngnnnnnnnnnnncnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnncccccccccccccccccccaaaaaaaaaaagaaagaaaatacacatacaccttttgtaaaagaaaatatgcagcctttctatgtcgtatctgcatacaacaaatgatcaatgttctcacccacatgtgattgcatctgaactcccgccatggcagcatggcaaagctgtaggaagggaatagggtcatgcttattcatcaaaaataagcacggccatcctggaggtcagaggccttttttctgcatcaaatctggagacatcacgatttaacagaaaacctgacacgtgttattttgacgtggatacatggcgattatcaggtgggcgcattacataaaagggtcctgtagtcagcagctctttggtgtctcttgaagccactgcatcaaatccttctggtatgttgttctctgcctccacgtacttatctcccctcccccccggttgtgctcggtttttggagacatgggaagctagtgagggggaaaagtgaaacgaagggggaggaagatgtctgtaaactccatttgctgttgggggaaaactgtcattttgtagtttcgctctgagagaataggttaatggatggtggacgctgttttaatctcagcatggtttgtgttgttttcctttcaattgcaatttggaatatagaacgggagtggatattgagaagctaccattctggcggctgaccgacttggacgactaattgtgattggtttaaaccgacttgaacaattaatcggacgacttgtaaacagtggaaggtactgtagctaaaagggtgagctgaagaatgacagaatggatgaagaatgccacgattaatccgaggcgtggatgatgccagatcagttgagttgttggtgaagcaacaacaggcttggatcgaagctagcccgcggtcgatgaagcagttgtcgtagatgggaagcacgggcggatcgaggtcgctcgctgcgctgccagatctaccctgtcacccgctgctgtcacgccatttcctttctgacgagcgccggcttttttagacaatggtaatgcgatgatgatgttatcgcataattgaattgcagcaacggacccatcccatcccctccagtgtccaggccatgtacgagaccatgtgccggggcggctgcggctgcctggtccctgtctcctccggcctgactcgtttggtcggtcagtggcgtgtcgtatgcttgatgcgtgccatgccatgcatatgaatgaatgaaccccgcgtgccgtttagccatctacatcggccgccccgtcttttaaacgttgggccgggacgcgcgctacccgcacgtgcatgatgagcgaggcacgaagagcacgggctgtgtcgcgccgcgcgtgcgtgcggtcgatcgtcacaactcacgacctgtaggtaggcggtagattgattccatatagaacacagtgattctaaaaattaaaaaaaaagttatacttaactgctgaatcattatttgatttactaaaatctttcggacggaacctaaaaagccgtaggctctggaaccaaacgctactttaataaaataaaatggatctggctgctgctcatgcattgagtggtaggtttcctcgcataacagagactagtggttaccatcacaaaatgttaattaaccttactaactatatttttttacatctattaaaggtcatagtttgctacaatttaagttggaggaatcaactagtaccactctctccgactcaagttcgtggaatgacttcaaaaaaaaaaatcactaatgacttaataattcataaacacacattataagttgacactaaaacaccccttttggtcaagaacataacacaaatgatctttcgcgataatttagtaagtcgaaaacctcttgatggcagacacgatattaacttaaaaacgatgggggtaagagcgcggagcaactgaataagcccaaaagaggtcaccccatctacgtagatacgcaaaaatattctacagagcaatttgacaaggcgacctcgacggcgagcagcagcagcagcgagaggccgtcgacggcgaggatccccgcgccca

SEQ ID NO: 3332 - DNA, 1494 bp, Zea mays
accctcgaggccggccgggaaagccttcccgtgctgacacttgctcaggttcaggctgcccgctctgccgccgccgacgccgacgactataaatgagtccccccgtcccgcccccgccgggaaatccgtcccccagttccctccgtccacacccgcccttctccttcgttcccggctaagaggccaacggacgtgcgatccggcgcgcttcctcgccgtcgtcgatcggaggcagaggaatgtcaggggcggcatccgtggagcgcgtgaaggaccgggccaccggcctcgacaagttcgtgctccgcgaggcccgcggcagctccgtcgaggtatatttatacgggggccaagtgacattttggaaaaacaacttcggtcagcaactgctttttgtcagtaacaaggctacttttaaaccgcgaaaagcagttcgtggtggcatccaaatttgcttccctcaactaggtaaccatggagttcttgaacagcatggatttgcaaggaaccggttttggagtgtcgatgaaagcccacctccttttccagttgctacttccaattgtcatattgacttgatactcaagtcatctcccgaggatttgaagatctggccacatagttacgaatttcgtctgagagttgctctgactccaaggggagatcttattcttacatctcgaataaaaaacatcggctcagacagcaagccattccagtttacatttgcataccacacctacttttcggtgtctgacatcagtgaagtgagggttgaaggtctggagaccttggactatcttgacaacctgcaatccaggaaacgttttactgaacaaggagatgcggttgtattcgagtccgaagtggacaaggtgtatttgagtgctccgccaaaggttgtggtcatcgaccacgagaagaaaagaacgtttgtgttgaggaaagagggccttcctgacgttggtgagctacaaaattaggacgccctttcattcttcgattacaacgtttggtttgtgaaatttttgcagtcgtttggaacccctgggacaagaaggacgaggagtacaagaggatgctgtgcgtgggggctgcggctattgagaagccagtcactttaaagccaggcgaagagtggatagggaagcaggaaatttctgctgtgccgtccagttacagcagcgggcagttggaccctgaactgattcgtcgaatgcacacaatataaagtttacccgcgattgcatcgatcctacgttccaaactagcctgtgttttttttttaattctgaagcagcgctgggattggaatcatcaccctgttaattactagacaaattgggccggaggtgccattcagatccgtatacaatattctttttctctgttttttttttgtattgtaccactagtccactacaaaaggaagccccaagtttgtactgcatgtggcaaacaaaactaccaagatatatatactaattgagttgt

SEQ ID NO: 3333 - DNA, 3256 bp, Zea mays
  misc_feature (40)..(41): n is a, c, g, or t
  misc_feature (67)..(67): n is a, c, g, or t
cccccgggtcgacccagcgttcgttgggctccccgtctcnnccctgggggggggggggggcggcatnatgatgagtgaacggagtcatgcttgtgagattaggctttgtcgttgtagcctccgtcgcagctttaactcttcagagagctaacagtggggccaggcacagcaaatactatgtccaatcaaggaaaaggggggggagggcgggcaattctgaacatggggagaaagaagaagagaaggaagaggttaaaacaatcagcggcataatcaactcagcccgctcgctagacgatgacgacgatgatatgctttccgagatcgaaagcctcctatcaggagacattgacatccctataccaagcgatcgcttcgacgttaatggacggtcacggtacaacaacgcttacatggctaacgaggcctctgagatagagaagctgcgcaccctggtgagggagatggaagagagagaggcgaagcttgagggcgagctgctggagtactatggaatgaaggaaatggagactgacatcgccgaactgcaaaagcagctcaagatcaagacagcagagatcaacatgctcaacgacaccataaactcactgcaggcggagcggaagaagctgcaagatgacgttgcatgtggagaggttgccaataaagagcttgaagcggctagaggcaagatcaaggagctgcagcggcagatacagctagaagcaggccagacaaagggtcagctgatgttgctgaaacaacaggtcatcggattgaaggccaaggaggaagaggcggggaaaaagggagccgaggttcaacggaagctgaagaagctcaaggagttggaagtggaagtacttgagctaaggaggaagaacaaggagttgttgtacgagaagagagatctcattgtgaagttggatgcagctgaagggaaaataactgagagtgatgtagttgccaatgcaagagaagagataaacaagctgaggcatacaaatgaggacctcacaaagcaagtggaaggcctacagatgaacaggttcagtgaagtagaggaggtggtatacctgcgctgggtcaatgcctgtctgagattcgagctccgcaattatcagactccatcagggaaggtctctgcacgtgatcttaacaggacactgagccccaaatcacaggagagggccaaacaactgatgttggagtacgcaggatctgaacggggtcagggtgacacagaccttgatagtgttgtttcttcaatgccttcttcacctggaagcgaagactttgacaacatgtcaattgacagttcttccagcagatacagcttcctaagcaaaaggtctaatctgatgcaaaaattcaaaaggtggggaaggagcaaggatgacagcagtagtttagcctcctccatcagtggctctccaaggaggaaaccaaagggcccactggaagctctaatgctaaaaaacgctggagatggtacagccataacaacatacggaaagagggatcccaatgatgtcttggatgacgaaaatgtcgcgtcctcattccaattgatgtccaagacagttgaaggttttgctgatgagaagtatcctgcttacaaagataggcacaaacttgcaactgaacgggagaaggctataaaagagaaggctgggcaagcaagagcacaaaggtttggtggtggccacagttcagctctaatttcctctccaaaaggtgcactccctccaaaacttgctcaaattaaggagagatcccctgcagctaatgctgaatccagtgagcaatccagtgacaaccaaaacaacaccctggtggtgagccagatgaagcttgccaacgttgagaagagagcaacaagagttcccagaccacctccccctcgatcaaccactgcttcaggggctaccagtattgcaagtggagtacaaacgccacgagcaccaggtgcaccacctcctccaccaccacctccagggaaagttggtggcccaccgccaccaccgccacctccaggtgctctaccaaggaaccttggtgggggtgacaaggtacaccgtgcgccggagattgtagagttctatcaaagtctcatgaagcgtgaagcaaaaagggagacatctttagggtcaatatcatccaatgtttctgatgccagaagtaatatgattggagagattgagaacagatcaacattcctcttagctgtaaaagctgatgtggagacacaaggagaatttgttgaatctctagcaaatgaggtccgagcagcaagcttcataaatattgacgacgttgctgcatttgtaaattggttggatgaggagttgtctttcttggttgatgagagagcagtgctaaaacattttgattggccagagagcaaaacagatgcaataagagaagcagcttttgagtaccaggatctgataaagttacagaacagggtttcatcctttactgatgatccacaacttgcatgtgaagaggctctcaagaagatgtattctttgcttgaaaaagtggagcagagtgtctatgcactactccgtacaagagacatgaccgtctcacgctacaaggagtacgggatcccatttgactggctgtcagattctggagtagttggcaagatcaaagtggcatctgttcagcttgcaaacaagtatatgaagagggttgcctcagaacttgatgcattagaaggcactgagaaagagcccaatagagagtttttgcttctccagggtgtgaggttcgctttccgggttcatcagtttgctgggggctttgatgcagaaagcatgaaagcttttgaagagctaagaagcaagatgaccacacaggcatctgctccaccaatatctcaaggctgaagcataaattgagcacaggattcagcacacatctggtcttacttgctggagagtgatttttagttgtgtatattaagtgtacagactacagaagagagattcaaattccggtgttgtgtcaagcaagttgtatatgccaagataatacaagtcaggtttgttcatttgtataacagttttagctcaagcataacacttttcattttgaaggttgtaactgtaaacaggcagttccagaatcacagtagagatcagatgcatagttttgcaactattttttttccagctgggcatgattttgctactacgactaataaaatgtcaaaagcatccattctgctaaaaaaaaacacccccac

SEQ ID NO: 3334 - DNA, 3076 bp, Zea mays
ctgtgcggcgctcgaggcggccgggtcaaaaacagcctacacggcccagtctctttccagaccggagcgacgagtccgcgagaccccccccgcccccccgcgccccgagcggcgccaattctgcgctgccatcgtcttcctccgtcacacccggctcgcaaaccctagctcgccccggccccacctccggccccgttcgtcggtgctatgtcgaagcggccgaagctcgagggtttcagcatcccgcggcccacctcctacaacttcgagcgctcgcagtccgtgcagcggctctaccgtccgaccgatgacccagacctcgacgacatcgccttctccgacgacgccccctcagatgcccaagccagcaccgcggtagaaggaaaggccgagaatgaggaggagatggacccgctcgacgccttcatggccgagatccaggaggagatccgtgcgccgcccccgccgcccaagcccgaggcgcttcgccgcacggattccgacgatgacgaggatgaccccgtcgagagcttcctgcgggccaagaaggacgctggcctcacgctggccgccgacgtcatgcgcgctggttacgactccgatgaggaggtctacgccgctgccaaggccgtcgacgccggcatgatggaatacgactctgatgacaaccccatagtcatcgacaagaagaaaatagagcccataccagcactcgatcactcgaccattgagtatgacgccttcacaaaagatttctacgaggagaagccatcgatttcaggtatgagtgaccaagaggtaacagattatatgaaaagtttgtcaattcgtgtttctggttttgatgtgccgaggccaataaaaaactttgaggattgtgggtttcatgtacctctaatgaatgctattgccaaacaagcttatgaaaaaccaactacaattcagtgccaggctttacctattgtactttcagggagagatatcattggtattgcaaaaactggctctggtaaaactgcagcttttgtgctccctatgattgttcatattatggatcagcctgagcttgagaaagaagaaggtccaataggagtcatttgtgctccaacaagagaattggcacatcagatatatctcgaagctaagaagtttgcaaagccttacaaccttcgagttgctgctatatatggtggtgtttccaaatttgaccagtttaaagaactgaaagcaggttgtgaaatagtcattgcaactccagggagattaatagacttgctgaagatgaaggcattgaagatgttcagggcaacttatctggttcttgatgaagctgatcgaatgttcgatcttggatttgagccacaaatacgatccattgttggtcaaattagaccagatcgacaaactttacttttttctgcaacaatgccatacaaagtagagcgtttggcaagagaaatattaactgatcctattagagttacagttggtcaagttggcggtgctaatgaagacattaaacaagttgttaatgtactcccttctgatgttgagaaaatgccttggcttttggggaaattgcctggaatgattgatgatggagatgttcttgtatttgcatctaaaaaggctagagtggacgagatagagaaagagttgaatcagagaggattcagaattgctgcgcttcatggcgacaaggatcaagcttactcgtatggagaccctgcagaagttcaaatctgggacatttcatgttctggttgcaactgatgttgctgcacgaggtcttgacatcaaatcgattaaaacagttgtcaactttgatattgcaaaagagatggatatgcatattcaccgaattggaagaactggtcgtgctggcgataaagatggcactgcatatactctgattacacagaaggaggcacattttgctggtgaactggttcacagtttgattgctgctggccaggatgtacccaatgaactcatggatctggctatgaaggatggaagattcagagcaaaacgagactccaggaaaggtgggaagaaaggtggcaaaggaaaaggtggtgttggcggtgctgggcgcgggcgcggtgtgcgtggagttgattttggcctcggcataggttacaatgccgaatctggttcacaagtgcctgctgcaagatctgctgctgtaaattctctgaagacagggatgttgcaacgatttaagagcagctttgtctctggatcttcaaatacaccaagcagcagtgcaccttcctttgtaagaccagcactccgtggctttgtgtctggcggcaccattggaggagacacacggcctgcacaggcagcccccactttcatccctgcatcccggcctgcacagcctgcccccgcggtccctgcatcccagcctgcaggaaataacaacgaaaatgggaacccgaatccagaaagttcacgggatcagttcagggagagaaaacgaccatcaggttgggatcgctagtccctgctaactggtatgcccaattgtgattccttccccgctttgttatattgatgtagtctcttgggagacatcctataaaaaagcactgtagattacatgatgtcaggtaagtgttgttttagttagtttggcctttattctttatccttcaactactgttgtatctggccgttgtttcacatttttcatcagagcaaaatttaccatttgtattcgaagttggcaccgaggcctcctttggttcatagaaaaaacagaggaaaaacttagttcatgcttttagttcatagaaatggagtatgtgaatagtgtatgaagttttccagtgtagcactagtgtttgatgggatcctgagagatagggaaggccagagttgacatgaaaatgaagacatccagatagttgacatgaaaatgaagttctccagaggcatcatggatcctggtaagagaagtaggaaaagttgacgttgacatgagaagatgcaatataagcagacttgaaaagatgaaatatacaaaacattcttcaaagtcactatgtgacatctctatatgtgatta

SEQ ID NO: 3335 - DNA, 798 bp, Zea mays
cggccgcgtgggcgagccaatgtttattacttctgcgggtcctcgaggccggacttcagttggagctcggaacgaatcgagccggggcccacttcgatcgaaacgagatggctccggggaagcgaggcaaggccaaaggggcggcgccgccgccgcccaccgcggcggcgagtaccggagctgtagggttccctggctgcctccgcctgatgccgccgtcgaccgtggccatatctatacacgccaagcccggctccaaggtcgccaccatcacagagattggggacgaggcggtgggcgtgcagatcgacgcgccggcgagggatggcgaagccaacgccgcgcttgtcgactttatcagctcggtacttggggtgaagaaaagagaagtgtctataggctcgggttctaaatcgagggaaaaggttgtgctggtacaagatgcgactcttgaaggtgtctacgatgctctgaagaagtcttgtaattgtgcatgaggtatgtacgttaatcctggagttaacttgaatgggcagggcatgtgaatgcttttctgatacgtaacctatttgcgatgtgatcctgttccagcttgcaaacacaagttagaaaatgaagtgagacgaggctgaattgttcgttcttggttgattttgtgacaagtggatcacgggggatcgaagggaattgagggggaaatgaactaattttcccctcaatcctctccgatcctcccgtgatccctggtcatcaaatcagctttaagctgtcagaataataatgcatatatgtcaatgc

SEQ ID NO: 3336 - DNA, 1948 bp, Zea mays
  misc_feature (1499)..(1499): n is a, c, g, or t
atttctcactctctttgtggtagacccaaatagaaacttaaacgtgtccacttcgctcttagaatctagaattgtattgttccgctctcaaaatctggaatggaaccactccgcttcggtggctcaccaaccctataaggacatgtttatttcggctttctaagaggttttggattttaaatttttggagtttccaaaagttaaacaactcatattggcctaaaacgcagaagctcactatagtttgcttttggcatgagagagagagagatttttcttttgaaagatctaaaaactagttatctaaaaagtggccaaaagctcaaacaagtatagccttagtagcctcgtgttgattcaatggtttaatagaacagctccaaaactaatatgttttcaaatacttgaaaattgcatgttatttgtttttcaaatttggagttataggcagactccgattaaaataactgcgagactaccacaaaacttcaagatggtgcatgcatgcgtgcagcaaataggcaggcctacatgatgacccacatactaagatcagcccaaaagataggtcgaatatcacggccaatgatcagtgttgagaaatgatctcatcctttcaaggcatcccttgggttgtaaagacacctcttgagttggcctctttaaggcactactttgtatctatataaacaaagcatccatcaattaagagaacatatttcactcttatatcattggtctcgccctctctgcgtactcaaacacgttatcaacatgagggctctctatcgagcggtttcttcctcggcgcataacgcacacccgttgtctggtccacggggaccatctactatgtcgccatagtcatctcggccatcgtcgaggactggcgtcgtgccatcgcgctcagccagacgacgctttgcaccaccatcaccgacttgcgatctcggccatgtccagcctgtggatggtaccgtagccatgctcctgaggctgtcggaggccttcaacctcatcagccagatcgagttctactacaagtagatcccagagcacatgcgcaacgtggtggatggaaggggagttttgttttgttttccttgtctccatctcctatactccccttgatttaatctggatttcgaaatcacattgtctgattcattatgcccaacattgaatggttactctgtgcctatgttcatacggatgtggagagaaattcattgggaatacggctggcgcactggactatggtggcaggctctcttagaccgagacaatggaccggggcgggaacgcatccgcagtagagcaatgcgatgctgcaacatggcaacacacggtttccgcttccagcaataaaagaattggatgaatgacctatgtatgttttcatatatgctttcatgcataattctaagcatacattgattattgttcatatgtcctttaaatttaaattttcaaaggatttatcttacacatatttgtcntgtatcactcattattttgaatttgaacataaggtgatagagtcatagatattggctgcgttttattctcatgaataatcatgtccagagaccatgtccaatgcagcgattcatttcacctgtactgagagggtctacactatgtaccaaccacatggtgattacctataggtgttcatcttaaaataatggttgtgatacttagtctactctaaagttttggagattgttatctttaaatttctttttagaaatttaatttcagcattttggggattgaaccctcgagtttcatcataattcctcgctgaaatttgtcatgagtctgattttaaagttttagttcttgactttaattgttttttaatatagtagagtaatttgctcctatatttcagcagactcatgtatattttattatttgtgttcatgtataaattaaatataca

SEQ ID NO: 3337 - DNA, 3170 bp, Zea mays
gtatctatttaatgctataggttttatatattttaatatttttagttaaatttagaatatgttgactttttaaagatttttcaatttaaaatagagaaaataagttttatccaattcagcccatgagtatattcagctgaaatgggaatccggcccatacacgagcataatcagttggaagattcgaacgaactgggccactagtctcagtttgatccgttgcgttcggctcccccttccatccatctgaagaaaccagaagaccgcggaagcttccggccgtcccaccgccacacgcccaacagtccaacaccaagacagagaggtgaaggctctggaacagccgggagtacgcgaaacagagtagggcaggaaagcttgcgaacacactggaacacctgcgaactctccctgcgatcaaccgcgtttgtataaagcaaagccacctgttcgtccggcctgtccatcggcgtgacacgaaaccaagcaacaattgagtgatcgatccatcacctctctctctctttcagcaaatctatccgcgacaactaagcattcgattctccgacaacaacaagcagggtaatggcgtctgcggacgtgcacatggctggcggtgcggagacggagaccttcgcattccaggccgagatcaaccagctgctctccctcatcatcaacaccttctactcgaacaaggagatcttcctcagagagctcatctccaacgcatcggatgtaagctcttccttcccgatcaagccatcctctgttctcatttcattttcgacacttgaaatgctctgctttacattacaccaacaacaagctaatccgtgacaatggcaatggcattccattgcaggcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgacctggtcaacaacctcggcaccatcgcgcggtcgggcaccaaggagttcatggaggcgcttgccgcgggcgccaccgacgtgtcgatgatcggccagttcggcgtcggcttctactccgcctacctcgtcgcggacagggtcatggtcaccaccaagcactccgcccgcgggcagtacgtgtgggagtcccaggccggcgggtccttcaccgtcacgcatgacaccacgggggagcggctcggccggggcaccaagatcacgctcttcctcaaggacgaccagctcgagtacctggaggagcgccgcctcaaggacctcgtcaagaagcactcggagttcatcagctaccccatctacctgtggacggagaagaccaccgagaaggagatcagcgacgacgaggaggaggaggacaacaagaaggaggaggagggcgacgtcgaggaggtggacgacgaggacaaggacgccaaggataagagcaaaaagaagaagaaggtgaaggaggtgagccacgagtgggtgcagatcaacaagcagaagcccatctggctccgcaagcccgaggagatcacgcgcgacgagtacgcctccttctacaagtctctgaccaacgactgggaggaccacctcgccgtgaagcacttctcggtggaggggcagctggagttcaaggccatcctgttcgtgcctcgccgcgcgcccttcgacctgttcgacacgcgcaagaagctcaacaacatcaagctctacgtccgccgcgtcttcatcatggacaactgcgaggagctcatcccggagtggctgggcttcgtgaagggcgtggtggactcggacgacctgccgctcaacatctcccgcgagacgctgcagcagaacaagatcctcaaggtcatccgcaagaacctggtcaagaagtgcatcgagatgttcttcgagatcgcggagaacaaggacgactacgccaagttctacgacgccttctctaagaacatcaagctgggcatccacgaggactcgcagaaccgcgccaagctcgccgacctcctgcgctaccactccaccaagagcggcgacgagacgacgagcctcaaggactacgtgacgcgcatgaaggaggggcagaaggacatctactacatcaccggcgagagcaggaaggccgtggagaactcgccgttcctggagcgtctcaagaagaagggctacgaggtgctgttcatggtggacgccatcgacgagtacgccgtggggcagctcaaggagtacgacggcaagaagctggtgtcggcaaccaaggaaggcctaaagctggacgacgaggacgacgaggaggccaagaagcggcgggaggagcgcaagaagcggttcgaggagctgtgcaaggtgatcaaggacatcctgggcgaccgcgtcgagaaggtggtggtgtcggaccgcatcgtcgactcgccgtgctgcctggtgacgggcgagtacgggtggaccgccaacatggagcggatcatgaaggcgcaggcgctacgtgacagcagcatgagcgcgtacatgtcctccaagaagaccatggagatcaacccggacaacggcatcatggaggagctccggaagcgcgccgaggccgaccggaacgacaagtccgtcaaggacctcgtgctgctgctcttcgagacggcgctgctcacctcggggttcagcctcgacgaccccaacacgttcgcggccaggatccacaggatgctcaagctcggcctcaacatcgacgaggatgctgctgccgacgaggacgccgacatgcccgcgcttgacgagggcgccgcggaggagagcaagatggaggaggtcgactgaggtgtccttccttcctataatatgcaagttttcagcgatgagggacgacggtcaatggcgatgcctgtttgtgtgtgtctgcgtgtgggtccaaaggggtcactgttggtacaggtcacggtagtgtctagtagtaccttgattgccaggaggcaggaccgtgtgtcttcttcgtgtcacatttcgggtctgctctgagtgtcgtggaatcctgtgaaacatataatacatccgatccgagtccttagcttccctcatcatggagaaaaagaaaacaaaacaagttattagtcggtgtatgaataaggat

SEQ ID NO: 3338 - DNA, 2944 bp, Zea mays
ctgaaatgggaatccggcccatacacgagcataatcagttggaagattcgaacgaactgggccactagtctcagtttgatccgttgcgttcggctccccattccatccatctgaagaaaccagaagaccgcggaagcttccggccgtcccaccgccacacgcccaacagtccaacaacaagacagagaggtgaaggctctggaacagccgggagtacgcgaaacagagtagggcaggaaagcttgcgaacacactggaacacctgcgaacttttcctgcgatcaaccgcgttcgtataaagcaaagccacctcgccggtcgacctaagcctctgcgtgacacgaaaccgagcaacaattgagcgatcgatccttcgcctctctctcactctctctcagcaatctatccgcaacaactaagcattcgattctccgacaacaacaagcagggcaatggcgtctgcggacgtgcacatggctggcggtgcggagacggagaccttcgcattccaggccgagatcaaccagctgctctccctcatcatcaataccttctactcgaacaaggagatcttcctcagagagctcatctccaacgcatcggatgcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgaccttgtcaacaacctcggcaccatcgcgcggtcgggcaccaaggagttcatggaggcgctggccgcgggcgccaccgacgtgtcgatgatcggccagttcggcgtcggcttctactccgcctacctcgtcgcggacagggtcatggtcaccaccaagcacaacgacgacgagcagtacgtgtgggagtcccaggccggcgggtccttcaccgtcacgcatgacaccacgggggagcagctcggtcggggcaccaagatcacgctcttcctcaaggacgaccagctcgagtacctggaggagcgccgcctcaaggacctcgtcaagaagcactcggagttcatcagctaccccatctacctgtggacggagaagaccaccgagaaggagatcagcgacgacgaggaggaggaggacaacaagaaggaggaggagggcgacgtcgaggaggtggacgacgaggacaaggacgccaaggataagagcaaaaagaagaagaaggtgaaggaggtgagccacgagtgggtgcagatcaacaagcagaagcccatctggctccgcaagcccgaggagatcacgcgcgacgagtacgcctccttctacaagtctctgaccaacgactgggaggaccacctcgccgtgaagcacttctcggtggaggggcagctggagttcaaggccatcctgttcgtgccccgccgcgcccccttcgacctgttcgacacgcgcaagaagctcaacaacatcaagctctacgtccgccgcgtcttcatcatggacaactgcgaggagctcatcccggagtggctgggcttcgtgaagggcgtggtggactccgacgacctgccgctcaacatctcccgcgagacgctgcagcagaacaagatcctcaaggtcatccgcaagaacctggtcaagaagtgcatcgagatgttcttcgagatcgcggagaacaaggacgactacgccaagttctacgacgccttctccaagaacatcaagctgggcatccacgaggactcgcagaaccgcgccaagctcgccgacctcctgcgctaccactccaccaagagcggcgacgagacgacgagcctcaaggactacgtgacgcgcatgaaggaggggcagaaggacatctactacatcaccggcgagagcaggaaggccgtggagaactcgccgttcctggagcgtctcaagaagaagggctacgaggtgctgttcatggtggacgccatcgacgagtacgccgtggggcagctcaaggagtacgacggcaagaagctggtgtcggcaaccaaggaaggcctaaagctggacgacgaggacgacgaggaggccaagaagcggcgggaggagcgcaagaagcggttcgaggagctgtgcaaggtgatcaaggacatcctgggcgaccgcgtcgagaaggtggtggtgtcggaccgcatcgtcgactcgccgtgctgcctggtgacgggcgagtacgggtggaccgccaacatggagcggatcatgaaggcgcaggcgctacgtgacagcagcatgagcgcgtacatgtcctccaagaagaccatggagatcaacccggacaacggcatcatggaggagctccggaagcgcgccgaggccgaccggaacgacaagtccgtcaaggacctcgtgctgctgctcttcgagacggcgctgctcacctcggggttcagcctcgacgaccccaacacgttcgcggccaggatccacaggatgctcaagctcggcctcaacatcgacgaggacgctgctggcgacgaggacgccgacatgcccgcgcttgacgagggcgccgcggaggagagcaagatggaggaggtcgactgaggtgtccttccttcctataatatgcaagttttcagcgatgagggacgacggtcaatggcgatgcctgtttgtgtgtgtctgcgtgtgggtccaaaggggtcactgttggtacaggtcacggtagtgtctagtagtaccttgattgccaggaggcaggaccgtgtgtcttcttcgtgtcacatttcgggtctgctctgagtgtcgtggaatcctgtgaaatacatccgatccgagtccttagcttccctcatcaactttatgttgctttccgattttgatctgtttcacagcttgtagaagtcaggtgttgaatccagctttttgtggtgctgttattgcagtgc

SEQ ID NO: 3339 - DNA, 2075 bp, Zea mays
gcacgagaccattacctagaacatcctaatcgaaaaagggaacccatcttcttcttccccgcgctgcctgctgcctgctcgagcttggagatggcgttggtgcggcgatgcctctgtggatccgaggaagactgcagagcgcttttgggcatggaaaatctccggctgttctcctacagagagatcagagcaggcacaaacaacttcgatcagagtaacaagcttggacgaggtggttttggaactgtctacaagggagttctaagagacggcactgaatttgccgcgaaggttctgtcctcggaatccgagcaggggatcaaggagttcctagctgagatcgagagcatatcccaggtgaagcacgcgaacctcgtcaggcttctgggctgctgcgtacagaggaaaaaaaggatactggtgtacgagtaccttgcgaacaacagcctcgatcatgcgctcaaaggagcagcagcagatctaccctggagcacgaggtcgggcatctgcttgggcaccgccaaggggctgagctacctgcacgaggagcacgagccgaacatcgtgcacagggacatcaaagccagcaatgttcttctcgaccgagactacctgccaaagatcggagatttcgggctcgcgaagctgttcccggacaacatcacccacatcagcaccgcagtggtcggaacgagtggatacttggcgcctgaatacttcgtgcatgggcagctgaccaagaaagccgacgtctacagcttcggggtgcttgtcctggagatcatcagcgggaggagggtctcgcaaacgatccaggtcggacatgttcccggtgcgagaggcatggatgatgtaccagcaaggcaggctgctagagatcgtggacgcgagcatggggagctacccggagaaggaggtgctccggtacatcaaggtggggctggcctgcacgcaggccacgcccagcagccgccccacgatgcgccaggtgcttgccttgctgtcggaacggagatgctcccgccgagtttcgccgagcaccgcggccaccacacggcccctgccctggggggtttgcccgccggtccgctaatccatgcgtcgccgagggcgaggtggccggcggcggcgccgtcagcagcaacgtcgccgaagcaggtcctgagcctgaacgcgcaaccggcaatccggcatgtaactgaaactgatatagtcacgtgtgaggcggcgttcgttctgtcacgtaatcacttgcgttagaatttgattttctagtcttgttcgtgctcgcagtttggaccgggaaaaaagggtaggaggggctaggcaggtccataaacgagcatattgtttttaatctcaatccatatgagttagagaggattgagaatctgttcattttaatctcaattcatgtggattgaaagaaattgagtagatttaaatctctaacaactcaaatttctttcctgttatttccagttacctgcaatctacatggaatggaatgtaaattcataaaagtcaaaatatcttctaatcccctggtgggaataacggaacaagtgggtttaaatccataaaagacaaaatctcttctaatcccctgatgggaataaccgaactgtttttgcacgaagtttactggaccaaaaaacaaccgattagtttagggttagatgctcactgacgctggaaacttgagcagctcaccaatgccagatgacgtaaagcactctatttcactgaagctacgtatgcgacaaatgcatgcacattcagagcgagtgggacacaaccagaaaagggacaacagaattagaggcacagattcccaagaaacgggggcatattctattacaagatgactacaacatactataattatatatatagtaaatgaatgctgtcagctactggattcatgttgcctgcctaggctgctaatgaagatgactacataaacaatgtaacggtaacactgtcaagtactcaattctgtgctataacttataacttgcctaaaaacttagcactaataaaactggctacatgctaaggctccaacctactgg

SEQ ID NO: 3340 - DNA, 2381 bp, Zea mays
  misc_feature (2347)..(2347): n is a, c, g, or t
ctgcacggagagccgtgacacagcgacagccaccaactagtttactcaactccaccgacgtgtaggccctttacttagatagaccccactcgtcaatagcttcacccgtcatcgttctcggtgtcttcacgacggctttaaaggtggcttcgaatccacaagcgaaacggccgctccagccggcgggcaaaggctgccattttaaaaccttgctctccggtataaaaaaaccttgctctccttctccgctggatccccaacccacccgcacggcaccaccaccaatccatccatccttacgcattagctacactccccggcgtcgagcccccgggaaccctagaccgccgccctcgcatctccgctcgtcgccgcggggtactccctccacccgtctggtgggagtcgcggcgggacgtccccgatccgagctctctccgccttagggtttttggggccggccatggactccatggagcagccggagcccaaaaccgcgggccactactacgcccttcaggttggctccgttttcctgacgggctactacaacgtcctgacgaaccagccgcacctggcgaaccagttctacacggacaacagcagtgttgttagactggactgcgagacgggtcggtggtcgtttggagagacggtggaggttatcaatgatatgatgatgtccatgaaactaagcaaggttgaggttaaaacagcgaatttcttagagtcatgggctggggcgattacgctgttggttactggcctagtgaaattgaagcactaccctgttcgcaagcgatttgctcagaatattgttcttgctccaaaggaagatggatattttatattcagtgacatctttaagctcatttgtgatgagtatgatgatcagtacccttttgctgattacaattgtgctgacaacatgccccaagtggaagcgtcttacacaatggctgaaatagggtctgattatttggatggagaacctgaggcacaggagactgttgatcctgctgaaaatcatgtgcagcaccaagattatttggaatataaggctggcaatgtgattgatgatgaaactcatttggaagagcatattcccccattccccagttcaacggatgttaaaagggattcacctcttgctcttccccaccctccatcacctaccctcgaagaacctgtggaagaagcacccaagacatatgcttcagtgttgcgaacgaaatcaaaggcaacgctggcgattacagagtcacagcaggctcaacagctggcccagcagccacagtctgcctcagtgcatgaaaagtctaacctggacaaccaccgggatgttagcgtccctgaggatgaagaagagtttctttcggtttatgttgggaatctttcgccatctacttcggtctttgatcttgagaaagtgttccaggcttttggaagaattaaacctgatggagttgctatccgaagccgcaaggaggctggagtattctttggctttgttgagttcgaagacatgtctggtattcagaatgctttaagtgcatctccagtagagttaaatggccgttttgttcatgttgaagagaggaggcctaactgcggattccctcgtggaagaagaggccgtggaagagctgatttctcaagggaccaagctggtgggagatacgacggggagtatgctactcgatcgaaaggaattgggcaccagaaaaaaactggacgccagtatgactactagttatgtaccgctctgctggtaaatggccgtgtaccattggtgttctctacttggtgctgttctggccataattttgctaaaagtcacaatgatgtcgggactagtatttctgctttgttgacattcggcggagtcttttttgggggatgggcatctgttaccattttgttgcgtcacagtagtttttggttctcagttaccgtgaccacttacaaatggatcatgctaccgtcggtgtcaaactttttaagcaatacctaggttgtacttgtaccgatgttaatagttggtattcttagattgacatagtttgcataagtcgttattcacgttggtattcacgttggtgtcgtgttttcatattgtgctgttttgacctaagggtcctaaccaattagtggatttgtgttacatgtcccggtccagatggttgatacaagaagatacaagatttatcttggttcggtcaataacagaggggaataagatttatattatcttgtatctagatgtttgtagtaggggtacaagctggtcgagatagggtgagtcgaggatctgtccttggttgagacttatattattttgcacgtngcacctagtcatctagttgtaatcactcacggat

SEQ ID NO: 3341 - DNA, 2154 bp, Zea mays
attgggtacctcgaggccggccgggctctcacttctgtacccaatcagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacggtgaggagggtccgtgttcggggaggtaatgtgaaatggagggctcttcgccttgatactggtaactactcatggggaagtgaagctattacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgtcctggacagtgtggccgagctgatgggtacatccttgagggtaaagagcttgaattctacatgaagaagctacagaggattgttacggagtattacacaagcaatgcatacagtcctgtacaggatgttgctgactcctgtcagaactggagctgctacgaatgtcatctttggccttgctctgggatataaatccgtcattatccctatttttgctattgcttttagtatttttctcagcttcagccttgctgccatgtacggtgttgctgtggctgctcttggaatgctcagcacaatcgctactggccttgccattgatgcctatggtcctatcagtgacaatgctggaggaattgctgaaatggctggcatgagccacagaatccgtgagagaactgatgctcttgatgctgctggaaatactactgctgccattgggaagggttttgcaataggttcagcagccttggtgtctcttgccctctttggtgcttttgtcagccgtgctgagatctcgactgttgatgttctgacacccaaagttttcattggactgattgttggtgccatgctcccatactggttctcagcgatgacaatgaagagtgttggaagtgcagcactcaagatggttgaggaagtccgcaggcagttcaacaccatccctgggctcatggagggcattaccaagcctgactatgcgacgtgtgttaagatctctactgatgcatctatcaaggagatgatcccacctggtgcacttgtcatgcttacacctcttattgtggggatcttctttggtgttgaaaccctctctggagttcttgctggtgctcttgtttctggtgtccagattgccatctctgcatccaacactggaggtgcctgggacaacgcaaagaaatacattgaggctggtgcatctgagcatgcaagaaccttgggcccgaaaggttcagacccacacaaggctgctgtcatcggtgacaccatcggtgatcccctcaaggacacctcaggcccctcgctgaacatcctcatcaagctcatggctgtcgagtcccttgtctttgctcccttcttcgccacccatggaggcatcctcttcaaatggctttagaggaagaatggaagatggatgggtagtttatttttgccgggggagagcactagatatatgtcatagagaagtttcagtttacccatatggtgcacttcatccttttttgtttcgcttgtactgtgtcgcagtcttgttgaacttgtcagccgtggtatcacctagtttttgggtctagatgcagtagccgagtggagcaaaaacgtctagcattctacaggattggaatttggacatggatgtgttgggaagtttgatactgcatgtagatatttcgatgatgatgatcaaggaatgcacaagtcagatttacctgtgtttgtgaaaaaaagaacaaaaaaaagaaaaaaagaaaagaaaaagg

SEQ ID NO: 3342 - DNA, 2392 bp, Zea mays
taccctcgaggccggccgggtcctctccgctctgctccctccgccgtgcgctcgaacgaactccacacgaaattctccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggcgacggctccgccgggaagagcggcgccggcgccggcgccagcgagtacctcatcgaggaggaggaggggctcaacgagcacaacgtcgtcgtcaagtgcgccgagatccagaacgccatctccgaaggagcaacttctttccttttcaccgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgccacatatgcaaatgccaggacaactcttgaggctaggaagggtgttggaaaggcattcattactgctttccgctctggtgctgtgatgggcttcctgcttgctgctagtggcctttttgttctttatattgcaatcaacttgtttggaatttattatggtgatgactgggagggcctttatgaggctatcactggttatggtcttggtggttcttctatggctctttttggtcgtgttggtggtgggatttacactaaagctgctgatgttggtgctgatcttgttgggaaagtcgaaaggaatatccctgaagatgatccgagaaacccagctgtcattgcggacaatgttggtgacaatgttggagatattgctggtatggggtcagatctctttggctcttatgctgagtcttcatgcgctgcacttgtcgttgcctcaatctcttcatttgggatcaatcatgaattcacccctatgttgtacccactcctcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgactcctgcagaactggagctgctacgaatgtcatctttggccttgctctgggatataaatccgtcattatccctatttttgctattgcttttagtattttcctcagcttcagtcttgctgccatgtacggtgttgctgtggctgctcttggaatgctcagcacaatcgctactggccttgccattgatgcctatggtcctatcagtgacaatgctggaggaattgctgaaatggctggcatgagccacagaatccgcgagagaactgatgctcttgatgctgctggaaatactactgctgccattgggaagggttttgcaataggttcagcagccttggtgtctcttgccctctttggtgcttttgtcagccgtgctgagatctcgactgttgatgttctgacacccaaagttttcattggactgattgttggtgccatgctcccatactggttctcagcgatgacaatgaagagtgttggaagtgcagcactcaagatggttgaggaagtccgcaggcagttcaacaccatccctgggctcatggaggcatcctcttcaaatggctttagaggaagaatggaagatggatgggtagtttatttttgccgggggagagcactagatatatgtcatagagaagtttcagtttacccatatggtgcacttcatccttttttgtttcgcttgtactgtgtcgcagtcttgttgaacttgtcagccgtggtatcacctagttgttgggtctagttgcagtagccgagtggagcaaaaacgtctagcattctacaggattggagtttggacatggatgtgttgggaagtttgatactgcatgtagatatttcgatgatgatgatcaaggaatgcacaagtcagatttacctgtgtttgcgaaaaaaaaaaaaaaaaaagcggccctcgagct

SEQ ID NO: 3343 - DNA, 1768 bp, Zea mays
tacccacgtgtccggacgggatcttctccctctcctcctcctcctctccgtctccgtctccgtcttcctcaatcccaaggacgaaatggcagcgactgtcgcctcgtttttttgccaacaaacaaaaacaaagcagcggtgaagggaggggaggaaaggaaacagcaaccacatgcgattatttcttggggattccgcccctccgacctatctaagcgaaccataaccacgggcagcaggacattatattcttctgcctgcccttccgttcaatttcaatttcacattccttctctcctctcctcctgctgctactaggttcgggccgtccgtcattgctcttgatttgcccgattattgcatctcctctagctgttgccgccggccgggcggcggtgtggttggcttcttgatctgcattatttaattcggaccactcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtagggaagctaacaccaggagctgaggctatctccctcatcaagggcatggaggtcaagatggaagggccatgcatgatatccaagttaatcgcggatacacttggaatcaattgctgtgtgctcatgggtgctaacattgcaaacgagattgctgtcgaagagttcagtgaagcaacaattgggtataggaaagataaggaagtggcaaatcgatgggctaaactttttaccacaccctacttcctagtttctgtcgcagaagatattgaaggagtagagctgtgtggaactctgaaaaatatcgtggctattgcagcaggccttgtggatggcttggatatgggaaacaatacaaaggctgcaataatgaggattggtttgcgagaaatgcgtgctttctctaagcttctgttcccttcagtcagagacaacacgttcttcgagagctgtggtgtcgccgacctaataaccacgtgccttggtgggaggaacagaagagtggctgaggcctttgcacgaaatggtggcaaaaggtcttttgatgaactggaggcagagatgttgcgtggccaaaaactccagggagtgtccacagcaagggaagtctatgaagtgttgacttatcgaggatggcaggagctgtttcctctgttatcaacagtgcatgagatctgtattgggcagttgcctcctacatcgatagttgaatacagtgagcacacgccaaatctctccatcatcggtggtcatactccattctactgagctagatactgctgtttggactagtgctccagtatcacttgttataaactaagaaatatgagatatgttgaatatctgaatatgttttgcatataaatatgatttcagtcatgtcaccttattaggtgcatatgaaaaaaaaaaaaagtatccagtattaatactaattgcaaatcggtgaatgcggatcagctt

SEQ ID NO: 3344 - DNA, 1098 bp, Zea mays
cattggcggccgcgtggccggccgcggcgcctcctcttcgtctccgtctccgtcttcctcaatcccaaggacgaaatggcagcgactgtcgcctcgtttttttgccaacaaacaaaaacaaagcagcggtgaagggaggggaggaaaggaaacagcaaccacatgcgattatttcttggggattccgcccctccgacctatctaagcggaccataaccacgggcagcaggacattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtagggaagctaacaccaggagctgaggctatctccctcatcaagggcatggaggtcaagatggaagggccgtgcatgatatccaagttaatcgcggatacacttggaatcaattgctgtgtgctcatgggtgctaacattgcaaacgagattgctgtcgaagagttcagtgaagcaacaattgggtataggaaagataaggaagtggcaaatcgatgggctaaactttttaccacaccttacttcctagtttctgtcgcagaagatattgaaggagtagagctgtgtggaactctgaaaatatcgtggctattgcagcaggccttgtggatggctgggatatgggaaaccatacaaaggctgcaataatg

SEQ ID NO: 3345 - DNA, 1617 bp, Zea mays
ttgatacgtgggcgcaaagccgcggcgacaatcatttgtttaagccgcgacccgcgcccccccatcagtcagtgcatcagcattcatcgccccctgcctccccttccattcgccctcctcccactccaccagctcctgcctgcctataaacccagggccgccctttgactctccttccctgtccagtggcggggccgcttcccttgcgttcgcggagagtctgtctgtctgtctagctagctagctagctgccgagagcgtgaggaggaagggggatccatggcggcggagaacgaggagaaggagacggcctgcgcggggtacaagcacgggccgccatgggtgttcaaaggcagcgcattgtaccagctgcatttggtgaaggcgtcgacggcgcgggccttcgtgccgcgggacctccgcctggttgaggccttcggctacacgctcggcggcatgttcctggcgcgctaccacgacagccctgccggcgaattcgacgagctcgtggtgatcgccggcattgtgtggaacccgccgacctcctgcgcgtgggctgccagggtgctggtgaacagcgtcgaagcctgccggcacggccgcaaggaggtaggactgccaagccatgtcgccacattctcgtcaaagaacgaggctgcttcgcttggggatagaccgttggctagaccaaacagcttcctcaacatgctggggatcgggtcgacagccttcgagcaagggaatggccgcgagattgaggtttcagagtccaagggcggctcgtctactcggcatctgtgcaacatcagcctgccatttaccgcaggatcacataaggaccaccattgggcgggcccagcaatcagaatgtcactcccgagtttcagcggacgtacagtggaccatcctgatcttctcaagtactcctgtcaagtagaatgcagggtgcgccctgtgaagcctgctaggatctggagtgcaagaaccacagagccccagcaggaaaaatccgacggcgaggtcagcagctccgggtccagcgtggcagccgacttggacgcccgaagccacagcatctcggtcctgttgtccaggcccatcttcgcgctcgagttcagctccctgaggatgcacgtcgacgctcccaggaccgttgttccgcaccgcgacgacaagaaagtcgggtactcgtccagcacttaaaacgtgatgaaggaaggagctgtgcctgtgcagtttctggttggaagcacaagaacccccgggagttttggccgcgtttgacccggttgcttgcgtgaattcgtgcagtttctggttgctttttactgcgcatcatattcgtttcttggttatttttttcttctctccctcggcggtattatttttcttgtttgtgaggaaatatgtcgggtatgcatagcatagcagagcacttgtttggttcaagattgcaagtagtttggttcctgttgcaacattgtcgcagagacttcgacgcatattatgtgttcgaagcagtaattttttttaaaaaaaaaggcacaacgaagaagaaaaggcaatgtgccaccaaaaaaaaaaaaaaaaaaaaaaaaaaaaaaaaaaaactcgagg

SEQ ID NO: 3346 - DNA, 739 bp, Zea mays
  misc_feature (78)..(78): n is a, c, g, or t
gttggatggaactctgaatagtggtgacttgcttgactgagctggggtcgggtcttgctgtttgtgatctactactgnatgagcttgttcttgttttcaggtgggctgccagggtgctggtgaacagcgtcgaagcctgccggcacggccgcaaggaggtaggactgccaagccatgtcgccacattctcgtcaaagaacgaggctgcttcgcttggggatagaccgttggctagaccaaacagcttcctcaacatgctggggatcgggtcgacagccttcgagcaagggaatggccgcgagattgaggtttcagagtccaagggcggctcgtctactcggcatctgtgcaacatcagcctgccatttaccggatcacataaggaccaccagtgggcgggcccagcaatcagaatgtcactcccgagtttcaggttaggcgaaccaaaccgtattcccccatgatttccttcaaagaaagaatttacgtagccatgcgcagatttctactgagaaatcgaaagaagggcaagaagaagaagggggaaaaaaaagagtcctcgtcaaaatacgtattgtttctgaaacaggcacgtctcgcttgctttgcgaatttcagcggacgtacagtggaccatcctgatcttctcaagtactcctgtcaagtagaatgcagggtgcgccctgtgaagcctgctaggatctggagtgcaagaaccacagagccccagcaggaaaaa

SEQ ID NO: 3347 - DNA, 1915 bp, Zea mays
gccggccgggtcgtcggcgacctcggggccggccgggaccgcaccgcaccgcaccgcaacgcgccaccgatccaccccgcgtcctcggcctccctccctccggcgagcggcggcgcgggcggccatggaggtgttctactacgtcgtgttcggcgcgctggccgccgtcgtggcggggctcgagctcggcaagagcggcaaggaccgcgtcgccaccacctccgccttcaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacctcgctgctcttctccgccttcgagtcctggctcgtcgcagagcacaacaagagaggctttgacccgcagtggctgtccataacattctccaaagccatcttccttgggaatggcttaattgccattgtgtctgggctattcgcgaaccttcttgctgagaacttgggttttggtcccgtggctccgtttgatgccgctgcatgctttctggcgattggcatggctgtcataatgtcctcatggagtgagaactatggagacccatctgatagtaaggacctgatggcccagttcaaggttgcagctaaggcaattgcttcagatgaaaagattgcattactgggagccatacaatcattgtttgagggctcgatgtacacatttgtcttcctatggactccagcattgagcccaaatgaagaagacattcctcatggttttatttttgctacattcatgctgtcatccatgttgggtagctccgttgcgtcacgtctattagcccgaaagctcaaggttgaaggttacatgcagattgtattctcgatatcggctgtcacccttgtcctccctgttgtcaccaacatcctagtgcccacatcttctgtgaaaggaggcagcatatcgattggaggttctcttcagcttcttggtttctgcaccttcgaggcctgtgttggcatattctggccatcaatcatgaagatgaggtctcagtacattcctgaggaagcaagaagcacaatcatgaatttcttccgcatcccgctcaacttatttgtttgtgtggtgctttacaatgtgaacgcattccctatcactgtcatgttcgggatgtgttctatcttcctcttcatggcagcaatcttgcagagacggctgatggttgtctcggatctacacaaatcatcaactaaagcacaagaaatgatcggggaagatgagccactaaatccttagacgtcgacagaaccatacgtgcaaatcagatacgaaggcggcatacacagagcaattcatttccacccgcgcaataagatggaagtcagaacatgtagttgttttcgtttgtaattttgtttctatagtgtaagatttgacaaggctgttagtttgcacctcggatctgcttatatccacagggcaatcgatagttcagcaagtattgagctatacctatgtcccgagaagattagatgagttggcgtcttggcgatcgatgtgggcttttcccgttgttgttccttgcaatttattttcgaaaaaaaaagaaacatgttcgctttaagctttacgatacggtatatattattcttggaagtgttatctactgcaagacaaaaaaaaaaaaaactcgaggggggggggcgtgtaccc

SEQ ID NO: 3348 - DNA, 2127 bp, Zea mays
ggaagcacacggccaccccccgcgggctcggccgggattcccatccccaccagcaccagcacacggacccggcggcggtgggcggtggcgcacccacaccccagcaccagcaagcaggtgcagtcagtgtgaggtgcggcccggccgaagatttggcgcatgcacactcactcactcactccagtgcccactgcccgacgaggaagtttcacgatctcaacccgtataaatcgacgccgcgagggggagcgacgagcgatccccgtaattaacctgtcccagccgcaccgatccaccccccctcggcctcggcctcggcctccctccggccatggaggtgttctactacgtcgtgttcggcgcgctggccgccgtcgtggcggggctcgagctcggcaagagcggcaaggaccgcgtcgccaccacctccgccttcaactccttcaagaacaactacgtcctcgtctactccctcatgatgtccggggactggctgcagggcccctacgtctactacctctacagccagtatggcttcgacaagggcgacatcggccgcctcttcatcgccggcttcggatcctccatgctcttcggcaccatcgtcggctccctcgccgacaaacagggccgcaagagggcctgcgtcacctattgcatcagctacatcctcagctgcatcaccaagcactcccccgagtacagggtcctcatgatcggccgcatcctcgggggcatcgccacctcgctgctcttctccgccttcgagtcctggctcgtcgccgagcacaacaagagaggctttgacccgcagtggctgtccataacattctccaaagccatcttccttgggaacggcttaattgccattgtatctgggctatttgcgaaccttcttgctgagaacttgggttttggtcctgtggctccatttgatgcggctgcgtgctttctggcgattggcatggctatcataatgtcctcatggagtgaaaactacggagatccatctgaaagcaaggacctgatggcccagttcaaggttgcggctaaggcaattgcgtcagatgaaaagattgcattactgggagccatacagtcattgtttgagggctccatgtacacatttgtcttcctatggactccagcattgagtccaaatgaagaagacattcctcatggttttatttttgctacattcatgctgtcatccatgctgggtagctccatcgcgtcacgtctattagcccgaaagctcaaggttgaaggctatatgcagatcgtgttctcgatatcggctgtcacccttgtcctccctgtcgccaccaacatcttagtgccaacgtcttctgtgaaaggaggcagcttatcaattggaggttctcttcagcttcttggtttctgcacctttgaggcatgtgttggcatattctggccgtcaatcatgaagatgagatctcagtacattcctgaggaagcgagaagcacaatcatgaacttcttccgcataccactcaacttatttgtttgtgtggtgctttacaacgtgaatgcattccctatcactgtcatgtttgggatgtgttctatcttcctcttcatggcagcaatcttgcagagacggctgatggttgtctctgatctagtacacaaatcatcaactaaagcacaagaaatgatcggggaagatgagccactaaatccttagatgtcgacagaaccatacatgcgcaatcagatattgaagacgacgtccatactgcatttcgtttcgtcacctgtgcaataagatggacgtcaaaaccatgtaatagagtctagtggctttcgtttctgtagtgtagatttgaccaggctgctaagtttgcacctgtgccgagaagattagatgagcaagtcaatcgatattggctattcgcattgttgtttcttttttttaaaaaaaaaatgttcgctttaaagtttaaacgatacggtatatatccttgtaagtgttgcattgctgcatctgatgacaattctggtggtgctgttactgacgttgagggctctctctacttggtcgttgtaagaactgttgcttcttaatgaaaaacgggctcaacaaattcagtagaaaaaaaaaaa

SEQ ID NO: 3349 - DNA, 1951 bp, Zea mays
atgcacactcactcactccagtgcccactgcccaacgaggaagtttcacgatctcaacccgtataaatcgacgccgcgagggggagcgacaagcggtcccccgagcccggccgggaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattcaactccttcaagaacaactacgtcctcgtctactccctcatgatgtccggggactggctgcagggcccctacgtctactacctctacagccagtatggcttcgacaagggcgacatcggccgcctcttcatcgccggcttcggatcctccatgctcttcggcaccatcgtcggctccctcgccgacaaacagggccgcaagagggcctgcgtcacctattgcatcagctacatcctcagctgcatcaccaagcactcccccgagtacagggtcctcatgatcggccgcatcctcgggggcatcgccacctcgctgctcttctccgccttcgagtcctggctcgtcgccgagcacaacaagagaggctttgacccgcagtggctgtccataacattctctaaagccatcttccttgggaacggcttaattgccattgtatctgggctatttgcgaaccttcttgctgagaacttgggttttggtcctgtggctccatttgatgcggctgcgtgctttctggcgattggcatggctatcataatgtcctcatggagtgaaaactacggagatccatctgaaagcaaggacctgatggcccagttcaaggttgcggctaaggcaattgcgtcagatgaaaagattgcattactgggagccatacagtcattgtttgagggctccatgtacacatttgtcttcctatggactccagcattgagtccaaatgaagaagacattcctcatggttttatttttgctacattcatgctgtcatccatgctgggtagctccatcgcgtcacgtctattagcccgaaagctcaaggttgaaggctatatgcagatcgtgttctcgatatcggctgtcacccttgtcctccctgtcgccaccaacatcttagtgccaacgtcttctgtgaaaggaggcagcgtatcaattggaggttctcttcagcttcttggtttctgcacctttgaggcatgtgttggtatattctggccgtcaatcatgaagatgagatctcagtacattcctgaggaagcgagaagcacaatcatgaacttcttccgcataccactcaacttatttgtttgtgtggtgctttacaacgtgaatgcattccctatcactgtcatgtttgggatgtgttctatcttcctcttcatggcagcaatcttgcagagacggctgatggttgtctctgatcaagtacacaaatcatcaactaaagcacaagaaatgatcggggaagatgagccactaaatccttagatgtcgacagaaccatacatgcgaaatcagatattgacgacgacgtccatactccatactgcatttcgtttcgtcacctgtgcaataagatggacgtcaaaaccatgtagtctagtggttttcgtttctgtagtgtagatttgaccaggctgctaagtttgcacctgtcccgagaagattagatgagcaagtcaatcgatattggctattcgcattgttgtttcttttttttaaaaaaaagatgttcgctttaaagtttaaacgatacggtatatatccttgtaagtgttgcattgctgcatctgatgacaattctggtggtgctgttactgacaaaaaaaaaatctctctaccggcccgttgtaagaactgttgcttcttaatgaaaaacgggctcaat

SEQ ID NO: 3350 - DNA, 870 bp, Zea mays
gcgccgtgttcctccatatcccagacaagcttgtttggactgggcttgagaggcttgcggggaagctgaggccacatagaggccggatttttgtctcacataacattaagttttgctcaagactgggaggcgatgagtgcacacgacggcttgccaaattgggccttgagtatgtggggaagcacactcatgatagcttgttgtttaaccactacgaggtctggtttgaattccgcaggccaaaagtttagatcttgatggtacagaaagagagagtggttggcttctgtgatgcaattttggcagtttcaagcacagattaagccatgccttgtactgtttgaacactactgggacctgacttgagattgagattgatgttcgctcggtgcctaattcaagcatatgcatatacaccaaaagtcatgattgagcaatgctgtggtgcttcagtgtgtcttcccagtttcattcggtgagtggtggatgaaggcttcagtttttattagcaccgattactgtatgttctataacttcagtaacatttctggtagaaactatgtgggtagctgatgtcaaagtagtaggatacatgcttctattccgaaagctacctctgtgggctgtggccaaaatagactcttatgagcacacatggttttgtaagctgtaacaaggataacttcggttgtcttgtttttgcattttatagaacatgcacatttttatgctgctgtatcctggtgagtatttgcaggcatatgattttgtcaatttacagttacagtgtaaaaaaaaaaaaaaaataaaaatacccctttttcccccttccttctcatttcttcttaatcataaataataaaagggggg

SEQ ID NO: 3351 - DNA, 1629 bp, Zea mays
  misc_feature (1535)..(1535): n is a, c, g, or t
cacctccgttggatcaacctgcgcctgtgagcaagttccaacaaaatctttctgatttttatatttatttcagatttttaaaaatttaaatgtttttttaactggaaaccatttccgggccgggctcggccggccgcgagcggcggtttttccttccctggtcccatcccattatcccaccgaaggtccgaagccgagccacggccgccgaggcgtcgcctccacgggacgggaccgcctgcaccaaggtgaggtaccataccacccgtccaccccacgttcccacccaaacggccgtcgaactaaccaatctgacggtacgagcgcacttgattcggttcgcctccaccttcctttattatagttgtagcgtccccgcccggccgcggacgcacgcccagacagacgagaccagatcggggaccctcgcggcgcccagttcccgagcgaacccaacccactacccacagccagaagcaaaagcccctcgccttttccgcgccttggttctcctcccgtccatccgcggcgagaacgaccgacgacgacagggcgagatgtgctgctgcccgagcaaggcgtgctgcatctgcacgctcatcgtgctggtgctggtggccgtcggcctcgtcttcggcttcggcgtctacacccgcggcttccacaagctcaccagcaacatgcacctgcaggacgatgcatacggccgcggtggcgccggcggctccttccgcgcctacggccactttgccccgccgccgtactagaaggaccgccgccccttctccgagatctagggcctggatgctgggcgattcgagccccgctccgctctcggtggagttggatgaactgccgccgccgccgccgcctgtaaaaaggaaatgtatcatgggattttcgttgcttgctgcattttggttttgtttgaaccaatcgactggattggctagtaattcgatttgttgaagaccgagtgagattcgacaacatattatcattatcccgtccgctgctgatttgtgctgcttcgccctgctgagtgattgttcacccaaccgttagcgccggtggtcacactcacatggacggtggtcggagttggtttgtttggccatctgaaactttcatgtcgcgtggtgcgccgctcacgccaaccggcatgggtgggcttggccagacgggcgatggcaattgcggcacgccaacgcattcacgagtcaaacgctcgctcgaagtggcgagtgccgtttacgccaacccacccacccgagtgtgcactgtgaacaaccgctttgtgtgttctgttggactgcatttgcacgtcctacttggtaacggctgcattacgctgttgctgggaccaataagacaataattattcacgcttcgccttctgcatttcggtgttgatgatcactctaatatgactgcctgaaatacacgttcgtttctatgttttccacgcagaggatgcttttccacaatataaagatggccggatattttatactgatatagaaatattggattantcaatgacatatgtggtgtataaatcaatcaagacaccagtgccatcaaatagacatctcatcctagacaagagaggtaaatcggttgatcaaa

SEQ ID NO: 3352 - DNA, 3557 bp, Zea mays
aaaccagactgtttgcagcccctcacaaaaaggagaatagatcccacctgcaggtgcaacaatacaatcaaaacgtgacctgcagatgaggtctacctcctttctgtgagagaggctacaaacagtctagtttacagtcggctgcatccaatttttttcccatcgtactctggaactaaatgctaccttaatcagtagcccccaaatgtcatgcagagatggtcagccagccaggcaagcattaaaagccagtgtccggtcgggccgcgtacctggttcgaccagaccagaactcaaccggtcgcgcttccttcttcaccctcagtcctcttccgtcctcctgtccaccgccccgtgcagttcggcggcgacatggcggcggccggcgacctgtccgacgatgagaagcgggcgatgcggggcagcaagttcgcgccgcttcctccgcctcctccctcttcccgacccgagccgaggatggcccatcctggaggagcactaaccacaaacaaggctgctgctctagcaaaattcctcgagagaaaacttcagcagcctgatggcttggactccctggaccctgaccttgtaaaactggctgtgaaaaatgcaaaggaaaccataaaagctagcaatggtgagccttcaacttcaggaagagtagtacgacatgtttcctcatttgtggatggaactcaggattctgaagatgaagcagaggtgaaggggatcaaaagaaaaaggaaaaataagaaggttaaaactcatcaaggtgacaaacaacagagcaagaaaaagaagaaaaataaaaagaaaaagggcaaaggtctttgatgattccatgcccccaggaagcgtcaaagaggggaagttttaagctgtggatgactgtttaaccaaaaaaatgtactaggatgctactacaagcagacaagcctcgatctcaaaagaagggtgggtggttggaggagggaggggggggggggggggaagggcatcaatcaatcccccttccctttttgtttttgttcctgccattcacattactggtttgatctggacccccttccccttggctggcactgtaaaacttactcggcctatcgcatgagcactgaaagtttcgttactctgcctatcgttgcgtatcatctgtatgcaagagggaattgattccgtacaggttgtacaaccaagtgttttttcctatgctgctagccatgatgtgcagtgcaggtttacttcggtgtcaaaaggaaatgctctcgtgcctttttcaccgcatacagatattatactggcagtcacatgagtattgaatgggatgggaaaaacctgggtgtggctgggcccttttcccctccgtccgcagaattcctgcccgctgttgtgtcttttcctgggattatgattaagagagagagagagagagagagctgttgtttgtttcccgaggagtcaacatgccctaaacgagagcaggtaggtaggcatgcccctccccgctcgtgcagtccgctagtgtacagttaaagcaaggtacggtacgtaggatctgcctgcagccattgctctaaaaaggagtgagtactgctgtgctgcactaggaattggagattggccgtacgtgcgcacccggccacaaacgagagagaccaactgctaattggatggaagtgattttgtatatgaaatttacagtccaaatggtcgcaaaacacgaacaggtgcgtggaaagttaaaaaaaaaagagaggaaaagaaaagcaaccgcggtccttgttaccatttcgggaggcaaaataaagctgtgcgtgaatggaccaggccgcggcctgacacgtcgcggggcggcggattcctgctccgattcacccaccccccagtccccaccgtgcatgtggtgcgtgaacagtgcgtgtcccccccaccgtcccaagtctgtgcctgcctccgtcacccacggcacctctgctcctatagtctggtcagccggtctggcagggagaaggggagaagggagacgggggggagggccggaggaggactctctcgctctgcttccttctaccggtatcactagtaccactgcacatttcatttcacgctcagctcgtgactgactgactgactgactgagcgaacagtcacctcttactgtcacgggcacagcgatggatcgtcgtcgaacgtgacattccacaaccacatccacagcagaccaacaacgtctttgtttgtcaaacagttaattttatctccatcggagctagctatttagctagcaagaattacagcggcgccgttgctctttttttttaaaaaaaaaatctctcagccatgcatgaagttattaataaaattgtttgtcaaacgacaactgtatgtatcgtctaaaataaatacttcctccgtgctggatagtttaattttacactaaccagcgacaactaaaacgaaacggaggagtagccagtaaagctgtagctcggagctacgtacggccgtgtacccaacatacatccgaattggatcggaaggaccgttagcgatgcatcagtggatgcatggtggtatgggcgggcgccgaagcacaacgtggcgagcgccgagctagcgcgtggcgtggccaggcacaggcacaggcacgtctggggagcggcgcacggtgcactggcgacggcagactggagacgcagacgcacgcatgcgcgagctcaaccgcatctcgtgtgcgtgccggcgcggcgcgatcgacgtcttctcgtacccggccacctgcccacctcgtatggtggccttatcctttgggagttggggacctggacctgggggtttcgcttcgcttcgaaaccgtccgcgccgtatggccctgtggctggcgcgtgcaaggggcctccggcgcgcgcgcgggggggaattaatgcggctccgacacgtcatgccccttcaccctacctactgcggctccctgcccctgcctgctctctacggctctacctacgctacggcatgcacacgcgctcggctacctctctactccctccgtatgaccctatgtactatatcctcctacctacgggctatacggataacaatagactcaaaattggaatccggttctatttatattcatttttgaaccaaaaaaataatttaggaccctattaaattatgaataagtatttgaaccgtcgttcgttagcacccctaactgtgtacgtgactactacatgcattggccgttggttggtaatggtacggaatacatgcatgcgcgcaccggccggccccatccattctacgctacgagctaagactatactacgccatcagcagtcaagcaccggtcatgtggtactatacgtacgtactcatgctgcagctagctagctagctgcaacaaatcgacgacggctgtcgagggcggacaaagcacgattggcccacatgaaccctgaccaaaaaaaagtacaacacttatatatatatatatatatatatatatatatatatatatatatatatatatatatatatatatatatatatatata

SEQ ID NO: 3353 - DNA, 1879 bp, Zea mays
gtatgggttcatgaagttgtacagttatttcaattagccacgacaaatttaggttcctgatcgtgcaagagcaattcaattcatgctcagccagtgtggacatgcagaagcaagtcaatatttgctcacccagtgcactagataacctgtacacaaatagttgttgattgcttacagaaatttaaagacaagtcttaaattaggtcataacctactgtcataccgtggagtttactgtattactctatgttgccttgaaatgagactgttgtgattagcctgtgttgccttatctgttgtgattagcctgtgttgccttatctgcatcgtactcaaatgcccttcaaattctgcaggaaattgttccactgaggaaggtgtgccgccgaccggaaactgactacaggcttcagattctgcatgctgctagagcggcagccactaatgcagatgttcacactccacccaaagaggttaaggtggagttggcgtccactgataagagcccagccgagcagaaaccccataagcagcacaagatgatggacgtgaacactgatgaggtgaccatggtctccaccttggagcaagatgagacaccaggcaagactgtagcccccgtaccgtcagcaactgcagaaacccgcaattcaagttcggacacagtgatgaaaggtgctgaggcttcctcggtcgttgaagatgacgatgaagtgcaggcagttgacaagatgaaagaggggtagggttttttttttctgtcaccttttgttatctaggtcagtgcctgtcttaattaccatgtagcatcttaatggcctcagaagcttgtttgaaggcctatgtgagcctttgccttgcctacacctttttgtttggtcgatgatatggtgaaatggaacctggctgggatggttctgtttctccgagggacttttgttatctgtggtcttccttctccagcgtgggcagaggggcgccagagactgcgggtttcgcttcaggatctcagggtaaaatgtgtagctgttcgattgattgtttgcttcactccattgagcgttgttcgtcaataataatttattggagtagtccttgctaaaaaaaaaaaaaaagtcagcatgatttgtcttttctcgtcccctcaaaaagtttggtcatcttacacttgtaaggtcatgttctaaacctttagaactaattgttagtcagctaatatattgttagctaggttagagcacctaacaactaatgattattatagaggtatagttaacaattagctggtccaatagttgatccgttttaaacatctcggctaatttccatgacaaccgagatcaatttattaccatatatttgcattatctaacatatagtcacgttaattctgcatgtgcgccacatttggcaatgaccggctcacagtgcgttgctctgttttttgctctctctaatcctaaggccataaaaatgtcaccttttaaatcacagttggtttggcaataatttaacaatacattaaagatataaataaactgaattcaataacgagatatccaatacttcatattagagctttattatgcgaatgcaaatggtgcaatgcaatgcaggacttatcttctactcacacatcccaaaagaaggaagtgaaggctgcattcaagttacttctcaacgtgtgttgttataccgatacttatcgcatgaattcggctttgactacagtttatccatatgcattattatcaacatgagaatgcaaatgccagactgccatgcatccatttcatataattcataactttgaaagcattccggcagtaggaaaatcatgcttcacatataactaaatttagatcacgtggcttgtgtg

SEQ ID NO: 3354 - DNA, 2790 bp, Zea mays
tcaagctaggatagagaatcgaatccgatccacaatccaaatcccaccgaggctctggcgcagcgcagtaggccatcgttcactgttggcacacacgggacacggcacgccgcaggccaccccgcccgcgagcgcgagacggagccggagccggctgcctgcttgaacgcctggtaacacggcctctcgcttcccctcccaaactttccctaccccgaccgccgatcctcctcgccttgacgtccaagagccccggtccgatgggtcgtccgccgagcgccggtgctccggcgttccgcttcctcccgtccgaggtggcggagatggaggcgcgcctgctgcagctcaacaacggcatccccacccgcgccgtgctgcagaccctcgcggataagttctccgcttcgcccgagcgcgctggcaaggtggccatccagcccaagcaggtgtggaactggtttcagaacagacggtactcacaccgggccaaaactcccagggccgcgtcgtcaccgccggctaagatgacgccctcgggagctgatcaccaccagcatgccgctaacgcctccgccttcagggctgctcagctctcttctgttgctgctgcgcaccacggttcctcctctacagggaagaatcctgtggaaagtgtctcagttgagtttgaggccaagtcagctcgtgatggtgcatggtatgatgttgctgcctttctttcacataggttgtttgaatccggtgacccggaggtgcgggttcgtttttctggatttggggcagaggaggatgaatggatcaatgttcgcaaatgtgtgcgacaacgttctcttccatgcgaggccacagaatgtgttgctgtgcttcctggggacctgattctttgttttcaggaaggtaaagatcaggctctctattatgatgctcatgtccttgatgctcaaaggagaaggcatgacgttagaggttgccgttgtagatttcttgttcgctacgaccatgattcttctgaggaaattgttccactgaggaaggtgtgccgccgaccggaaactgactacaggcttcagattctgcatgctgctagagcggcagccactaatgcagatgttcacactccacccaaagaggttaaggtggagttggcgtccactgataagagcccagccgagcagaaaccccataagcagcacaagatgatggacgtgaacactgatgaggtgaccatggtctccaccttggagcaagatgagacaccaggcaagactgtagcccccgtaccgtcagcaactgcagaaacccgcaattcaagttcggacacagtgatgaaaggtgctgaggcttcctcggtcgttgaagatgacgatgaagtgcaggcagttgacaagatgaaagaggggtaggttttttttttctgtcaccttttgttatctaggtcagtgcctgtcttaattaccatgtagcatcttaatggcctcagaagcttgtttgaaggcctatgtgagcctttgccttgcctacacctttttgtttggtcgatgatatggtgaaatggaacctggctgggatggttctgtttctccgagggacttttgttatctgtggtcttccttctccagcgtgggcagaggggcgccagagactgcgggtttcgcttcaggatctcagggtaaaatgtgtagcttttcgattgattgtttgcttcactccattgagcgttgttcgtcaataataatttattggagtagtccttgctagtttgttcaatgttgtcagcatgatttgtcttttctcgtcccctcaaaaagtttggtcatcttacacttgtaaggtcatgttctaaacctttagaactaattgttagtcagctaatatattgttagctaggttagagcacctatcaactaatgattatttaagaggtataactaacaattagctggtctattatctaatatattctaaacccgtcagttaattttagtaggtaactatagttttagagtgttgctacacgtatgactggtacgactagggtcatctaatggcttataatttattagttcaaaacaagagacaacaacagttgtagattaacgttggttggtcgtactctagttatacaagtggtcatacgtgaagcattttcattagttttataggtttaaaacaggatgaagtaatacagaaaattctcaaagcttgtgtcttagccaacattcaggcactcaacgcgcctgcagaattgcattatataaatacatcttgaggcccaactataatgccccataattgccgcctatagatggcaaattataaattttgattatctagctgatagggtaatcatatatagagttggtaacggaatcaggcgatactgtcttttcctatatcgctgaaggccgcgaagcatgcacgttcagaagttcagtcaaagcaccatgacgttgggggttttttttgttaatttaatgcttcggccttcagccatccttttgcacctgcaaattctgagctgatcttttgtatgtatgttctgtttctttattgtagctgaatgctgcaaatcttgaatacttatttttttaaaaaaaaatcgcctgcttttgttcagttattttctctctagtggccctcctaaactcttttgcagatgtaaactactcatcaaagcaatagaatagccgtgcacaataaatcacacccaactgcaactgatcagcctgctttatttgtgacccacataataacccactccctgatcctgaaatatttctagataattag

SEQ ID NO: 3355 - DNA, 1639 bp, Zea mays
cctcgaagccggccggcaccgttgagccggagccggagccggccggttgcctccccggagccatggacgcctacctccactgactcacacttctcctaaactttacccacccccgtccgccgatccaccaccgatctggtctcactgcatcctcctcccctcaccgtccaagagcgccggtccgatgggtcgtccgccaagcaccactggtgctccggccttccgcttcctcccttccgaggtggcggagatggaggcgcgcttgctgcagctcaacaacggcatccccacccgcgccatgctccagactctcgccgataagttctccgcctcgcccgagcgcgccggcaaggtggccatccagcccaagcaggtgtggaactggtttcagaacaggcgttactcgcatcgggccaagaccaccagggtcgtgccgtctccaccggctaagatgaccccctcgggggccgatcaccaccagcacgccgctaacgcctccgccttcagggccgctcagccctcttctgtcgctgttgctcaccatggctcctcctcgacagggaagaaccctatggaaggtgtctcagttgagtttgaggccaagtcagctcgtgatggtgcatggtatgatgttgctgcctttctgtcacataggttgtttgaatccggtgacccggaagtgcgggttcgtttttctggatttggggcagaggaggatgaatggatcaatgttcgcaaatgtgtgcgacaacgttctcttccatgcgaggccacagaatgcgttgctgtgcttcctggggacctcattctttgttttcaggaagataaagagcaggctctctattttgatgctcgtgtccttgatgctcaaaggagaaggcatgatgttagaggttgccgttgtagatttcttgttcgctatgatcatgactcttctgaggaaattgttccactgaggaaggtgtgccgccgaccagaaactgactacaggcttcagattctgcatgctgctagagcgcgcagccgccagtgcagatattcacactccacccagagaggctaaagtggagttggcatccaatgctaagagcccatatgagcaaaaaccccagaagcagtacaagatgatggacgtgaacactgatgaggaggtgaccatggtctccaccttggaacaggatgagacacaaggcaagactgtagcccccgtaccgtcagcaactgcagaaacccgcaattcaagttcagacgcggtgatgaaggatgcggaggcttcgtccgtggctcaagacgatgatgaagtgcaggtggttgacaagatgaaagaggggtagctttttttcgcactttttgtgtttggaggacttgatgttgtcgtacagagttttctaatttagtttgtagtatatgtttttctaattaagtactccttccattcttttttatttgttatggtttagtttagaaatgaactaacgctcgttcttttttatttgtcacgttagtttaaaaatgaactagcggacgacaagtattgagaacggaggtaatacagtacttgtcgtaattaccgtgtggcctcttaaaaaaaaaaaaaaaaaaaaaaaaaaaaaaagtactctgcgttgttaccactgct

SEQ ID NO: 3356 - DNA, 1119 bp, Zea mays
gaatgctcatcgaataggatatgttgcaccacgatttggcaggaatactgaggcaggagatggagaagactctcctgaaaacacagcaagtgcacaaccatcaccttatcattctggtaaagggtacacacatgcaaaagacttgagtaataatatcaaaaagggtggtaaggcaagcacatcatttggtattcagcaaagagctgagaagtccgcaaggactaaacgatctacgaagtcaataccgcccgggctgtctgatagtgataatagtgattctgagtttatgggcaccctgtcgaggtcaagatcgcacaccctgaagacaaaccgaaagcggtgtcgcggccgaggtactggtttgataacacctcaatccagtggactgatagaaagagagagggtcagaactaaatcccagccattggacccaaaagcaacaagcaacggagatctacatactatggatgagtatcagtctgttatcatgcagttaagggatgaaaattcatcactaaaggaaagattatcaaagatggaagaatcgatgtcccaagagctagtggttgagcgtgacaagaataagtctttgacagagagggtggaggatctgcagagacaacttgagtctgcaaccaaggaacaggaggcattgatcgacatcttctcagaagaaaggaaccgacgagaccaagaagaggagagcctgaggaagaagctgaaggacgcatcttccaccatacaggatttgctggagcaactgaatgttgccaggaaaggccgcaaagtttgaggaaataaactagtaacgttgctccttgcgggcatcgtcttagtttagagtttgagggttagctgcatctacattgtgctccaggtcgtttggagcatcccatgtacagccaagcagtagtgaccactgaagaacacgttatgctttatctgcagttagcagttaccctacaagaaataacttgcgtaattatctttttatcctgttacgtcatctcttgattacttgtcggtttctgtgctctggttgctgctgctttgggcttcgggaatacttgtactaccagttggccatggttggtttgaaaggttatgttactgcaagcc

SEQ ID NO: 3357 - DNA, 6046 bp, Zea mays
  misc_feature (5455)..(5455): n is a, c, g, or t
ggcgcggaagcggagcacccaacccaacacgcctccctcccctcccctccagatccagcctccctttcgtcctcctcttcctctgctgagttcctcttcctccgtggaatccgcacccgccgcccgctcccaattcggccgggatccttcgattcgcttcttcctccctcgtctatagttgggaaatctcaacgctggggagtcggtcatcactgttgaaggccatgatatcactctgccagggcaccacagtaagttttggcaaactgaatccatgagttttggtcagcttgggacccaaggaaggacaataaagtttggtccgagagtgaagtagcagagtggtgccaaaaaaaaattgcccaacacaccatgcctcgcgtccgcttcactcttactgagatgaaggaagggatatcaacggttgcaaggatcacagagctcatatctgagatgcgcaagctggaaaactccgtggacatcaacacgtttgacgtgataaggcagtgctccacggctgccaacacactagcatccaccaaaaacgaagagtgtcttcagcattttgttcagctaaatggtgtttccattctcaaccattggcttcaggatgctcaaaattgtggtggggacgtcagcaatccagctgctgaggatctcatagttgcgatattgactgcattggactgtcttccgatcagcaatgagcaatcagtctcctgtggggttatgcctactgttggtcacctgctggctcacagaattgccgtgatcaaccaaaaggcaagagcactctgtcacaagtggggcggtgtaccaaaacatggtacaaatggagagcattttcatacagaggagtcaagccacactgaccagcttaagtctccagatgccggccacaagacagaaactaagagaaagtgtgtagtggacgaaggagagcctgatgaagaatcaaaacctgaggtgacaactcactcagatgcacctttgtccgacccttctctgactaatgataatgcagatgcaacagagcaaccagcagggctaacttcaccaaatccatcaaacggaaatgcaacattaggggatgtgaacaacttggtcaggtctcctacatctgcaggtcatgtgggtttagaagatgggcagtccacccccaatgaaatttcttccaatgatgctgaactgcccattaatggcatactccggtcaaactctactaatgcaaaaagtggtactggacaagatgctccagtggaatcaactccagtggccatgtctgtagaccataataaacctggaaagttgtttcctggtagtaaaatgggtctggaggatagtattatttcagttagctcaagtatcaaggagtctcagccatttgcagctggtagatcacatttggagaaggatacaactgaaactttgaaccatcttgcagttgtaacccgtgatttgcaagatttgtccgaggaaagtacaagcaaagaagatgaacctacatcatcatctagtacagatgatatggacatgagcggtgattatatattgcaaagatgcatgtcgagctttgggggctcctccaaggcagcagacacaaaatccactgcattggaaggggagaaatcaacacgaatggcagactttgatgatacagatgcactagaagttgcacgtctggtagctattgaggtggagcgggaagtcattgactacagagaacccttttgtagttctcctgatactaattccaggaatgctgacagtcctgacctggaaggaccacggcagcctgtagccattgccagtgaactgaatgataataaatcttccagtacagaggctaagtcaggaagctcctcatctcataaggaggatggatcaggcatcacagatggcagcggtccgttgagtagaaaacatacacacagtgtcgatctggggaacttagaccttaatgaaaatcagtgtgccgaggaaactgactttaatccgaagtcgatccttagtaattctgtcaatttgtcaatgcctatagctgtggctgcatcaagaggctcatctgtgtttccagctcggctccactttgaaggtggacttgggtggaaaggctctgctgcaaccagcgcctttcgaccagctccacctcggaggactcctgatgcagagaagtcactttcagcttcttcacataaaacaagcaacatattatttgatttaaatgtagctgacaacggcagtgctacttctggtgaaccactttcgacagcaatcctgccagcttcttctgaactaccttccgaggttgcttccaaagcagttgatgtgagcggaggactgaaacttgaccttaatttctcatgtggtgatgaggaagatgctatcactgcaagcaatgtgccgtcattgtggaatcaccaacaatttaatggcaactggagtcagccttctttctcatcttcaaagcaacctgcagccagaaactttgacttgaatgacaacatgtcgatcgctgatgtttctgtgcgaggaatggacgggtcttctgtcaagactccttcaaggccaagggatatgtcggaccattctgccgtcacaattatgggtaagaggatagttgtaggacagagagatgatggacagcaataccagcataactttctgggaccaagtgctgaatcaagagtttttgcaagacccactcaatcttttgcacatactcctgattatagtgttctcagttatccatctcaacctgccatgccttttaccccagcgttctttgccccagggggcagtccatacttggtggatgcaaaaggtgcaccagtcataccaccgctgtcaggtctaagcctcggcatttctcatccatctttcaacaccagagcaacacagccctcatctaatgaactgagttacttccatcctagcgtggatttcagttatggagtgtcatctgaaggcgcacgtagggaagcagggagctactggcccatgtcctaccagggtcagacaatgtttgtggatgaacgcatgaggaatgtatcacaggatggtacttctgggttggtgctgaagcgaaaagagccagagtcaggttgggatttgtacccacgtcgttgagcgtgagcctgaaggtttgttgcagtcgcaatcgattttgtcccactctcttaaaaaggatatgttcaatgctccgtttatggcggcaccttggacattgtattttagggtatttctttggcacgggcccagttctactaggtctgaagacatacacggagaactgaataagagatcagctacaggtagatttgacagatgttgacatggcaaggacattgttagctgctggaaaccacctcgtgtagatctggttctttgtgaatgtattagctttgttttagttgacataatatagccaaattgctctctagggagctaaattatgtaaatcatcatcgtataactcatagatgaaatgcatccctttttatctatctttaaaagaaaaaaaaaaaaaaaaaatgtactgtgatcaactatattgtatatatgtcattgtttgaaaatgcgcataaaaggtttgtactttgttcttttttatttgtcgtggtttagtttaactagcgaatcatgttgcatgcagattgcaggtttagagagtcgactgttagcatgtcggaaccagatgctttatttggatacaaactgtacctgtctgaaattaactataaaaaaagaagaaagtgtgtggctgtgattggcaacatgtgtaaaaaaaagagtgaaccatatatactcctccgtacgcatgttttagtgaggcgtagtatcgtaaagtgtaaaaattccaatttgaaccaactgcacatcagaacaggatcaaggttggcatgccgtatcatcaatcgatgaagctaaacctattcatcaaaccggtgtcatgctacggcgggctgacgctacagtacatgatgagacgactggatggcaaagaagaggaggctggcttctccagtgatggatcagctgcaatatcaaccaccggcctcgtaaagtcgtcctcagagttttcaggtcgtttttcgtctctttggactttgggcaccgtctccatcccacctgcatttgaatgccagactttggatctcaacaccagctgaactcaactgttcaggcgacggtttagtttagtttattatctaatcaaagaatacgagcattatgcatgtactggtgatcttgtgaatacaagcagcagcatttggtcatctgattctttgactcgtactgatgagaagttttttactccactagaaattgaacaaaaagctgccgaaattgaacaacacagaatacaagcagcagcattatgcatgcttacccatcctgcgtctgattcttccttttcttgtggataccattcggcgctggcatctgatgatcttggctggcctcaggatcatctagcaacgcactcctgtccaacacgtttgcatcagctgagctttgcctgagccgctctttcaactcttccagcaacacaacccctgcacagcatgcataagtatttggtcagcaacgcaaaattcacagctgtatgtttttaaaaggctctctcttgcatttgcagcatcgcaaaacaatctcaatctctcttggcgccttgctgcaatagcaggagagaacggcaaatgaatttataagggaacatctatacaacaataaacacagtaagatctaccgagagcccgcagcgcgcggagatggaagacggtgtcggcgaggccaggatggccggcatcggaagcccgcgtgacggccacttccctcaggctcaccagcacatcctgaacaaacaagtataaccatctggttactcgcgatctactggtagcaggttgatcgggaccggagctgctgccatcagagattcagaagagcgatggcgcgtggggtttccttacgagctccggctcggagagggtttcgagccaccgcgcgtctgctgcaccttgccgcagcttgctctccgactctgcctctggactgtcggcggcaggatcagcaggaattgacacgccggcggcggctcgcggtggcgccatcaaaacaagggaagggaaggaaagggtcagagaaaacgagaggggaggcggctggggcccgccctacaaaacaccgggcgggtttaggaaaaagtcgatttaactcccctaattgactcactacacagcttttcttaaagatttcccaaattaataatttctccaacaacactctaaataaactttttaaatttagctacttctactttaacgttattttctctctgcacttgacaatcatttaccaactccttaaacgaaaaaatggttgcatttgtggttaacgaagatgatggttaacatttgtgaattatttttaacgtggatagatttaaaanaaaactacaacctatatttagaaagttatttggagaacttataatttttactccaaagttatttagcaactctgtaaatctgtaatctacagagctaaaatttacatgactattagagttactattacatataaaacaaattattcttttccttaaactattgaaaacaccttgatagcctcctaggttgattctagtagtttagctgacatggtatattttaaagtgttcgtaatcaatgaaatattaaggaataattatatatacctcaattataaaacttgttattgaatatctaataatgttcgaatgatcctcaagcaactagaatatctaactatatatacctcaattataaaacttgttattctatatagtacactcatccacacaatcaaacctgcctcaaagcttgctgcccttgtttgacaattttggagattaaatcttgattcattaaaaagtttcttgcacttggttgcagttgtactgttttttttataataaaggtccaatcgatctagtgtcacaaaatcctttccggatctcttgtttgttgccttattatacttgtcaattagtctaccatca

SEQ ID NO: 3358 - DNA, 845 bp, Zea mays
aggccggccggggaaaaaaatacaaaaaaaaaaaaaaaaaaaaaaaaaaactactactaccaatttcttacacggcttagggcgcaagaggcctctcctgctctacacactgccctagctagccgtttggagggcagcgttggcagctagcagcgacgacagatggagtgcagcggcaaggaggagcagcagatgcagatcgtgtgcgtgcgcagcgcgtcgacgggcggcggcgaggaggtgggggagtgggcggagcagtcgtcgcggtcggcgctgtcgctgttcaaggagaaggaggaggagatcgagcgcaagaaggtggaggtgcgggacaaggtgttctccatgctgggccgggtggaggaggagaccaaacgcctggccttcatccgccaggagctggagctcatggccgaccccacgcgccgggaggtcgacgccatccgcaagcgcatcgacaaggtcaacaggcagctcaagccgctcggcaagacgtgcctcaaaaaggagaaggagtacaagatgtgcctcgaggcctacaacgagaagaacaacgagaaagccacgctggtcaacaggctgttggagctcgtaagcgagagcgagaggctgcggatgaagaagctggaggagctcaacaagacgatagaatccctctattagatctgatctcacggaagaagaggatgacgatggtggtaacgtagtcgtggtatttcggcccataagagaaatcgaactagcaatgactgaagctcaacgtgcaaatttttttttctgcgacgtacttgatgattggatttgtgtatttgtacacgtgatttgcaaaaaaaaaaaaaaaa

SEQ ID NO: 3359 - DNA, 1394 bp, Zea mays
cccacgcgtccggacgagttgaaggacaggaatgaccaacctcatggaacatgggaggaggtgtacagaaatgtgaaaagggtagagaggttaaaaaatgaattgcatgaaagagatgacaaggagcttgagcggacaggtcagccactttgtatatacgagcctttcttcggggaggggacctggccctttctgcaccagagctctctttatcgtggagttggcctgtcttcaaaaggtcgaagaccaggagcagatgatagaccaggagcggacgatattgatgcttcttctcgtcttccacttctcaataatgtttactacagagatattcttggtgaatttggagctttctttgctcttgccaacagaattgacaaaatacataaaaattcttggatagggtttcagtcctggagagctacagcaagaaaggttagctgttctggaggcctttcaaaggatgtatggtgtacatcttgatcgtgacctggattctctgttacatatgcctaatgatggagacacgtggtctgtgatgcaaagttgggttttgcctacacggtctgtcctcgttttgctgttgttctccagaatgtttgttgatgcactggatgcacaaatgtatgacaagcaccatcaaactgggcattgcatcttgagtctccacaaggaccagcactgctactcccgtcttctggagttgattgtgaatgtttgggcattccacagtgcacgacggatggtctatgttaatcctgcaactggtcaaatgcaggagcagcaccatctcagcggcaggagaggtcaaatgtctgtgcagtttttctcctacgccactctgaagagcatggacgaggagcttgcagaagagtttgacttggatcacccagacaggaggtggctctggccacaaactggagaggtcttctggcagggtctctatgagagggagcgtagcatgcggcagcatgagaaggagcggcggaagcagcagagcagagagaagatccagagaatcaagagtagagctcggcaaaagacgttggggaagtatataaagccaccacctgatgatacagttgtctcgaacgatacaacgactgtagatttgtagcattttgaccatactttagggtgataattcttaccgtggaaaattttggttcattctttcattgttacggctaatgtcctcggtcctcactgagtacccccggcaggtgtgaatatttttggtcagttttatcgtgccctctggtgttctgggtgctttacaggcgattttgtaacatatctaggccattaagtttaaatttgggttcccgtagcgtagatgcttttgttcttttcgcttacgagcttctcaataacaggcaacaactgctccgggt

SEQ ID NO: 3360 - DNA, 1402 bp, Zea mays
gtttgtggttaatttatagtgaagctattagaagttgttcctttgacattttcttatttcgtacaggaccggcactgctactctcgtgtcctggagttgattgtgaatgtttggcccctccacagtgcacgacggatggtctatgttaatcctcagactggtgcaatgcaggagcagcaccatctcagtggcaggagaggtcaaatgtcagtgcagtttttctcctacaccactctgaagagcatggacgaggagcttgcagaagagtttgacttggatcatccggacaggaggtggctctggccacaaactggagaggtcttctggcagggtctctatcagagggagcggatcatgcggcagcaggagaaggagcggcggaagcagcagagcagagagaagatccagagaatcaagaatagagctcggcaaaagacgctgggaaagtatataaagccaccgcctgatgatacaggtggctcgaacgatacaacatcagtagatttgtagcattttgaccatgatgattcttaccgtggggaatttggttcattctttgtaacggctgtccttggtcctcactgagaacccccggacgggtgtgaatattttgtcagttttgtcgtgccctctggtgtctgggtgctttacaggcgattttgtaacatatctaggccattgagttgtcaagctgccatcttaggtgtaaatttgggtttccgtagggttgtttttgtccatttcgcttatgagcttctctataacagacagttaacacttaacagctgctccgcatttgcagtctccttggtacaaaatgagtcgactgatggtatcaatctgtcaagatatatttgggtgaacctgtgctaatgcctcttttcggtgttgagaattttgttcaacatcatgtaacaaggaaaacctattatacctttaggatttgtttagcaacaatgtttcttaaaaccatagttttacaatatcgaactgacaattgttacgacaatatcgtagttttggctagctccaaaaatgccatggatacaatattgtaaaccaatgtattaagtaaaaattagctatgtcataaaaaatttggtttggagtgaagtttctaatcttccaaaaatattatgatttaaaaacataatttttaggaatataaccaaatattttatgacataaaatattatgggtattactaaaaactatgatattgttgcttagaaataggtaaaaatactattttgcttctaaccagtccctccactgtttggtatcctacattaacctctccttatggaagtcctcgtgacctcatcgaacattgagggacagttcagtatatgtttgggactatatcctttttagctctgcatacaattttattagtcaaaca

SEQ ID NO: 3361 - DNA, 2631 bp, Zea mays
cggggactgagagtagcgaataacatataaatgctagagagctaagagaggaacgaaataacatataaattttaaaatatataaaaaatacagataaaagggatatggttgaagatagtgccctcaagcctcaacctgcacgagaccattacctagaacatcaattctccctcgttgtcttaccgtgtcgttgttgccgggttttcttggcgagcgacggagccacagaaatggagtgcaatacgggcgcctaattttagcggcggggaggggagcgaagcctgggcagccactcgccggcctccaagaaaccgtcgccattttttcatccgagtgccgccgattttgatttcattattgtctgtcttcgtggggaaccaattcggttttgtttcggaagaagggagaggaggatgcagtgggcgggtctgagatcgcaggcgccggttcccacggcggcgtggacggggccgaggccaagaaccgcgaggtgcccgcagggtagattccccacagcgcgccgggcgctggtggcgtcggcagcggcctcggacgctaattcgagctcgaattcgccggggaaggacgaggagggggaggaggtggtgcgaagggagaaggaggagaaggcggtcgcgtcgcttctgatgagaagccagaagtacgccatgctaaagcagcagctcgccgtggccgcccaatttgaggattacaaggaagcagcgaggttgagggactcgctgaggtccttcgaggagaaggagcctgtgttgtgcctccgccggttgatgaagaaggccattgaggaggagaggtttgaggatgctgctaaatacagagatgaattaaagattttggctccacactccctcctcaaatgttctagtgatgcaactactttggggataagagttcaagtcaggagcgtctatattgaaagccggagccagccattgaaagggcaattcttttttgcttatagaattagaattacgaatagttctcagcgccctgttcagcttctcaaaaggcactggattgttacagatggaaatggaaggacagaaaacatttggggagttggagtagtgggagaacaacctgtcatattcccgaagactggttttgagtactcttctgcatgcccattgagcactccaaatgggagaatggaaggtgactttgagatgaagcacatcgacaaggctggatcatcaacattcaatgttgcaattgcgccattctctctgtcaattcttggtgacgataatgatgttctgctatgaactacactgaggacttgcttgggagcaaatggattgaagggaattaagggggctacaatcccttactattcaattttgaatagtaagggattttagctcacaatccccttctgcaaacaagccctgagatttaaactagacacacaaacacaaatatttattgtaagtgatgtaattgagcgcaaggttcaggtggaactactatggttgacttatggctggagccaagtgccctggtgcaaggtcaggtagagttctctgggatgttgaatctggaccatgcgagtatcaattgtgaggcacaataggacatcctaccaattgtacttctaaatgtacagcatggaacttagagcttgctacatgtattatacagtacctttttatttttcccatcacggtatcaccttagttatcgcggcctttgattatattgtatatcagctcagcaaaatatggtgttttttgttggaactgcaatgtaagatgtttgatatgaccgttggtgcttcaaatggacacagtgacggtgcattgcattgcattttgcactcggcctggtcaccaagtgctactttcgttggcctaatctagataactgggctggactttggtgtgtccatcgctgggatatttgacaaccgagctcccatccgtttttctttacttttttctttctgaccatgatgtgttgggctggcattcagacgaagtgaaggattgtgtttccgcttcagcctattcttctatacggtggtaaagcaaaccaaaacgagcaacggctttctcgttagttgatttatatgttgcttgtttagtttcgatgcagaagatgtcggtaaattgttcaaaaacctcgtacgagaacttgtataaggaacgatctctgtggtgcagcagttcttccataccttattgatccgctagggatacttgtttctttcttgatgattgaaaaactagttttaattggttaatctaccgtgtatcatacctattgagcaccaaaaatgtccagacggatggtcatccgtccctaaggccagacagtccgcggtccggactatccgccgtggaggcgcagactctccgtgcgcgtgcgtagagtcagttagtgttccggatttcttgcgagatttgttagctaaatcagcagaattaactcgagaaccgacttctaatgggtccagacctccccatttatatagtgaaggctacggccaattgaacccccacaatcgatacaataaactctatttatcgtttttaccttatgcattaggagtagatctagtttagcctatctctacctcaaatcttcacctctctttggccctacgtcgac

SEQ ID NO: 3362 - DNA, 1140 bp, Zea mays
aatcttctcggtcgtcttttccaaactgcaagatccaatccccaacaaaccctaacgcctgtgcccatgctcagggcgccgcctctggctaccgtgcctcttggttcggccccggcatctcctcccacgacgcctcctccggtctcctctctcgttccccaggcatttccattcaattattcagccataggatcccctcgtcgccgccgacgccgagctctgtgtcttccctcgtatcggccctatcctaggtaaaacattcagactctgaccctgtcacaaaactgcttgtccgccgccggcggcggctaccactcaccagcaagccatctcttggagggggtccgcttcctccttgactacccatcgacctctccgccctcgtggccttcgcaccggtgccaacagccgcgaaaaaaggtggcgtggatgccgtgctcgtgtcttcctctacgggttcctcaccaggctccctggattcaccaacacgaagatatcaagtgcagaatttacatttgcaccgtggacaccttttcctaccaagaggttcaaattttactgcaaaatcaacgagttcttggtggtgttggtatgacataagatctaatggtggcacgtagaagtggaaagaaactttaatggaagacatgagcttttgccactgtcctctatagggtgttgaacatgccatctgacggtaggggacgacccctcgactttgttgttgccgccaagatacactgactggcctagatctaacatgttaccagtagatgtctgcaaccatgccaggttaaaagccccctttcagagttctatcgtgtggtgtccggccatcttttggtcgaaggggcactaccaatttacgtcgtcttgcccaggacaactccaaggcttagctaatgctatggtaaagttgtgggagaaaagttttattgctaaaattgctttgaagagaggagtatagcttaccaccagtgagaggatgtcgaagatattaaagtaattatagaaagtgtctcctgttagattttgtacagtttgggtagcatatttaaatatttatatcctagttagaactattaattgatcactagcagcaacacattacagatttgaaggcaaaaaaaaaaaaaaaaa

SEQ ID NO: 3363 - DNA, 1149 bp, Zea mays
cattatgtctgttcaaagtgtaatatgttaacataatctttatttacgcttttatgtattgttctttttgatatattatatttgtgacgttaatatatctgtgaaattagatcctgacacacctacattcagttttacccttaaaacgggtgtgacaatattcccaaaacatgcatcaatcccagatttttttttacggaattatgcttcaccggaatcctctagacgcatgtagcggcttggctgcttgggcaagctaagaggcagcttcgtccgttgatggaacatcttgcacacgatatattttcagaactgcgcgcgtttgcgtcccgctttgacgcttcgtagagtagtaattccttacactctaccgagtggtagcccaaatgtcatggacacactcctagaccaggtatccaaagtccaaacaccgtgctcgtgtgggccctgagtgccagcggcatatcctgtgattctcgctccctactcctccaggccggccggccccggcagatctgtgcgtgttcttctcaatccattccagagtccacgctgcagaagccaagggggatggaggtcacaatagcggagaagaagccccgggccgccggcgacggcggcggcctggttgagaggctccccgaggcgctcctggtggaggtgctggcccgtgtcgacgtcgacggcgcctgctccgccgctgcgtcctgccgctcgctctacgctgccgccaacgccgttctccccgccctcacctccatcgacctctccgcctttgccccgtcgaacgccatcctcagcaggattctcgcggggaatggcgcggtccgcagcctcaccgtcaactgcagcctcctcgacgactccgccgcctccgtcatcgccaggggtagcctgcgcgacctctcgctgctcaaatgctccttctcgatgagcttctttgtggctcttggtggggcatgccacgatttaagatcgttgaagctggagatggcggtttgtccatacactctttatccttgcctagcacctgtctacgtgggatgtgttcacttggacacctctttgggcgaagttccctctgcttgatccactccccacttttcccaccccccgggctccattcccctctcttccctatcaacatcc

SEQ ID NO: 3364 - DNA, 885 bp, Zea mays
atcgatccgcacgacgaggagacaagatcacgtaggctcttaaatctatcttctggaggagcaagggcattcaagcagaggtggatcctctttcccaccaagtcaaggtttgtgaattcgggagtgctaaaatattgatcttccacaagagaatgcctccagaagcaatggattggcttctagaaaacgataaagtgccaaacccatgctatagagtataaactaagtaagggcaggcaccggtgccaatgaagctgggatttggtctggtgacattctaggtagatgacgattttattccatagatactgtgagcacaacaattggaagcttaagtcaatttcttgctcataggttgtatttatgcgtcaacagcaacaacagctactatggcagaggctgatgaagttgatgtggttattgatccaaaagatatcgaccttaaaacaacaagatcgggtggagaagggcatcttcagcagttacgaggacgtcgagaagctattgcaggcactgtccaagaaggaggaggaggccgtgcgggtgtgcctggtcaccttctgcgctaacgtccttctcaacttctatgtgaagctcgatcctctagccatcacgtgtaggttgttactcggaatgccagagcgggatatggtgtccttcgtcatgctcgtgcagggctacaacacgcatgctgacatgtatagagcatgatgatgctggcgaacccctggatgagagttaggattctgcgtcaccgctataaacagcaagcgacgcggtgcgcgtcgtctgcatatgtagcctttaactgtccaacttcatggtacatgtgaattcgtaaatatttatatgcaaacgtgtgtgtcgggattgcttggatctgtt

SEQ ID NO: 3365 - DNA, 1661 bp, Zea mays
gtcgacctgcagctcaacagctggtgccatcttgcatgcatggtgccaagaatatgatcaagatgctgcctctgcggctctgcccctctctctctctcagctgctagtggcatcctgacaagtaagcagctggcatcttcttcttagtcaagtcttttcccacgcgtccgttcttttaatcttttttttctggtgacgcgtgacaagcaagcagctggcatcttgaaatcgttatcgcagctatttcattgcgtttgtaattcctactaagacaatagaaaagaatagaaaaagaaacaagtaaataatgtgccctgccgttccccccacccacctcaaccgcagggctgcgacgccgccgtcctgatcgcgtccaagaacaacgacgccgagaaggacgcgccggacaacgagtcgctcgccggcgacggcttcgacaccatcaaccgggtcaaggcggccgtcgagaagaggtgccccggcgtggtgtcctgcgccgacatcatcgcgctcgccgccagagacgtcgtctacctggtaaccgccgtcaccacccccttcatgtctcgagtcagtcagtcagtcccgtcgtcgtccctcgaccagctggtgacgtatcggtattcggtggtgacgaactggcaatgcaggcggatggcccctactggcgcgtcgagctcggccgtctggacgggctcgattccagggccagcgacgtcaaggggaagctgccggacccggacatgcacgtcaaggacctcacgccggtgttccagcggaacggcttcacggaggtggacatggtcgcgctctccggcgcgcacaccgtcggcttcgcgcactgcagccgcttcaccgacaggctctacagctacggcggcgcgcggacggacccgtcgttcaaccccgcctacgcgtaccagctcaagcaggcgtgccccatagacgtcggccccaccatcgccgtcaacatggaccccgtcagccccatcaggttcgacaacgcctactacgccaacctccaggacgggctggggctcttcacctccgaccaggtgctctacgccgacgaggcgaccaggcccatcgtcgacatgttcgccgccagccagaaggacttcttcgatgctttcgtcgccgccatgctcaagctggggaggctaggggtgaagacggggaaggacggagagatcagaagagtctgcactgccttcaaccattagtagaggcctctcctgcgtgcagcagcgtttgtaatccagattatctcaagctcatgctgtttggagttcgatcgagatgcgtatactgagattgatgattgatcatttttctttttcttctttttttgttgcatacacttgccaaagcttgaaggtgttctttctcctctgtttcttcctttttttttccttttcttctttaataacctttttaccttactttttttgggtgcaatttttgtacagactgaagagtgtaataccatgaacaacttgaagatttttaattgaaaaaggttaatctgactaaaaaaacggccaatatactggagactaggttactttggctcgggctcggttttgtctaagtgcaatgctgccacatgatcttatttttaattttcttctgaaataaatgatcatctgcaggcatgcaag

SEQ ID NO: 3366 - DNA, 2695 bp, Zea mays
  misc_feature (1)..(141): n is a, c, g, or t
  misc_feature (274)..(274): n is a, c, g, or t
  misc_feature (280)..(281): n is a, c, g, or t
  misc_feature (289)..(289): n is a, c, g, or t
  misc_feature (293)..(298): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattggcccaatgatttacgccccaagctttggaaattttaaccctcccctttaaagggaacaaaaaagctggaaggcttccccccgcggtggccgggcgcctctttggacttagtgggtttcccccgggntccacnnaatttttncccnnnnnntttttttgcgctcactagtccccccccccccccccccccattccgcgcagttccgcgtgcgaggaacaggaaccgctgctgctctctgcctccgctccgatcctgcttgcgctcgagaaccgcgacgccgacgcccttccttgacgcgttgttgatctgcgagctcagatctgcatattagagaagatttttcgtatattctggtgaacatgaagagaaaggcgcagtcaggaaaatctcgctcatggtggtgggacaatcatattagtccacaaaattctaagtgtctctctaaaaatctagaagaaatggagaagcaggtgaaacaaatgttggggctcattggcgaaggagagttttctgcagaaaaagcggaggtgttctatgagaagcggcctttacttattactcatgtggagaacttctattgcatgtatcgtgctcttgctgcacgatatgacgatgtaactggacaactacgcaaaaacattccatcatctcttcaatcatatggctcggttggtgtctctgaatcagattctgagacacaatgtttcacatctccagagtttgatatgccacagcaaaagcaaaagcctggaccagatttccttgatttttccattggctctggtgttagctctgatgtatcaaagaagggtagtgaaaggtcttcatcatcttcagattctgattcagagcttgatgaggccaaagaggaaaatggtagtattttttatgccttgagccaaaaaaatattgagctagaagatgagcttcaagaagtaaggggaaaacttgatgctttagaggaaaaacatgctcattgccaaagagatttgagtaccaactcaaaagttactgaacatgattctgctttagagagctcaacaaaagtcaacagcgaaaaggaagcattggaagctgtgctgtttgagcggaaaaatgagattgaaatgctgaaaggtgcaatggcctcagctgctaagcagtttgaagttgaattggcacatcgtgatcttgaaattggtaagtgcaagcatgaacttggagtactctcggagaagtatttgcatgataagtctactctcgaggatgagcttagaaggctccatggaataatcaagaatatggaaggtgacttagaaaaaatttcacaggagagattgcagctcaggtctcggattaaagagctcgagcaggcagctcacagcttagactattcagcttccgagatagttgagctacaagaagtaataaggaatacacaagcagaattagaaaaggtcacaaaggagaaagaagtgctcaaagaacacgctaacgaatttgagcaacttttaaagggccttgaggtctcaggtacagaggttgcaaagctaccagaaactatcaagaacctggaagcccagctagaaagatccttcgaagagaaatcagtactccaagaccagatcaagcagctggagcaggttatgtctgaatcttcggagaaacattcacatgagcagttctctcttactgcggatcttttgaagttatctgaagtgaacgcttctcttgaaggcaaattgtccgatgtggcggcagagcttatccaagtttatgctgacaaggaagaagaatctctcgataatgagaagcaaatttctgtcctcagtaaagatattgctgatctcaggagaaagcttgaattgttgtcatctgagaaaaccacagttgatgatgagttggccaaactgctagctgatattatgattcgtgacgaaaagatgaagcaaatggatgaccacctaaatcagcttcagttagagcatgccaagctgatggcagaatttgacaatgcacacaggtccttgtcagagctgcatgcgcaggtttctgagctggaagacgaggtagagaagcagaagcttgtgatatccgagagtgcagagggaaagcgggaggccatcaggcagctgtgcttctccattgaacactaccgcagcgggtatcagcagctgaggcagctgctgcaaggccacaggaggccgttggtgatggcaacctgataaatgaacaaagtccgtttgccaacaaattgcgcagttgcttgtctctgggcgtgttctatttgtagctctgttctttcacaacttgtgccgtgtagtttatgttataaagaattctgtgtggtatgtgtgtagaatgtaatgggatgggatatttatgttgttccttcatactcctatggctgtttttttccttgctgtccgctctggaggggggtgaggtgcttgaacctggtcttttcagtcacgactttatgtggtcaataactgaactgcacaggggaactcccttttcaatctccggggggggcccggaacccaattccccctaaaggggggccat

SEQ ID NO: 3367 - DNA, 2652 bp, Zea mays
gattagtgaaggggctataatgcataggctaactagtctagggttacaaccagtgagcctcatgggctgggctatagatataggcccatagacacaatttagtgtaatacagtctaacataaacaatctgacatgttattctttgccacacagggtggtttatagtgcctgtcttttttattttaatatttattacccactctaggtaggtatgcatggttgttttctgagtgttcttttaaatcgacagaaatggagaagcaggtgaaacaaatgttggggctcattggcgaaggagagttttctgcagaaaaagcggaggtgttctatgagaagcggcctttacttattactcatgtggagaacttctattgcatgtatcgtgctcttgctgcacgatatgacagtgtaactgaacaactgcgcaaaaacattccatcatctcttcaatcatatggctcatttggtgtctctgaatcagattctgagacacaacgttcgtcatctccagagtttgatatgccacggcaaacccgccggcatggaccagatttccttgacatctctgctggctctggtgttggctgtgatgtatcaaagaagggtagtgaaaggtcttcatcattttcagtttctgattcagagcttgatgaggccaaagaggaaaatggaagtattttttatgccctgagccaaaaaattgttgagctagaagatgcgcttcaagaagcaaggaaagaacttgatgctttagaagaaaagcatgcacattgccagaatgatttgagtacgaactcaaaagttgctgaacatgaaaaaactgcatacttcagatgtggaatccgacaaccttaagaaggatccagaagaaacggattctgctttagagagctcaacagaagtcaacagccaaaaggaagcattggaagctgtgctgtttgagcgcaaaaatgaaatcgaaattctgaaaggtgcaatggcctcagctgctaagcaatttgacgttgaattggaacatcgtgatcttgaaattgataagtgcaagcatgaacttggagtactctcagagaagtatttgcatgataagtctactcttgaggatgagcttagaaagctccatggagtcatcaagaatatggaaggtgacctagaaaaaattcacaggagaaaatgcagctcaagtctcggattaaagaacttgagcaggcagctcacagcttagaacgttcaacttccgagatagttaagctacaagaagtaataaggaatacacaagcggaattagaaaaggttacagaggataaaattgtgctcaaagaacgcgctaacgaatttgagcaacttttaagggcccttaaggtctcaggtacagaggttgcaaagctaccagaaactatcaagaacctggaagctcagctagaaagagccttagaagagaaatcaatacttcaagaccagatcaagcaggtggagcaggttatgtctgaatctttggagaaacattcacatgagcagtcctctcttgctgctgaccttttgaagttatctgaagcgaacacttcacttggaggcaaattatcctctgtggcggcagagcttgtgcaagtttatgctgataaggaagaagaatctcttgataatgagaagcaaatttctgtcctcaatcaagatattgccgatctgaggagaaagcttgaattgttatcatctgagaaagccgcagttgattatgagttggccaaactgctagctgatattacgactcgtgacgaaaagatgaagcgaatggatgaccacctaaatcagcttcagtttgagcatgccaagctgatggcagaatttgacaccgcacacaggtccttgtcagagctgtgtgcgcaggtttctgagctggaagaagaggtacagaagcagaagcttgtaatatccgagactgcagagggaaaacgagaggctatcaggcagctgtgcttctccattgaacactaccgcagcgggtatcagcagctgaggcagctgttgcaaggccacaggaggccgttggtgatggcaacctgataaagtgaacaatgctggtttgccaatgaactgcacagttgcttgtctctgggtctgttctgtttttagccttgttctttcacaacatgtgccgtgcagcatggtattaagaattttgtggtatgtgtgtagaatgcaatgggatgggatattcatgtcgttcatttacactcctgtcttttgttcttgttgcctactgttgaatgttatgatatgcttgaaccttcatctttttcagccattcaaaaaaaaaaaaatgtggtcgataactgaactgcacacgagaactatcttttcaatctaagatgtgtttggcacaagcataggtttgactcttctgacttaggactcttgtgtcactgttactgatgcgagggacagaggaaggtaacgggctgcagactaagtttagatcttacctctgctctaaacacaaaggtaagtgttgaagttgactgagtacaattctgattcctgaggctgacctagctgatgcacttgaaggttcaagttttctgaacacaagtttggatatttatggacatctaaagcaacatatagatattttcgttttcatggaaaaaacaggggtac

SEQ ID NO: 3368 - DNA, 2875 bp, Zea mays
  misc_feature (2618)..(2618): n is a, c, g, or t
ctagttatttgtgaagaataaaacagggcaacctactttctaaagaaactttctttatttacggatgcagtgatcttaattctcatgaagatatcgatatgaagtgtgtcttatgggactacatacatgtgaaccgaaacatctcaacgagacctgaatgaatttttaagctcgagctgctgaatactcatcatccatttatctccgtataataataatgataatgatgataataatagtaataataataataataataataataataataataataataataataataataataataataataataataataataataataataataatcataataagatgacttgcggccagccggtggtgaggaagagaaaagacaaactactccacggtcgggccgctaggagctccccaaccaattgttcgtccacgtggcccatccgcattggttgggaggcccgccataccatcacccttttgttttgtctgtatgccacacaaccacaaggagctgtcatccacacgattcgtctctcgaataagtttagtgacgccataacaataagttttttttgattgaacgccagtaatcggacgagatagcatcttggttttctagtgtattactcccctgtcattctaaaaaataactgcatatcttgtatttagattagaggagtcaaataatattttttaaagtttatccaaatataataaatatatcaggtgcacatgacattagatatgggttatatgaaggatgtcctttgcaaaatatatggcaaccacgagacacattagatgatcatcatgttttaatatgtgcagtaaaatgccacgttcacctaacatgttatctaaataatatctaattggtcgtgttatatatatttatagaacagaatttatgtagagagacacgtatataaacatcttgaggacggatatgcatttatttttagaacgtacttacggattagacatagtatataccaaggcgatgttttccattcatcatgcatgcattctggatccaggatccagaattccaggcacatgctgcgggtcttggacgacctttgtgtggctggctttacttttgtttccattgaagcgcgcggtcgtgtcgtcatgggcagattatccggccggccgagcagcttcctcgcgagcctgcctgcacgttaatcaatcctgtggcctggcctggcctatatatacacaccatactagcatgcgtaatatatatgcgttataacagcagagcagaggtcaacaagacgagacaagagaatgcctgtgagcaggatcgccgtgggtgctccgggcgagctgtcccaccccgacaccgccaaggccgccgtcgccgagttcatctccatgctcatcttcgtcttcgccggctcaggatcgggcatggccttcagtgagtaccttaattttatttccattcattgcattgttaatacgtacgtacgtaccaataaccatcatcatcaccaggtaagctcacggacggcggcgccaccactcccgccggcctcatcgccgcgtctctggcgcacgccctcgccctcttcgtggccgtctccgtgggtgccaacatctccggcggccacgtgaaccctgccgtgaccttcggcgcctttgtgggcggcaacatcagcctcctcaaggccctggtctactgggtggcccagctcctgggctccgtcgtcgcctgcctcctcctcaagatcgccacgggcggcgcggccattggcgccttctcgctgtcggcgggcgtcggcgccatgaacgccgtggtgctggagatggtcatgaccttcggcctcgtgtacacggtgtacgccacggccgtggaccccaagaagggcgacctcggcgtcatcgcgcccatcgccatcggcttcatcgtcggcgccaacatcctggcggggggcgccttcgacggcgcctccatgaaccccgccgtctccttcggcccggccgtcgtcaccggcgtctgggagaaccactgggtgtactgggtcggcccactcgcgggcgcggccatcgcggcgctcgtctacgacatcatcttcatcgggcagcgcccacaccagcagctgccaaccacggcagcagactactgatgaccatcatcatcatgcactgaataattaagaccagaccactcaatatatatacatatgaagaataacatgccaaatctcatctcctagagctagcaacttgattctccatatatttcttaaatacaaactaaactcgattgagtatagcttggtatgaaaccacatgtgtgtgatgttattttgtccttgtggtaatttgtacatctctatctctatcatattaaagcatcaatttcgacaaaaaaaaaagcggccgtcgtcttacctcataattttacaaataactctttaacgtcattgtcacgtgctatgaaatgttaacaaacctccgcgattcccactccagctaacaacttccgcaccaatggtatgcagtatgttgcgtttgcaggcattttatttgctctcgacttcgaaagtctatctcaaaaccgcggttggttggtgccagtctacaatcgatgcggccgagattagtgntctataccctaccttgacaaatctagatttagtagatccagatcatttcataatcttgttatataatatatttattatttttggtaaatccaaagcggatgaaactagggcagaaaccataaccaaaaatcctgtaaccgaagccttagaaccgcattgtttccaaaaaacgatgtattaaagcatcgacagtatagtgcgtgataatttttcacgaaacattctcaaattttatcataggctctatatatgatatc

SEQ ID NO: 3369 - DNA, 1217 bp, Zea mays
ccggccgagcagcttcctcgcgagcctgcctgcacgttaatcaatcctgtggcctggcctggcctatatatacacaccaggcgggccggcgtaatatacatgcgttataacagcagagcagaggtcaacaagacgagacaagagaatgcctgtgagcaggatcgccgtgggtgctccgggcgagctgtcccaccccgacaccgccaaggccgccgtcgccgagttcatctccacgctcatcttcgtcttcgccggctcaggatcggggatggccttcagtaagctcacggacggtggcgccgccactcctgccggcctcatcgccgcgtctctggcgcacgccctcgccctcttcgtggccgtctccgtgggtgccaacatctccggcggccacgtgaaccctgccgtgaccttcggcgcctttgtgggcggcaacatcagcctcctcaaggccctggtctactgggtggcccagctcctgggctccgtcgtcgcctgcctcctcctcaagatcgccacgggcggcgcggcccttggcgccttctcgctgtcggcgggcgtcggcgccatgaacgccgtggtgctggagatggtcatgaccttcggcctcgtgtacacggtgtacgccacggccgtggaccccaagaagggcgacctcggcgtcatcgcgcccatcgccatcggcttcatcgtcggcgccaacatcctggcggggggcgccttcgacggcgcctccatgaaccccgccgtctccttcggcccggccgtcgtcaccggcgtctgggagaaccactgggtgtactgggtcggcccactcgcgggcgcggccatcgcggcgctcgtctacgacatcatcttcatcgggcagcgcccacaccagcagctgccaaccacggcagcagactactgatgaccatcatcatcatgcactgaataattaagaccagaccactcaatatatatacatatgaagaataacatgccaaatctcatctcctagagctagcaacttgattctccatatatttcttaaatacaaactaaactcgattgagtatagcttggtatgaaaccacatgtgtgtgatgttattttgtccttgtggtaatttgtacatctctatctctaccatattaaagcatcaatttcgacaaaagaaaaaaaaaaaaagcagaaaaaaaagtcgtcttccctcataattttacaaaggggcggcc

SEQ ID NO: 3370 - DNA, 6254 bp, Zea mays
  misc_feature (651)..(651): n is a, c, g, or t
ttttatttccctcattatgatttctgtttgtattgggacgcgtgattgtcacttccatttactccgtattaattgttctaatacacaaaattgttgaactaggtttgtcgcatgtgctcgccagttggctaaggcactggaagtgccattggtaaatgatttaggatacacaaaaagatatgttcgctgcctccaggtactgactgtttcatgagtccttttgattcagttaataacatgccaaacttccttgcaatttgtgtccacaactgcacatgattgcattgtacatagccatgtagatttatcgatcaatttcattttcttttatgccactcttattgaatttatcaccctaactaatcttttcttttgtctaaacattgataatcagattgcagaggtggttaattgtatgaaagatttgatcgatcatagcaggcagactgggtctggtccaataggtgcagtattacttaccttttatcctgttcttgtggcttaatgtattgttgcttcaaaacataatttgttcaataaggtgaaaggagattttttgggtaccagttcaccccaattcggactacaagtctgtaacttcaagtacagggtcaatgttaatttctcatttgtcaagtgcagaagtgctanatgttttattaggcattttgtctgttttaccattgattttgaacatcctacttgcatgttcttctactgtctatgaccctatcacattggaacagttctatttctgtgttttgcaacccatatatttctgcagtgtcgtgtacgatttgggatgtgtgatgttccaacacataattaggataactaaaaaaatggaaactttctatcggttaatgttcatcacatctttgttttttatatagcttccaaatatttgtatcttagtttatgcatgcttttgtctggatgaaaagctaatgaaatatattattgaacatacaacacatagttattgggtatgagttggcatgcattatatagtatcattattgataagttgtttgatatttttaatttggcaagcctggtatcaatcattttcttctgcttgttttgaacatacacaatcatgttcttttttctccagagagcttacataaattccctaggagagggaattctggggttagttctgttcaagcccagcagcaatctgaggagcagaagcctgttccacagaattctaaccagagtggtcaaaattctgctcccgcaactggaatgcaagtctctgcctctggaaatggcgatgctacatcaaacaattcactcaattttgcaccatctacttcggcaccatcttcatctgttgttggtctccttcaaggctcagtaaattgcagacaagaccatccaacaagcagcggcaatggtctgtataatggtggaaacagtggtccggttgctaaggccaactcaacaaactccatgcaatcaaatgcaccagcatcgtttcctttgccagcaccctcggcatcaaatggcaatatgatgcctgctcctcagcactcaagccaaatgaattcaccaaccatgtcatcaaacctacctcctatgcaaacacctgcaagccgacctcaggaacccgagccaattgagtctcaaagctcggtccagaggatattgcaagacttgatgatgcaatcccatattaatggtgttggcccagttggcagcgatatgaggagagcaaacacaattactcctggtatgaacggtgtcaactccttagttggtaaccccatgacaaataaccctggaatcaatgggatgggatttgcggccatgggtggccttggtcaacaaatgagaacggcgatggggaacaacgcattggcaatgaatggaaggaccgtgatgaatcacagtgcgcatgacctgacacagttggcccaccagcagcaacagcgcgatttaggaaaccaattgcttgggggccttagagctgcaaacagcttcaataaccttcaatacgactggaagcctgctcagtagagtgagcaggagtcagaaagctcgcacctaatattatacagttatccttgctgggtcggtccatcactgacaacacaaaagttacgcctcaccacaacctgccctccctcagaagcggagtgttcttactgatggtgcatgctacatgttacagcgaatatgaaacatgagcgctgatcggtacatgttacatcaactgtctgtatggctgtctcccattgtgttctgcaaaagtgaggccccgtgaatcagagcctactttcacatgggactcattgtgggtgcaagtgttggcggattccaaactggggcaagatcagggcgtctttctttcccctgtttttccaggttggatgacaacgatttctctcttgcagtctgtactcttgtgtaccatggctctccgtaagttgtgaaagcatgagcacctatttccacctttgatggccaagaatctcattgtagctttgctgtaccatgtataagctgttattaactagtggaaagcagcaggaaaaaaattctgaagggagtgtgaatcttggtgtgtcatctgtgtacctgtgtttctgataaatgctctcgtttaagcaggttgatctttcacaaaaaaaaaaaaaaaaactcgtttcatttgttggattaaaaatgggttggtagtccggctgtgagtttacgttagtatgtgtcactcgtgagtatttgtattgtgacgggctggtgatgttcagctctggagagtatctgtgtcacaagtctttgttcggtagccagaaggctggatgtgagcagtggctgaagttagcaacgagttgggcaataaataatagtaggagcagtggcaatatgaaactagacccgtttgtttctgattataatctgtgtagattatataatccattgtaaataatcaagatgacaaacaatcaagcagattatgagtagattatacaatttgaagcctagattatgataatcattttatctctcctcaaaaggagcttattagagattcttctatcctccttcacgaacgcacttcttcctccatccgcccgtcgcacttctcccataacctacctacccaccgctactgtatctccatggatgaccatgacgccgacgacaaccagtcgaagcggacactccatcgccggtctcgatctggacaatggcgtggagcactgtccgtcggggcgcaacctcggcacggcgagcgcaggatgtggcattgccactgcaggtcgccccgtgggggccccgcgccatggctcacgtgtgctctagctgctcgataaaatgatcacaagaatgaatgttgtttcaacactagcagactacgccggcgttgccacagcacactacgccgttgatgctgcccaggcaggtccatgtgatgcaagggcaaggctatgacggagcagtagcagagggctggctgcctgaaccgaatgaacgcattacgcatcatcgtcatatcatatatccatccatatatatgcaagggcaaggctagagatacatggtgtttatgcgcgagctgggcacatgtatcatcgatcccagtatcccatgcatgcagatgcagctcgggggcacatcacgagacatgggctgcctctctcgcgcgctcatgagctactaccgatgtacttgtcgatgagggtggtgagcgtggacttggggacggcgccgatgacgctctccttcttctcgccgcccttgaagatgagcacggtggggatgctgcggatgccgtaggtggacgccacgttggggctgtcgtccgtgttcaccttgcagcacatgatcttgccggcgtagtccttggccagctcgtcgatcaccggcgcgatcatccggcacggcccgcaccacggcgcccagaactccaccagcaccggcgtctcgcacgccatcaccatcccgtcccagttcttctcgtccgccaccagcactgcccacggagccaccagcgacgcgacgcgggcgaggctcatcgtcagtttatttatatatatattcgcaggcaccgaaacttactcctatataatattaccttcgtccacggcgttcttggactggcagacgtgccgcgcccggcgcgtggcgacgcggccgacggacagcggcgcggccgcgacccgcttcgacggcagcaccaggttaccgccgctgctgcagacgaggagcctgtccttgctgccagcaggggcggcgtgcagcgcccacgctctgaagcacgtctccagggccattaattcttgtctggcgtggtggtctcactcacctcacgcgcgcgtccacggcgagaacgaatgtggtgagtaggtgagcgcgaacggccggcgtaggcggcggggataggatttgtttcccggacatcatggatatttgggagcaggctggggtggcattgtgaggtgggcagggcctgcggctctgcatgtggatgaggtgttttttttccagctcctgcgttgccacccacataagcttccttttcttctggcatcgtttatgtgcgcgcgctgctgtctgccctgggccgcctcacgcctctaattcagctaacgtggtaagaagatgaaaacttttcctttttatgtttaaaaataatcgaaatttcaaatgtatatccagatttcgaaaaaaatacatttatgtatacctacagcatgaggtaaaacaatctaagcaactaaataaatattaacaattattttatatacatatatgtgaattacaatataaaccgacttgaaaggaataggtagattttaacataacgagtcacgagacacacaaaatcagacagagctccattacccctccatggactcttctctgtattgaaaatgacacaaatgagattctagagggatagaaatgattatatagcggggacctgacacttagccacagagcggcaggtccccagccgctcacccaccgagcgacaagctccctgccgcactgccattgagcgacaggagccctagcgctcgggtaaggtgcaacaagaactgctcaataaaaaaacaaaacaatacaggtctatactgctccccactgacgcgacaagtacccataattgtaattttttaagttgagatataaaatagaaatttcatttatttttaaatataaaaaggaaaagttacataaaagatcttggagaacattataaaacttcagtatctcatcccctcagcactagccattagatgggataaaacatagatgcatactatggaattaggagaaatcgtcatagatggtgtatacttcagcggtcggtggaggcgcataaatgtgaccacatgctcagcccctccatgaggcatttcctgggtgtgtagtacacaaccaccaaggagcggtgttcacgctaacacttgcaagacaaaacatgatggaggcacaaaaatgcaaccacatgctcagctcctccgctggacatttcctaagtgtgcggtctacaaccaccaaggagtggtcttcgcgctaacacttgcaagtcaaaacaaaaaacgtgaaaaaggtaagaaatgaaaaaaccaacaaaacgaagtggccttacccgcaacactagccatctctaacagtacatcaggacccaaattcaaatgttagtccatgtcatagtcttctacagacacctccctagctcgcgaaacatcttgaggctttaggacctcaacattgtgccctcgccctccttcgcaaggcagtggacgttgtactgttcggggggtgaagtccctctctgtgttgcaggtgacttgttgatccctctagactacgatttgctcaagtgtcctagggattttcatgcatacatgccatgtatggctgcctcaaacttgttgattgcaccctgtccaaggatggagttttatgggtaggccatgtccactatgtcaaatgttatgtgtttggtcctcacattgggggtgactctgaacaaaactgatagtgttatttttgtaatggacagggtggcctcttcactaaaaccacaaagtgggttgttggccttttgaagctgattagggttgatggccatgtgtttgaaggcatacatgaaaattatgttttcttggctactgatgtcaacgaggactttgtgcccgtcccaattgctgatgttgtggttgatgaccatggtgtctgtatgcgaggcacttcacaaattgacatcccttattcaaaggttatgaagatgg

SEQ ID NO: 3371 - DNA, 3327 bp, Zea mays
ctccgcccttcccttcccttcctccgctcgctcgcttccgcttcctcctcctcctgctcgccgcggctcgcgagggaagttccaggcttccagcggagtcgtcctcgcgggagtgcggagccccggcacggcccggcggcgccacctcggcgccggaggagggacgtttgcgctgctcccgagggccgaggcccggatcgccggattcctccacgggctcgctcggatcgaggaggcgcggaggtgggctcggttggtgggtttttcgccggccgtaattcttgtggtggcttccttgctttcggagacgcggggctggggagctcccgtgcttgcttctggctaatccgcgcttccttgcgtcgccctgctcggtgctgctactcgcttgggttcgctggattacaggacgaaaggtgacgaggaggtgcgctgacgcttttgctcggctccggttttggctgccggcggagtcgcaatctcggctagatttgccgagctgcggcgggggccccatcccggctagatttgccgcgctgcggcggatgcttcgacgcgcaccggatctccaccgttcctgcggcgcggagtgaaggtacggttcccgaccggattttgggaagatggtgccgtcggggcagcacaacccgatgggcccgggccagcaggtgggcgcgtcgctgctccggactagctccagcctccttggcggcggcgccggcgccggcgccggtggccagccggggatggggatgggcgtcggggtgctcccgtcgcagtcgcccttctcgtccctcgtctcgccgcgcacgcagtatggcggtgttggcggcgggaacggcttgctggcgggcgcgtccagtgtcgcgtccatgctcagcagacagcagtcctatgggaatgggggaactggggtaatgccgggcagcggcgctgggctcccgatcggtgggctgcagcacagaggcggccttgatggcgttggtgacttggttggcactggagggccggattccatggcgttctcttcctcgggccctggtagcttgggcaatcaacttggcgtggacagcttgcagcagcagcagcagctggatgcaccacaagattcacaaaatcagcaagagcatcaacagcaaatgtcaatgacatataatcagcagcatatgatgtcacaaactcagcagcagcagcagcctgcagtgaagttggagaatggaggcgtccttggtggggtcaaactggagcagcagatggggcagcctgatcagagtgtttccgcacagatgctgcgcagttcgagtggtggtgtgaagctcgagccacagttgcaagcgttgaggagcttgggtgctatcaagatggagcaccaaagctcagacccatctgttttactacagcagcagcaacatatgttgcagctgtctaagcagaacccccaggctgcagctactcagttgagcctcctacaacaacagcagcgtttcttacaactgcagcagcagcaacaacagcagcagattctcaagaacctgcctttgcagagaaaccaattgcagcagcagcaacaacagcaacaacaacaacagcaacagcagttgcttcgtcaacaaagtctaaatatgagaaccggtaaatcagctgcttatgaaccaggaacctgtgcaaagaggttgacacattacatgtatcaccagcaaaacaggccacaggtaaacatttgtcacaaacaactattgtcatcatttcaacctaggcggatgctcattattaaagatatggtattaggacaataacatcgagtactggagaaactttgtcaatgaatactttgccccaagtgccaagaagaggtggtgcgtttctctgtatggcaatggccgtcaaactaccggagttttccctcaggtttatcttttgtcgacttgaatataggctggtagttcaattttagtgacctggttgtttgttatgattactagcaatcatacagtcttttgtttacatgcgatatattttttgagaatgccccaatttggctttttggttctttaacatgtatacaatgctatgttatgttttaggatgtttggcattgtgagatatgcaataggaagccagggcgaggttttggtgggtataattgtcttttaaatatatcctagtagatattttatgtttccatgcgattatgcattattactattcgatgtcatcttaccttttatagaaacaacggttgaggtcttgccacggttgtgccaaatcaaatatgccagtggtacactcgaggagcttctgtatgttgatatgccgagagagtcccagaattcatctggacagattgttttggactataccaaagcaatccaggagagtgtctttgagcaactgcgtgtagtccgtgaggggcatctaagaattgtattcaaccaagacttgaagattgcatcgtgggagttctgtgcccggcgtcacgaggaacttattcctcggagatcaatcataccacaggtcagtcaacttggtgctgtagtgcagaagtaccagtcttctgttcaaagttcagcatcactatcaagtcaggacttgcaaaacaattgtaactcgtttgtcgcatgtgctcgccagttggctaaggcactggaagtgccattggtaaatgatttaggatacacaaaaagatatgttcgctgcctccagattgcagaggtggttaattgtatgaaagatttgatcgatcatagcaggcagactgggtctggtccaatagagagcttacataaattccctaggagagggaattctggggttagttccgttcaagcccagcagcaatctgaggagcagaagcctgttccacagaattctaaccagagtggtcaaaattctgctcccgcaactggaatgcaagtctctgcctctggaaatggcgatgctacatcaaacaattcactcaattttgcaccatctacttcggcaccatcttcatctgttgttggtctccttcaaggctcagtaaattgcagacaagaccatccaacaagcagcggcaatggtctgtataatggtggaaacagtggtccggttgctaaggccaactcaacaaactccatgcaatcaaatgcaccagcatcgtttcctttgccagcaccctcggcatcaaatggcaatatgatgcctgctcctcagcactcaagccaaatgaattcaccaaccatgtcatcaaacctacctcctatgcaaacacctgcaagccgacctcaggaacccgagccaattgagtctcaaagctcggtccagaggatattgccagacttgatgatg

SEQ ID NO: 3372 - DNA, 797 bp, Zea mays
cgcattggcaatgaatggaaggaccgtgatgaatcacagtgcgcatgacctgacacagttggcccaccagcaagcaacagcgcgatttaggaaaccaattgcttgggggccttagagctgcaaacagctttcaataaccttcaaatacgactggaagcctgctcagtagagtgagcaggagtcagaaagctcgcacctaatatttatacagttatccttgctgggtcggtccatcactgacaacacaaaagttacgcctcaccacaacctgccctccctcagaagcggagtgttcttactgatggtgcatgctacatgttacagcgaatatatgaaacatgagcgctgatcggtacatgttacatcaactgtctgtatggctgtctcccattgtgttctgcaaaagtgaggccccgtgaatcagagcctatggactcattgtgggcaagtgttggcggattccaatctggggcaagatcagggcgtctttctttcccctgtttttccaggttggatgacaacgatttctctcttgcagtctgtactcttgtgtaccatggctctccgtaagttgtgaaagcatgagcacctatttccaacctttgatggccaagaatctcattgtagctttgctgtaccatgtataagctgttattaactagtggaaagcagcaggaaaaaaattctgaagggagtgaatcttggtgtgtcatctgtgtacctgtgtttctgataaatgctctcgtttaagcaggttgatattacaaaaaaccgagagtgcggcgggcccgggtacc

SEQ ID NO: 3373 - DNA, 2079 bp, Zea mays
  misc_feature (27)..(27): n is a, c, g, or t
ttgggtacacctcggacttggccgggncacacacacacacaccaaaaacagattcgtccttgcagctcgccgctcataccatgtctaatatttaccatcgtatcgtatccatggtgctgcaccaattcaacgctcctccttattataggtcagcttagtagtcggtggtgactcgatcggcgagatgggcatggtcgcttccatgtgcacggagcccatcaagcggcaccgggtggagagagacctcgacggcaaggtggcggacgcgctccgggagcggacgaggtcccggcagaggaccttcaggtcggtgaacagcatcaccatgcgcctgcccaggttcaaggaagggctcagggacgtcaagaacatcttcgaccagtacgacgaggattcagatggcacgatcgacagcgaagagctgcagagcttcggaagcagagtccgggtgcacatgtccgaggaggagatgagcaacctgcaccggtactgcgacatcgacagcaggaagggcgtccagttccaggagttcgtcgtgctcctctgcctcgcgtacctgctcttcgggccagacgtcacacgacgcgtttcggagttcgagtccggcaagctcaactacgtgttcgacgagctcatcgacgcgtacatcttcttcgacaaggacggggacggcatgctgcggaggagagacgtcacccgcaggatgaacgaggcgtcgcaccaggagaggacacccagccacataacagcacagctattcaaggagatggatctgaacaggaacgggaaggtgaacctcaaggagttcctctactccatgatcagatgggctggtctcggaaccgaagacgatgacagcgatgaggcctcaccatgatgtaacttttttttcttttcttttggtctgcattttaacagttgaataagtaaaatgtatgttgacaattgaaagtaaaaataaaaaaatcatgaagaaaatcgaaggtccaaaaaaaaaaaaaaaaacctcgttatttcgttaaccaaaccaaccaacattatgtaataatcgatggcactctgatttagcacatctatcagatggtgactagaatctttatagacgtagcaattggaaggtatcaaaataaactttaaatgtttctggtagaagctatcctatatcgcatctagcggatgaacgaatagtataacaaacgaaaataaagcatcacaaataatcataaaacgagatattatagctctttagagctagtttggtaaccacattttcccaacgaaaattagtgggaaaatagaaatcccatggaaaaatacagtctccaaactaatccttactatgattatcttcgtcactgttgggggccttcggctccgaaggtcctcaaaaacagaatttaacagtgtttctggagtataatgtgtgaacaggtatctttagacccgaatcggtaccacagtgggagaagctcaaagaatacgaaggttgatacaccgccgaaggagtgagcaggaaagcttcggcgtgactgcagaaaaggaaaccgacttaaagatgaaaaggctatttaaacctcggtggattactatagaactactaccaaatgtaaagggcatggatgtaattttatatgggttgtgtcccgtgcctataaataggtgaacagtacccccgtactgttcacgctgacttggcatttgctttttgcgtcacgcttgtacttttacttccttccaagccgaaggttcatctgtaacttgatgtcgtttcgattcttctataataagaatgcagaaatgaattgaagactacatgtaattgtttatgtttcccttcgtattctgtatttcgtatgatccctccttctttcgttattatatgttgtgtttatgaaggtacgtccttcataaccttcgtccgaaaatcattatttccctcaggatataatggtcttcagacgaaggttgtgaaggacataccttcatcagtgcagcgtatgataatgaaaagagaatcatatgaaatgtaaagacacatgaataattatatatcactatcaactcatttctattttatta

SEQ ID NO: 3374 - DNA, 5001 bp, Zea mays
agactacgccaagcccgcaattaaccctcactaaagggaacaaaagctggagctccaccgcggtggcggccgctctagaactagtggatcccccgggctgcaggaattcgcacgagaccattacctagaacatcctaatcgaaaagaaattacgtatttggccccgcgccgcacgccctcttctcgtgctccagcggattcgctaggccgcgagcctccaaaaccctaaccctaaatttgggggcgcttgggtcaaagagacggggggaggaatcgagccggcggcttgcggcggcatcagcgatggcggcgaagcgggagatctcgagcaccctcaggaacctcaagtttatgcagcgcggcgcggctgcgcagaaggccgaggagaaggccgaggtggaggtacaggaggaggcggtggtgatggcgccgagtggaggcttcgcctcgtccgcgcaggtcgttaggaagtgcatagttatcatggagggtaatcctcatccaggagctataaagggtcggatgtctttccaaaatttcaatccatctatcgataaactaaatgaagaggcaagaggtgaccagcaaacagaatcagcttcccccagtaactgtgaccaagacaatgcaaactccagcagagggaatgaagttccagcatcaagatgtagagattttggcattcccagttcagaaagcatatctctaaatgaactgaagaggaaggagcccgaccttgatatggaaacaccggcatcttacaaggaaccaaaaaccaatgttggcggtaggtcatcttcacaaagcaatggtcgcggatcacacaagtccaacaagcgtgaaaagctcgacttcaatcatctaagaccgaagaaatgaaaaatggtgttcgagttagctcttgtactctgtttgtagctgtacccaattggccatctgctgtgttttgtcgattatatctagagagctggtaaccatgtccatgtgaccatgtggcatgcattcttagtgagattatgtggtgttaatcatttttctttctattgatgtgttctactcaactactctgctgtaagatgtgaggctctactgtacagcagtgatgaatgcagttctgcttatgttttatgtcgcctactaagcatgtggtcaaaattgagctacggcatgatcgttcattttgcactaccttgcctcgttttttcatgctgccactcgttactcatgctgttctctaatgcattaggccatctctaatctagcagaccgtgtgcaagcactgtggattatattgtttagtctttgtgcgcgtttggtttgtcttttgtctcttaaaagccaatccaaagggctaaaatctagaagcagttttttctaaaagccgatgtaaaattaaaagcacatttagacttacttttagcggtttttagatgaaggcacatttagtggattttagcggttttcaccctgtagtttttagctttttacatctcacatcccacaaccgttttttcacatctaacagtctacaacaacttttttagagccacatccaaccaaacaaaaccttagattatttttagtggattctctatctttatcttttatttcaaactacgcttttgaagtctaatctacattttgcacgctcatttagacagtttactggagatggctttacggacgcctgttgaggtgaaaccttgtttacatgtatatattccacttccacatgtgattcgtccatatagaaatctacgctcgaaactttgggtttctaaattttggatctacaaacacgatggcccaactgtgcgacccatgtttcaaattgcaatgttttccccagaactactagtatttgatttctttcccctgtttcaagttgcagcctcgcccctctcgctctcgcggctctcggcggatcggcgttcagtgaaagctaaaagcctaaaaccctagttcgaacctctactagccggcgacagcggcggtggagcgcgggatacccggagatgccagcgccgtctgcggttgcgtcggccgtagagaggctacaggcagcggcgcaggacgccgccaagtcctcgtcgcgctcggccggcgccttctccgagcaggcgcagcaggccctcgtgtccaggaccgccgggtaagccgtatccgctgacaccgacctccatcttctctcgattcgatgcatccgcggtcgcaggctttatgcttgctctgttgtttgccctgatttggtatggccacgcggaatttgcagcgtgcttcttccgatccccatttatgatttgaattgtgcttcggatgatcttattactgtacttcatggattcagctcacttccagccagtttgcccttacgtttacacgagcagtaccaggtagtatcgtgcgatatgagtaattcatggtttggtaggcaatgtactccatttataacatccacagatgaaaaccgtaaccgaaaatcccgtaatcagggcctcataaccgtatcgtttctgtaaacacaatatcatttccgaaaatcactatatttaaaatttaaatttcaaatatctgtcaacatttattgtaatcgacaataagttgattaattatgaaaccgagtaaatttacgaccgaccgacaatcattttcgtataaacgatatcgtttccgactgtttcaatccctattaacttcatgtttatagtcgcttaaattatatcaagggcatgtggtcaatggttaagatgttttccccagaacccttatgtaaccaaattcccaaaagagaagcataagaaatcccttttcagtgaacccttcagttgctgtcaagttaagctcaaagtggtagcttgatgtattgaattttataggtttaagaatttcaaaggactattttgcctgaataaatcaattcttacacttttcttaagtcaaaaaatttaaagcttgtctgaatttatagaaaggagtgtcaagatttatggcactacattagcattattggattggatgcaccatgaactatattttcactttttcagaatatgctcatttggtgtcacaaatatttgtagctttttttataaactcggtcaaaaatgaaaaagttcgactggcaactttaggtattattcatttatcgaggcaagattggaaatgaaggtagtagttacttgaggttaaacttttaagtggcagccaatcagtaaagccgttgtatcaaggtttttatgagttctaaatcctggaatatttgaccagtgttcaactttgtctccgatttcagttgaagcaaacagtgtttatccttgaactgcaaatgtgtaacaaaatatggagaccacgccaatgtcgctctatggctatcaatgttaggaaacctgagctcagcgtcagctatacattattcataatgtacatggactatgtgagcagaatcagccgcctgcaaaaatgtggttagcctgaaggaaccagtagtgcagtgttttttgtattaactgttgctgtacttcaaacctgtcatgagaagtgctgctatgtttctcctgatgttaatttattctgcattgcagacgggttgtttctctgtcaacatgtgcaaaggtcagtgccattagctttgcgattggtgttgtggcagggttcacactcaagaaaaggctgcgcagatgggctgctagactgctgaagagaattaaggacgacgactattgactaatgcgatcttttcctcattgtctttggagtttgttcagaaatcagaactatggctactacgtacctcagcatcttgtgtagccaactgtttttgtgcctccacatatttgctatgaatgctggtatatgataatatgaaccatcagaagttcatcacgaaaaaaaaaaaaaaaatgtgcaaatggtgatacaatgtcgccaacgacagtatgatcgtgccatgctctctggtgtccttcgtcatcaaactttgtcgagagtatgatctttcccagtgttgacatgcttcttgactgagtttcactggtgagctgctttactatttacagtacaatgtccttaccttgcgacgtcacatgaagctgaacatgcgagagtccagtggtataatggatcctccccagaaaaaacaaaattaaagtggacctctaaaaaataatttaaaattaaagtggacatatagtctatattttgtagatactgtgttttatctatcttaatcaaaaggccaaaaaattatgagttttgaaaagaaggtctactttttttatagctaactgtacattttatcttatccaaaagattagggtcagaagaaatgctcatgtctcgtttgattttttcagctcggatggggcttgtttgattttttcacgatccaagctaacatcctaccttagtcattaacgagtcagctcgtaagctaaacaagttaccatattttagcaaaacgaaactatatgcatatcatttacgtaataattgatgaacatattatttatatgtgtggcgtctatgggctatgagttaaactaatgattgatccattatgtctatgtgttaaattggtctatataaatataactataggttaaaccgattaacatgtgtgtgaattgtaaattaatgagtaatgagttgtgttaatttggtgttacgttaatgtggtctatgaaactataattataattattatttctattgttaaattagtttaaaattaactagaaattaattattatatatattgttttttcctgctctggctcacgacctaaacgagccaagttgagccgactctatgactcgttaacttaacgagccaagccgagccagctcgaactcgaaagagccaatgtatctccatatccagctctataaaagaccaagaaaaatatgcgttgaaaagaaaatctacctttttatatctaacttggacgctcgtcctcctttatctagcaaagtgttgaacttgtatgattttcacggcccaaa

SEQ ID NO: 3375 - DNA, 738 bp, Zea mays
agtatttgatttctttcccctgtttcaagttgcagcctcgcccctctcgctctcgcggctctcggcggatcggcgttcagtgaaagctaaaagcctaaaaccctagttcgaacctctactagccggcgacagcggcggtggagcgcgggatacccggagatgccagcgccgtctgcggttgcgtcggccgtagagaggctacaggcagcggcgcaggacgccgccaagtcctcgtcgcgctcggccggcgccttctccgagcaggcgcagcaggccctcgtgtccaggaccgccggacgggttgtttctctgtcaacatgtgcaaaggtcagtgccattagctttgcgattggtgttgtggcagggttcacactcaagaaaaggctgcgcagatgggctgctagactgctgaagagaattaaggacgacgactattgactaatgcgatcttttcctcattgtctttggagtttgttcagaaatcagaactatggctactacgtacctcagcatcttgtgtagccaactgtttttgtgcctccacatatttgctatgaatgctggtatatgataatatgaaccatcagaagttcatcacattacagaatcaaaaaatgtgcaaggggcggcccaatgtcgccaacgacagtatgatcgtgccatgctctctggtgtccttcgtcatcaaactttgtcgagagtaggatctttcccaaaaaaaaaaaaaaaaaagtggtc

SEQ ID NO: 3376 - DNA, 1742 bp, Zea mays
tgaccgagattttttttaatgagcatggtctctatttacctaatcttgctctaagagcatctccaacattgcttcaaattagtgcctcaaattgaaaaatgaggctttacataggaaaaactattctaacagtgcatcatttcataaaatttggtcaaaaaactataggacaccctctcgagtgccttaaatatactacaccgtagtgggctgccctgcaatctagatttgtggttttactgttggagtgtggtgttttatttatacactaaattctataaaatatagatatttttaaatttaggatatttttataggttaggagatgctctaagatatttatgatagcaagccggccgggccgggaactttatccgttccaagtatctcccctcttgcgcctcctctcgactcttccgtttagtgcccaccgaaatctttctaccacccacgttccggcatccatggctcgtctgttcgcggcgcgagcccttacgctggcccgcccctcggcggcgccatccgccctccgcttctgcccctcccgcgcgctgtcggacaaggtggacttcatcgagatcgacctctccgaggagtccccttcctcttcatccggaggaggaggcgcgggcgaccccgccacggttcaggcgcagatggggtcgcggcgcctggaggacgccatccatggggtgctcgtgcggcgggcggcgcctgaatggctccccttcgtgccgggggcatcctactgggtcccgccgttgccgcgggcgctcggggtggcggagcttctcagctcggctatgcacatcacgaggggcgccgaggcgatgacggaggaggaggcattgagcttcactaccgtgcgggggtggccatccgcggcgtactttgtggcaggctcctactgttgagccagctgggcactgggattgtgaaatgatgatgtgtagggctgcatagttatgatttctcactgaatcataggaagttcggtattcttgtggtggggtggggaggagttgtgtccgaaattctttgctcttttacctttacattacatggctagctatgcattgtttgtattgagttgatacgtaagttagaaacatactgacttcagggacacgttggaggtataattggttcgttttaatttgagtggatggtcatcggtgtttcacaaatgggacctgtccaatgcaagtgttgttccagacatttttgttccatgttattagtttttaccattttgaaatgtgatgtaataagtctagaacttattggtacattatttgtgcggttgaagttgaaatgtttcaaaacgtaagttgatttaaaggagtatgttttctgccttaactcacctgacagtgaaacctgtgtttgttgataacctaatgtgagtctaaacaatgcctgtactcaaagcaatgtgcctttgggcagtctagccgctagctctagcccttgtaactatggagtttggagggttatgtgctccataacagtttcttagaattttgagatattattttgtaaatgatgactcccaggctcccagccatgtgagatagcacagttaagctcggtatacatgtgaagatgaattgtcatgaacgtaggtggcatataagtttgtcaaaatagtgatcctaaatggcatcggaactcaaatggtaggattgcaaatcgtaggatcataactaatagaattgcaaaatcatatatttaccaaatag

SEQ ID NO: 3377 - DNA, 972 bp, Zea mays
ccggccgggaagatatttatgatagcaaaattgaagtgcaaggaactttatccgttccaagtatctccccggttccgcctgcccgcgactcttccgtttagtgcccaccgaaatctttctaccacccacgttccggcatccatggctcgtctgttcgcggcgcgagcccttacgctggcccgcccctcggcggcgccatccgccctccgcttctgcccctcccgcgcgctgtcggacaaggtggacttcatcgagatcgacctctccgaggagtccccttcctcttcatccggaggaggaggcgcgggcgaccccgccacggttcaggcgcagatggggtcgcggcgcctggaggacgccatccatggggtgctcgtgcggcgggcggcgcctgaatggctccccttcgtgccgggggcatcctactgggtcccgccgttgccgcgggcgctcggggtggcggagcttctcagctcggctatgcacatcacgaggggcgccgaggcgatgacggaggaggaggcattgagcttcactaccgtgcgggggtggccatccgcggcgtactttgtggcaggctcctactgaagaggcagctggggacagtgaaggtcttctgatgggttgtagttataacttatagtaatagacagctagggagcccctgcaacaatggatcccctcaagctgtcaagcatcttcggatggtgtgctcacagctggtaaaatgacactggttcaatcttatgtatttgcagaacccggtgcgctagcacctggacatggtgggtgtatggtccacggaacccagccgtggcgcataatgtaatagagtttgtagtttgtactttgtaccatattttccctcttgaataaaggcatgtgttacgctgaaaaaaaaaaaaaaaagacagctcttcttggtgtgtaaaaaataaaaaaaaaaaaaaaagcggcctcgagctcagcttt

SEQ ID NO: 3378 - DNA, 3328 bp, Zea mays
gtttcatacaacatgtacaggtatatgcatataggttcaagaaagaaaaacttcatgtccaaaaggaaggagaatgaattctccgcaaaatcataaaaaacattacaagtttatatcatgtttatgtgcacttcataacctttatgaacaatattttgctaactaaaaaggattgtacatatgactaatacttttgtcaacacattgtttcagaaactcactgcaaactactattcttattattttatggccttcaacaccaacattttattgcttacgtgcatgtacataccagctcctataggcaacaccaacgtaatacgacatcctgactgctcatactattatatttgtaaactaaactatcctgctaatgttatatgaacaaatatatattcagaataaatctgtcacttctatgatgaacttttggaacacactgctgaaatacaatgtaatatatatggtcctctcagtctaccgtaggtttgctgtaactactacaattacaatctcagcacatcaacttctgtaagcactggaaccagtttaaatttgcccttaaatttatggcagcatatggtacataataactgctaacaactactctaagtgtacatataattttaatacataaccccaacgaaactgatcgtaaaaatggttcaggttcaccatgcgcgcatggcgcgcaccatacactagtaaaagtgaaacatgatgcaaagggacaaatggaataacacataagaacttatcttattgctttaacattttcagtatgtttcttattgtattggacaaatttataagcataccttcggctcctgaataatgggatgcacgaagattctttgaaggctaagcactacgaagtcgggacccttccaaagatactttttgtagggtaatgttcatctatttataggggagacgaactgactttgtacatatttacagtaatgcccatccatttttacataagccatttacaaatgacattagggtagtaatgtacttcctcctttctcagctccgcaaattccaaccctcgtcgtccggtagccttccttttggacttgtggcccaagttgccgccttcagccattattttcgttgcttgcgtatagacgaaatgcctttgtacactgcttttagccaaagcttagctttgtccgtcagtgagaatattcctgaaacacacttgtgattttgaaaatggttgcttatgattttcgttgcttgtgattttgctcttcgtttttcgactttatgattttacccttctgttttgaaaaccaaattaccgtttgcctcaccctctcaacgccattagtgaaaatcagatttggtgattaaaaaaataaaaaatgtgaaaacaatggatgaaaggtccaaactgccctccttatattatatatgggtgttacctaacaagagtaaaatcacaattacataatataacaaagggcaaaatcacaatacatgtatagacatttttgtcttttttatatcagatttaacaccattaactacatgaaacgacgcaggggtatgccaaagcctcgtttccaaaaccaagggttaaaattacaaagttaaaaaacaaggttaaattacgattgcaaggctagagaggttatactaaatgcctctatagtttacgtggctgacctctaacataaaaatgatttagttctgctaagagtttaaaaataatttagaaagcctaaaatatataaaaaacggttgatttgaaatagtaaaattgaacgatgatcgcgagcgttgatttagatctagtcatccgcgccgccggccccggtcaagtcctccccctacctctaccagctgcccgtcgcacacaaaaccccaggctgcccgccgccgccgcgacccgccacgccgccatgtccgctgccgcggcgctccggccgatcgagccacttcccctcccgaccgggctctccctctcgccgcgcctcaagcttctgctcaccttctttcgcgccgacctcaccgtccggcccctggacgagtggcagctcaagtccgccctcctcgcgtttctccgcgacccacctctccccctcccgctcctccccgactcagacctctccgtgagccgcctccctgacctccagaagcgccgtcgcgaggagcccgtagcctctggggtcctccacgtccgcgacctctccttcctccgcccccgcaagggagacggcgaggccgaggagatgaccggggagcaggagaagtacttcgagtggcggagcaccctggttcagaagctcgaaggcatcgagctcaacctcgagggagtgaagttccggatgaccgtcgagatcccatcgtctgacgacttcagaacgatgaagaagtcatgggaggatttctactcctccgagctactcaatagcaggaatcctgtgagaaagatagctaaaaggccagacacaattgttgtccgtggcgtgccttccaggtggtttgcagagacaagagtatcatccaaaccttccacgctggtcacccacactgttttctcagcgcttggtaaaataaggaacctaaatatttccaatgatgatgagatagaagcaaaaggacatggagtcaacaaggggctcatatctggacttaattgcaaagttcaggtgcaatttgagagctacaatgacttccaggatgcaatgaaggcattatgtggacgttctttagagaaggaaggatcacggttgaaagtagactatgacgtgacctgggactgtgaaggtttctttcgcatttctcaatatgagccagttcgtaacaatttagaggagagggattcattagcatcggttaatagccagaggaaacatcacacttcacgaattgaatcagattataggaagagattcagggagtgatgacataagcccatggtatgagcgagatttctttgtcctctggagagggaaaacagctgcattgtaccatcgtatcgtttcattctcagatttcaagttatatttctcatttgttcacaattaaccgaacagaaaaacccattctgatacttactaatctgtatttattattagtatcggttttatcctcgatgatacccagaggccagagagcgccacaaaaaaaaaaaaaaaattttattccaaagaattcttagatgttgagcattggcgcctggacccatgctcatcgatcagtcacagtggcgtctgagttcagacttcagagtaatgaatgatttcagaaatgagcatagggacgggtcagcctacacgtgccgagctttgacgatatatcggttacagccgtgcag

SEQ ID NO: 3379 - DNA, 2826 bp, Zea mays
gatcgattcggcacgacgcgaaagcggtcccaaaatactcccatcaaacaggcagtttcgattgggcgaagcgcgtggaaaatccaccgcgccaggaaatcccagagcggcgtcggatcgtggcctcgtgcagcggcatccgcagcaggaataatgaatcgtcatgatccacgttgccgagcccgcagacaggaacgggggtgtaagccgatccgcgagaagaatccaacctacaagacctacaaggccaagcgacatcccaatccgagcgtttcatctcgccctctgctctgccccctcacaccttctcgccaggctcagtggtgacatcagctgaggtccggtagtttgcctctgcagccatgcctcaaatccagaacaccatgcggcaaaactgcacactcctagctgttctttgtggggagtttgctgagaagcggcagacaccagcttccctggcgccagacacaaagcggctgcggctgtcataccctttccctgagctcgcttcgtctgggagactggaggtgcacacgctaatcaatcccactttggagcaatttagagaggcacagcaggcggtgcatcctgtcttcttgtatcttcaggggcagcagcaagagaatgaggaggagattggcacgcttgtctggggtgatacagatttatctgacccgcagatgtttgtctcactcatcaccccaccatttccgaccatggtttatttagaggttcccactggggaaaagcttgcccagtcacttcattcaaaggggataccatatgtggtatattggaggaatctattttcatcttatacagcatctcattttcgtcatgcgttaatgtcagtcattcagagttcctgcagccatacatgggatgcatttcaacttgcacatgcctccttccgactatactgtgtaagaaataatcatgtacaaagtgttaagcttggcccctgcctacttggggatgctccaaaaacagatgtcatccctgctggggatgaagtgaatgaggaacaaggttgttctgaaggttttccagatataagaatatatgatgaagatgtgagcatgaaatttcttctctgtggagtaccatgcaccctggatgcatgtttgttgggggcactagaagatggtttgaatgcgctcttgaatatcgagattcgtgcgagtaaacttcagaaccgagccagtgctcatccacctcttcaagctgaagatcttccacatggagttgttacaatgcgctgcgatatcacaacttgcagttctgcacatgtgtcgtttcttgtttcatgcagtgcccaaacttgttttgatgatcagcttctagggagccgtatcaagaatgaaattattgagaagaggcagttagttcgtgctctattgaataatgaggataacaagccatcttcatatgagcctttgccttccatgtgcgtggcttgcggagcttctacttttgaagtctggataaccatgccaaaatgggcagcacaggttttgaaacatcttgcgccagaaatctcctacagaagcttggttgcacttggaattgcttgggtaaatggtacaccagtgtcctcatttgataggcaggatgcagaccggcttcttttcttttgctctaaccagtgcggagatcaagctattcaaaatggctcatatgctcatgtatccagctggtcagcaccccttaccaaggatagaaccactggaagtctcgagtcaaaacagatgtcatttggtgcaaaaggagttgtaggggataatacgatctccctatcatcattgaaaccaaggctaaagcctgcaacaatgagaccccttcctcactctcgcaagcaacaaatgcatccctttatggggtttcctcagtccatcattcacgatgctagtcaagttaagcctagcttgccagcccctcctgtgaagcacaacgcagtacctgttaccgcagtgacaccgagaaaatcatcatctgggtcaccatcatcctggtcacgtgttcagctaccaatcccattgaatcctctgccaataaagaaacatgagtgcaatcggttgcctatccacatttgctctgaagaagacttcttgaaagatgtcatgcagtttctacttcagaggggccacatccgacttgtacctcagggaggactggcagaatttcctgacgcagtgttaaattcaaagcgtcttgatttatataacttatacaaagaggtggtataccgaggtggcttttatgtaggcaatggcataaattggaaaggtcaaatcttttcaaagatgcacaaccatacagttacaaacaaaatgacgggtgttgggaacaccctaaaaaggcattatgagacgtacttgcttgaatatgaacttgcacatgacgatattgatggggaatgttgcttgatttgccacagtggtgctctgggtgactgggtgaactgtggattatgtggagaatgggccccccttggctgcgatagacggaaagagctaggcactttcaaggactactcgaaggcagatgggatggaatacatatgtccccagtgtagccttgcgaaatacaagccgccgttgcctgcaccatgaaatatgttgattaacttctgttactttcttaagggtgatggtttggatagaaattagtggctaaggatgtgtagtgttgacctgtactattgaatatgatcctgtacgatttgtacattttttttataaaatttctgatttccgaaaaaaaaaaaaaaaaaaaaaaaaaaaacaaaaaaaaaaaaaaaaaaaaaaaaggaaaaaaaaaaaaaaa

SEQ ID NO: 3380 - DNA, 1780 bp, Zea mays
gcgcgcgggcggacgcgtgggcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgcggcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttgggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagctcgtcgtctagccatgcgtgcaacgatggatgcgccggcgaaagcgggggagggacagggcaaggtcgtgcgctgcacttgcgtgacagctccaccggatggaatgcgaatatgcgataaagctcgtgatgccgctgttgctctccgtgcaactggcgcaagtggaagaagctgtctctgtgtgtaatcaagtgtcttgtctgcggacgaattttcggtatgtgcgtcgttgtcactgctcgggattgtgctgctgctgataagttcggaaaactgtacacccacgtagggagagagacgatccgtgatcaagaacagcccgctttgttctttctctgataaaaaaaatatccagcggccaaacaggcgcgcaagtcaacagaacagcgacctgagctcgtgacacgagatcgagatcgaaatcgcccccactgaaaccagaactgcagagccgagcggtaatccaacgctgacgacgtaacaggaaaggttggtttgcttttgctcagggacacacccacagctccaacattgggtttgtgaggtaaaataaaatggaagggcttaccggtacccctttttaggcttttactagtttaaaatgcaagtggcgcgatgcccggatgggggcatggcgcaagggtccccatggtgcttttggggtggtggcgccggacacgaaagggagaacaccccgcaacccagcgatgaaaggcccccccccccccccctctttattggtagccaacgataaaaatttgatgccccgtgcttacccgcaatttaccccattgtatttgaaataagcatatgccccgccccattgatccc

SEQ ID NO: 3381 - DNA, 2686 bp, Zea mays
tgcatgcctgcagcctgcgtagctttgttcagatcttcgtaaagtccatgggataagtagctgatcacgctttcaagctccgctgttgtcgtctttaattttctttctcctcatggtctgggcccccacaaaagctagctgtggttgtctctatcctctcgtgcccagcccccgggccgggtccgtgcagccacgagacggtctagaagcaatgcaccacatgacttccacgccatttcttcctgcgacggcaaacctcagggccaccgcattgatgaatacagatcccacagctcttgtcgcggctccggctgtcgattccgcccgcccgcccgctcttctagctgtcagggatgatttccaacggaacaaaatgcctctctcgtctaaaaaaaacacacgagggaaatgcaggtcaggatcgaagaaattttttcgtgataataatcatcgccaccagaggccatggaaaaacgtagagtattccttctaccttcttctccgtcacgggatcgccgtgtgaactgaccagatcgagaagccgaggcggaccagggcaggtctggtcaggcgatggaccatctagaaaagcaccgggcggtggcagggcacgggccaacagcgccgcggcacgcacgcacgaggcacgatcccgagtgccaccacgccacgacgggacgggacgagatgagcccacccgcgctccacctcccgctgacgccgacctcatcgctgacgccaccacactctgctaatcccattcccatccatccaccttaaccaacggtcaggggcggaaagcgagcggccctcccccgcaaactactggactaagatcacaatcagggctaagcattagcgtcgcctaactgggccgcgacccctgcttattttaatgaacaagcccattccgtcacgtggctggctccaggttgggaaagttcaacgaacccgcctccgcctcgagaccccgacctagaacatcctaatcgaaaagccgttcaactcgatcacttctttcccttccacacaggcacacaggcacacagcacacagctcactcaactcccctcccgcttcgtcagctcaccatcataaaccaaacagagagctctctccctctcggtcgttccattccaggatgctgcttaacccggcgtccatgctggacaccatccggcagcacctcctggaggagccaccagcggcggccgacgagagcttcgggatcctggtggcggaccagtggagcgactcgctcccgttccgcaccgacgacgccgacgacatggtggtgttcggggcgctgcaggacgccttcgcctacggctggctacccgacggctccttcgcgcacgtgaagcccgagccggtgcggtcccccgactcctcctactactcctacgacggctcctgcttcggcggcctcccgtacccggagcagccactgacgcccggcagcgagggcgaggcggccgccacgcccagccccaggagggaggaggccgcggcggccgtggccaggggcaagcactacaggggcgtcaggcagcgcccgtggggcaagttcgcggcggagatcagggacccggccaagaacggcgcgcgcgtctggctcggcacctacgacaccgccgaggacgccgcgctcgcctacgaccgcgccgcctaccgcatgcgcggctcgcgcgcgctcctcaacttcccgctccgcatcgcctccgagatcgccgccgcggccgccggcgacaagcggccgttggcgttgcccgagcccgccacctcctcggactcgtcctccaccggcggctcgcccaagaggcggaagcgaggcgaagccgccgccgccaacatggccatggcgctggtgcccccgccttcccagcttagccggccggcccagccatggttccctgccgccgcgccggtcgagcaggcggcgatgccgccgcgcgtggagcagctcgtcatctagctagccccgcgcgttaaaccggactcgcggcgagacaatgaggcgtgcaagtgcaacgacgggtgagccggcggaaggcggaggaaaacaggacgaggcccttgcgcgaatgcgacggcgcgcggaatgcgataagctcgggagcaattgggggtccggatgccgctgttgctccgtgcaactcgcgcaagtggaaagaagctgtctgtgtgtagattcatccaagtgtcttgtctgcaaacggattttcggtatatgcgtccttgtcacctgtcagggtggtgtggtgtgagggcttgggcttgtgctgctgataagtttggagatctgtacaaagaaaaaacgtaaggagaagatgagaccaaaaaaaaaaaaaaaaaatagtagaaaagaaccacaaatgggagcgccgtggtctgataaatatcctgcggctaaaccaggcgcgcaagtcaacagaacagcgacctcaactcatggcatggaatcgaaatcgaaatcaccaccctgaaaccaaaactgcggaggcgaagcgagcactaaaacaaacgctgctctgctgacgtggcaggaaggtggcttgctcacggcagcagtatcgagacgagaggtgggtaccacagctccaacgttggatttggactgagccgattgagtatgtaacgaaacgatatcatcgtttggctttaatctatatcgagattttgtctt

SEQ ID NO: 3382 - DNA, 3811 bp, Zea mays
  misc_feature (150)..(150): n is a, c, g, or t
agctgatgtatgtatcccccggagtcgtggtctgtagaaaaccacgtgctacgctgttaaacaattcgcggacagcagcatgtctgcgcaagcaaaggctatgctggcaaaagcacgtcgagcaagacccctgaaatcttcagtcctcanttctcccgcccctgcagtatcggtcgtaacagttactgatacactacacagcatcgggatactactcccaacatgcggcgtgcgtgcctacctgccgtggatatcaggatgggtggatcagatcatccgccttttggacgaccacgctactccatccaaagaagcaggcacgctgccggctgtagcgtgcttcgttcagattttcagaaagtccaggagaaagtagctgttcatgcttttgaagccctactgttctcggtctttctccgcacaaaaagctctggccgtctctatcctctcgtgctcgggtgcaaccacaaggtggtctagaagcaatgcaccacatgagtacatgacttccacgccatttcttcctgcggcggcaaaccgaacctcagggcctactaccgcattgagtactccaacaaggtgactccccacgtattaaaatactacattatttaaagtgtttaggacactaaaaataaattgtgctataataattaaaccataaaccatatactattttaggaagtaattacattatttgaaaaagaatgataagaacgatatagaaaacaatgacatagcactagtctattgtatagtatatttatgtcgttttatggtgtgccttatgatttttaataaaaaatatagaataggttactgttggacccacttttttttaagtcaaggcactgatttaagacactgttgggagatgctccaaccgaaaacacgggagaaatgcaagccagaggttcatgcctcatggcttggtgccaccgagattatctaccaaaagtcagcttcctgactcgaagaggccctttttataatacatataatcaccgatatccatgagaaaaaaggcatagcttgccttccattttgtttctaaaatgcataaaccggagaataaaacccctttccttattcatcacgggatcgtcgtgtgaataaaacccgagacgccgaggcggatatccacccggcagacatagcaccgagggctggtttgatcgcgtctgttttaaaggcttcctagttaaatttaaatagagaaggatttaactcctttcaaccccttgaaaccagacgcaacttgagcggtggcacaccggcacgcacggggcaacagctcccgcggcacgcacgcgcgagatacgatcctgatccctgcgtgccagtgccactgccaccacgggacggaatgagcccggccacgatccacctcccgctgacgccgacctcatcgctgacgccacgccaccggactgctaatccaccgggcggggaaagcgaccggaatccttcaaactagtcgactactagattattacaatcagtgctggcattagcgtcgccgcgaccccctgcttattttaattttttgtacgtaccggcaaaaacgccattccgtcacgtggctccaggttaggaaagttcaacgaaccgcgacgccggtgtgaaccggcctccgcctatataattccccggcccaaccatcgccgttcaattccattccacacacacccgtctcagctcactccctcctcctccagtttcgtcagctcatcatcatcataaaccgaacacagagctctcgattccattccaggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagatcgtcgtctagtctagccatgcgccggcgaaagcgggggcaaggccctgcgctgcacttgcgtgacagctccaccggatggaatgcgaatatgcgataaagctcgggatgccgctgttgctccttgcaactggcgcaagtggaagaagctgtctctgtgtgtaatcaagtgtcttgtctgcggacgaattttcggtatgtgcgtcgtggcaaaaaaaaaaaaaaaaaatgctgctgataagttcggaaaactgtacaaagacgtagggagagagacgatgcgtgatcaagaacagcccgctttgttctttctctgataaaaaaaatatccagcggccaaacaggcgcgcaagtcaacagaacagcgacctgagctcgtgacacgagatcgagatcgaaatcgcccccactgaaaccagaactgcagagccgagcggtaatccaacgctgacgacgtagcaggaaaggttggcttgctcttgctcacggacacacccacagctccaacattgggtttgtgaggtaaaataaaatggaagggcttaaccgtatgcctttttaggcttttactagtttaaaatgcaagtggcgcgatggccggatggcggcatggcgccagcgtcgccatcgtgcttttgcggtggtggtgccggagacgaaagggagaagacgccgcaagccagcgatgaaaggagcctaagccccctcgtctttactcgtagccaacgataaaaatctgatgccccgtgcttatccgcaatttataccattgtatctgaaataagcatatgccccgtgccattgattccagacattttccagcacagcgttgtcgtgtcgcgcaacagctggacttgggacacggaccgagggagtagtatatgagattttctttcctttttcccaacctgttgggtgttctgctgttctatcgatcacagtggcacccgattgagcacaggtcattgggccaaagcagggcagtgtttcatgaaaagcagggcgctttcatgaatggtagctttattagcagaaagggaaaaaaaaggtacacaaaggagaagagagagagagagagatcacaaaggcacgctatcgctggtctccgtgctttcgttctgagccggacaattacctagctacccaggtgtgcagacagatcagatgtattgatccctccgtttttaattaaaaattatttatcatgaagtctgattattcagcatcatattaaa

SEQ ID NO: 3383 - DNA, 1405 bp, Zea mays
gttcaattcgatcacttcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccaccacctcctcggactcctcctcgtcttcggccagcggctcgcacaagaggcggaagcgaggcgaggccgcggctgccaacatggccatggcgctggtgccctcgccctcccagcttaaccggccggcccagccgtggttccctgccgcgccggtcgagcaggcggcgatggctccgcgcgtggagcagatcgtcgtctagtctagccatgcgccggcgaaagcgggggcaaggccctgcgctgcacttgcgtgacagctccaccggatggaatgcgaatatgcgataaagctcgggagcaactggggtccgtccggatgccgctgttgctccgtgcaactggcgcaagtggaagaagctgtctattggaagtcaaattgagccgcgcggacagtccggcgctgaggccggacggtccgcggtccggacagtctgcggtggtggcgcggacggtccgcgcgcgcgcagagtcagttagggttcctagtttctcgcgggatttgttacctaaaaccgcgggattaactcgggaaacagttggaaacggatccagacctccccctttatatagatgaaggtctacggccgattgaaccccaacaatcgaacaaatcaagtctatttctcgttttttaaaaaaaaaaaaaaaa

SEQ ID NO: 3384 - DNA, 3768 bp, Zea mays
aaaatagttttagtgtttaatgatagtttccggccgttttcacccctactatccggaccgggtcgtgtctgggccgtgcttttttgtgtcgtggctgggctgtcccacgtgttagtgtcaattactcatctatagagagtggtttgatacaaagtcgtttttcaagaaagatcgctagagacgggggcattcaattttttgccactttaatgtagcagccgtttaatttgtgtcatttacaccatattcactgattcaaatagtgggaaatagttaacttttaactagagatgttgtgaaactaggaaaacccggcgcccactgcaggccggcccgcccgcggccacgctctggttagagataagatgtcctcttgtcgcagcaagtgatttggctcttgccatggaggtgccgctctccccaccgcgtgcccacgccggcctcctctgctgcagctccactcccgtcgtcctcggcctccgctcccagtccgccaccgctccgagccgccgcgcgcggccactccttgcccgcaggaaccgggacagccggagcgacgaggagaccgcggcggagcccaagatcatcacggtcgggcggccggggaagagcgggcggcggcgcaacaggaagcagcagcagcagcagcagcagacggcggcgaaggaagaagaagaagaagaagaggaggaagatgaggacgaggaggaggagcgtgacgcgacgatcccggaggtggtgacgaaccggatgatgcggcgggtgggcgcgtcggtggggcttccgctggcgctgggcgtggggttgttcccggtgttctactacctgaaggcggtggcgaaggtggacgtgccgacgtggatccccttcggcgtgtcgttcgtcttcttcggcgcggcgctggccggggtgagctacggcatcctgtccgcgagctgggaccccgcccgggagggctccctgctcggctggaacgaggcgcgccccccctggcccgtcttctgggactcgctccggggacgctcccagtccccacctcgccggggctaggagtagagtagggcagggacagacaggaccgccccagtgtgatgactgacatgacactcttgtgcgtttgtctcggaaaaacttgggctcttgcattggtgctgctgtgtaaatccacgtcgatcgctcgctcgcttgtgttggggttggggacgggggttcaatgagaatttgcatctcttgtttggttcagtaagagggatggaatggattcactgcggtgctcattcggttattcaggaaccatctctggtacgatttcatctaatatcctgttgggttattttctaatacacatacacatgaattagatgatattaaaaaaattaataaaaagtttaatttgtttgagatttaaactcatccatccaatcatctaagatcttttatgttttgcttctcggctatcttcatcggaactaaaaagtacttttagttggcactcttctctgtatcgctcatcgtgtgtgtcttctactgttctacagttcgactttcaccgtcttttcgatggaacccctctatttctgcgagaaaattgatagaatagggatgaagtattgtctcgatcgaaatctatcaagtctacacaatcccagtttgcaaaaaaaaaaaaaaatcataaatccggacgcggaacgccagccaatctttgatgggtcatggtaatcccagttcatccagtttggaagctaagataacgaaagagattggagagactaaaatatcattattatttaaaattgaataaggagattttcagctcattatattccctctgattttgtggagaaactagtctcggtcccatgaagagggagcgagaagccccgattgtgactgtgtgtaggcattaacagttggattgcgtgtctcctcctaccgcgatgcaaaaacaggagcctacagctgggtcattttcagcgtgaactcgtcggcggtgccggcgccggtgcggtggcgcccgttgcgcgcggggggaccagtcgcgctcgcgggcccccttcttattaacgcacgctggtacggtggcctaactaacggccttgcggctgttttggggttggactggctagcgtagcgtctggcccatattaacattaccacagcaggcccaaagtgtgtaagccatcgactcgacgtccaaagcatgctgttttgggacctcgaaacaaatagtatgctgtgtatttttgccatccgatttcacaaaccgttctccttgcctgtcattccgcaggaatcaaaaggaccatatttttaaattagtttccatctcttcgttctgaatcgatccgtgctccgttatgtttgccctggagaggtttagtttgtgtcggccggtcaaattgcacagagagagagagtgcaccggagggagcggcgcaggcatgtgcggactgcggagcaacgatagtttgcagggcccggccccaatccaatgggcaaatctcagatccggccggttgaagtaaaaaaaaaaaaaccgagatgttgcgtgcgcagatccagatccgtacgcgcgcggcgcctccctggcaattagtacaagctagtgtgacgatattaatagttaatgggggggtatatgtgtagtatacgctattagttaaatacccctagtacgttttaattaagaagacggagtgtgttggtgtgtgtgtgtgtgtgtgttgcttgcttgaagaggaagagagcccaggagggcgacgccgggctgggctgcaagcagaggtctctccggacgcatggaagttggaaaccaaccacaaagcgttcacctgccctgcgggacgaaggcaggtgccgtgcggtgcgccagagccgattggacaccacggtcaccgcagtgcttggcaattggtgcccccgatccactaccgaccaccacaaagcttttgttctcctccactgcacggtgcggtacgcttttgtttgcgggttttcgtaggtggtgttggaagtcaaattgagcagcgcggacagtccggcgctgaggccggatcgtccgcggtcccggacggtccgcgcgcgcgcagagtcagttagggttcctagtttctcgcgggatttgttacctaaaaccgcgggattaactcgggaaatcagttggaagcggatccagacctccccctttatatagatgaagggctacggccgattaaaacccccaacaatcgaacaaatcaagtctattactcgtttttaccttatgcattaggagtagttctagtctagttctagtttagccctagtttagtattccaatcctcaaattctccgcctctcctcgactctacgtcgattagaggagtctaggtcggcctgcccgagcctagacaactcctaggatctctcctccccgacggggtccctcccgggagcgagatccaggcgccgtcggcgatctaccgccgccccggcgcacgcgcggaccgtccggccctagggcgcggaccgtccggccgtcaggcagggaacccgagctcctgcaccaggtcgcggaccgtccggccctgtgccgcggaccgtccgcgtctgaccagagagcgccgccgcctcgcaccaggccgcggaccgtccggcccctgcgcgcggaccgtccgcccctgtgcagagggcaccgccgccggttcttcttgagtgattggcgctccgaaaaagcgtcaacactgctattgcatagcttgacaaattgttagacacaaaatatacatt

SEQ ID NO: 3385 - DNA, 3236 bp, Zea mays
  misc_feature (2197)..(2197): n is a, c, g, or t
ttaaataaacatctcatttaaacaaggtataccaactaattgggtgtacaatttaatttttaattttttatgtgaaagttttactttcattttaaatttattttttaagaatggtcggaaaaaggggacacaaagtttaacgtggaaaaaactctcctaacatggaggagaaaaaaacacgggaaaacagatctattatgtgacgtatcgtacagggtacacggagacatatttatataggcaaagcagacagagatatgatcacataatcttatccaatagacatcattaaatatgattggtgtgtcatcaaagtcactagtattgtagtacctacgttcttaaatattagtcacgttcatttttgaactgagtaccagtgtgcacaaagttactcccttatctttcttccctccggctaggttctattttattgcttagcatccccgtttggatcctccgggctgacccggggaagcgccgaagcgggagacgggcgggctgacgtgcgaaaccaggcaggcagggacgcggacccttcgtcgactcgtcgtccatccctcctcctcccttccaccggccccggcaacgaccggtcgctcggtctccgtcgtcgtcttcttccgttccttccgccccctctgcaacgcacaacttggactcgtactcctctgctccaccgtagacgcgcctagctagctcatgccatatataggcgcccccgacctcgaggcgggcgggacacgaggctgaacgcttgaacctgaacctccaaagcagcaaccccagcagctttagctcctcctcatcgcagccgcagcgccgtcccctactcttcctgcgaccaactgctgtctctccggcgacggcagaaccgtctctgcaggtgcagggagggacccgggagatgagtctggggctgctcaacacagagcgcaaccaccttctctccccaaagccgcagagcccgcgggatgccgccgtgtcgtcgctgctgaggtcacccagggcgtcctgcggctcctgcagccagagccccaagccgaagcccaccaagatggcgcacggcggcctggagcgctcgctcagcttcaagaactgggaggcggacgacagccggggcggcatcaacggagcgcgcccgggcgccctggcgctgcagcagcaggagagcccccggcgcgtggtctccgtgtccccgcaggcgcaggccatgatcgagtacatctcccctcgcccccgcgtggagctggaccaggcggccaccacgctgcagaagatgtacaagggcctgcgcacgcgccgcagcctcgccgacggcgccatcatcgccgaggagctgtggtggaagacggtcgactcggtgtacctcaacatcaagtccatctccttcttcgacgaggacaagcaggagaccgccgcgtcccgctggtccagggccggcaagaggatcgccaaggtcggcaaggggctctccaaggacgacaaggcgcagaagctcgcgctccagcactggctcgaagctgtaagcatctcatcaagcgccctcgttcgtctttcttggatttggtagcaactacaatcgtctcatcctctgtttcttcttttcctcgtctcagattgacccgcgccaccgctacggccacaacctgcatctctactacgacatctggtccgccagctccagctgcgagcccttcttctactggctggacgtcggcaacggcagggacttgcatcaccacaagtgtccacggagcaagctcaactcgcagctcatcatgtacctcggaccagtacgtggccggtgcccttgaaataacctttcgttccgcagacttgctcgtctctagctatatatatgctgatctccattgttgttccatctcgagcagaacgagagggcggcgtacgaagtcgtcgtggaggaagggcggctcgtgtacaggcagagcggggacccggtgagcacgaacgaggagtccaagtggatcttcgtgctgagcaccagcaggtcgctgtacgtggggcagaagcgcaagggcaagttccagcactcgagcttcctgtccggggccgccacctcggccgccgggaggctggtcgccaaggagggcgtcctcagggcgatatggccctacagcggccacccccgcccgcccggcgtccgcttcagggagttcatcgccttcctcgnaggacaacaacgtcgacctcgccaacgtcaaggtacgcaacgcaatggatccgtcgtctgtctgtccctgtgattgactgccgaataaaggagatggggggggcttgttgtctgacgacaagacggttctcgtgtatgtgttttcagcgatgctcgggggacgacgacgagttcccgtcgttcaagaagccggcggcgggtacagaagagaagcagcaggcagcagaggaggcagccccagtggcgacagaagaggagccacgacccgtgccggagctgcccgcggtggacatcgtgaaggagggcacgggcacggccgcggacgcggagccgccgaagacggcgatgggcaggcggccgtcgttcaagtggtcgacgcccacgggcgcgcgcatcggctgcctccagaactacccggccgacgtgcagagcatggccctggagcaggtgaacctgtcgccgagggtggcggcggtggcgccgtcgccgcgcctgcccatcccgtcgccgcgccccagccccaggatcaggctgtcgcccggcctgcactacatgggctgccccaccccgacgggcgccagcaggctcgcgaccccgaccccggcgtgcaggcgctcctcgcccaagcagcagcagcagcagcagcacttgatggggttccgcgcgccggccgtggcgctcacgctccccaagcacaaggccaagtgatctgcttgctgcccattgacacctcgccgcagcggcgttttccgaggtgttgctgcgttgcgccgggttaacaattttgttgattggtttgttgcgttctctgatcggctaccattctttcgtacgttagttcgttcctgggtcatcgtattttgacctcactctggtagtctggtagcactctggtgcttgcgctctgcgtgcaccactgctgtacaactctaaactacagcctgcaatgcaaggccctactgtaacctgaacctgcatcctgcagttcctcagacaaaatgactgcaggttccgttttgaataaaaggattcgttcatg

SEQ ID NO: 3386 - DNA, 2495 bp, Zea mays
gcttatcctctgtaacagaatataattatcttctgtaaatatagggatgataatggatcgcgatccaaatgcttcttcacaaaatgataggatcctaaataaagttaattcaaaaatctgagccagacgcagccaaaaaaaaaagagagagaggatagtgtcatggtgattataattagctagtgatgcggggcatgaacgtgtctcgcgtgcaaattaaaacagagacaatccgtcgtcgttgttgcctaatttaacgtgatcgaggggagcagaaccaaacaataatccaacgtactctagcttgttgcctagctagttgtttcacgtggtgcaatttaataaaagagtgtttggtgcttagctacacgatgtccacatatgcttgttaatataattatgtcgagcttatcgcatatagacttggccggatcgaaggctatatataaggaagaggtgatcatcaggagttgccacagctggcacagcactcataagttaagttgtatagctagagatagatcgagcgagcagctatctatctatctatcttagcggcatatatcgcgaaacatagctagctggagtgagttttgtaatcatggacgtcgccaacaaagtaggcaagcagcttaagttcgacgtctcgtcgaaggcggaccggcaacgcttcaatacgactttcatccaggagattcgccgtgagctcggtgacacaagcgtgatgcaggaggcgttccagctcccgcctcagacggacaccccgagctttcaggacctcgtgctgatcgccggcgagagcaccgccaccctgcggctgcgtaccgacaacctctacgtcgtcggcttccgcaaccaagccggccggtggttcgagttccggcacgaggacggcggacttcctccgaccataccaggggcgacgatgctgcacttcagcgggagctacgtgggcaccaacagtctagctccgctaaatcgtgtacgtattgtcaattcgatcattttatttgttcttgtttgttaattcgatcttctgcatattactagctagctactgcatgaattaggtatcaatatatatatagtgatggatgcatgcgtgcagccacgagatgtcacccacgcgtccgacacgatcgagagtgctgtgcacagcctggcccagtcgacgggagaagaggatcaaaggctgaaagactggttgcgcacgctgatcgtgagcttcatcgagtcgatcaggttcaactcggtggccagcgcggtggccgaagcgctgcgcaacgaccaagtaaatcagctcgaggagcaccacatccaccaaatccgcaactggagtgccatctccacggcgctactcgccgccgccaacgacgtcgtccaagaccccgacaccaacctcttcagccagttcgccaacgagtgcaggatacgcaacgcctaccaagcggccatcacgctcggcctggtgctcgtcacggccaggaccaatcgccgccatccccgcgcggccgacaccgccgccctcgggctcacccttgtggaagtcgtgtcggtgcggatcctctacatcgacggggaaagacccggcgacctctacgggacggtcagagtcgtcgactccttcggcggcgtgcacgtgtacgaccagcccagagccagcgcgcagtcggtctaccccggggacaacgccaagctcgtctggccgtctcgtgtcgtgtcggccgccgacgacttcgtcatcgacgtccacctcatggaccgggacacagatccatcgccggacgatgaggtggccaaggggatggtggcgtggaactcccgcgacgccctcagcagccaccgcaacgtcgtgacgagccagctcatcacgggcgagtacggctcggcacaggtcttctacgcggtgttgaccaacgccgtggtggccaccgtcgccgtcctgctcatcaacggcgacgacgagagcgtccccgacgtgtacggctccatcacagccaggaccgacatgtccggcgccagcaactcgctccagtaccagctgttcaaaagggggcagaaccaagatgtgggtgtgccggccaatacctacataccccttaacaggaaggtggtcgcggcggcgctgggctcgccgttcaaggtggacgccgacctgtgggacagagacagggacccctcccctgacgaccagatcgcgctaggctccgtctccttcaacccacgcttcgtcggcacggacaaggccaggatcaccggcaagtacggcgagattgaggtgcaggtcacctggtcaccctccgtcatccaaccctagctaggtcatccatcttattacaataataatgaataaaccaagatcgagcgaatccaacgattcctgcatagataagatcgatcgatcgatctcgaagtgtttagtttttgtatgccaataaaccgcatgcatgcttgcggggatcaataaataaataaatgttctactccaaaatgag

SEQ ID NO: 3387 - DNA, 2293 bp, Zea mays
cctcgaggccggccgggccgggtctttccgaccctgttgaccctgcctagcgttgagcacaactgcacaagcaggagaaatcagaatcaagggtctcgtcttcgttcccttcgcctccccattccgtaccgcgtcagatcgcacccctcctccatggcggcgctcagcctccgccagaggcagcttgatctgattgtgcggatgctgcacctcaacaagccaccgccgccgcccggcacggctgcggagcaagaagaggaggtgtacaagatcctggtactggacagcttctgcctctcgctgctctcgccgctgctccgcgtcgccgacctccgcaagcacggggtcaccctctactttcccatcgacaagccccgccagcaggtcgccgacgcccccgccgtgtacttcctccgccccacgcaagccaatgccgaccgcgtcgctgcagatgccgccgcctcgctctacgcatccttccacctcaacttctcctccgccctcccgcgcccgctcctcgaccgcctggccgccgccaccgcagcctccggctctgcccaccgcgtcgcccgcctcgccgaccagtacctcgacttcgtctctctcgaggacaacctcttctccctcgcccacccgcgctcctacgtcgcgctcaacgaccccaaagcggccgacgccgacattgaggccctcgtcgacgcgatcgcgctcggcctcttctgcgcggcggccacgctcggcaccgtgcccgtcatcaggtgcccccgcggtggccccgccgagatggtcgccgccgcccttgacgcccgcctccggcatcacctcctcgccaagcctaacctcttcaccgaggcctcagcctcagcctccgttgcctccttccagcgccccgtgctctgcctcttcgacaggaatttggacctctctgtgggaatacagcacgattggagctaccgccccttggtccatgacgtcctcggcctcaagctcaacaagctcaagatgcccgcggacaagtctggcccggccaaggcctacgatctcgatgattccgatgccttctgggtagcaaacagctggtcgccgttccccagggtggctgaggagatcgagtcgcagctcgccaagtacaagcaggatgtggacgaggtgaaccagcgcaccggtggcaacaaggatggcatcgagttcgatggcacagacctcattggcaacacccagcacctgatgaatgccgttaactcgctcccggagctcacagaacgcaagaagatgatcgacaagcacacgaatatcgcgacagcgttgcttgggcacatcaaggagagatcgctggatggatactgtgactgcgggaacgacatgctcacgaagggcaccgtggacaggagcacgctactgggccttctccgagggaagggcaccaaggcggacaagcttcgtctggctgtgacctacctcctctgtttcgagacgccagagctagagcaggtcgaggcggcgctgcgtgagtcagaagtggacatgtcagcgtttcagtatgtgaagaggatcaaatcgctgaacacgcagtttagtgcctcgtcgtcaagcagtgcaacgaggagcaacattgttgattgggcagagaagctgtatgggcagtccattagcgcagtgacagcaggggtgaagaatctcttgtccagtgggaggcagcttgcattgacgaggacggtcgaagctctcatggaagggaagccgaatccggaggtggacaactatctgctgtttgacccacgtgcccctagatcaggaagcggtgggcagttcaaagggccattcagagaagcaattgtgttcatgattggtggtgggaattacattgagtacaggagcttgatggagctggcagaatgctcgcagccgccttcttccaagcatgtcatatacggagcaactgagattgtcaacggggtggagttcatcgagcaacttgcagaactggggcagaaagcggggctgggtctgggtggtggaaacaaccctccactacagtaattactaataaataagggggggttctttcacatcgtttgaacattgtcagatatgatatgatcatttgcttccttttgtatggtttatattcgttgagaatatgttagtgcaatctgatccgcagtcttttttatactggttactggaggcaataataattataaacagatggaagaacaagacattcaaaggtttcttgggatggagctgctattgtcaagtaattttaatagatagaaatgaagtatgcatc

SEQ ID NO: 3388 - DNA, 1314 bp, Zea mays
gaggccgccccgggctagggtcgcgaacgcgggggccgcggcacacgcaaaattccccatcccccaaggaagtcaggccctcgcgcaccagcgcgaccggaccacaccgaccgcccgtctgaccgacgcaacccagccgtccagacgcgccgccgaccgtccttccaccaccacgcccgcgccgtcgcacgctccctagggttccgcagggccggggatcgccggagatggactggagcgcggtgacggcggaggacttggtggacgcgctgcgggaggtggactggtccatgccgccgcggcctgtcccggagttcttctcccgcttcaccgtcccacgctcctactccaagtggaccagccgcctcaagtgcaacctctactactacaggacaaactatttcatcttgatcatgttcatccttgggatgggcttcctttggaagccagttgctatagttgctgcttttatgactggacttagcatcgcatttctcaatgatagttttgcagtcactttcaatgagaaagtcacaaggaccgtaagacaattttcaccacatttagctgcaaagttgaggccacctataactcctgttcttcgcggtcgaccaagctctaagagatcaattcatatttgtgggcgacctcgctgggtgtttgtcctgttcttttctgcagtgagctgtatactctggttgacctcatgcagtcttctcacagtcctctgggcacttctcattgctctatttgcaactgtgctccatgcaagcttcagaacaccaaatctcaaagcacgtctgaatacattcagagaggaattccgggctgtttggcggaattatagtgagctttaagggtttcctttgtttctctcatgttcatgggtaatgaaggtgtctggtgccgttgtttgtgagctgtgctaggagatctagttgaaggtgaaacgccattgcacattacatggactacttgctctcttgggaggtgggattctggttgggttgactccgaatgcgatgctatgccagcacacgatccttcaagaacagtagttttctttcgtacttctccctaaccgagcattagagagaggacagcatgtaaaggatgtaaaaatgtacttgttctcgatcaaaaagtatgttgtttgttgaaattattactaatttgtattgcatcctcttttggatcatttgttaggtgactatcattttgcttcagcatttttgtcgagttagttacatcaagtgatactttaaaaaaaactctgttcctcgtgcaaaactcgaggaggggccccgggtaccc

SEQ ID NO: 3389 - DNA, 1203 bp, Zea mays
gggtacctcgaggccggccgggacgaacaagccacgatataataaaaaaacctctaattccccagacccggcaagcgacgccatcgcgcaccagcgctgctggaccaccgcccgtctgacgcaaacccagccgtccagaaccgtcgtcgccgccgcagcccgtccttccaccacgctcgcgccgttgcgcgctcttagggttccgcagggtcgggatcgccggagatggactggagcgcggtgacggcggaggacctggtggacgcgctgcgggaggtggactggtccacgccgccgcggactgtctcggagttcttctcccggttcaccgtcccacgctcctattccaagtggaccagccgcctcaagtgcaacctctactactacaggacaaactatttcatcttgatcatgttcatccttgggatgggcttcctttggaagccagttgctatccttgctgcttttatgactggacttagcatcgcatttctcaatgatagttttgcagtcactttcaatgagaaagtcacaaggaccataagacagttttcaccacatttagctgcaaagatgaggccaccaataacacctgttcttcgtggtcgaccaaactcgaagagatcaattcatatttgtgggcgaccgcgcagggtgtttgtcatattcttttctgcagttagctgtatactctggttgacctcatgcagtcttctcacagtcctctgggcacttctgattgctctatttgcaactatgctccatgcaagcttcagaacaccaaatctgaaagcacgtctgaatacattcagagaggaattccgggctgtctggcggaattatagtgagctttaaggtctcatttgtttctctcatgttcattgtggtaaggaaaggtgtcttgtgcagaaacgtccatgctgtttgtgagttgcactaggagatctagttgaaggtgaaacgccattggacattactacatggattatgggaggtgggatttgggttgggttggctccgaatgcgatgttatgccttagcacgtgatcccccaagaacaataatttttctttcaggcttctccctaaccgaacattggagaggacagcatgtaaagaaatgtaaaaatgtaccggttctcgatcaaaacttgtgttgtttgtagaaatttttactaattcgtatcgcatcatcttttgaacg

SEQ ID NO: 3390 - DNA, 2703 bp, Zea mays
caacgaccagacgcaacacgacggcgacggccatggcttcgccggacctcgccgccggcgacggcagctacgactttcaccttcgctctctctccgcggcctcacgggactccgctgcggcctccgaccccgcctctgaccccaacctcctccaatctgttaggagggtgtgcgagatgtgccgaacggcgaaggaagcgaaggacgagatggtggcgcgggcgttccccgtgatgggcaagctatttcagcgatgcgccgccgctcccacgcaggccgttgcctccaccggcgtgctgctcctcaccattttgcaattcttcttggattttggggaggctgttttgcatgatgctgatggtagcttgaaaaccttcttccgctcttgcttaaggagtttgcagatcctattgttgcagagcgcacagttgaattccttgtaacaaacaagacaaagatccttagctcctttcccaatttgattccacaggtgccaacacttgaaatatttacttacttggaattgacaattcccacatgtagctcctattattcatgctgttgcagatcattgctttgaaaaactgaaagatataaatccagcttccttctttgttttatagcatatttgtcaattttttatgtgaatggtgggggaggcccctacatgtatttcttcactaacagaagcaaagaaatatttacaatacaggaggctgtaggccaaaaaggtagagaaaaaacagaaaaaaccatatttgtatgataagctactcaaccaatcttttgtaagattctttatagaatatctctcttctcttcctattttccatattcgacttaatcttgttaacacatgccaatgcttgtgtatccttgtttatacacagttctatccattgttgttaaagcttattgcatcaaacggtgagaggtatgtgctcgtattgtcatgaacttcacatagctctatcatccatgttccctttaaatgactcagtacaggtaccataaatatccaatagcaatcccggtgaactacctaatttgttttctaacattctagactggagaataagttttcggaagtacttccattaatgatgtcagcaggatcttttcttcccctcttcctatcccttatggatttgccaatgttggtggtggcactggaaaaggtggaaagaagttctggaactcttattggtagtagtatagctacaatccagaagagcgctgctcctgagatgcttcttgcactgatggacgaggcatatactggttctgccgtagaagaacctagtggtaattcaggttctgatgatagtggtcccctagaccttactgacccaatgttcttagaccttctaaaagatgagaatgatggcattgccgcaaaacattggatatcccctacgatatcttcaacgttacaagcagcatttaacagcccacagtcggacagattgaaacagtcactggaaatggcacctcgctttcttactttatattttgcaacagcattgcgagacgttaatgactcactgctgtgtgctcttattccagtagttatgtcaagatatgctgcaatgttcccagacaaagttttctctttcaaggtgagggaaaggctttcagacttcattttggctgcattccagcggtctcccaacatcattgcagtactgaagaaacctattactgacagacttggtgaggctcatgataatcttgccaagacagagttagcattgcacttgtgctgggccattggtgagcatggagctggaggggtgggtcacaaggatgtagctcgtgaactatttgaaaatttggagttattattgtatgaaaacctggcaactagccgtttgggattaagccaagagccaggatctgattccatgggtgcatcatctagaaagtcatcccaagccaggcttctctgctttgtggtgactgctattgcaaaattagcaacatgccacagtgagttgcttccgagggcacgcgtgtcattgggtaaggtcgctcgttcccgaacctcagacaggagggtctggcaacgggcctgtgactatttagggctcatgaatgaaccagccatctgtttatctgtactgggaccgtccaccgcccaaggaaatggtcctggtattgtgaattggagtgaaggaggaacaaagatggtagctcatgttcctttttaccttttagcccagcaaaaaggtccaccgtctcataatttttcatttgccgacctcctcccaacagaatgaagaaaatatctgcatgagtgcattggtgcaggcatgatttctctagcagaaggccatataacgattttgttttgaagatccaagttcctttttaaaaaaggggctggtctgaacattcaggcttatttctctagcataatactcataaagagtcctgtacttttaggtcttgttcggttattcctataatacatggattgatggaattaaaaaaaatttagaagaactttgacttgcttaggaattcaacacatctaatcccactcaatccatatggattgagagctaatcgaacaagtcttacatggttgactatgcactcgagttatggaatgtatggtattacatttctaagtggtggatcgtagtgtaaaaaatgtacacgtctgaatttgttcgaaatgacaagtatctgttttgtttg

SEQ ID NO: 3391 - DNA, 2853 bp, Zea mays
tggctccctaaccaaaagcactcttatgactagtttgagagtccaaatatcggagggggttggagggattttaacccctacaacccttccgattttgtgactcccaaactataacggatttttatttttcaaaagaacataaactaattttcccgttccacggtagggatgaaactctacttagaaaacgcgctcctctcgttcttcacttcgacaggagctggagcgcccgccctccagcccaggtccgcgccgccgccgcgccgaccacaatcccagcgcccgctgcccagacccagcgccgcctgcggttgtgagcgcgaacaggagagagcgggtcttcggggcgagcgccacgcgcagacggcggttgaggagcctgagaaaaccctggtcttccttcaagatcctggtggatcgcgcccagctccgcgaaatttccttgatgtctatgtaggttcgtcctaaagattcgattttgttggctcttttgatccgacgcagatccgtacggttctcgcctgattctgcaattcaggcgccaggaggcttgctggctgtttttggattggtgtcttctcccatggggtcttgcaggtgtaggagggtgaattctgtctgattaatcagcggagggcaagcggctactgtggctgcgcgaacatggcgggcgagcaggctccggagggcagcgggaccagtaggcgcatggatctaaacctgtatctcggactccctccattgccgaggcctccagtctggctaggcacagcgatgattgccccgacgttgatgcccaattcgactgcgccggaagccccaagaacaggcgagcctgacgaatcgctcgccccggcggcggcagcctattcgccttcgaatgcgctttccaccccggaggagcaaccaatgcttgatcccatagtttattcctggctcgatggcaacagtaccgatggtgaagagcacactgatgcttctgagccagggccagtcgatggtgtcaacgtccctaggtcgcagcttttggtagctgccactgggttggaaggggatgatattcctgtagtaaggtttctgcgccctagtcaggtggctgctggtggaatggagatggtgagcacaagtatacttcggcgatccaatcaaggggctgctgcaattgagtccgggacccctgagctccgctttcagagggtgatacagattagccagcagcacagcattgtgaggccagcatcagcgaaccacagtcaaggggcagctagtacagatgcggataggcttgtctgggcaatccagcgcacacataactcttatgaagcagcaaggcggcaaaagctagatggcgacaacaaggtgtgtggaaacagtgcagctaagaaggatgggtcctgtgattgcaactccagctttgagtgtaatatctgtcttgacccagctaaagagcctgtggttacaccctgcggtcacctcttctgttggccatgcttgtaccagtggcttcatgcacattcactccactctgagtgccctgtatgcaagggtgaggtgctagaagtgaatgtcactccgatatatggaagaggcggtgaagaaggggattccaccaaccctgacttgccacccaggccacgagcaaacagaagggagagcctgagtcaacagctgcaaatggcagacacaagaggaattgcaacagtggtgaggcagttgatacaaaaccaaggtatagttagaggcctcccaagctcaacagggatcgaaatgactgtggttactacaggtcggcaaagggctagggcccggagaccacaaaggcaggataataacgcatcaccttccatacatgttgcagcacagaatatgggcaatgttgcctctgagagcagcaatcaaatccagctgccacattctaatggcgacaatgctgcacagatggttcttgcatctcctcagcagtcatcgtctgtcgaacagctgtcaacttctagcaccacagctcttatagtgggtgagcctagatcaactaggcggttaaggcctttggagtccccaaccataagaagaacaaggaggaggccgctgtaggtaccaaagtggtgtcactcccttcaatgaaacctacagaccatgccccattgttagttattaccatgattagctccaataacatctcaaggttaataatgtaggcatgtatatgccatcactcgttcccacctttctcttacataccatgtaccatctatgtagcttcatcatggagtcaaaatgtcagttccaagatctatgataatcttgatctcctgtatactcgaaatatattttctgatttagtctctgtttctggtatgatatgtcattataacttccctgaaaaaaaaaaaaaaaaaatccaacgtagttattcatcattgcaagcataggaggtgtatttggatgtgtgttcatgggcattttgccagatggtcgcccagtcaccgtcaagaagctcaaggttaggaacgggcaaggtaagtgtgcgaccaaggctgaggtcaatactatcagcagaagtacatcataggcatttgatttcgctagtagggtattgcattgcagatggccaacaaatgtttgtttatgattttgttcccaataacacacttcattaccacatccatgttgagaacatttttatttcagttatattattttctaatgttactttaatgccagcttcattagagcactataataatccattgcttatataatcattaacttgaccacttaaaactgcagttagtgaagcagcactggattggtttacaagggtttaagattgcaactggagcagcctgagggatg

SEQ ID NO: 3392 - DNA, 2502 bp, Zea mays
gccggccgggttccaaggataaaaatgacatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggcttcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatatattttctgatttagccgcaaaaaaaaaaaaaaaaggccattataacttccccggtgtggacgttccttagttttcgatgtagttatccatcattgcaagcatgggagaatgtgtatttgggtgtgttcatgggcattttgctagatggtcgcccagtcactgtcaagaagctcaagattgggaatgggcaaggtgagtgtgagttcaaggttgaggtcggtactaccagcagaagtacatcacaggcaatttggtttcgctagtaggctattgcaatgcacatggccagtgaatgcttgtttattattctgttcccaacaacacactttattaccacctccatgtcgagaacattttactttcagttacattatttaacgtttatttaaggccaacttcataagaacactctattattcatcacttgtactgtcattagcttgaccactcaaaactgcaggacgactcta

SEQ ID NO: 3393 - DNA, 2167 bp, Zea mays
  misc_feature (251)..(251): n is a, c, g, or t
ttttttcaaccacacagaacttcacatctttatattaataaggaaaagaaagcatccaaaatagaccgtttacaagagagggtacatacacccatgttgtttttgggattagatatttacattaatttttaccaattagcataatggcgtatgttgcatttatgtgagttggagaatgaaaccctaaccctaactagggttgggactgatatatatatcaatagttgttggccctggcccattacacaagngtgtgacagtaattacaaggggctaactccaaaaccctagacaggtactctaacaatgtgcccccctacatacacataaaaatcattttggaatgtactgattttttcatcgtgtcaattatttgccttcttttttatgtttttgtatttgcctcctttatttctgttctggagataataacctgcatgcttagttaagtttcgtgagaaggtaggctagatgattctgtaggttatccttcttttctaacatgtgtaaacatgagtagttttacagtttaaattacatgaaactgcaaagatgtcacatcaattattctgctgccgctgctgcttttgttgtttttgatgtgcaaccttgccaactttactctgcaatctacatttgtatgattgtatctactagtttgagcatagaacaccgcaaatgtttagatacaataatcaagtgctgaaatgtgaaacatttctaatttaaaatattttctaacattcaaattcaaatatttattataatgactatattttgcaggtacagaactagtcgatggtcttatgcaggtattctggtgtatattagatttagacaggccggacacacagacaataaatagtcttgttgtgccttgtgtggaatttatttatagctatgctgaatgcctggctttgcattccaatgaaaaaactagtgtgtcagtgggacctgcagttgctctgctgaaggagctgctctttgcaccatatgaagcagtacagacatctagcaggtgattttctcttctactgttcatacatcagtaagagtaccacaattaatatttgctagtttttcttttgtttttgtatcattttctcacttgtgttttattgctgctttccagtttggctatctcatcccgatttcttcaagtccctttccccaagcagacaatgatagctaatgatgatgctcctgaaaaccaagctaaagcaagtgcttctgctatgaattcaaccagtgcaaactctcaggttatgattgaagaagatcctgtcacatcatcagtgcaatattgttgtgatggctgttccaccgttcctatacttcggcaaaggtggcactgtagcatatgtccagattttgacctatgtgaaacttgctatgagatacttgatgcagatcgtttaccagcaccccattctaaagatcatccaatgtcagcaatacctattgaagttgatacatttggaggtgaaggcagtgaaatccatttctctgtcgatgagctaacagattcaggtgttcttcatgctgataggagtgttcagacctccccatcatcaattcatatatttgatgcaagtgagtctgcagacttacctgagactattacagaccaggcaactgtttcgatttctgcatcaaaacgtgccattaactccctggtacttaaccacctaattgaagagcttagaggctggatggggaccactgctggtactcgagccatacctttaatgcagttattctgcaggctttcttctgctgttggtggtcctttcatggatagctcaaagccagaaaattttgatttggagaagtttgtgaagtggctaatggatgaagtcaacataaataaacagttccctgccaaaacacgatgcacatttggtgaagcattgatccttgctttcatgttcttcacacttatgttccgcaactggcatcaacctgggagtgataattctcattcaaagtcaagtgggagctctgatttgacagataaaggtcctgctcaggttctgggatcaacaacaataactcttccgtcatctagtgctgacctggataaaaatgagtttgcttcccagttagtccgtgcctgttctgccctcaggcagcagaaatttttgaattatcttatggatattctgca

SEQ ID NO: 3394 - DNA, 1608 bp, Zea mays
acagccagcacgagaccattacctagaacatcctaatcgaaaaaccccaacgcaggagcaacacagcgtcgccggcggcgatggatcccctctccgtgctccgcgactacgctggccgcaacgagctggacaagatcatcttctccggcgacgagatccacttcggctctgactacaccttcccggcttccacccccaccgccttcgcctccaagcagtcaggtcgcccctacccgctctccgctgccgtcttcctcgcgcagcaccacgacctcaagcacaccgacttcatccaggccgcgcgcctccgccgcatcccgcccgtatcgctccccgaccgcaagaccttcctcgacttcctccgcttcggccacaactccctcccctccgccgacccgctcctcccctccgccttccagccgcaggagccccacctccatccgccctcgcctccgccggaggaccccgcagctaccgaagaggccaccacgggaaagcaaatccgcgcgctcgagcggcccttcaaggaccgcaactcaatcctcgacgcccgcggccgcgactttctcgccgtcttccatgccgccgtgcgccgccaggacgagcagctcaagggcggcggcaaggatgcggcgccctcttcccgccccaactctggctccgtcgctgcagccctggccaagcccaaggtgctggacaggtccctgggcgacggcgtcgtgcccatcatccttgtgcccagcgcctcgcagacgctgattacgatctataacgtcaaggagttcctcgaggacggggtgttcgtgcccagcgaggagaggatgcgggcgaccaagggagggaagccggagagcgtcacggtgcagaagaagctgattcgtacggagagagctggcggcgctgggggtgccgtctccttcgaggttagggacaagccggcttcgctcaagtcagacgattgggggcgggtggtggccgtgtttgtgctcggcaaggagtggcagttcaaagactggcccttcaaggaccatgtagagatcttcaacagagttattggtttctatgtgcgctttgaagatgatagtgtggaagcagccaaggtggtgaaacagtggaatgtgaaaatcatatctataagcaaaaataaaaggcatcaagacagaacagctgctcttgaagtatgggagcgcttggaggaatttatgcgggcacggacataattgatgtgcagtcatggaaaggataaaagacaaccattttactagattcattcgcaatattggtcggtgactgtagatggcagaatggaatggccgggagcctatgaagactgcaatctttgtacgctaggatgtatttgtaatgttgtacttgcaaactgctaacttatttctagtttaagtatatgagacaattttgcaagttgcgcctgaaagtatattttctttctacgtctctatgttctgggggtcgctggctctcatcctgccattatctgaggtctatgttttaatttgttttttctatataataacctgcttcagtttaacgttatattgtaaaatgaataccctgatgtgtgaataccatgatctgattcgtggcaaa

SEQ ID NO: 3395 - DNA, 4193 bp, Zea mays
agtatgggtgggagctaagataatctagaaatcgtttttatttttttgccagtggaactcaagtactcaactaaagtactatggcttggcagcggtgtgtgcctagaaggttggaagatgacgaggcaggcgagcgagctcaccggaaaatctgctagggaaatcgcctgagcgcgcggactttggaggtcgggctcgggcacaccattcgtcgccgccgcctgcgcacaggaacatggcggttccgcattgcccgggcctagaaacgtcagcccacccaccgcatgtgcgaatccggtcttggcatgtcggcgacggcgaggtgcgggaagggacgcgagagcatgcagcaccccgtttcctcggttccctcaccctccttgctctcgtcgtcctcgcccgcgccagccacttgcttgcaggttttcccacatgcccatgcgggcctccccccattgaccgcgcaccgccgagggtgacccgctgggccgggcgctggtcccggcctcccgggccgcgaggatccccatccggcggtccacgcggtgtcgtgtcgtgtcgcgccatcctaccgggtacctaccgaccccagccagagccagccaccttcccccacctgcgcgaaaccgcgttatcccgcggcgcggcacgcagccccacgctacgcatggtgtcagatcagatggatggaacgccagcgaggagccacacgcagcaatggcgcaacgcgcaggtcgatcccccctccccccccccttcttgtccaaaaagcaactccccaaccgcgttcacacctcccgctgccccgtcacatcagaccaccgatgtttatatatataccgcccctccctcgccccggcccggcagtatcgcctttgcccgcacacacggctcccattccatttccgctgcctgcctctgacgcgcacccacaccacctcgcctccctcagccctccgcagctcggcctctgcttgcgttgcgttgcgtgtgtatgtagtggccgcaacacaaaaatcaagagacgtgtatgtatatgcgacccccaacagccaacgaccggcctccaagcggtgggggtggaggagcagcagctggtgcaggtgcagcagcaggggacgacgacttcgccttctactgctcctacctccaggacgccgacgctgccgccgcctcagcgacgtcgacgctcgccctcgccgtcgacgaccccaaccccaaccccagcgccgcagggatgacgaacggccggcgccggaagcagcgcggggcagaggacgccggagccgccggggaaggggaggaggaggccaagaaggacggcaagaagcggtccatagccaagctgctcacctcgctggcggcgctggaggcggaggagcacgccgaccgcgcgggcgccgcggacgcgtccaggcgggagctggcgctgctcgagtccaacgccgacacccgctcgcaggccaccatggactactacgccaagatggagagcagcttcgacgccaccgccgagtccgaggccgccgccaggtccaagcgctccaggctcgccgcgtcggccgccaccgcggccgtcgtggccggggaggaggcggcagcgtcagcggcggcgtcgccctccgcgtcggcctcgccgacgcgcgccgcggggcaggggcagggaggccaccaccagcgccggctgtgggtcaaggaccggtcgcgcgcgtggtgggaccggtgcaacagcgccgactacccggaggaggagttccggcgcgcgttccggatggggcgcgggaccttcgacatgatctgcgacgcgctgggctcctcggtggccaaggaggacaccatgctccgcgccgccatccccgtccgccagcgcgtcgccgtctgcgtctggcgcctcgccacgggggagccgctccgcctcgtttccaagcgcttcggcctcggcatctccacctgccacaagctcgtcctggaggtgtgcgccgccatcaagtccgtgctcatgccgcgcttcctgcagtggcccgacgccgacgccgcggcgcgcttcaaggagggcttcgagcgcgcctcgggcgtgccgggcgtcatcggcgccatgtacaccacccacatccccatcatcgcgcccaagatctcggtggcggcctacttcaaccgccgccacacggagcgcaaccagaagacgtcctactccatcactctccagggcgtcgtcggccccgacggcgccttcaccgacgtctgcatcggctggcccggctccatgcccgacgaccaggtcctggagaagtccatgctccaccagcgcgccgcggcggggatgatgcacgactcgtggctggtggctggcgccagctacccgctcatggactgggtgctggtgccgtacacgcaccccaacctgacgtggacgcagcacgcgttcaacgagaaggtggccgagctccggcgcgtcgcggtggaggcgttcgcgcgcctcaaggcgcgctgggcgtgcctgcagaagcgcaccgaggtcaagctgcaggacctccccgtcgtgctgggcgcctgctgcgtgctccacaacatctgcgagattcggggcgaggaggtggacccagccatccgctgcgaactggtggacgacgagaccacgccggagaaccccgtgcgctccgagacggccagtcgcgccagggacaacatcgcgcacaacctgctccaccgtggcttgggcggcaacacattcttctgatctcatccgtcaccttcttcttttttatgctttgctagtacagtagtacagaattgggctggaacaagaaagaaataggcattcttttcttttaattacactagaagatgattttggtaggattcttatagaatctatctatctatctatcaccgagcgtttttaaccttttcacgctcgattttccggttctctttgacacctttctccttccgacgcgccgtcgccgcctagtcgagtgcctcgccggtactgtaccaatagcgactttaatctttcccttctcccgccgctatcagggccatactcgccttcgccttgggctcgactcaatgtctccgccgtctggtctacttttcttcctaaaatctcttttaaactcgttaaagatggagaagtagagagggagaggaagaagagaagatttaaatgttgaacactgatcaattgaaatgatatgtagctttttttactccttccgtccataaatatttgtcgcctccactatggtattcgtgttagttaaattttttaaatttgactaaatttatagaccagattaccaaaattttttgtatctttgaatatttttaatatgaaaatagattaaaagatctagctaatgatactaattatctactatagatattaatattttcttgtataaatacagttaaatttagaaatacttgactctaaaaaatgagaaagactaatatttatggagggagggagtactgctgttggtgaatggatcgctttatcgatatgcaattttatgattcttagctgagagttcccgttcttcctttaactatctttcttttttcactaaaggttatgaatgtttaaatatatcgagtcagaataaatcaaatcgctaattcataagagtttttcaggtttgtgttgaaaattgtgtccagtaaaacagaaaattataattttctataaattatagataggatagatggcaaatgaccgaccgacacaagaccatgtaattaattcacgcgatgtaaccatcatctcttacgtaaccatcgtctcactctcacgcgatgtaaaccatgtaactaaaaaacggaaacgacaccagatactcaagtactggtaacgaatcaaccaggagaccagagcgagtactagcgttgtagagtagcggtggttcttcgtatgaaagcagtcaacaaaattacaagctaaggtgaaggaagtcatttcctcaagagcaaaaggcgaagatgagctaacaaccttcccttcctacctgcttggatgaactactttcaattcttttgtctagaagttagttgtatgaactatcttttgtctagaagtttgttatatgaacatgaattaaatgttgttctaggtgtcattttcaggagggttaggatctggtgtatcaccaaactcgactcgacgcagagtgaaatactgaatcaccaccaca

SEQ ID NO: 3396 - DNA, 748 bp, Zea mays
ctgcagcatttttatacgtcatcctgcaagacaacacaaccggctcaattacattcgggcgttacaacacagtaagagaacgcctagaactaccgatacatttcaccttgtatatggtattgcaaaggtataatcagttagggctgaggtgccaacctcataggtatacaacccctcgtaatggaatgacgccacaatgaactgaattacaacaccaaagtggggtaacaaaaactgtacaattggtgggtcacaatctgttattaaacccttatcatggggagaatggctgattggaagatattgtacagtgcatgttgaacttctccagagctatgttcacagcggatcagatcagccaataatgggaaaaagcagggtaatattctcctaaaggaatctctctccagatcacccaacaatttcatcacttgaagggccagaggagtcctagcagccaattcctctttcttagaagcgctcagcggcactgcacaatgtaagggcggatttctttgggacgccccatcacatggtttgtgtcctgcgcacttcagatatgtttgcaatatttgctcacaggtatcaagcacttgagactctatgttcatctcttctgacaaggatggataatcatgttgcagagcttgaagaagtttgaggtaactctggtaggaatcgttctcaaaatgaacaattgctggctcagatacctccaaaagggaacatgctttatgaaatttcgatt

SEQ ID NO: 3397 - DNA, 957 bp, Zea mays
atgaaatctaagaaagagcgggtggttctttacagcaaccgagctcagtgctaccttctcctgcagcagccatcggctgccataagcgatgctactcgagcgctgtgccttcatagccccgtgaatcgtcacgccaagagcctgtggagaagagctcaggcgtacgatatgctcggctttgcgaaggagagcttgctggatacgatccttttcataaacgagtgttcgcagtcgaacgatcctgacctatccctgaagcagaacaaagtccctgattatgccgagcggctggtgaagaagcagatgcgcgccgcttggctgttcagggaagcagccctgaagcacgggggcgtccgtcgcgcgggggatgctagcgacgctgcgtttggccaggaggccgacgactccgagtgggagacagctagcgaaagcgacggcgagaacggtgccgccacggggggagaagcagacggtgagactggatggaagaatggtggccgccaggaagatttctgtgagaaaagctgagcaacagccaaatgtgtattcagagagtctcaaactgagcggctacagaagcagctgctgggccttctgcggtcggcacactacgaagcatcaaatctttctaacggaacgatctggtgacgtttttattgtcctcaacaaagcaagggggcagaggcccaattaaattggttctccacgtcttctcgctgggtcagttgagctgtgcctgtgaccattcaatatttcctctttgatgctggtcctcctctggtgtttgtaacatgtttttcgttcagtttgtcaagtccctgaaagaacagaactgtgtgcattgcttgttttgttttattgttttctgaagtttggtgaagaggccgtaatcctggcgctctcccctttccatttgacttgtgagaaaaaaaaaactagagggggggcccggtaccc

SEQ ID NO: 3398 - DNA, 1226 bp, Zea mays
  misc_feature (24)..(24): n is a, c, g, or t
  misc_feature (84)..(84): n is a, c, g, or t
  misc_feature (138)..(138): n is a, c, g, or t
  misc_feature (167)..(167): n is a, c, g, or t
tggtccgcctgcggtaccgtccgnattcccgggccagagagttgagattggaatgccatgtctctttgcaaatccatgtgctgngaagaggtcaacaagactaaggataagttaaaccaagttggtatggtcatatantcagaaaccaatggacaatatttgctatngagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccacctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggagaactgctaccaagtagggggtgaaattagaggaattttgtcttctagatatgcgtatggctcttgttggtgctgaaaggaccagaaaatatttggtgtaactgtagtagaacaatacatctgttttctgccgtttgtttttgtttttgtttttgtttttcacaacgttgctgtaagttagtgctggaaatcacaggtacattcagttctactgggcgccttgttcgcttgtcggatagcagtcgaacgattttgtgctgcatatgttaaaattgaactctcgtgcgtcttctagaaaa

SEQ ID NO: 3399 - DNA, 2910 bp, Zea mays
  misc_feature (26)..(26): n is a, c, g, or t
  misc_feature (29)..(29): n is a, c, g, or t
agctggagctccaccgcggtggcggncgntctttctccaaaagggggcccccgggctgcagggagagagagctcctagtcccccccccccgaaaaaactgatggtgagagtaaggacggtcaagaagagaagcctgatggcgatgccacccaggaggagcaacctaaaatagaggagaatgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggtgttgcaaccagctatacctggaaattatgtaatagtagtgcctcgacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaaggtggcatgcttttgctggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggaggaactgctaccacgtaggggtgaaattagaggaattttgtcttctagatatgcgtatggctcttgttggtgctgaaaggaccagaaaatatttggtgtaactgtagaacaatacatctgttttttctgccgtttgttttcgtttttgttttttcacaacgttgctgtaagttagtgctggaaatcacaggtacattcagttctactgggcacgttgttggcttgtcggatagcagtcgaacgatcttgtgctgcatatgttatatttgaactgttgtgcaaaaaaaaaaaaaaaaaatttcccaaaggtcagggtaagagtacgtggagaggagagcagcgaatggtggagcgacgaggcaaatgaatccgggacgacggtgacgtgtgaagcgagaagatttgttggagcgccggaaacgtccgaagtttgggggcgccccatggacgcacgccacaaaaacgtttggaattcggaaacgtctggagctttcggtgcagcattttccttattcgttcgttcagggtgaggaccgaggacgaggagaagcgattctcgtccgggcccagcaaacattcggcacccgttgcactaccggtaccagacgcacgtgacgtccgtgtcgatcggtccagtttcatgagcccattctagtctatagagagtagttacgtacgtacaaacattgaactatccatcgtccataggatgggatcaaacagttgtcgacaaaacaaagaaaagaacaccaggccgccttgcttatatataaaaatattagagaaagtacctatatatatatgtatttttttgcatatgtacactagtagtagtagcagtagggtcgtccaaaaatggggaaggcggcgcggggcccgtgggccacatgtctgccacctgatcaccacgtgggcgaaccccgcgcgggccccggcgaaag

SEQ ID NO: 3400 - DNA, 1690 bp, Zea mays
aattcggcacgaggaggttgcactccactctcccacctccactgcgctgcccgcctgcctttataacgcggcgagcccagtgcggggaggcagagaacccaaggacgcgcctcgcctcgagatccactcggagggccaccgcgaccgctccggtcggttccggcgaggtgccgcgcggtcgtaagtcgtaacagcatacacagggcagacaaagctgcgattttgggggggctgttggtccagccgtggttgttggtggagataaaccacgtgaaggctggtgctctggtacatgttcgccaggcactgatggcatttggccgaggtggaaagatggacggccgccggccgtcctcatcgtcgtcgtcgtcgtcgttctgcacaaccaccacggtcgtgctctttgtggcgctctgcctagtcggcgcgtggatgatgacctcgtccactgtcttcccgctggagatttcgtccaataagaagccggtggtgaagcaacagcctgcgcctgtcaatttcggggcgtcgcaggaggcatcacctggcattgctggtgaagggtccgagaaatttgaggacaccgacaacaatgatgccacagtcccagaggaaccgaataaacaggatgcttctgagcaagagaatttcaatgagaagcctgaagagaaagagctggaagtgccggtagagaaagcggagaccaaggatatgtttgatgacgcaaatggaaaatcagaagggctgtcagatgaaacgaagaatgatgatggggagaagagtgtggagaagaaagacaatgaaatcacaaatgagagtggtgatgaaaaaactgatggtgagagtaaggacggtcaagaagagaagcctgatggcgatgccgctcaggaggagcaacctaaaatagaagagaacgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtgattctgtttattctgaattgtacaacaccgaatcatctttagctgaccaagatgcgtgtttgcttattaccacgccgtgctgttttttttgcaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggtatattataatcatcccagcatctcatattagtcactccttagacttgtacttgtctgcctcacacttttgagcatcagtgattgatttattgttatactattccacaaacataatttgtcaaatagcaccatatagaaatctgca

SEQ ID NO: 3401 - DNA, 1607 bp, Zea mays
caaaattgggttaaggtcgcacccgccggcctcggcctccctgggggtgggactcagttcaagaatggtgccctccactatattgatactattcagcaggcactacctgatattgcatggggcaaacgaagccgtgtcattttggatgttggttgtggagttgccagctttggaggctacatgtttgatagagatgcgcttaccatgtcttttgctccaaaagatgagcatgaagctcaagtacaatttgcattagaaagaggaattccagcaatatcagctgtgatgggcaccaagagacttccgtaccccagcagagtctttgatgtcattcattgcgctcgctgcagggtcccttggcacattgaaggtggcatgcttttgttggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagagatgcaaactggctgcagttttcgccgaggtcgaccgtgtactgaggccacagggcaagctgatcgtgagggacaccgcggacacgataaatgagctggagagcatggccaagtccctgcagtgggaggtgcggatgacctacaccaagggcagcgagggcctgctctgcgtcgagaagtcgatgtggcggcccaaggaactcgacgctagcacgtgaaatgtgtcgaggagaactgctaccacgtaggggggtgaaattagaggaattttgtcttctggatatgcgtatggtccttgttggtgcgctgaaaggaccagaaaatatttggtgtaactgtagaacaatacgtctgttttctgccgtttgtttttgtttttgttttttcacaacgttgctgtaagttagtgctggaaatcacaggtacattcagttctacaaaaaaaaaaaaaaaaaaactcgagggggggcccggtccccaatcg

SEQ ID NO: 3402 - DNA, 2053 bp, Zea mays
cgaggccggccgggccgggagtgcatccaagaacccacccatggcttcaatcaacacagtcctcggtgcaatcttcgttgcttccttctacttctgtggctcccttgccttcttccctcctggtcctggtccccaccacgagggagcccaccaccctccaatcggaagtgctccaatcccaggtctttctacagactactacaggttgacatgcccgcaagctgacgagactgtggcgcccatactgaagaaggctatcgcaaaggaaccacgggtagctgcctcccttctcaggctcctcttccatgactgctttgtccaggttagcagcacggtctcatgttctctatttggtcaatcgtctcttttgtcccggccgtggttcatgcgatgaaactaatcgcactatcgcagggctgcgatgcgtcggttcttttggatgacgctgaggaagtcgtgagcgagaaaaacgctatccccaacaaggattccattagggggtttgaggtcatagacgagatcaaagctgcactcgaggaagcatgtccgcagacagtgtcctgtgctgacactgtcgccctggcagccagaggttcgacagtgctggtaagaaataaatctctctagctaaattcaagtgatggcattgacaacaacctgcagtagctagttttacatgagtagaaaatgtaagggatttcccacaaaaaaacatgttttatttcctttagtcttggtccagttgttatatttaatcgatataattaagcttcttctcacctgacagagtggtggaccgtactgggagcttccattaggaaggagggactcaaggacagcaaacatgaagctagcaaacaagaaccttcctccaccaaacgcaacactgcaccgtctcatcaagttcttccgaaggcaagggctggacaaggtggaccttgtggcactatcaggaagccacaccattggaagtgccagatgcgtgagtttcaagcaacggctctacaaccagcacagagataacagaccggacagcacgctagagacgagtttctaccacacgttggcgtcggcgtgcccacgcgccggtggcgacggcgagatacggccactggatctcgtcagcccttcgcgatttgacaacagctattataagctggtactggaggggaaagggcttctcaattcggacgaggttctgtggacaggaagagaccccgaaattgcaggcctagtcaagagttatgccgaagacgaggcgctgttctttgagcactacgtgagttcagtaaccaaaatggggaacataaatcccctcacgggtcacgatggagaaatccgcaagaactgccgtagggtcaatcaggagatctagtcgttgaaaggcttcagtttcagtcaggttcctttgcttatgacgggaaatttcattcacatgatgtcaactgtaaggccactattttcaatgaaatgtatctcatcatcttcttttgctctaaaatagtgcgtttattaagacaacgtttggttccaaagtaacgtgggacggagtcactctgcttctaatctgttcttgtttgaattggttccatataggatctaaaaatgaaatactatgctcaaatattgacccatttgactccctgaatttttcggacggcgtcgggccgttctaattggctctataaccaaatgctaactaagtcattcattgcataatcatgtccttagcttctactccactaaaatttaggtgacattttggggctggacttaacaaccaaggactaatgagcctttttgtttccgcttataatcagattctcagtcaactgagaactgtctgcacttatctgtgttcttgttttctgattacaaaatgaaaaaagaagtgcgtgatcaacactaagcggaaggggatcctcgactcgtttcctgttagggtaggggatatggaggtaggagaaggcagaggtagaagacagagataggagagaacagagagctctcttcagagtttctattgttcagatgaataatgtccccacgccca

SEQ ID NO: 3403 - DNA, 1266 bp, Zea mays
tgccccccgacgtcgcgcccgggagtcggccagaacccacccatggcttcaatcaacacagtcctcggtgcaatcttcgttgcttccttctacttctgtggctcccttgccttcttccctcctggtcctggtccccaccacgagggagcccaccaccctccaatcggaagtgctccaatcccaggtctttctacagactactacaggttgacatgcccgcaagctgacgagactgtggcgcccatactgaagaaggctatcgcgaaggaaccacgggtagctgcctcccttctcaggctcctcttccatgactgctttgtccagggctgcgatgcgtcggttcttttggatgacgctgaggaagtcgtgagcgagaaaaacgctatccccaacaaggattccattagggggtttgaggtcatagacgagatcaaagctgcactcgaggaagcatgtccgcagacagtgtcctgtgctgacactgtcgccctggcagccagaggttcgacagtgctgagtggtggaccgtactgggagcttccattaggaaggagggactcaaggacagcaaacatgaagctagcaaacaagaaccttcctccaccaaacgcaacactgcaccgtctcatcaagttcttccgaaggcaagggctggacaaggtggatcttgtggcactatcaggaagccacaccattggaagtgccagatgcgtgagtttcaagcaacggctctacaaccagcacagagataacagaccggacagcacgctagagacgagtttctaccacacgttggcgtcggcgtgcccacgcgccggtggcgacggcgagatacggccactggatctcgtcagcccttcgcgatttgacaacagctattataagctggtactggaggggaaagggcttctcaattcggacgaggttctgtggacaggaagagaccccgaaattgcaggcctagtcaagagttatgccgaagacgaggcgctgttctttgagcactacgtgagttcagtaaccaaaatggggaacataaatcccctcacgggtcacgacggagaaatccgcaagaactgccgtagggtcaatcaggagatctagtcgttgaaaggcttcagtttcagtcaggttcctttgcttatgacgggaaatttcattcacatgatgtcaactgtaaggccactattttcaatgaaatgtatctcatcatcttcttttgctctaaaatagtgcgtttattaagacaacgtttggttccagagt

SEQ ID NO: 3404 - DNA, 848 bp, Zea mays
gatctcagaagcattgtgcatgatatgtgcctctagctgtgctgtgcaaaagcttatatagcttctctttttggttaagtatgaactagagttctgctgagtaaatagtgctgttaagttggtgtcgggtggaatgtacaccatctagagtagagcagctgtatgtatgctcatgtgtccttgtaagttgtaatggagatgaaaaatgagttgcaaaatgttgatccctgtttgtctgttggataacttaaactggtaatgtacaactttcaatgtacctgtaaaaaaaaaaaaaaatggactgtatccagatcgttcctcgtcttttcagcccgggaaccgcgcctggtcgaccggcggtggaaaatatccccaaccacacgcgaacgcgaagggcacgcgacggctatggatacaacattcttctctccggcgccgatctactccggtggccgcttctcaccgatctactatctttcacttatgttctaccacgacaacaacgattgctgcttgctgctggccatgtgcgcgaggcctggtcatgcataaacaatggtgcatgtcatgaactctttaaccgtagggcatttcagtgcattggatggattactagtcctgtaatgaaacctgtaataatggtgcttctatgtgactgctgcaagacatcacttgtctgctctttcttgtgtaaactgatgacagttatatgctgttgataaaactatatgcatgaacaaaagcctgacggttcctagccttgtatgctggcccctttctagcactaatgctattttacttgaaaaaaaaaaaaaaaaaaaaaaaactcgagaagggggcccggtacc

SEQ ID NO: 3405 - DNA, 2243 bp, Zea mays
cggccgggaatattcatctccattgcgtgccccgccgccggccgggaccgttcacattaatagcttttcctcttctttccccatccaccctcgcaccctcaccgaaaggagaaggcttcagccttcaagcgcacacaggcacgcaaatcccctcttcatcaacctcgactcgagtccgcgcgcgtccccgaatcgagaggagatgagtcgtccgcatgacggtcacaggtccttctttcccatggggaatcccttcaggatgattctcccaagaggagcccgcctgccaccgaagctcactgagctgctcacttcgtatgaggatggcctggcctcgagcttgaggaaggtcaagccagaggccacctcagaggtgttcacactatcatggatgaagctcgcagtggagtgcttatcagagctgcacaccaatatagccaccctgattactgagcttgagctgcccttatcagactgggatgagaagtgggtggacatttacctgaacagcagtgtgaagctgctggacatctgcattgccctgagctcggagctctctcggttggatcaagggcagctgcttgtgcgatatctcctgaatgtgttgaactctgggagcgacatgccatcccaggagcagctcaggagagctgaggtgtctcttaaggaatggatagagcgagcaagtgaaaggtctcccaggcttgatagttgcttggcagcgctacaggagctttctggaaaccttagcctgatgaaggttaggcattctgctaaggggaaagtgctcatgcgagcattgtatggaatcgaggctgttaccgtcttaatctgcagcgtacttgtagctgtactgtcgggtaccttcaagccactggtggactttgatgtccctgagaaatttggttggtctacggccttcattgatcttcagaaggccataagcggtgaacttagcaggcaactgtccagaggtagtgttgcagctgtaaaagagctggaggatgttgatgtatgtgctaaacagctgcatacattgacttgcactgttcagcttgaagaggagaatgccagcctggctcattcatttagccgttcaaaggaagtggtcctggcagatactacagcccagggaagaggccatgcggataatctcaagttggctgatgatagtagctgtcagcatgaagtgatcatgctgcaaagtattactacagaaggaggaatggatacagctgatatcaaggaggataccgagaccattggccatacaaaggaagtgatggcgcctgagaaaataattgacagaggacaccaagatgataacacaaagcaggacactggtgttgtcactgatatcagttgcttggaaaggagagaggaactgctgaactgcatctcccggatgtcgaaaagtgctgaaaggctccagttggggttggactcgctgtcgaagcgggtggatgacttcttccatattgtgcttacagggcgtgatgcactactttgtaatctcaggttttcaaacggcggcaaggttgctgcagaggtcaggtcttaatatgccatctcatgtttgtgccatgttatgcatgtatagtcagctcagcggcccatcgtgatgtgtggtgcttctgacttctggcccctgctcagctccaccaacactaagccggggccagatctcagaagcattgtgcatgatatgtgcctctagctgtgctgtgcaaaagcttatatagcttctctttttggttaagtatgaactagagttctgctgagtaaatagtgctgttaagttggtgtcgggtggaatgtacaccatctagagtagagcagctgtatgtatgctcatgtgtccttgtaagttgtaatggagatgaaaaatgagttgcaaaatgttgatccctgtttgtctgttggataacttaaactggtaatgtacaactttcaatgtacctggaaaaaaaaaaaaaaaaaaggttcgacctagagtgttgttgttaaggccttgtttggataaagagggattgaagtggattgaagtgtattttagggattgaaagagaaattagttcatattacacctcaatccaccttataccacctcaatccactccaatccaagattacccaaacaagacctaagtgggaactacgtaccctttttgtaagcagtaactggagtggtgtcgagttggtgtcggtggcatgtgctggtaatggggatggaaatgagttgt

SEQ ID NO: 3406 - DNA, 1233 bp, Zea mays
ggagagatgatgatgatgacatgatgttgttttttctccctatgctacatatattgggttcgagttcaaacatagtaagggaaaaaagcgaaggcatacatcaaagttaagtggcgaagaacatgttcaggagttgctttaaggtcatttgaagaattgtcgggtagcgttcaggatggagcctgaaattttcaaatccttggcatgttatcttagaagggaggggttggtccgtgatataaggattaaggtcgaggaaaaagttagcattcttcttatacatgctcagccataatgcctcatttgaatggtgatgatgcattgctgcttgttgctgacggccgcctgctactgcttgctacttctaccacgacaacaacgattgctgcttgctgctggccatgtgcgcgaggcctggtcatgcataaacaatggtgcatgtcatgaactctttaaccgtagggcatttcattgcattggatggattacttgtcctgtaatgaaacctgtaataatggtgcttctatgcgactgctgcaagacatcacttgtctgctctttcttgtgtaaactgaggacagttatatgttgttgataaaactatatgcatgaacagaagcctgaccgcttcctagcaccaaaaaaaaaaaaaaaactagcactaatgctatttcacttgtctactattttacttgtctcctatcttcatagtatttcacttgtctgctttttcagtgcattgtatgctgcctgacggtaggaaatggaatatgttgataagtcttttgcataagagctcgtgtggattaaccgaatggcctttttcaaacatggattaaaaccctaaggggatcaaacccccaagtggattgagtgaaaggaagggatacactcaatccctctctggattagatccacttgggaaattaatcccttgcaaccgaacaagcccctagagggttctcacacccattcacgtgatctgccatggtctccatcctctagtgaacctcctagcgcacccgccgcccatcgaacatcgatgagcaggggcggtgcatatagcagaccccaacatcccctccccacgtagacggtcgaagatgtggagctctgctagctccagagagggccacgggtgcgaatatgtaccccgcgcagggccgggcatgcgggaccgagtttgttacattgcgcggttaaggccaggctggatcccctagaatcgcggtg

SEQ ID NO: 3407 - DNA, 2738 bp, Zea mays
atgagtcacatacaaatcatagtgcagcttcataagagctcatatgcctccaatttaaccgcggtgtttggtttctagggactaatttttagttcctccattttattctatttaatccctaaattgccaaatacgggagggactaaaaattagtccctagaaaccaaacatcccctaagttcttatgctgcctgatggatttaatttccatgatcattaatggcgcggtgcttcagttaggaggccgataaacctggaagactacactccacctgttgagcttcttcagatattacccctgaagtccagcgttagaggaaaagatgttggcccccaaatcggtccaaataactcaaaattttctccagtatgttcctgttgttatagttcaatggctaatgcattatgcatgtgttttgctgtcattggtccttgcgatttgcatatttaaacacctccctttgtacttcgttttccactgggcagggaatgcaagctttattagacctgctgtttgctgttgaaggttctgtatcagatgcagcaaagattttagggtaacacgttacatctatattccactgctgcgcacagatgctagatggcagcatgtatatttgctatagttttacattcaagccacctcatagttatctcggtgaactatgaccataatgcagcctaagcactggtgctttgtcaagattgattctgtcagatgattctctccgaacggccgcgaatgaactgcgagcttcgaaggtaaccctgcaaatatgtgagctggccacaaatgcctattcattgattagaggataccgcattccaaactttaggctctaaatttatcccaggaaaaacaatcatatcacatagtaacctagggtactaatacgaggtccttatctaaacagaccactggtgatagccaggtccatcacattgtgttataccctacagtactttatcagataaattttaagcacatcagatggccagtaattccacattaggtgacatgccttgattcccacttgagcaatctttacatgaagtataatgtacaagcaccatccactcatatccaggacaagtcactccatttgtataaatattaagagtatttggttcagagcatgtttgctaaaacaggataattatgttatgtcattcttaacttctaagtgctgaccaagttttaaatattattcatttcattgatttcctgcttacaataccctaacgctccgtttggatgcttggaattggattccattctaataattgtaatttagatatagatcaattaagctaatacagttttatatagaatatttttatataatattgttagccatatgaaaaaaatatttatgtgctacatttttattatagaggagcgagctgaagagcgtgctataagttcctgccggtacgtaaactagtgatatataaaaatcaatttccaccttatcatcatatgaatttgagatatctaagctttgtaaagtggtggaatgtcaatttccaaacaaaatagcctactctattaagtatattctaattccttcgaaatgaagggatccaaacggcccataattagaaaaagcatcattgtaactgttttatctctctctgcagggactgaagcctttgagatgaaatcctttgtaaaatcctcagcttcaagtgcaccatatcccataggtgccatgttcgacagatgtcaggaggcattatttctagggaaaacctttgaggtttcatgcggtttgtttaagggatgttcgtcgtcattagattgccgtaaatatgttcagtaggcagctagtatatcttcagaatatcctcgtttcgtattacatatacccccaatgttctccagcagggcaacaccattacaccacttaaccaatatttttccttgaggacctgttaacctcaaacttttatttgccagccaaaagttgttgaagcggctgtgctgaattgctgatttaattggctgtaactacctcatgggtacacaattctaatcttgtttcctttcagcgtttgatgatgcttttatatcaaattggtgctcttaaatttaaatgcaccatggatctgtttttagcttccattgtcattgcatgaaaactgaaattataatcatagttcgagctccagctcttccaccaaagcacgaattcagcaggaaacggtacctctgttttttgaatgttgcattgtgaccctctttttttttttgcaacgaaaacactgtttgcccctattatgttataagcataaagcatataacattgttaactcaaaagatgttttttatatccttcatcggtgcctttcttattattagagctgttgcaatgtccggtcatgggtcatttactcatttagcacggtttgtgctcgacccgtgcctagtgtcaggtcggtccgtgtttctctgtttgatgtgtcgggtcgggttttttcgggttaagtcaggtttttttggctttggtagagttttttcgagttgggtcaggttttagctcaaaaatcacggttcgtacctggcccgtgaattgttgggagtaaaaaaattatggtacatactcgaccgttgcattggttgggtcggactggatcttttttggagaggttgagtcggattggtcgggtagccgatgatcaagtctacttattatcaacttgtaaatttgccctcagtttgatataaaagtttagag

SEQ ID NO: 3408 - DNA, 1228 bp, Zea mays
ccggccgggtccctagtcccgattcccgaacaagagcgaggccgcactcccccacgagtccactctccgaccgcacgctccgcgacgcgatggccgcgctccgcctcgcctccttcaccctccgccccgccgccgccgccgccgcctcttccggcgcgactccatcggctccccggtccgcctctttctccagcgtggcgcgggggctcccctccctccgcctggccccgccccgccgccgccgcggggacctcgccaggccccgcgccgcggccgaggccgcggcggagagctacgcgtccgcgctgtcggaggtggccgtcgagaacggcaccctcgagcagacggtctccgacctcgagaagctggagaagatcttctccgacgaggccgtcgccgagttcttcgacaaccccaccgtcccgcgcgaggagaaggccgagctcatcggcgagatcgccaagtcgtccgagcttcagccgcacgtcgtcaacttcctcaacgtcgtcgtcgacaacttccgcgcgtccatcgtgccgcagatcgtcgtcgagttcgagaacgtctacaactcgctcacgggcaccgaggtcgccaccgtcacctccgtcgtgcagctcgagtcgcaggacctcgcgcagatcgcgcagcacgtccagaagatgaccggcgccaagaacgtccgcctcaagacgcagctcgacccggcgctcatcgccggcttcaccgtgcagtacggccgcgacggctccaacttgatcgacatgagcgtccggaagcagatcgaggagatcgcgtccgagttcgagttgcccgccgtcccgctcgaagtctgaggccggcttgaggcgtccatcctcgccctcgaagctatagctgcggctactgtctcaaggaaccaagcgggaatgttggcactgtccccttcagtcagacctgcggatcaacggcggtggctccaaatctccaatactactacatatgaacggacactatttttgtgcgtttctgttgacgggaacctgtgtagttctttctcctttttttccctgtggttgacagacacagacactgtaatatgtttattaaaaacactcatctatatagctgagtgtgcacctcttctctcaatcatatacaagctgagatagagtcatgggatgaggatgttgtccaccgggaagtaaagaccatgtcggctgagtgtgcactaaggctggctccagca

SEQ ID NO: 3409 - DNA, 1129 bp, Zea mays
cattgggtacctcgaggccggccggggtacgtctgtccgctcccaccccaaccccctcagtcctccccgcggggcccctttccaagtctcaaaccagagcgaggccgcactgcacgcgagtcctccactccgaccgcacgatggctgcgctgcgcctcgcctccttcaccctccgccccgccgctgccgcggcctccgcctcctccggcgcgaccccagccgcgtccggctccgtctccgtctccttcgcccgcgcggcgcgggggctgccctccctccgcctggccccgccccgccgccgcggggacctcgccaggccccgcgccgcggccgaggccgcggcggagagctacgcgtccgcgctgtcggaggtggccgtcgagaacggcaccctcgagcagacggtctccgacctggagaagctggagaaggtcttcgcggacgaggccgtcgccgagttcttcgacaaccccaccgtcccgcgcgaggagaaggccgagctcatcgacgagatcgccaggtcgtccgagctgcagccgcacgtcgtcaacttcctcaacgtcgtcgtcgacaacttccgcgcggccatcgtgccgcagatcgtcgccgagttcgagaacgtctacaactcgctcacgggcaccgaggtcgccaccgtcacctccgtcgtgcagctcgagtcgcaggacctggcgcagatcgcgcagcacgtccagaagatgaccggcgcccagaacgtccgcatcaagacgcagctcgacccggagctcatcgccggcttcaccgtgcagtacggccgcgacggctccagcttaatcgacatgagcgtccggaagcagatcgaggagatcgcgtccgagttcgagttgcccgccgtcccgctcgaagtctgaccggcccgaggcgtcctccatcctcgcccatgagatgctttggtgcttcctgctgcctctctctccctgctcttcatgtgtaccattctctgattgaatatttgagtgaatggtgaatactgcatacctggatttcaggattcatatttgaatgaatggtggatacaccgcatacctggattccaggatcgtattgaaaaaaaaaaaaaaaaaaaaaaaccggccaaaaagcggcc

SEQ ID NO: 3410 - DNA, 1791 bp, Zea mays
agcacaggcctggaaactgaatattcttgctgttatttaagaggaaactgctttgctgctctgctgtgtagtgttagaattcagactgaactggtctgtattaaactctgcctggttgcatcggttcatattattgtaacaaaattgtaaaatcacgcgtattttaacacggataccgacacttgcagtggaaatatgcccccctctctctctttttttttaaaaaaaaacagttccatgataataaactgctgtgcgcctgtgcccctcttgggtcctggctgatgaagcggttggcctgaattttcttttcgggatgactgcttctgtaaaatccccaggccccaaggcccaagcgcagcgcagacgcacaatcatccgtttcttatccacctcatcccaccactggccacacgtctccggccacgcgacgccctccagccccaccgtcgtgcgatccgtcggccacccaatcccgtacgtccgtccgcccccgccccccgccccccccccccgcagtcctctccgccctggaaggctggacctttccaagtctcaaaccagagcgaggccgcactgcccgcgagtcctccactccgaccgcacgatggctgcgctgcgcctcgcctccttcaccctccgccccgccgctgccgcggcctccgcctcctccggcgcgaccccagccgcgtccggctccgtctccgtctccttcgcccgcgcggcgcgggggctgccctccctccgcctggccccgccccgccgccgcggggacctcgccaggccccgcgccgcggccgaggccgcggcggagagctacgcgtccgcgctgtcggaggtggccgtcgagaacggcaccctcgagcagacggtctccgacctggagaagctggagaaggtcttcgcggacgaggccgtcgccgagttcttcgacaaccccaccgtcccgcgcgaggagaaggccgagctcatcggcgagatcgccaagtcgtccgagctgcagccgcacgtcgtcaacttcctcaacgtcgtcgtcgacaacttccgcgcgtccatcgtgccgcagatcgtcgtcgagttcgagaacgtctacaactcgctcacgggcaccgaggtcgccaccgtcacctccgtcgtgcagctcgagtcgcaggacctcgcgcagatcgcgcagcacgtccagaagatgaccggcgccaagaacgtccgcctcaagacgcagctcgacccggcgctcatcgccggcttcaccgtgcagtacggccgcgacggctccaacttgatcgacatgagcgtccggaagcagatcgaggagatcgcgtccgagttcgagttgcccgccgtcccgctcgaagtctgaggccggcttgaggcgtccatcctcgccctcgaagctataggtcctttttctgctgcctctctccctgctctgctattcatctgtatcattctctggttgttgaatgttttgagtgaatggtgaatgctgcatacctggattttaggattcatatttgaatgaatggtgaatacactgcataccggattcaagaaatttggtttcaaataaggaaagtgatagaaatgaggaggatgtgaccataaatttcacatgaacggtgtaggaagtagagaaactagtgtccagttcctataactgcaggcattccagctttgtcactgggccgcgtttatacaacggtcttgaactgggaaaaaccctttggcggttccccaacctttaattcggcctttggcaacaaccatttccccctttttcgccccagcttg

SEQ ID NO: 3411 - DNA, 847 bp, Zea mays
  misc_feature (805)..(805): n is a, c, g, or t
ttgggtacctcgcggccggcccccgaacaagagcgaggccgcactcccccacgagtccactctccgaccgcacgctccgcgacgcgatggccgcgctccgcctcgcctccttcaccctccgccccgccgccgcctcttccggcgcgacctcatcggctccccggtccgcctccttctccagcgcggcgcgggggctcccctccctccgcctggccccgccccgccgccgccgcggggacctcgccaggccccgcgccgcggccgaggccgcggcggagagctacgcgtccgcgctggcggaggtggccgtcgagaacggcaccctcgagcagacggtctccgacctcgagaagctggagaagatcttcgccgacgaggccgtcgccgagttcttcgacaaccccaccgtcccgcgcgaggagaaggccgagctcatcggcgagatcgccaagtcgtccgagctgcagccgcacgtcgtcaacttcctcaacgtcgtcgtcgacaacttccgcgcgtccatcgtgccgcagatcgtcgtcgagttcgagaacgtctacaactcgctcacgggcaccgaggtcgccaccgtcacctccgtcgtgcagctcgagtcgcaggacctcgcgcagatcgcgcagcacgtccagaagatgaccggcgccaagaacgtccgcctcaagacgcagctcgacccggcgctcatcgccggcttcaccgtgcagtacggccgcgacggctccaacttgatcgacatgagcgtccggaagcagatcgaggagatcgcgtccgagttcgagttgcccgncgtcccgctcgaagtctgaggccggcttgaggcgtccatcct

SEQ ID NO: 3412 - DNA, 2038 bp, Zea mays
  misc_feature (85)..(85): n is a, c, g, or t
  misc_feature (94)..(94): n is a, c, g, or t
gcatgcctgcagagttgctgttgcctgcttcacaggtcacagcacagggcctgggaaacttgaatatttctttgcttgtttattntaaagaggngaaacttgcctttggttggcttttgttggggtaagggtaagaattcaaaactggacctggtcctggatttaaacctctggcctgggtggcattgggttcttttattggaaccaaaatggtaaaatcacccgttttttaccacggttcccgacacttgcaggggaattatgcccccctttttttttttttttttaaaaaaaaacagttccatgatattaaactgctgggcgcctgtgcccctcttgggtcctggctgatgaagcggttggcctgaattttcttttcgggatgactgcttctgtaaaatccccaggccccaaggcccaagcgcagcgcagacgcacaatcatccgtttcttatccacctcatcccaccactggccacacgtctccggccacgcgacgccctccagccccaccgtcgtgcgatccgtcggccacccaatcccgtacgtccgtccgctcccaccccaagtccccaaccccctcagtcctccccgcccgggacctttccaagtctcaaaccagagcgaggccgcactgcccgcgagtcctccactccgaccgcacgatggctgcgctgcgcctcgcctccttcaccctccgccccgccgctgccgcggcctccgcctcctccggcgcgaccccagccgcgtccggctccgtctccgtctccttcgcccgcgcggcgcgggggctgccctccctccgcctggccccgccccgccgccgcggggacctcgccaggccccgcgccgcggccgaggccgcggcggagagctacgcgtccgcgctgtcggaggtggccgtcgagaacggcaccctcgagcagacggtctccgacctggagaagctggagaaggtcttcgcggacgaggccgtcgccgagttcttcgacaaccccaccgtcccgcgcgaggagaaggccgagctcatcgacgagatcgccaggtcgtccgagctgcagccgcacgtcgtcaacttcctcaacgtcgtcgtcgacaacttccgcgcggccatcgtgccgcagatcgtcgccgagttcgagaacgtctacaactcgctcacgggcaccgaggtcgccaccgtcacctccgtcgtgcagctcgagtcgcaggacctggcgcagatcgcgcagcacgtccagaagatgaccggcgcccagaacgtccgcatcaagacgcagctcgacccggagctcatcgccggcttcaccgtgcagtacggccgcgacggctccagcttaatcgacatgagcgtccggaagcagatcgaggagatcgcgtccgagttcgagttgcccgccgtcccgctcgaagtctgaccggcctgaggcgtccatcctcgcccatgagttgctactgtctgaaaggtgtggcaagaatcaagcgggaatgtcgttgggcctgtccccttcaggcctgcggatcagtggtgggggctccggatctgcaatacatatcaacggacattcttctgtgcgtttctgttttccattttttggcgggaacctgtgtaaaagtttctcctttttgattgtggttgagagacactgtaatatggttaaaacacacatatgtagctgggtctgcacctcctctctccgatagagtcgcgaagaattgtataggatgagtttgcgctcccttaacctcgccgaaaagtacatcaggcgtagttcactcgtgcactctgctgcttatgttcgtttgagattaccgagctttcatgctgaggcatgaagcttgttcggtcattagttgcactctagtttcggtcagtggtccgggtgtcatcgttttgccgcaacccctgagctcacgacgaaggcgtgcagtaaacaaaccagtgatgccgatgcgtactcgatccctgccgacgaactaaccgtccacagtgaaactgcatggcacaaatccatggctgtccatggctctccaatag

SEQ ID NO: 3413 - DNA, 3840 bp, Zea mays
  misc_feature (3707)..(3707): n is a, c, g, or t
aaaatggtgggagggattaaacaggttaaactattgttcaagggagtagagatattttgcaacccttaaataatggatagtgtcttatcgttatagtttcctatcatatttttatgtaccaggcataatttctgatctaagctgtcacctgtaagtttcgcagcagcttatctcttcatcattgtgttaaccttgtacattatgcagaaaatggttgtctttatcatgcattgaggatgtctggaatgctatcacaaataattagtgtttttatatcagtgtatattataaatatattatcaatgtattcttaatgatgaagaggaacaacatggaatacccaaggtggacaaggctagcacaccgaggtcaagtttatcctccaggaccaaccatggaagtgaatcttctgatgatatttgcctatcattaagaattatatattgactcttttgaaataatttgtgcaatattgataatgtttgttcaacatcagttcaatctatttgggcctacgtatttatagttgtattacatatttatattatcaacataatgttagtgttgcggtgatattttgcatcacgaatttacaatatcatagtgatgtttgtggttctgtatctatgtttcatactaatttttttattatcgtggcaacgcacgggcacatacctagtaaaaaactatacctttgaccttgcattcttatcaggaccgtccagcccaaaacgaggtcggtgggtccctgttgcgcaaccttatataaactgagaggtgggggttgacagctaacaatacgaggttcacacatcgtatatatttcccacctaaaccctggactgattgagagggtgagttgtcagcaacgagaagttcatcgccagcaaagatcacttcctcaattgttgctaccctagcatagatcttcactagcgaacgtggtagcgattagatcgaaggtataatatgtttttagtattgatctaatggttaggtttttagaagaaccaaaagatccatcagttctaccatagaacaatcattaatcattctatagtatcatactgttacatgatatacaacttactactagcatcaaaaactacatttggtctcaagtgtatctcatgtttccttttcagtaggcaaagtctcgtatgcattgactaccatatcctcaagcacgttaattattgctctttgaatgtagtatatcgtgcttcgggccaaacagggttgggccaagaaggctcaaaaaacttttgcgttatgtcgtgctagcctaatgaatagaaacagtggtccaacctgtccctaaatcacgttgtgtctttattaggccgtttcagcccaaacttgtcccatatatttgaaccacataaagtctaaatattacaaccacataaagtgtataacttactaaattaaatatattaaacaatatgatcatcattgaccatgtaaaatcaaaatattacagccatataaagtccatagcttactaaattaaagaaattaaacaatatgagcatcattgggctgtgttggcccaagcacgatccatgcatacgggcacgatccatgcatacgggctgtgccgggggcccggcgggccagaatttgaggcccaacccagacccgcctttaggctatgctagtttggtccatattattttgtagtgagctatgttttaggctcttgtttttaggccatatttatattggcccactaagtatgagcctcatggcgctcatgctcgtcttcgagagtatgtggttctactaactataaaatagcaaacaataaaatagcaagctagctaggcactataatatgaagcatggttttggaaatatttttttgaggtaaaataaaaccgttttttacttcctaaatcgaagtttaggattgcttttaccgaattattttcatataaaaatagttgaataattaatatttttaaaattaatttttatgattttgagacgtttttagaacccgttgttctatttattacttccaaaaccatcattattgttgttgtctgacttatcatctctgacgcgacaccacgtcggtaaaatcatcaccaaaatcatctaaaggcttgtttggtttcatgtaatccatgtgaattggatggaattcatagtaagtcgaaatatatttcaatacatctcatcccatccaatctatatagaataaaaataatcaaacaaggcttaaagcggaaaacaaatggctgtaaaaattgagggaggttaaagtaatagttttataaagcttggtgacgaaatcggacaactgttagttacgcgaggtaaattagatcttattttttttagaaaagaacggtaattctggcagtttcagaacacagcactctggtttgtaagtatggcccacagtggcggaggcagccgggtaggtgggcgttgggcgttgggcagccgggtagcgtgcttttgagcccagagccccatatcggcctgcctcgcgcgctcgccagacccgtcctgcgactcatcaacgcacagcagctgctccattcagtttactgcacaccctacagacgggggcgtactgttgtatcggcaatattcttcccgttttatattttttatttactgctcgcttcattctgaattcaaaataatattccttagtctaagtaaaaaatcctaacaacttgttcggtttcattagaattcatataattagaagggattaggtggatttcaattcatagtaagtcaaaaaatttatattttttttcaatcccttctaatgcatgggttttagaaataacggaacaaagtctaagaggttcaaagtttttgataaacagtggctgattttcttccagttttaaatgcgcatgtaatttgttgtgtggctacctaccctcttgatgatagaagtcattccatagagtaaaatgctcattgtggagttgtgtggaagcgtctcgatgcttctgtgaacaagggtaccatgaaaaataatataggaacacacgaacgtaggaggacacatgcctaatcttacctctacattgatctagcattgatacttgagatttacatgttttcaacactggagtgagtacacttgtaagtgtcttgtaagagtctgtttgggagcaaagttttttctttgctaattccaataaaataccatggtatttaacaatactttagtaaaccatggtattatgaatagactagtaaaatacaatattgaaaactttagtgtaagctaaagttttttctcgtctcacttgcgaaactgtggtattgaaatactttagttatactttagcattaaaaaaatacagtattgtaaaagtattgtaaaactgtggtattaaaaaaactgtgcccacaaagaggccttaagatttaaattttgccctaaaataaatggctaaacgattcaaggtccgaggcatggcatagaagacatggttgacagctcgttttgtgtcggtttcccgctcactgttgaaaacagtaaatttaccgaaaactgttgaagtccgaacgatttggacttccaaatttgatttggcgtgttcgccattctcggtcgagaaaccactgcaaactagcggttttcgctgccagtagaccaagaaagcattgtaacctcaataaaaattattattttttacgagttatgtttataaattgtttaaatcacnatgcatattcaagaataatatattcacaaaaatggatgcccaaaatcaaatgaaacatacttatgcaaaagaaaatgcaattccagtgcaacacaaagcaagaaggttacaatagtgacatacaagtgtatat

SEQ ID NO: 3414 - DNA, 2310 bp, Zea mays
cttcttggacacaaacaccagagagagcagtagcggggacggagtgggtgcccgggccgggcaccagcggaaggaagaggttatcggcggcggtagacctcacggcgatggatatcacggaggtaacggtggtgcaccacgcagcgctcgtgctggcggcgctctgggtcgccgcggcatccggctggacgcacccggcgctcttcctcgtcgggctcctgtacatatttgcggtgaatcaacggtacacaatgaggctgtggaggcgggtctggtttacttctcatttcattatatttttggaccagcttctctctgatgcagagactgtcaggtggcttaattacgctgtggaaaagatttggccagtttgcatggagagggttgcatcccagcagttccttttacccatattcccgtggttcctagagaagttcaaaccatggacagcaaggaaagcagtaatccaaagcctttacttgggtaggaacccaccgatgtttacagatattagggtagttaaccaatcaaccgatgatgaccacttggttctagagatagggatgaattttctttcagctgacgatatggatgcaagaatggctgtgcaactaaggaagagattaggatttggcattacaacaaacatgcatataactgggatgcatgttgaaggaaaggttctggtaggggtgagatttctgcggcagtggccatttattgggcgtgtaagagtatgctttgttgagcctccatacttccaaatgacagtgaaaccgctgtttggtcatggacttgatgtaactgaactcccaggaatttctggatggcttgacaggatgctggatgttgccttcggacagacacttgtggagcccaacatgctagttattgatctggaaaagtttgcctctgaatcaacagataactggtttagtgttgatgagaagccacctatcgcatatgctcgagtggagatcctggaaggtgctgatatgaagccatctgatcctaatggactagctgatccatatgtgaaaggacaacttggaccctaccgttttcgcacaaagatccataagaaaactcttgatccaaaatggctcgaggagtttaaaataccaataacttcatgggaagcactcaatcttcttcatcttcaagtccgagataaggatcccatttttgatgacgctcttggcgattgttccataagcatcaacaagttaagaggtggaataaggcatgatatatggattgcactgaagaacataaagacagggaggattcacgttgctgtaactgtacttgaagaagaaaatgaaaaggtttctaatgatgaagaggaacagtgtggaatacacaaggttgacaaggctagcacaccgaggtcaagtttctcctccaggaccaaccatgaaagtgaatgttctgatgaattccggaagatgtctgatgaatttgagccagttgacatagaaggatcggcaaagcccgatgtttgggtgcatcgccctggcagttacgtcaccagtacatgggaacctcggaaaggccgtccccggtgccaggattccagaattcaccgggagaatgattcttgtagtgatagcccaaggtcatcagtgtcaggatctcatagaagtgactccagcactgaagaacccacgagcagtaaatcgcatcgccaccttcaaaaggtcaagaagggtttgggcaagctagctggagcagtgctccaccggagcccaaaggagaatgatgacgaagcttccccatgtgtaactcctcaccaaaacattcgaccggtcggggaaagcagggtttcagtaacatatgtggtcgatcaagatccagcaggggttgacggatcggggtcgagacgagatgaccaccagcaaagccctgagagagaggagctggacagcccgagtaaaaggcatctgaggaagaaggcggtgcacatggtgaaacatgctgggaaaaccgctcataacctaaagagcatgttcagcaagaagggccttgacaagagcaaagaagaacaccgcagtgatgaggaatgcgacgaggaaggcgacgttgttgctgctagaagagtgtagaatatgcaaggcttagttctattcctttggcgttgtaggatacatatagtatgtactgatgaagtgttgcacaagaggcgcttgggccatgggtctcatcggctaaatagagtattacataccacatttgacaccctctcacaaacttagacttaggtgatgcttgatcacgaagataaaaatgttccgtttgacggtgttacac

SEQ ID NO: 3415 - DNA, 1585 bp, Zea mays
  misc_feature (180)..(180): n is a, c, g, or t
gaggagggatggacggcgaatctggtagtagacagcggcggcggcacactgcggaggagtcgagtgtggcggcggtggggaaagtgacgggagaaatggtgaatgggcacaatagatcgggaagaaacgactccttacgtacaaggcagatacgcctttgttgcttcgttgtcgagccgnggtctgaaaccgttccttcgtcaagagtcgacttttttgtttttttgcaaaaaaaaaaccctagacacgactcaagacacacgttattaattggttttgtacctgccctaatagagaagcatgttaaaagaagtacaataatagcaaagaaaaactcgataccgaggtagtaccacatggcttctatgatgacgcagtgaccggaacgacaccgaaccgcgaacgaaaacgtaactttttgaaagggctaaaataaaaaattttgccctccccggctcccccctcccatttgcgccgccacgtgcccgctcagcttgaccaggtgacgagcccgctagctgccacgttcccccgcggtccgctgccgcgccacgcagccagctcgtatagaaatatatacggaagtactagtatttctcatcatctgaccgccgcccatgaccgaaccgaacaaaccagcggagcgtgcggtgggtgatgataattcccacatccgctgctcggggtgcggtcggcgcgtgagaccgtgcgagagagccagagagggcacgcaggacaccaccgcggcccctgccccacgcccacatcggctcccgcgtcggccccgcgtccatccggccgcctttccgctcaccgtccgccgcttcttctcccctgtgggcccgtgacctggcctccctcccacctcgccccgccgattcagctccccttcctcgacgcaggcatcggggccactcatgcataacgttcgcacggtgttccgcttccgcccgtcttgagaaactaaaaacacacagagagagcagtagcggtagcgcggacggagtgggtgcccgggccgggcaccagcggaaggaagaggttgccggcggctgtagacctcacggcgatggatatcacggaggtaacggtggtgcaccacgcagcgctcgtgctggcggcgctctgggtcgccgcggcatccggctggacgcacccggcgctcttcctcgtcgggctcctgtacatatttgcggtgagtgcgcatgctccatccacccgcccgccggagtctctctctctctctccttcttgcctcggaccgattgcttcggtcccccgttgttgccgagaactcgatgaattagtcaaactctggctcccgtttcttcaccgctacatttaggtgttcgatttatatattgctcgtcttaaatttttttgtggactttcatgtattcccctccttgttttcgactcagctgcattgttacgagctagtaaaggttagagataaattgacgaacacgctgtctttggttgctgatcgagtcattaacccatgagaacgtcatgtctgaccaaaacgggccttagtcatagaattgacgaaagcaaatcgttatcatacttaagatgctggaga

SEQ ID NO: 3416 - DNA, 3248 bp, Zea mays
  misc_feature (566)..(566): n is a, c, g, or t
aatgtgaatcatgttcacaccattgtgatcctgacaatctttcttttgggttcgcttgacaaggacataaatccttccccatggtagtcaggtttgttccttgttctcctacagaactctttattgttaattatctaatagatatcgtaaacaatatttatagacaatgtgctctggtcggaaactctgagaatatgaatatgccaattttcctttagtatgattatttattgctttgtcaacaaaacacttcagcgaatggttctcatggcactttccatatattagcgtcggtacatgagttctcctttttatacttggtaatttacagtctgtgcatggtgactttgtctgcagatgactaccgtaataaagatgaagttagtgttctcacggaggaattcaagacccaacttaccattagggaggatctgttcatcacaaccaaggttgtctgatttacagaatgatacattttgtattatggaggactggcctttccaaaatggatgcgaccattaaaattgtgccccatgaattggtaatgagggttgggatgtcatgcnctgctaattcactcgggatgtatataatttgtgtgatataacatttgtctgtaattaaaaattctaaattaactttttagaaataatttgtgtgatgttgataatgttttgcacacggattttgcatattatagtgatgtttgtcgtttcgtattaatgtttcatacaaatcttttacttccgtcgcaacgtacgagcacatatttataacaatataacacagatatgtacataagttatcatgttattatacggttccgttgcaacgcacgggcactcacctagtaagttttataagcattcaactactactctccatttcacactgtataaactaatttcatcattacttttatttacactttgcggcacactttcataaaggatcattttcattttgaaaattgataaattccaatttcttggcacatttattattttatatcaattaaatgtattactatgtatgtatttataggaattgtaaaagaatatataaatatggtaaaaaaattatgactataaacttaataaaacgaattgatacttattataaggttatgtgccaaatcaaacaagtatctaaatgtgaatctgaattcgatctatccttttgtattcgtattctataatatttatatcgtataatattcacatttgtatatgaattaaattaaatatggtaaatagtgagatggtctttatgcgtatccgatggttgtgatgtcggatcgcgcttgcggcttgccgcagtcgatccgaatcgcaacgcccgaatataccactcctccctgcttgcctcccgctgatatgatatccgtccattccaatccccctcttccgctccgcctccctctagctcctctccctctcgcagccatcctcgtccccccaagaatccggacgtcgtttgtcccctccttttctggtaagcacttgctgccttgctcggatgggttgctgcttctgttcggcggattctttgttgcgagcttctatattcaaatctctacatccagcttgctgcggattcgcttgcagttagagaccgacgtgtttgaggttttagctgtcccggatataataaactcggtgttttcttcatttgttcggaaactttagttattttctcttaaatatgcttgttagaagagcgattggggaagaggtctcacttattgctgggagcataagctttcattaaaaaaggtataatagttaattgggataatgtgtctttgaatctgtatatcaaaaaagggacaagttcacaaggctaagacaagtccacaggaactaatacaagttacagtatgttgtcaaatgtcaattgaaggaagtagtgttttcctatctaacttgctctgtatgttcatctcctctccctctttgctaccggccggtgcagccatcctctccccctaagaacccggacgtcgtttgtcccctccttttctgggcgtttacatctttaagctcaaagagaaaggattatgaaaatggcgcacttgatcactaattgcagctttcagacattctcgagttctcctaattactgccgcaatattgggcaactacagaactcaaaatcttcaaatctgtccctcaaatcctgttccaggagacaaaagaagtcatatgttacctgtgctagcgctgccgtacaaggacagacacaaacacctcttactggtagccagcaagcttatgagcattcatcctccaaacctaaaaaggtaatggttattggtggagatggatactgtgggtgggcaacagcacttcatctctcaaacaaaggttatgaggttgcgattgttgataatcttgtccgccgtgcttttgataaccaactcggtcttgattcccttacccccataacctccatccagaatcgtgtccgtagatggaagtctctcactgctaagacaatccagctctttattggtgacatatgtgattttgaattcctctcagaaaccttcaagtcttttgagccggatgccgctgtccactttggcgagcaaagatccgcgccatactctatgattgatcgttcgcgggcagtctacacacagcataacaatgtcattgggacacttaatgtcttgtttgccataaaggaatacagtgaagagtgccatcttgttaagctaggaactatgggtgagtatggaacaccaaacattgacatcgaagaggggtttatcactattactcacaatggaagaacagacaccttgccttatccaaaacaagccagctctttctatcatctgagcaaagtgcatgattcccacaacatagcatttacatgcaaggcttggggtataagggccactgatcttaaccaaggtgtggtctatggtgtcagaacagatgaaactgcaatgcacgaagagctatctaacagatttgattacgatggggtctttgggaccgcactaaataggttctgtgttcaggctgctgttgggcatccacttacagtttatggaaaaggtggtcagacccggggatatctggacatcagagacactgtacagtgcgtggagctagcaatagctcccccctgcttcttttttgaaatatgtctatggtcgaaattgttagcgtgcatcaatcagatcaatacttaaaatgccagtggttgaaatcactactcgcattttgtcataaatc

SEQ ID NO: 3417 - DNA, 3017 bp, Zea mays
  misc_feature (1223)..(1223): n is a, c, g, or t
  misc_feature (1298)..(1298): n is a, c, g, or t
ttttttttttttttttagattgccgatgtgaccatttaatagagacggtccctagatgtgtttgtctctattatctttccttcatcagtcggtgcaatatacattaatggatcgttttttctccaggccacaaatcggcaatcaagaaacgctacttccaccacacggaggagctgctacgcggccaccctgcattcatcgaccggtccatgccatcgttacatgagcggcaggacatcatggctagtgccgttcccgagctcgctgccgcggccgcagttgacgctatcgccgagtgggggcgtccagccacggagatcacgcacctcgtggtgaccacctactccggcgcccacatgccgggcgtggactggctcctggcctcactgctcggcctgcgccccaccgtgcgccgcaccatgctctacatgaacggctgctccagcggctgcgtcgcactccgtctcgccaaggacatggccgagaacaaccgcggcgcgcgcgtgctcgtggcctgcgccgagctcacgctcgcccatttccgcgcgccgcacgaggcccacgtcgacacgctcatcttgcagtcactgttcggagacggcgcgggcgccgtcatcgtcggcgccgaccccgtctccgtcgaagaaccggacttcgagatgctgtccgcctcgcagaccatgataccggagagcaagcatgtcgccgccggccagctctgtgaggatgggttccacttccacccttccagggagatcccgtccctggtacgtgaaaacatagagcagtgtatggttgacgcgctctcgctgctcggcatcggcggcagctggaacgacctcttctgggcggtccatccgggtgggcgcgccgtcttggacagcgtcgaggcggggctcaggttggaaccgcacaagctggaagcgagccgccgggtgctgagtgagtacgggaacatgtctgggccgtcggtcattttcgtgcttgacgagctccggcgccagcaagagagaaaggggatgggggtgattcttggcttggggccaggagtaagtgtcgaaaccatggttttgcaagcaacggatagccaaaagaagatttaggctctctttggcacgtaccccttccgtctgcggcactagccgttgaactctgaaataatgttgtcactaatatatggtgctacacagaagccttatagtggcaattctatagctatttgnactgtcgttgttcagtgccgtcagtgctagggaccaatagaaatcggccttttcactggcggttgttttgcaatngcaagtggaaataacattagcactgacgggttgtttaagaaaaccgtcagtgaaaacaacatttgcactgacggttttcttaattaatacaaccgtctacgtaaataacattagcactagcggtgtgcttaagaaaaccgtcagttctaatgttatttccactagtgattttcttaacactccaattgcggttcacttaacactaccgaaagtgtaaataactctctttgtggcacgtaccgcttccgtctgcggcactagccgttgaactctgaaataatgttgtcactaatatatggtgctacacatagtggcgatcctaaagctatttgtagttgcgtttttcagtgtcgccagtgataggggccaataaaaatcggtcttttcactggcggttgttttgtaaccgcaagtggaaacaacattaacactagcgggttgtttaagaaaaccgctagtgaaacaacatttgcactggcggttttcttaaaacagccacatgcgtaaataacattagcactagcgcggtgcttaagaaaaccgtcagtgctaatgttatttccacgggcggttttcttaacactccaattgcggttcacttaacactatcgaaagtgtaaataactcttttccactgacggttcacttaaaagaacgaccatcattttcactggcggtttacttaaaacaatcaccagtgtaaatagctcttttccactgacagttttattaattgaactgccagtgtaaatagctcttttgcactgacggtttagttaagtgagtcgctagtgtgtatgatatttccactcgcggttcacttaaaacaaccgccaatataaatatcttctttccactggcggttcagttaagtgaaccgtcagtgtaaatatatttacaccagtggttccttaaggtgggcccacctgtttattttcattggcgcgcggtaattaaaactaccggtataaatttctgtgtgatgccagtttagagctcttttctactattgtctaagatgtaatccgaagatccacgcaaaaagctatggtccgcatatttatccaacatcgtgccactaatgcatctccaaaagtatccattaatatcgttctcttaaattggtccccactatttgtagcggatgatgtaaaatagggctcgcatcaatatagataatgatactatttgcaagattgaagtttaaaatagatgatctgttggagataatcttatatcttaggacagggagacacatttagctagctccagcagctttacatatcctatctcttatcacatctattatttgaaacgtcactctataaacagtgcagtctacagtgtaaattgtgttttacacaaccatattcacgatctgctggagaccgtcccacttgtttaggcactgtcatgctaaatgttagtagctaacaattagctggatgtattctatatattttttctcaatagctagtccaaccctacatcgtcaccatcttaaggttgtcttcttcgatagattgcataaaatagagaatgccgaactttgcagaagatggcctaaggattgaagaccctaaatgagttactgtcctctcgtatagtctcgtaggagtagtgaaactcacgagtcacgagagcgagtatgattgccgaccgagattgcatctagagagttgacccttagatcggatagaggcgacccagcttgcgccc

SEQ ID NO: 3418 - DNA, 1882 bp, Zea mays
ttgggtacctcgaggccggccgggcgcgcctgcggcttgccgcagtcgatccgaatcgcaacgcccgaatataccactcgcaccttcgcgccccgggccggcggctgatatgatatccgtccattccaatccccctcttccgctccgcctccctctagctcctctccctctcgcagccatcctcgtccccctaagaacccggacgtcgtttgtcccctccttttctgggcgtttacatctttaagctcaaagagaaaggattatgaaaatggcgcacttgatcactaattgcagctttcagacattctcgagttctcctaattactgccgcaatattgggcaactacagaactcaaaatcttcaaatctgtccctcaaatcctgttccaggagacaaaagaagtcatatgttacctgtgctagcgctgccgtacaaggacagacacaaacacctcttactggtagccagcaagcttatgagcattcatcctccaaacctaaaaaggtaatggttattggtggagatggatactgtgggtgggcaacagcacttcatctctcaaacaaaggttatgaggttgcgattgttgataatcttgtccgccgtgcttttgataaccaactcggtcttgattcccttacccccataacctccatccagaatcgtgtccgtagatggaagtctctcactgctaagacaatccagctctttattggtgacatatgtgattttgaattcctctcagaaaccttcaagtcttttgagccggatgccgctgtccactttggcgagcaaagatccgcgccatactctatgattgatcgttcgcgggcagtctacacacagcataacaatgtcattgggacacttaatgtcttgtttgccataaaggaatacagtgaagagtgccatcttgttaagctaggaactatgggtgagtatggaacaccaaacattgacatcgaagaggggtttatcactattactcacaatggaagaacagacaccttgccttatccaaaacaagccagctctttctatcatctgagcaaagtgcatgattcccacaacatagcatttacatgcaaggcttggggtataagggccactgatcttaaccaaggtgtggtctatggtgtcagaacagatgaaactgcaatgcacgaagagctatctaacagatttgattacgatggggtctttgggaccgcactaaataggttctgtgttcaggctgctgttgggcatccacttacagtttatggaaaaggtggtcagacccggggatatctggacatcagagacactgtacagtgcgtggagctagcaatagccaacccagccaaacctggcgagttcagagtcttcaaccagttcaccgagcagttctctgtcaatgagctagccaaactggtgactgcggcaggagcgaaacttgggcttgaagtggagaccaaatcgatacccaacccacgagtcgaggctgaggagcactactacaacgccaagcacacgaagcttattgagctcggcctggtgccccacctgctctcggactccctgctcgactcgcttctcaactttgccatccaatacaaggatcgggtcgacacggcacagatcatgcccagtgtgtcgtggaagaagatgggtgccaagccacggacagtctctgtttagagggtgattcaacttcccctgggttataatatcaaccatggcattgacattattgacatatgtaatataataattatgcacgttagtatgatttgctaggtagtgaggtgtttattacgatattaaattatattgttgcccgtgcaactcaagagttcatgtgagaaaaaaaaaaaaatcactcgagccgccttgaggtct

SEQ ID NO: 3419 - DNA, 1081 bp, Zea mays
gcacgagaaaaccgtatgggcccccggccgcccggccggggtcgtcaaaaaatccccattcgttccccttctcgcctccacgagccttcacaaattgccctctcagctcttctcctaatctcactctagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactcctcgctcgccaccgggaacctccagaagatgtccgagaccatggacaatttcgagcgccagttcgtcaacatggaggtccaggccgagttcatggagggcgccatggccggctccacctccctctccacgccggagaccgaggtcaacagcctcatgcagcaggtcgcggacgactacgggctcgaggtctccgtcggtctgccgcaggcagccgcccacgccatccctgccgccaaggataaggagaaagtcgacgaggatgacctttctcgccgcctcgccgagcttaaggcccgcggctgagaggttgtttcaggctttatcagatgcgattcaggcttatgctgttgagccgcaatgacccattgtcctgtggactgctactcatgtttggtagattcgtaaatactactgttatatgcttgaaggcgtgtgttggcattgccatgtggggtttgtgtgactcgatggaaactttgctgtcttattgtactttaaaatccaataatttgcgcgattgcggacaaaaaaaaaaaaaaaaaaaaaaaaaaaacgagggccgcgtgcaaaaaaagcggcc

SEQ ID NO: 3420 - DNA, 1121 bp, Zea mays
  misc_feature (1096)..(1096): n is a, c, g, or t
gccggccgggtccggcattggctacccccgggccggccgggggctcttcgcccagatcaaaatcgaatcgatcccccaacccgatcgcctcgtcgtcaaaaaatccccattcgttccccttctcgcctccacgagccttcacaaattgccctctcagctcttctcctaatctcactctagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccggctccacctccctctccacgcccgagaccgaggtcaacagcctcatgcagcaggtcgcggacgactacgggctcgaggtctccgtcggtctgccgcaggcagccgcccacgccatccctgccgccaaggataaggagaaagtcgacgaggatgacctttctcgccgcctcgccgagcttaaggcccgcggctgagagggtgtttcaggctttatcagatgcgattcatgcttatgctgttgagccgcaatgacccattgtgctgtggactgctactcatgtttggtagattcgtaaatactactgttatatgcttgaagccgtgtgttggcattgccatgtggggtctgtgtgactcgatggaaactttgctgtcttattgtactttcaaatccaataaattgcgcgattgagctcgtgggggggcccgggtcgncaaaaaaaaaaaaaaaaaagcggcc

SEQ ID NO: 3421 - DNA, 938 bp, Zea mays
  misc_feature (835)..(835): n is a, c, g, or t
  misc_feature (888)..(888): n is a, c, g, or t
  misc_feature (904)..(904): n is a, c, g, or t
cattgggtacctcgaggccggccgggaaaccgatcggaggtgttaggctcttcgccagattaaatcgaatcgttgcccccgacgccgcccggggcgtcgtttaaatccccattcgttccccttctcgcctccacgagccttcacaaattgccctctcagatcttctcctaatcttactcaagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccggctccacctccctctccacgcccgagaccgaggtcaacagcctcatgcagcaggtcgcggacgactacgggctcgaggtctccgtcggtctgccgcaggcagccgcccacgccatccctgccgccaaggataaggagaaagtcgacgaggatgacccttctcgccgcctcgncgagcttaaggccgcgggctgaaaaggggtgtttcaggctttatcagatgcgnatcatgcttatgctgntgagcccgcatgacccattgtgctgagactgcta

SEQ ID NO: 3422 - DNA, 969 bp, Zea mays
aggacacggtcgccacacgacgactcccacgcgcagccaccgcacggccgtgttgccaccaaaccgcgtggcggtgctacgctctccgcccagatcaaaatcgaatcgatcccccaacccgatcgcctcgtcgtcaaaaaatccccattcgttccccttctcgcctccacgaaccttcacaaattgccctctcagatcttctcctaatctcactcaagccctagccaaatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccggctccacctccctctccacgcccgagaccgaggtcaacagcctcatgcagcaggtcgcggacgactacgggctcgaggtctccgtcggtctgccgcaggcagccgcccacgccatccctgccgccaaggataaggagaaagtcgacgaggatgacctttctcgccgcctcgccgagcttaaggcccgcggctgagagggtgtttcaggctttatcaggtgatgcgattcgattccttatcctagccccgcgtgaccttagcctatgttttgctgcggtagc

SEQ ID NO: 3423 - DNA, 2702 bp, Zea mays
  misc_feature (1176)..(1176): n is a, c, g, or t
gctagttaacccaaaaaattattttttgctagtacaacatggccagcttcgaccaatgatacgccgtctaggtggttcccgcggacgcagtaacttattcccgcctagatacgccgttcccgcgtgaatcttccgcctaagcgcgcgagtgaaacagcccggcccaggggttctcttttgcgtctgccgttggagaatgttacaaatgcgtacgcgaccttgtgctctggcgcgaggcagattactgaatacatctctaattttaggtagcatggttggagacagtctaaggcgagcaggcgaccaataaataggcataaatgtcgtggtcatcttttctaagaacagaacaaaagaaaacgttttaaccaatgacaaatgtgagtaattccacctaaactttaagagtgagttaaaaatacatactagattttgactgcttatggtagagttggaatgtttggctaaaattttataaagctaagctagattttgtaaagtgaagcaaatctaaacgctccttaacaaaatggcttatattctcgatagaattgttagaatccgaaaagagaaaaaaatctttaaaattgacttgaaattgattttcgcttttactagaagcatataagagcaactccaacagcctagctaaatcaattagtatcggtaaaaatagaaaaacggcgctcaaaactcgatccaacactctttcttcgcttttctttcccgctaggcatcctgttaagatcgctaatcatctttggtgagcacactcagctcaccatctccgttcccgtggctgtgagcttgcctgcatatacgatgaacacggattgaccgcaggggcgacgccagaaaataaagttattggggtctgttttactaatcatcatctaaatacactagctaacaatatatttgtatagtatttcttaaattttataggggtcaagtgacaccaataaaaccccctagcttcgcctctaattgaccggtacaacagttcaaaaaggcaaagaacaaaataggtcacgacgccacacactttgctgggtctatctcacggtacctcttttcaagttgcttgaagttcttcttggcaatcgcagtctacaacaacaacgccaaaccgacaagtgattgataatgttgtgatgatagatatgcagtatacantatgtgtgtagtaccttatctcgtactttgacggtcggatcggtacctcgagtggcggtctgttgtcaaatgatttccacaagaattataaagagtttgttttaccttaatgtttaagaagttgtctatttttttaagttctcatgaaactctaaatttagctagaattatacatagactcttggagttgctcaacacatgatatttcttcttctagttttaaatgcagtggttttgaccggatctataacgtttataccacgcgctgtagcacgatctacggccaggacacggtcgccacacgacgactcccacccgcagccaccgcacggccgtgttggcaccaaaccgcgtggggtgggtgttaggctcttcgcccagatcaaaatcgaatcgatcccccaacccgatcgcctcgtcgtcaaaaaatccccattcgttccccttctcgcctccacgagccttcacaaattgccctctcagatcttctcctaatcttactcaagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccggctccacctccctctccacgcccgagaccgaggtcaacagcctcatgcagcaggtcgcggacgactacgggctcgaggtctccgtcggtctgccgcaggcagccgcgcacgccatccctgccgccaaggataaggagaaagtcgacgaggatgacctttctcgccgcctcgccgagcttaaggcccgcggctgagagggtgtttcaggctttatcagatgcgattcatgcttatgctgttgagccgcaatgacccattgtgctgtagactgctactcatgtttggtagcctttgatcattgttgaagaactgctatcgtgaatcgtgagtgtgatgctttataaaattgtgcccaattgcatgtgaaggtggtcaggtatgtatatctactacctgttgaaccaagctttttagcgatttgagttgtactctagagcagataactttagcaaataatggcgtaccttagcaatggtataagaatttcacaggaattagttcaaaaaatacaggaaaacacaggattcaagaaataatcc

SEQ ID NO: 3424 - DNA, 1155 bp, Zea mays
caggacacggtcgccacacgacgactcccacgcgcagccaccgcacggccgtgttgccaccaaaccgcgtggcggtgttacgctcttcgcccagatcaaaatcgcattgggtacctcgaggccggccggcgtcgtcaaaaaatccccattcgttccccttctcgcctccacgaaccttcacaaattgccctctcagatcttctcctaatctcactcaagccctagccaaatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccggctccacctccctctccacgcccgagaccgaggtcaacagcctcatgcagcaggtcgcggacgactacgggctcgaggtctccgtcggtctgccgcaggcagccgcccacgccatccctgccgccaaggataaggagaaagtcgacgaggatgacctttctcgccgcctcgccgagcttaaggcccgcggctgagagggtgtttcaggctttatcagatgcgattcatgcttatgctgttgagccgcaatgacccattgtgctgtagactgctactcatgtttggtagattcgtaaatactactgttatatgcttgaagccgtgtgttggcattgccatgtggggtctgtgtgactcgatggaaactttgctgtcttattgtactttaaaatccaataatttgcgcggttgcggacaaaaaaaaaaaaaaaaaaaaaaaaaaaaaaaaacggccgtgcttctagag

SEQ ID NO: 3425 - DNA, 7710 bp, Zea mays
tttgtgaggttttctctccctgggtttagtcctccttactcccaactagggctagtttggaaacttaaattttcttgggatcactgccattttctaggatgagcaatcctagggagtgtcattttaataagatatttggttatttatagaaggttttctctccttgggtttgtttacccttgcttccaatataacccgctagtttgaaaacttaaatcccctttgggtttggagattgaacggggaattagcttattttattttattcgccttcaattcccaagggctttgagtttccaaactagccctaaggccttgttccagtgtagagcttgttcggttaggagtgtattaaatggggttagagggaattaaatcccttgctagtcaaaattgaatatgaagggagttaatacatatcattcctctcttatctccatgcaactggacaaggtcgtatgggaatcaaaggggattaaatctctttccattcaattttgactagcaatcgatttaatccccttcaactttggctcagtcgatatctaagcgtgtaatcttcttcatatttgcattcatcaatttgtcatacacaaaatggatgcatggtattacgtttatgtggcttgaacctctataatccatccatgtgcacatatccattgtagtaccttgaatctagcgatcctcctccctacaactctcattatatccctaattccacattctcctagagtatgtagtgtcgttgtacgatgacatttagcatgctaggtagggttcagttggagcgtttttttgtgttgtgatggaatcattgtcatactcgctcgatggagcaattatctatctctaacaccagctccgcaactccagtcacgagatgatagtgcattgtggacaaggagtgtgagggtgagggcggtggcgagggtgtggcagacgataatgatgtgggagaggtgagtgacgacgagaaggatctgactatgtaagggatgggtgtgtctagtgcattgtggacgcggagtgtgaggacaagacaacgatgaggccaaggtttaataacatggtcaaccgacatgttgcatttccggcttcagtggccttggcgcccacaggcgcgatcatgaatgggctcattgcaagtgtgaaaatggtggttagtagcaaagtagcgagagcaggaatgtggaaggatttttggtggactggagcagcatggagagggagaagttttctaagcgtagtgtagaccacatatgagcaagtcgtggaaagaaagcgaggataggtggtccgtggtggcagggggtgacgcaggagacagacagtggggacgttccccaagaggggataaggcggctcctgggcggtaggagaagatgtggcaagatgtgttggtcatggagtggtagggatgttcctagagatggtttacttgcaaaccaattctaaacctaaagtttgcagattacgcactatataaagtttgcaaaccaattctaaactatatatgcgatatatacttatttggtcatggagtctatcgcttctaaacaataattttcacaggcatttgacttagccagtcgctcttaaaaaattaattgatgtcagatggaaacataccgtgtatcaaaattgtagtgctaaactagatttaaatttttatagttgtttctttgtctcatttaatatagttctatagtcaaaatactctcgtgcatgtcaataaaaagaataacattgcattttttaacaatcgttaaaaccagaaaatccggcttcaccatctctgatgtttcgataggagtaaagaaaccgaaagtcaaagaagaaactcttaccaaacaaacctccggtcgtcgtgacaaactggccgtgaaaggtttgcatcatcaaattcaaatcaacgtcgcgttccatgagccgtgggctggaccgagaggcccgtgaccgacccaaggcctcccaaagggccgaggatccgcctggctcggcagtcgggctggagaccctgtccgggtcccggggaacagcgagccagcgtttcgccttgtccggacggacggaactgacccgcctcgggacccgcgcccccagtaaaagtgactgcaaaagcggaccccaccctgacggcgtctggcctgtccgtttccacccgacatgggggatcagcagcgagcaacagtagaaaaaaaggactttcttactgccaccgcctgtgcacgcacaaatgcgagttctgacgatcttgtactacgccatttttttcattaaaaaatggagggaaaaacaacgggcttgtacttgtacgcccgactgcgcacttgtcaaatccaaaacttgtactgttaccgcttacattaaaaaaaactcaaactataaccttcgacaaataagtacatatctcatattttatattttataagagactagttaattttaattttttagtacattaatttttttatgaatatttgtatattcaaaaaggctttatacgaaaatactttgtctgtcctaaaaaggggaaaaacttagctataggttacgtaccaattaaataagtgattcatgtgtaatcaaatttccggtgaataatatccaatcctcaaatcaatttgttatcggcatacatttcatacatccataatattttcttttacgtttccgaaagggcttgacaggaataaaaaaaacttgatcgggaaaaggatttcattttcaccaaaaaaaaaacagagagagaattcatccgtgtttattttgggctttccaaagtcctttttttcttgagtacgccaacaagtacagtagtgacatgacggacgtaaacaacgagcaagcagcatgggattagaagcacgaagcacttccgcgttcaaacttcgaactttctcaaaccgtcacgaagtggatgcgtcctggtcctgtgctccaccgccatcggcgaagagacgaattgaaggcggtcgtacggtacctgcacgactgtaacagacctcactggcctctgttgtactagtaaagtcattctcagtggttgtttttgtaggagtttcatggttcaacactggccttgagccatccatgcatatgctcaggtggtcttcagcgttgagcgttgagtgtttacttgaccacgacaacaaactatagagcgtgcatttccttcatcagtcggtcacaaacgagatcaaactatagagcgtgtttgtttcagctttgtcacggaggcggaggaggctggttctggaggatgaagccaccacgccgaccgagagaccggtggtgccttttattttaggatttaaatataaagccttgctctaatgtttattatgtagaggttgctgctgacagttcaccgcaccaagcccaagcatttgctcccgcttatcgtacaacacatactactgcacgattcgcaagtacagtacgacccgtaattagcggagaacagtttatcccaccgttccattccccttcacttcaccccccgccgaggggaaagtgtgatgattagcagacttgcagcttgtatctcatttataaatacacaaaccccacccagcaggccagcactcaagaaccgcaaggaggcgcctttccggcgttgcccttgtttttttcccctctccaactcgaggggttttcgatccggggggcggttcccggcgagatttttgacccggcccggtgcttggttccattgatctccgtctgctactccttcctcctacttggttgccttgccttcccggtccctgatcggagcctgtcgccggcgggcgggcgggctgagtttactgcccgttactggggggacaaagagcagaaggaacagagagtaaaaaatcttgggccttgatcggatccgaggacggggcaatgcggtaataaggagcggccatcactgccggagtttgatccatccaaggagaagaaagaggaggggaggccgcgctttcctttctttctggtgagcgttccggcctccgcgccgcccgtctctgttcattctttttagccttaaagctactacagtactaggcaacaaaagcggtcgcggaagttgccatctttttttttccccccctttcatcattgctgatggcgtcgcctgcctgcctgctcacactcacgcagaagcggaggcaactcccgaggcgcccgccatgctgcgcaacagatcgagaagggcggttggtggtggtgccaaccaagcccaaggacgagcgggcggcctcatggccgagctccccgcggccgccgccgcccagtcgccgaggcatccttcgtcgtcctcctcctcctctcccgctgctgctcccgtgttcccttccccgaggccgttcgtggcgatggcggcgctgccccaggccgggctcctgccggacgggtcctccgaggggccccggtcagccgtgagccccacctccatcctcgagaccaagcacttctgctgctccccgctcccgccgttcctgtcggagcggagcctccggagggcggcgcgcgcggacgcggccgcggccgcggagccggccggcgtcggcctcgccgacgtgctccgggaccacggggacgccaaggtcgccgggggcaaggtggtgctagggtcccagctcagagtccaggtcccgtccggcagggccgtcgagctgctctcctccccgatcgagttcggcgccaagaacagggacgcgcagctggcggcgctgtcgcccgccaggaggctcctgccggaggtcgtgagctcgccgtccgcccgggtgttcgccgccggcggcgtggccgtcgtgccccccggcgagatggccatgtcggaggactacacctgcgtcatctcgcgcggccccaacccgaggaccacgcacatcttcgacgactgcatcgttgagagctgcggggatttgctagccgacaagcccgcggccggcggcgcagcagctgctgcctgtggcttcttcagctcttgccatgcatgcaacaagcaacttggacatggcaatgacatcttaatctatcggtgagtatccccaaaatccattcgggttcactgtagatcagcagaactaattgctgtactttgagtaattgattttggattcctctgccccttgcatgagtgatactgtaccttcttcgtatgctaggaaggtcaaatcgctgtcagactaatgcctgtactagaggaagcaagcatgaacgaaaatacataatgatctttcgatgctaggagttaggacaccatggcagcatgatatgctagatctgacctacacaacaaacaaaagcaaaaccacacattcagacactcagtataggaagttctgaattcttcgtcctgctacatcctttttagtataggaagttctgaattcttcgtcctgccacatcctttaaaaattgacggcaccctatgttctgagttctgaccgtgtattaggagactttcatggtggatttctttcactataccttaaaagcaaacgtcattgagagttttgatcatgcactgttatttgacacggagatggcttccatcatttgcctggagggggaccttggcgagtggttctaacgttggagtcgtcatttttttcttacgacctttctggtttgagcgtggatcatactacggtacagtacatgtttagtggatcttatcaggatcacatcagctttctttcatgcgaccaatcttcactggtactctttttggttacccacccaccgggaacaagttgcttgctcatttgagattgtgatgcctcgatcgactcccctgttgccctggaagggaaaactgccccttgttttcaagcctcttggtacaccgagactgcttgctctcgtttttctccctctctctctcccttgctcgctgtgtacgatcgaccatccatcgtagctttgagtagtttcagttttaatctgtggcttcgctgttcacaaagatggcagcgtgagcagcgcctctgatctctggaaaggctgtaggcgtgttataatccatcagttaggttaggtcatcactgttctgttatgatatgatacagttgttcctctttttttttcctctttttttgctctgtccagaggccataaagcgttctgcagcagcgagtgccggtaccaggagacgcttttggacgaagcggtggacggagaatttgcgctaggcgatggaggaaaaggaggagggcgttgttagtggaggagaagagaagccatgaggacgatcctgaacaaccaaccaccggcaccgagacgagatttctttctttctttctttcttcttcttcttcttttctttccttttcgttctgtctcctttgcgggatctgcgtgctgttttcggtcgtcgactcgatgaggagagtggtggtgatcttattagtcttttgcggattaaagaccttttttttttggcgcccgctttcgtaagaggctgaagattggtgacctgggcctgatcttgttcatgcaacttattttcccagctggttccgatgttatgatgcgcttcgatgcttgtccatgtgactcgctcatccagtgtggaccctagcctgaagtaaattgaaagaggggaaaaaatacttgtctctcctttgccctgtttctgtttgtcaatcatcacattatttccagtgattcatcagggtgctaaagaaggggtagggtctagtagtacagtatttccactatgatgattaggggttgttgattgagatgttagtatacttgtgtactggtggcctggtggggtggcttggagtttattaggagtgattggctggtttcctgtaactggatgtctggttgcagccctgggagtgtgcagctggaccgatgctattctgattgcgatttctcctggcgttgtctgtgatgagttcatctccacgcttcgctcccccccgtgggcggtttgatccgtccttcgctttccttctctcctgctttcggttcggttcgcttgctgctgctgctcctccactgcattattgcgtcggcgcagcgcagggaattattgctgccgttcgttactcatggcaatggcaatggacggctgcagcttttgaccatggaaggaactgttctgggctcatcagtgtggccgttttggcagagagctggtggagtggtatgcccatctttgggctcatcagtgtggccgctctggctcggtggaagatgcagttttttagcttcacctgctcctctgaaaccaaggcgtcagtgttgttaattgttccgtcgatccatgttggagacagattattctaaacaattcctcgttatcttaggtcattcgttacggagttacgacaaactagcattgttcacaagtctgaaatattcgtactagatgatgtcgaacgttacttaattaacgccacattctcaaactaatgtttcagggatgttgacacggtcatctgtatcgtccactagagataagagaatcctctattcagcatgttcgtttgcttttatttgtacgcttctataatatttttatctttatagattacagtgcgacgatcctttaatccgaaacaaacaggctgaatagagtaatacagtagtaatatgcgtcaagcgacagcgccttctgtagccctgtcttgttttttttttcaataacagcgctatctgtgattggatcgccagaaaatggtgctttctcag

SEQ ID NO: 3426 - DNA, 1436 bp, Zea mays
  misc_feature (1400)..(1400): n is a, c, g, or t
  misc_feature (1421)..(1421): n is a, c, g, or t
acgcagaagcggaggcagggcgggtgggacgggctcccgaggcgcccgccatgctgcgcaacagatcgagaagggcggttggtggtggaaaaaaccaagcccaaggacgagcgggcggcctcatggccgagctccccgcggccgccgcccagtcgccgaggcatccttcgtcgtcgtcctcctcctcctctcccgctgctgctcccgtgttcccttccccgaggccgttcgtggcgatggcggcgctgccccaggccgggctcctgctggacgggtcctccgaggggtcccggtcagctgtgagccccacctccatcctcgagaccaagcacttctgctgctctccgctcccgccgttcctgtcggagcggagcctccggagggcggcgcgcgtggacgcggccgcggccgcggccgcggagccggccggcgtcggcctcgccgacgtgctccgggaccacggggacgccaaggtcgccgggggcaaggtggtgctagggtcccagctcagagtccaggtcccgtccggcagggccgtcgagctgctctcctccccgatcgagttcggcgccaagaacagggacgcgcagctggcggcgctgtcgcccgccaggaggctcctgccggaggtcgtgagctcgccgtccgcccgggtgttcgccgccggcggcgtggccgtcgtgccccccggggagatggccatgtcggaggactacacctgcgtcatctcgcgcggccccaacccgaggaccacgcacatcttcgacgactgcatcgttgagagctgcggggatttgctagccgacaagcccgcggccggcggcgcagcagctgctgcctgtggcttcttcagctcttgccatgcatgcaacaagcaacttggacatggcaatgacatcttaatctatcgaggccataaagcgttctgcagcagcgagtgccggtaccaggagacgcttttggacgaagcggtggacggagaatttgcgctaggcgatggaggaaaaggaggagggcgttgttagtggaggagaagagaagccatgaggacgatcctgaacaaccaaccaccggcaccgagacgagatttctttctttctttctttcttcttcttcttcttttctttccttttcgttctgtctcctttgcgggatctgcgtgctgttttcggtcgtcgactcgatgaggagagtggtggtgatcttattagtcttttgcggattaaagaccttttttttttggcgcccgctttcgtaagaggctgaagattggtgacctgggcctgatcttgttcatgcaacttattttcccagctggttccgatgttatgatgcgcttcgatgcttgtccatgtgactcgctcatccagtgtggaccctagcgtgaagtaaattgaaanaggggaaaaaatacttgtccnacaaaaaaaaaaaaa

SEQ ID NO: 3427 - DNA, 1582 bp, Zea mays
gcaccccttatacagccacttgtgtctcgaatccttccaacaattctatccattttagtgaaacccaaggtccagccggatggactggttgcaggttcactggaccttttgacgattctactcaaaaatgctccagttgctgtggttaaagcagtcttcgacacatgctttgtttctactgttcaaattgttcttgaaagtgatgaccatggagagatgcagaatgcgacagaatgcttggcagcattcatatcaggtggccggcaggagttgcttgtctggggtggtgaacaaggacaaacactcaagatgctacttgatgcagcttcaaggcttttagatccagcgttagaaagttcagtatcactatttgttggaagctttgttttgcaactcattttacaaatacctctacacctgtctcctcacataccggaccttattgctgctattgtgagacgtatgcaaacgagcatcattgcaggattgaaaagctctcttattgttataatagccagattagtacatatgagtgcaccaaaggttgctgggttcatcaatctattgctttctatccctgcacaggggtatgacaattcacttgtttatattatgtcagaatggtcacaactacaaggtgaaattcagggagcctaccagataaaggttacaacgactgcattagctcttctcatatcaactcgtcatcctgagctatccaaggttgaagttcaagggcatcttattaagactagtgcaggtataacgacacgttcaaaagctcgagtgactcctgatcaatggaccaagattcctctcccagttaagatcttctcattgctggcagatactttaactgaaattcaggaacaaattggtgctggtgatgacgatgactccgaagaggataatgactgggaagaagttcagaatggtgatgctagtatatcagatgatatcatacactcagcatcggttccttcaatgactaatccatcagttgaacatttaaatgcaatggccaaggtttttgatgaggatgatgatgatagttatgacgatgatctgacaaaaaacgaccctcttaatgaggtgaagttagcggacttcctaacaaacatctttgctaacttgtgggagaataatcgaccaatatttgagtatctttgccagggcctgtcggattcacagagatcagctgttgaaaaggttttgaggaggtgaagcgttaacttgggatcctgtcttccacctttcgggatataatatatcttcatattagttatcgagtcctgtttgcattgctgtggactggttttcttgctcattatatgttcattggtgtaaactgatacatctctgaagccggtgttatgaggttttgttagtgtaggtttctttatgttctttgtatttaaaatctacaagatgtgagtatttgttgtgccgggtgtggtgatgttgggtattcatgtctgaagaattcccggcttgacttgttcttacgttgaattcctccggagggaccttgattccttggctttattcatcaatttcatgcatgcctatttggaggagcgcc

SEQ ID NO: 3428 - DNA, 1603 bp, Zea mays
cgcttctatccacaaaccccagccgcagcgtccgtgtaccagtgatgttgccactgcccaccgtgggcgtgggggcggtcgccgcgtcgccggccaccgccgcaggggtagcggcgcccataaggtttcgtccgctccgcctcgtcgcgagtcgagccagcactaccccttcttctccctctacgtccagctcggctatatccagcgcgtcaccagcggggcattcccgcgagcacctgtcgggcagggacggctccccatcgaagaccagcaagccccgggtgttcttcctcgacgtcaaccctctatgcttccgcggctcccaacgtagcctcggcgccttcgcgcgctggctggccctcttcttcgcacacgtcagcatccgtgaccccgtcgtcgctgttttggacggggatggagggaacgagtaccggaggcggctgctgccttcgtacaaggcgcatagggctcgcggcgtcggcactggcgctgacacgcgcgtcgtcgacgttctccgccaatgcaatgtcgcggttgtaagagtcgatggatatgaggctgatgatgtggtggctaccttaacagaacaggttttacagaaaggttacagagttgccattgcctcaccggataaagacttcaagcagctgatatctgatgatgttcagctagtcgtgcccattcctgagatcggccgatggtctttctatacattaaggcattatgttgctcaatacaagtgtgatccaactgcagacttaagccttaggtgcttcatgggcgatgaagcagatggtgttccaggaatccagcacttagttcctggattcggcagaaagaccgcggtgaaactactgcaaaaacatggttcgttagaaaacttgctaaacacggctgcaatcagaactgtcggcagaggttatgcccaggatgctctcactaagcatgcagattacttacggaaaaattaccaagttcttagcctgaagagggatgtaaatgttcagtttgacgacagttggttatccccgaggaacacatgcagtgacgccaatgttctagctgactttcttcttaaactgagtggccaaggcagaagctaaatagctggtacaacgacgcatttgcacaagctggacttgttcctcaccaaccacaggatttaacaagaaaagggagatgcataaaggttgaaggagccggttgctgtaaaaaaaattgcgtatatccttgctccaaagtagtagccatcacacattctcgcttgtgattcgtggaactggagcagccctacctgggttgaagctgggtggaaaaatggaagtttggaaggtctgtctgggtgggtacatggtgacgggacaagcttaagaatatacagggataagctatagtggtagtactactgtgctgtaggccgtaaagtccacaagtaccttgccaggagattacagatggcgtacttcgtactggtagcgactcgttgatgtacaactaaatgcacgcgggttttttttttgtaaagtttgtactgagacacagtgtcccgacgctgtcaggaatcatctttaaatcatttttagtgacacaaaaaaaaaaaaaa

SEQ ID NO: 3429 - DNA, 2286 bp, Zea mays
gggcactccgcccctcgaggccggccgggctcccttcttcgattgccgtcttctctggcttccattttcgcgaggaggcgaggtggacagagacgccgccgccgcttccgcttcgacctcgacctcggcttcggcttccacgagaattctagcaagtcttctggagaatataatccacatctgtttattttgctgcattttggtatggacgaatctgcctgtagatccactgccccagttgggtttcttagaagaggttcgggcatttccttgagaaatcaaagcaatgaggataggtcaaatcagtacaacaagcagccagggaagagttcaaatcccaatcctgtaaaattacggttcactgaaaataaagagaaaccaaggtattttcaagggacatttcattcatcaggctccagggcctcatctgtaagctcttcaaaagctcctgctagaaaatactgcgacgagagacagaaacagccctttttggcagagacagacattgctgaaagcagtaacagaagaactgaggttagacgcctacaaagtggcaagaaagcttctgtatttggtgatgggcatccatacacacagaagagtatctcagaagcttcatcatcctcaacaattactggaggcttgccagaagagcatgatcttggagctttatatgtttctggttcttcaggtagttctgcacatccagttaatcccaggaatgctgcattgaatgcttcggcacatatgcaaaaggataaagaagaaatgagttcaggtagacctcaaggtgctcccacttttgttcgtcggcatactttacctcaaagtttttccactggtgtcaagtcaccaactgcccctggcactggagcacagagacgtggcctcaaaaatcttggttgcacttcaatatctgatgttctgccttcaggatgctcttcatctgattctgctcgtgataggagaatcgaagttacaaagaagagaacttctggtgcaggaagttcttcaagatcaaggataagtgaacaatctaatttcagtcagccacgtgctagttatcctggcagtactggtcctagagctagagctgctgaacaatcagcttctcaacaaacagcaaggaccaatagccgaaatattccggatcatacagattcaataaggactagacgaccttttactctgcgtgccagggagaggatgatgccaggtgaaagggaggacagtgtatttgctctgcatgagactgttgcaagcattcatccagaatgcggacattttcacatggatggtactcccccagagagattaggaagacccttttatgcagaactacctcatgcaatttattcatctaatcgtcaaggatcaagtagtcagacagcaaggagaagatctacgtctcgtactgaagaaagccctcaacggatgtttcatggtatgttttgggagagagatggctacagggggataaacatggaaggaattgcacaggcgttgctagcattggataggattgaacatgatgttgaattgacttatgagcaactgcttctgctagaaactaatctgctcttaagtggccttgatttgcacgatcaacatgaagatatgagattggatatcgacaatatgtcttatgaggaactgcttgctttggaagagcatattggctcagtgactactgcccttactgaagagcaatttaccaagtgtgtaaaccaaagtgtgtatgaagcaagaaattcttatagagatgtaagcaagatcgcagcagatgatgtgaaatgtagcgtatgtcaggaggaatacgttgatggtgaagagattggtacaatgcaatgtgaacatcagtaccatgtgcgctgcattcacgaatggcttaagcagaagaattggtgtccaatatgcaaagcttcagctataccttcagagatgaccaagggagacgcatgaatcttggcccaaacttgtaaatagcgtggatttattattagacattgtagatgctgacgcagttcaccccaatatgtggatacgatagtctctcccgaacggtcgaacgcctggaaccttttgttactgcatcttttatcttcttagcacacccttgctgcttgacagcagtacgggtcagaaactcgaaaataaccgtggttctcaagaaatttttccagattccaaaaaaaaaaaaaaaaaccttgattgaaaaaaaaaaaaaaaaaaaaaaaaaaaaaaaaaaaaaaaaaaaaaggaagacaaaaaaaaaaaaacaaaaat

SEQ ID NO: 3430 - DNA, 2904 bp, Zea mays
gcatcatgactccattattcaaatttagtggaatgacttcgttcctcataggctcatactagtacttattattagtttgaggaatgatatggtgatggatcatctcattcgattccctaaaccaaacaaaagactaacgcataagatggactactttatttaacaaaccaaacacccctaaatgaattaatataggttggtaactctttctgcactattcaattaagaacttcgaattaaggtttaataacaaaaaaactgtgctcaatatttcagcacatttgtataaattatttttttgcaaagtataacaaatatttcggcaaaacgtttgagcagtgaaggtagtgcttggtgtttagggttttagggtggcaggtctccctgtcctggtgtgttctttagaagtgtgtgtgtgtgtgtttgggtgtatgtttgtgttctgtatttttgccctttgtgggtgtttttcttctctctaatatataaagatgcgcagttctcctgcgcattcgaggaaaaaaaggtagttcagctacgtaggcccccccccaaatgctctttaactgttacaacgctagcattggcaacaaacactgactttatttctcggttgatagctttgcgctgcgctaaacatcaataaaagaagtgtggatagggaccttgatgtttaccgcaacatactctcaaagctggttcaagccaaggaacttctcaaggaatacgtggatagggaaaagaagaagagagaagaaagatcagaaaccccaaagccaaatgaagctgtcacaaaatttgatggaaatctttattccataaggcattagatcaaccctttgcagaggagagtttcccagtataacagaattacgtgttgagaaactaccaaatgatctcctttcaccacagacatcttttgctgctcgtcttgtggtgtagcattcttgcggtacaaaaggatccagatcattcttactattggacagatatttgtattttctcatgagtcttcaaatcaaatgtatttattttctgtcagtctgaaagtatatgaagcggtgtgtagggttaatgttactcataagcagagaaatatagctttctcttttgtactttgtggagatactttgcgagcctgtgttcacttacatgtttttgcaaccatgaaatcagttgatgggttctttatctgaatttgtatgtaccgggctcagtactgggaaaatatctgtggtggaaaagttcaaggaaccagacaattctgtgctggattcacgcttcaggaagacgtgaactgttgtaacctttttcacattttgggtgaaagtaatctgatacatacgttcaatctgtcattgtcacaagtggccttccagcaagtgcaggctttggagcaaaggctattggtaactgaagatgatgtatggggttacagatgggaatccaacaccttttcttcaacgaacttattataaagctttgattggacacattgaggtggatcctactttcaagtggttatggaagagttgctgtcaaacaaagcacatggctttctcttggctgcaaattaaagacagactgagctctaggaatatgctaagaaggagaaatatgactcttgattcgtgtaactgtggactctgtagtctgcagtggcagtggaagaggtttccttgtttaaggagcagctacaatctgaaatttttatggtggcaacgattcttatgagttgggaaatttgaacagtaaggagtaaaacaatctttgaacacctgcagatgagtagccaagattacagaatgttcttcaacaaggagaccttaatggtcagccatggagtgaagccttgcttaagttctttgtttgatcgatggatctaaagtgtttgttttattctttctttgctcattttctttgttttctaagcttgttcttccccttgctgtcgtatatagtctgcaactctttccctgtttcttgtactctacagattgaacatattgtatcagtttactttcattgatagccttttcaacttttctccctttcttgttatatatattttttttctgtagagacggcccctccagtttcttttaaaaaagagcaaagcaacatcggagaaactgagaattccttcgcttatctttccaaaaaaaaaaaggttcctttagttgcctctaaactgagaattcagttatactgcgagacatgatggttacagtgagcgacagaaactgagcttcgcacgcgttttgggtccaaaaccacatggtctccaagagtattttgacgatattttccagtgggaggcggcactccaaaatccgaatgccctcctcccaattgtatccctccacgtgtcccatggtccttcacgactcacgagcagcccatccattggaccatacagataagaaccggataaggcagatcgtggccgtcaaatagatcacatccgttctatggccgtctgatttgccacccagagataacaccggaatttcctacaagcactatcctatttgtagcccgtgacgagcgagccccacccccacgccacacaccaccaccggacgctagctcaccaccaacctcagcacatcgaggagaagaggagtggccatggcttcgtcggtggccgccgcggcgagcacattcctgggcacccgcctggcggacccggcgccgcagaacgggcgcatcgtggcccggtttgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcag

SEQ ID NO: 3431 - DNA, 1467 bp, Zea mays
  misc_feature (24)..(24): n is a, c, g, or t
ttgggaccctcgaggccggccggnggccatcgggcccccggcggcgcgcgaggaacaatagcctttcctctcactcgcccctctgcatttaccactttgccctcgtcggcggcgctgaccacccgccgccgagtccggcgaaacaaccgcctgtagttccagagtagtacctcatggcggccatatcgtcgcttcccttcgcggcgctgcgcggagccgccgagtggaggccgtcgtcgacggcggcggccgtctccggcgccgtcgtgctcagcgcgaggtctcgccggggctcgcgctcggtggtgcgatgtgtcgccacgacgggtgatgtcccacccactgtcgcagaaacaaaactgaacttccttaagtcatacaaacgcccaatcccaagcatttacagtgcagtcttacaagaacttttggtgcagcaacacctgatgagatacaaaaaaacctatcagtatgatgctgtgtttgctcttggcttcgtcactgtctatgatcagctcatggaagggtaccccagcaatgaggacaaggattccatcttcaaggcatatataacagcattaaatgaagatcctgatcaatacagagctgatgcactaaagatggaagagtgggcacgttcccagaacggtagttccttagttgatttttcttccagagatggagaaatcgaggctattctgaaagatatatcagaaagggccaagggtaagggaaacttcagctacagccgattctttgcagttggcttgttccgtttgcttgagctctcaaatgcaacggagccaacaatactagacaagctttgcgctgcactaaacgtcagtaaaagaagtgtggatagggaccttgatgtttaccgcaacatactctcaaagttggttcaagccaaggaacttctcaaggaatacgtggatagggaaaagaagaagagagaagaaagatcggaagccccgaagccgaacgaagctgtcacaaaatttgatggaaacctttattccacaaggcattagaatcagccctttgcagaggagagtttcccaggataacagaattaacagtaacatctggaccgtgttgagaaaccaccaaatgttcccctttcatcacagacgtctttggctgctcgtcgtgtgatgtagcattctgccgtacaaaaggatccagattattcttactactggacagatatttgtattttctcatatgtcttgaaatcaaatgtatacattttctgtgtgtaggggtcaatgttactcaagcagagaaatatagttttctcttttgtatttaaattcaggtaatttgggaggccgtgttcacttatatataatatagtgtggcaaccatgaaaacaattggtgaagaaattaaaaaaaaagcggccccacccgtcgccgcttcctcccgttagactaggttaggcttaggctagggtgtcgaccagctcgc

SEQ ID NO: 3432 - DNA, 1783 bp, Zea mays
ttgggtacctcgaggccggccgggaagacgtccgcgcctgcaagagcctttcctcgcactcgcccctctgcatttaccacattgccctcgtcggcggcgccgaccagctgccgccgcgtccagcaaaacaaccggccgtaggtccaaaatagttccccatggcgtccatatcgtcgcttccctttgcgccgctgcgcggagccgccgagtggaggccgtcgtcgacggcgccggccgtctccggcgccgtcgtgctcagcgcgaggtctcggcggggctcgggctcggtggtgcgctgcgtcgccacggcgagtgatgtcccacctactgttggagaaacaaagttgaacttccttaagtcatacaaacgcccaatcccaagcatttacagtacggtcttacaagaacttctggtgcagcaacacctgatgagatacaaaagaacctatcagtatgatgctgtgtttgctcttggattcgtcactgtctatgatcagctcatggaagggtaccccagcatcgaggacagggattccatcttcaaggcatatataacagcattaaatgaagatcctaatcaatacagagctgatgcactaaagatggaagagtgggcacgttcccagaatggcagttccttagttgatttttcttctagagatggtgaaattgaatccattctgaaagatatatcagaaagggccaagggtaagggaaacttcagctacagccgattctttgcagttggcttgttccgtttgcttgagcttgcaaatgcaacagaaccaacagtactagacaagctttgcgctgcgctaaatatcaataaaagaagtgtggatagggaccttgatgtttaccgcaacatactctcaaagctggttcaagccaaggaacttctcaaggaatacgtggatagggaaaagaagaagagagaagaaagatcagaaaccccaaagccaaatgaagctgtcacaaaatttgatggaaatctttattccataaggcattagatcaaccctttgcagaggagagtttcccagtataacagaattacgtgttgagaaactaccaaatgatctcctttcaccacagacatcttttgctgctcgtcttgtggtgtagcattcttgcggtacaaaaggatccagatcattcatactattggacagatatttgtattttctcatgagtcttcaaatcaaatgtatttattttctgtcagtctgaaagtatatgaagcggtgtgtagggttaatgttactcataagcagagaaatatagctttctcttttgtactttgtggagaaaaaaaaaaaaaaaaaaaaaaaaaaaaaaaaaaaaaaaaaaaaacccggacccacaaacacaagtcgtcgtaggcagcgagggtctctcctctcccacgcatcgcgccaaggaagagagagagatcgccgctccccgtctcggcgtcgggggcgggtgccctccctcctcgagcgagatctgtctggtcacagatctatctgacaaaatggtgaagatctgctgcatcggggctggctatgtcggtggcccaaccatggccgtcattgccctcaagtgcccagacattgaggtcgtcgtcgtcgacatctccaagccccgcattgaggcctggaacagtgacaccctgccgatctacgagcctggtctcgatgatgttgtgaagcagtgcaggggcaggaacctcttcttcagcactgatgttgagaagcacgtcgctgaggctgacattactctttgtctcggtgaacacccc

SEQ ID NO: 3433 - DNA, 942 bp, Zea mays
attgggaccctcgaggccggcctttggtgatattctgtttaccaaggaaagcaaaagggaataaacctgtgcatggaaagtctctagtccaagtatacacataccagatttcagaagctgatattttacaagtagcaacaatgatgggatttgatgatgaactagatgtaacagatgacattggagcagctgatgtgattcttgcatcgagttctgaaatgaagcagaatccttggattcaggccggcgcggccgcccccccgcttcccatatttgttgtcaagactaatacgatggctcaaatagttaaggctatcagaatgattgttggaagggacaacacatcatcaagtaagcagcctgaggttatggagggagagatagagattgaggatgatgctccgaaacgtaagccatctttggaggaaattgatgccttggaggaggctcgtcttgcaatcgagtacatcgttattccaggtggggagccagttgagctcctcccaagatgttcagaaatagttgctcggcagctggagctcgtagagagctaccagctacttgctgaaacctttggaagtgactccaattctaggttacagattctccccatgaaaataaccaagaggggttctagtaaagacaatggagcatcaaagcccactaaacaaaccggatcagatttgatcgtcagtgagaatggtggtggctcaagtttttctcggctgccatttctgccaaagtgatcgtctagatcttctgatcaccactgtcgaaaatgtacatcattcctctctcttgttggtcattggacaacattgtgcagggttgtaaatagtgtgtccaatgttgaagaagcgaaagagcaaaagctaactgcaattgccttccattcttttgctggaaaaaatccgttcatttctggtgtcagccaggtcagct

SEQ ID NO: 3434 - DNA, 755 bp, Zea mays
  misc_feature (50)..(51): n is a, c, g, or t
gggaccctcgaggccggccggggttagtataatttaaatttataaattanntgaattcggcaaaaattattttcatctgtttaacaaaaatgaagctcgcaagatgcataataagtctaccgagtttgaaatgccgttggtgatacctgatagagagtatgaaatagaatcactgccactctatcaggaagttatggtcactaggtcattatcatcagatggcaacttcagcgatgattttgctgcatccaggcaaacaaaaagcaagagtatgccatcagaagataattttggtgatagttttgtttatacaaggaaagcaaaagggaataaacctgtgcatggaaagtctctagtccaagtatacacataccagatttcagaagctgatattttacaagtagcaacaatgatgggatttgatgatgaactagatgtaacagatgacattggagcagctgatgtgattcttgcatcgagttctgaaatgaagcagaatccttggattcataatgttgccaaataccacaagcttcccatatttgttgtcaagactaatacgatggctcaaatagttaaggctatcagaatgattgttggaagggacaacacatcatcaagtaagcaacctgaggttatggagggagagatagagattgaggatgatgctccgaaacgtaagccatctttggaggaaattgatgccttggaggaggctcgccttgcaatcgagtacctcggccgcgaccacgcta

SEQ ID NO: 3435 - DNA, 1398 bp, Zea mays
ttgggtccctcgaggccggccgggatctttccttgtccttcgtaccccgtccggtctctctctcgctcgctctcagccttccttccctggcggcaacgcctgggcggacgagcgccgtcgccctgccagttcttcgtcggtcccttcgcctgtgattggcgccgcgtcttctttggatttcggccctttcgcgccggggactagcgcccaccaggagcaagattgaagccttgaagggctatatagggttgggcacggttgacctgatcgactgaaactgaaatggcattggtggtgaagcggtaccgatgtacgcactccgtgagctgtgcttgcctcaagggccatgtcagggaggatgcaatgtatctcgtgtttaaacacatgaactggaacccgaagatgattgctatcttatccagtgtatgtaagtggttcgatgaatttgccaagagggtgctctggaaggaattctgccatgccagggcaccaaagatgatgaaggatttgcactctgacggaagtcatatcgttgatggcaactggaaggccctagggaagcttcttatctattgcgcagggtgccctagtggagacctgttcagtaatatccatgacccagtcccggggcactttgtctacagaacccgtttttctaggacattggggaagagcttactggcgccacagtgcaggtctgatgcgttgtatgtctcagagtcctgtgaacatcttgaccagggcgaggaaggtgacttgggcctcttccggggtatcttcaagtcgtttgctgcgtcgaagatgaagaaaatgttgattgagaggcaggcaaacttccatttgaataagatgtgtccttattgtaagacaaagctatgggacttgatgcaaccaaatatgataccaagtagtgccgccgtgagattgggtgcggaagatggttctgttgagtactatgtatgccttaatgggcacatccttggttcatgcactctgatacccatctctgattctgagggcacaaaggaagagtgatcaagacttgatttaggttgctgtgtgaaatcccgtgcttgttgactagggcgtgagcagcgataaggacgagccctgtcgccgccgttgtacttaactgtaattgtagtgccagtgttcttctagctgcctttctttgagggtgtgggttgacggattctcgtagttgcttgtagcagtagaaaaagaagaggttgctgtatcgtggctgccttttatttatgaatacctcattacaggtatgtttgcagagcacctgcatattgctttggtaccggtatgtaccttcaaatgcacagatttttcctgtatccagcacagcctgttgtgctccggaaaaaaaaaaaaaaaaaaaggccccta

SEQ ID NO: 3436 - DNA, 4864 bp, Zea mays
atttcggcacgaggggaagaagaaaagcctccgattccttccctcctctcctcgccgaaagggagaaggatggacagctcatggctgcgggctccggcgccggttcacatggtcgggggatgctgcgaggactgaagactttggatgggtgttgcgtgtgctcatcccaccgagcgagagggagagacgagtcagaaaggcccgcccgtgaagctccatcccgttcttgcccagtgttcatcaggtgcagcttgcgcggatccccctcatgaactgagcaatcgatagaagaaacaaaaagggccatttccgctacagaaaataaatcatcaggaatgggaaaacgaggccacaggcggtctgcatcacaagacgacgacaatgtgggcttgtgtgtggggcctcatgcgcatgctttacttccgccgagaccccaaacttttgctggatgcgaagcagttgagtgggatgcatgcgttccgggaggtcagcgggacgggcccgtcggcggacgcgccggatgattttgacgggatagaagaagatggtaacatagaagatcgcactttgcagaaaccgacagtaaaaaaccttatggaggatgaattggaaaaattaatgctgctgaagaaatttccaaatgatgaggttcagagaagaaaagccgacctgggaattgatgtctctcttgatacgatttcagagcatacaaataaatcaacagataactcatatcaccaggcaggaatctctacgccttcaactccatcaatggattatggggttttgaattatactgaagaatataatcttgaatctgtgctggtgaattttctaggtgaaatatatagttgtcacaatgaatgcccacacagtgattgcaagaacaagaatgaattgtgtccttcactgaagtccctaatccataaaaaggtcaatgaattgaataatcttccccacaatattggccgtgggcaatctcaagagggcagtgatgctaagccatctgaccaaaataatctttataacaccatggcagcccaatccaaacaattccaggatgcattggaaatactgggttcgaacagtgaactttttgtgaagctgcttcagaagccaaatcaacatatagctgatagtatccaacagcatgaaaacagtaaggtgtctgctggattagagcctgacaaaattcatggacagaccaattttgttggaggaagaggaagctcaaaacagcatcctttggctacaaaagagcaggctaaagagagaaaatatatgttcttctggaggaagagtaaatcaaatagaaggcagatgcttgacgcaacagatggagctcagactgttagcaaaattgttattctgaagccaaatccagaaagagggattaatcagaaagcagctactgcaagaactttacatcaacagccatgtacatcgaatgctcctggatgcagtggaagggaaaactcaaagttttcaattaaggaagtcaagaaaagattcagatttgtgactggtgagagaagtgaaagaaatttgtcacctgcagaggaccttcaaggagacccacgtaagatcaaagattctgttgttgcaattaataaatattttagacatctccctgaagggagcttggcaaacaagtctgcatcagacattgagaatggcatcaaaccttttatcagcagtaagcaaaagaatcaaaatgggagcataactgaaatcagtggccatatagtagcaccaaaaggtgcatctgtattttatgaagaggccaggaggcatttatcagagatgctaaaaggtaatgactgttccataaactatccagaagttcaaatatcaaaatccttggaaggcatactttctcttcctcatggcaatgtgtcaaccactgggagtagcctgaggggaaaggattaccttgacccctcacctggagaaacagatgtttacgatgcatgtgaggttgagagagaagaattgcacacaagagagaagccaatcaccaagaggatttggaagcattgctcactgtacttgcacaacagttgatgatcaggtgacagttcgagaaggatattacacgaatgaagcacaagaaggtaattcacttgatgctatgaatgatggatgcttattttttgaatacaaataaacacaagaatcttggacaggaccaagacatgctcatgatgagccagacactctgtatattgaaggacttgataaattcatttgccgcgaaaacattcgcaacgaggagtccagtccagcagaacaaagcagagacgatatatgtcaagtaagcttaaataaatgcatatttttctttcttgtgattatttttctaaatgtcccatgtttcataaaggagatactagaagaaataaatcagggaaaagagcatgttaaaatgtccctagcatctgttgagggcatagataaaaagttggggcagcaagagccagaaactccggaaccaagagcatcagccaaattaatttcagccggttctcctaatcaaagcgatgaaaagcaagagaggcccagtccagtatctgttcttgagtcatccttggaagatattggcagtccagactgcataaacaagaaagagtgtaagtccaagcggaacaacttaattaacattattcagttatactgatgcagaataaaattgctctacatatcggtatagttaatcttttcatgacgtacaggtgagctgcatggtctccaaaggaccctgtattttccagataatgaaccagacgttaatgtcctttgggaggacaagaatgtcaggttggactacataaagctggtgctagaactctcagaactgtgcgcagaacaaaatctagaggtatggtacctagaagacgagttgatcagcccctgcttgtttgaagaactacagagccagggtgatcagacggatgatcgaatgcttctgtttgactgtatctgtgaagctctaacagagatccaagagagatattttagactctcctcttggctaacttttctaaaacacgacatacggacacctccgacaggagagaacctaatcacagaagttgataggtacgttaacgggtatattatccagtacagtcttccaagtactctagagcagacaattaaaagggatctggaagttcagacgtggatgaacattagatcgaaaaccgaagggattattatggagatgtgggagtttgtattggatgagttgatagatgagactgtctccgatttgtggatttgaagttctgattaggcttcgtccatggtgcctctgtggcgagcatagtgagtaggatacaggagctctttcgtgctgaaaaagcaccagttctatgcggcagaatagcatgggctaccgctagccaagtgtgtaactgcagtggtgctcgggcgcgcgttctcgtgtggaggagaacagaagtctaggttcagcagatctccagagctgtgaagtttgcgtggatgaagttgggcacggtttgtctcacagccatgcctctgcacggcgaagtgtacagcagtctgaagcgcattgcgattttcctctttgcccgttgagatttgggagcttgtgtgggcatgtgtgatgcgtgcacttttcagcgtgatcagatcgcgcttgtttttttataggtttgttttgtgtgtaaatgtgcaaaaaaaaagcaaacatacatgattaatcaatcaaatgacatgttttatgtatgcttggctgaccggccccagccgcatctacccccatggggctgtgcatgtatttatagatcaaaagatacatgcagatatgtacaagcaaggcaacaacctgccgagaagggaggcgcagctccagccaagaataatgagatacgctaacagaataacaagatatcctaacaccctcttcaatctaaacatggtgcgactaagtttagattggcccggaatttactaaacgatgtcgttggaagagccttcgtcatgatatctgcaacttggtcctttgtcgagattggacgaacctctagttgatgtgtagcaacacgttctcgaacaaagtgatagtctacctccacatgttttgatcgtcgatgaaatactggattagcacacaagtatgtcgcaccaatattatcgcaccacatgacagcagcacgagatgaagatatgccaagttctcgcagcaatacttgaagccatattaattctgctgtaccatcagcaatggccttatattccgcctcagtgctagatcgcgagacagtaggctgtttgcgagacccccaagaaataaggttaggtccaatataaatagcataacccccagtactatgtcgatcatcaatatttccagcccaatccgcatcagaaaaagcacttagaagaaaggaattactcttggtgaaacagagacccatgttgatagttccatgtagatatctcaaaatccgcttgactgccatccaatgatcagcagtaggtgcaaccatgaattggcacacctggttgaccgagaaagcaatatctggccgagtgagaagaagatactgcagggccccaatggcactccgatatctggttgcgtcttcagcagagagtggtgcgccaccctggatttgcaatttatcagctggtagcattggcgtagcaaccggcttggatgtcagcatgttggtccgagtgagaagatcatgaatatatttgtgctgagacaggatgagcccatgcgtggtgtgctgacattcaatgcccaaaaaatatgccaaagggccaaaatctttgactgcaaaatcattacggagttgactaaggagtctatccacggtagctgacgacgagc

SEQ ID NO: 3437 - DNA, 1765 bp, Zea mays
ccggccggctgtattttatgaagaggccaggaggcgttcgtctgcggcgcgacaaggtaatgactgttccataaactttccagaagttcaaatctcaaaatccttggaaggcatactttctcttcctcatggcaatgtgtcaaccactgggagtagcctgaggggaaaggattaccttgacccctcacctggagaaacagatgtttacgatgcatgtgaggttgagagagaagaatgcacacaagagagaagccaatcacaagaggattttggaagcattgctcactgtacttgcacaacagttgatgatcaggtgacagttcgagaaggatattacacgaatgaagcacaagaaggaccaagacatgctcatgatgagccagacactctgtatattgaaggacttgataaattcatttgccgcgaaaacattcgcaacgaagagtccagtccagcagaacaaagcagagacgatatacgtcaagagatactagaagaaataaatcagggaaaagagcatgttaaaatgtccctagcttctgttgagggcatagatgaaaagttggggcagcaagagccagaaacaccggaaccaagagcatcagccaaattaatctcagacggttctcctaatcaaagcgatgaaaagcaagagaggcccagtccagtatctgttcttgagtcatccttcgaagatattggcagtccagactgcataaacaagaaagagtgtgagctgcatggtctccaaaggaccctgtattttccagataatgaaccagacgttaatgtcctttgggaggacaagaatgtcaggttggactacataaagctggtgctagaactctcagaactgtgcgcagaacaaaatctagaggtatggtacctagaagacgagttgatcagcccctgcttgtttgaagaactacagagccagggtgatcagacggatgatcgaatgcttctgtttgactgtatctgtgaagctctaacagagatccaagagagatattttagactctcctcttggctaacttttctaaaacacgacatacggacacctccgacaggagagaacctaatcacagaagttgataggtacgttaacgggtatattatccagtacagtcttccaagtactctagagcagacaattaaaagggatctggaagttcagacgtggatgaacattagatcgaaaaccgaagggattattatggagatgtgggagtttgtattggatgagttgatagatgagactgtctccgatttgtggatttgaagttctgattaggcttcgtccatggtgcctctgtggcgagcatagtgagtaggatacaggagttctttcgtgctgaaaaataaccagttctatgcggcagaatagcatgggctaccgctagccaagtgtgtaactgcagtggagatcgttctcgtgtagtcgtgtggaggagaacagaagtctaggttcagcagatctccagagctgtgaagtttgcgtggatgaagttgggcacggtttgtctcacagccatgcctctgcacggcgaagtgtacagcagtctgaagcgcattgcgattttcctctttgcccgttgagatttgggagcttgtgtgtgcatgtgtgatgcgtgcacttttcagcgtgatcagatcgcgcttgtttttttataggtttgttttgtgtgtaaatgtgaaaaaaagagagaaagcaaacatacatgattaatcaaatgacatgttttatgtaaaaaaaaaaaaaaaa

SEQ ID NO: 3438 - DNA, 1895 bp, Zea mays
agatcacggacacgcagatcgagatcctcgccggcgtcatcaacatctactcgctcttcggctccctcgccgcgggcctcacctccgactggctcggccgccgctacaccatggtgctggcggccgccatcttcttcacgggcgcgctcctcatgggcctcgccccggactacgggttcctcatggcgggccgcttcgtggccggcatcggcgtcggcttcgcgctcatgatcgcccccgtgtacaccgccgaggtggcgcccacctccgcgcgcggcttcctcacctccttcccggaggtcttcaacaacttcggcatcctcctcggctacgtctccaacttcgccttcgcgcgcctgcccgtccacctcagctggcgcgccatgttcctggtcggcgccgtgccgcccgtcttcctcggcgtcgccgtcctcgccatgccggagtcgccgcgctggctcgtcatgcggggccgcatcgacgacgcgcgccgcgtgctgcagaagacctccgactcccccgccgaggccgaggagcgtctgctcgacatcaagaaggtggtcggcatccccgagggcgtgaccgacgccgacgacgtggccgccatcgtccgcgccagcagcaaggcatcgtcgtcgtcgtcgtcgtcgcgccacgacggggtgtggaaggagctgctcatcaacccttcccgccccgtgcgccgcatgctcgtggcggggctcggcctcatgttcatccagcaggccacgggcgtggactgcgtggtgatgtacagcccgcgggtgttcgagcgggcgggcatcaagtccaagaccaactcgctgggcgcgtccatggcggtgggcgcgtgcaagaccttcttcatacccatctccacgctgctcctggaccgcatcggccgccgcccgctgctgctggccagcggcggcgggatgaccatcttcctcttcacgctggccacgtccttgcacatgatggaccggcgccccgagggggaggccgcggcactgggcgcggtgagcatcgcggccatgctgtcgttcgtggcgtcgttcgcgtccggcctgggccccgtcgcctgggtctactgctccgagatctacccgctgcggctgcgcgcgcaggctgctgccatcggcacggggctcaaccggatcatgagcggcgccaccaccatgtccttcctctcgctctccaacgccatcaccatcgccggcagcttctacctctacgcgtgcatcgccgccgcaggctgggtgttcatgtacttcttcctgccggagaccatgggcaggagcctggaggacaccgtgaagctcttcggcaaggacgcggacgacgaggacgtcggcgacagccgtcgtcacgcgcccagtaagaagccctccacttccactgagcttgagctcagtgctcagcactgagtgatgtgccatgcaacacgtgtcctcccgagtgtgaccgaagcttatgtctaaagcttcgatgatacagtctactcctagtatcttgtgtgctcgaactgtggtgaatcttttgtagatcccgggcctctcctatatttcgtcttaggtttgtagattttttttgttgatctcgtggcatagtgcgtgtgagtagcgagggattggggcacgcaacactttagtctaatttggatactctagtaatgagtgtgattggagtggattgagatgtattgagagaatatttgatctattggtgatttacaccctcttcaatccctccaaaacactttaatccaaaagtatccaaactaggccttagaaaaaaataggaatatgctaaaattcgcctgcattttagttttgaatgtgattgttattgaatatattttatcctacagttataaattaaaaaaaaaaaaaaaa

SEQ ID NO: 3439 - DNA, 1758 bp, Zea mays
aatgaatgatgactgtgcgttcttcgtcggccatctcgatcgaccgagcagacatctcggtgatgagcggcgcgcagctgttcatgaaggaggacctcaagatcacggacacgcagatcgagatcctcgccggcgtcatcaacatctactcgctgttcggctccctcgccgccggcctcacctccgactggctcggccgccgctacaccatggtgctcgcggccgccatcttcttcacgggcgcgctcctcatgggcttcgccccgggctacgggttcctcatggtgggccgcttcgtggccggcatcggcgtcggcttcgcgctcatgatcgcccccgtctacaccgccgaggtggcgcccacctcggcgcgcggcttcctcacctccttcccggaggtgttcaacaacttcggcatcctcctcgggtacgtctccaacttcgccttcgcgcgcctccccgtccacctcagctggcgcgccatgttcctggtcggcgccgtgccgcccgtcttcctgggcgtcgccgtcctcgccatgccggagtcgccccgctggctcgtcatgcggggccgaatcgacgacgcgcgccgcgtgctgcagaagacctccgactcccccgccgaggccgaggagcgcctgctcgacatcaagaaggtggttggcatccccgagggcgtgtccgacgccgacgacgtggccgccatagtccgcgccagcggcaagggctcgtcgtcgtcgcgccacgacggggtgtggaaggagcttctcatcaacccttcccgccccgtgcgccgcatgctcatggcggggctcgggctcatgttcatccagcaggccacgggcgtggactgcgtggtcatgtacagcccgcgggtgttcgagcgggcgggcatcaagtccaagaccaactcgctgggcgcgtccatggcggtgggcgcgtgcaagaccttcttcatacccatctcgacgctgctcctggaccgcatcggccggcggccactgctgctggcgagcggcggcgggatggccatcttcctcttcacgctggccacgtccctgcacatgatggaccggcgccccgagggggaggccaccgcgctgggcgcggtcagcatcgcggccatgctgtcgttcgtggcgtcgttcgcgtccgggctgggccccgtcgcctgggtctactgctccgagatctacccgctgcggctgcgcgcgcaggccgccgccatcggcacggggctgaaccggatcatgagcggcgccaccaccatgtccttcctctcgctctccaacaccatcaccatctccggcagcttctacctctacgcctgcatcgccgccgcagggtgggtgttcatgtacttcttcctgccggagacgatgggcaagagcctggaggacaccgtgaagctcttcggcaaggacgcggacgacgaggacgtcagcgacatccgtcgtcacgtgcccactaagaagccgtctactgagctgagtgctcagcactgatcgagtaatgtgctacgcaacacgtgtcctcccgagtgtggccgaagcttatgttccgtaaagcttcgatgatgtagtataatatttttttttgtgtgtcggaactgtggtgaatctatgtatatcccgcgcctcttttgtttattagatttgtacattttttgttgatctcgtggcatggtgcgtgtgcgtagaaaaaatattattaaaaatatctatctctgccgcgtgtggcctacatgttatatttttg

SEQ ID NO: 3440 - DNA, 1283 bp, Zea mays
ggggacgagagaagacgaactaaacgtttatgcacgacaattctttgacgatcttccaaactatttagcagacgaagtgatagatgtcaaacatcaagctggtgaaaacgtcgatgtcggacagaaaaccgaagcacagaaggaggccgactgcagggctgcggcacgagagagagcgatggaagctgaggcttcacaaaaagaaaataaggagaaggcaaatgagaagactggtgatggcgcatctaaggagaaaacatctgagaagactggtgatggcacatccacaggaaaagataaggacgtggacgctggaacttcgggttcagtgtcagtacccaagctcaaagccatgtcgaaaaagatgcgtgtacctcaggcaaaagggaacaacattcttcatcttgacttccttctgacatatgaaccacaacaacaagatttatcaaacacccgagcaaccagggctgagtttgacaggtggtatgaagcagtacagaaagaatacgaacttgatgacacacaaatgacagttgtcatgagtggactgatggtttgccgcgtggccggccggggctcaccgaacatcaatggtgtctggaccatgatggacggagatgaacagagaacatttcctttaaaaccagttattgagaatgcatctccaactttcagacaaattatgcatcattttagtgatgcagctgaagcgtatatcgagtatagaaactcaacagaaaaatatatgccgaggtatggacttcagcgcaacttaaccgactttagccttgcacgttatgcatttgatttctatgagatatcatctcgaactccagtgcgtgcaaaggaagcccacatgcagatgaaggcagcagcagtccgtggttcaaacacacggatgtttggtcttgatgggaatgtcggagaagcccacgaaaatacagaacgccatacagctggcgatgttagtcgcaatatgcactccctcctgggagttcagcaggggcactgagacggggttgaacttctacgcagtaatttagtaatatatacgtaagctattgtggtgaggttttacctcgttagttttatatatatattatgctatgttcctactatgcctgcaagtgagtgaggtcacacctcgacacttatggtaggtactattactagcttcgaatcacgatacggacggtccattgagtggttctaccacgaggatgcagcgagtttcgtggtgagagacaaaaaaaaaaaaaaaaaaaaaaaaaaaaaaagcggcc

SEQ ID NO: 3441 - DNA, 2966 bp, Zea mays
gcacgagatgccctggacagctagtcacgaaacatgtcgttaaaggcccgtgtccacactttgcattatatttatccacccgccgggatgctgagaagtttttcaggccactcatgggcaaatatgacaaaagtagacttaacaaagcagcttttgtcaaagatcttacaaaatatgcaaaaccgacttacattggtgaagtcaacactgctttatttgagagagccgttgaacatgttatccggatcttgcgtgatgttggaattcaaacatgtgaatatattacagacgaggatgaaattttcaaatctcttaacatgaatgctgcggttggagcgttatatacaggaaagaagagagaatatttttccgagtacacacaggaagataaagcagagataattaaacaatcgtgcgaaagagtatatgagggtaagctcggaatttggaacggatctcttaaagctgaaatacgacccatagagaaaacggaagcaaataagacgagaacattcacagctgcaccattagaaacattactagcaggtaaggtttgtgttgacgatttcaatggtcaattttattcacaacacttgaatggaccatggacggtcggaataactaagttctacggtggctggaacaaattacttgagaagctaccagatggttggatctactgtgatgcagatggttcgcaattcgatagttcactcactccttatttgataaatgcagtgcttaatattcgattacaattcatggaaccatggaatattggtgaacaaatgctcagaaatttatacacagaaattgttttcacaccaattgcaacacctgatggatccgttatcaagaagtttaaaggtaataacagcggacagccgtcaacagttgttgataacacgctaatggtgattatagctttcaactatacgttgctatcgtgcggcatcgacttggaaaaggctgatgaggtgtgtcgaatgtatgcaaacggagacgatttgttactcgcagtgaacccaacacatgtcaacattctaaatgaatttggaaaacacttcgcagcgttggggcttaatttcgattttgaatcacgaacgaaagacaaatcagaactttggttcatgtcaacgcggggcatcaaacacgaaggaatgtacattccgaaactcgagaaagagcgaattgttgccattcttgaatgggatcgatcattactccctcaataccgtcttgaagcaatttgcgcggcaagtggttgaagcgtggggttacaaagatctgcttcacgagatacgtaaattctatgcgtggctgctcgaaatgcaacctttttctaacttggcaaaggaaggctcagctccatacatagccgaatcggctttgagaaacttatacactggtgctaaggtttcagaagacgaactaaacgtttatgcacgacaattctttgacgatcttccaaactatttagcagacgaagtgatagatgtcaaacatcaagctggtgaaaacgttgatgtcggacagaaaaccgaagcacagaaggaggccgaaaagaaagcagctgaagaaaagaaagcgaaggaagctgaggctaaacaaaaagaaaataaggagaaggcaaatgagaagactggtgatggcgcatctaaggagaaaacaactgagaagactggtgatggcacatccacaggaaaagataaggacgtggacgctggaacttcgggttcagtgtcagtacccaagctcaaagccatgtctaaaaagatgcgtttacctcaggcaaaagggaagaacattcttcatcttgacttccttctgaaatataaaccacaacaacaagatttatcaaacacccgagcaaccagggctgaatttgataggtggtatgaagcagtacagaaagaatacgaacttgatgacacacaaatgacagttgtcatgagtggactgatggtttggtgcattgaaaacggttgctcaccgaacatcaatggtgtctggaccatgatggacggagatgaacagagaacatttcctttaaaaccagttattgagaatgcatctccaactttcagacaaattatgcatcattttagtgatgcagctgaagcgtatatcgagtatagaaactcaacagaaaaatatatgccgaggtatggacttcagcgcaacttaaccgactttagccttgcacgttatgcatttgatttctatgagatatcatctcgaactccagtgcgtgcaaaggaagcccacatgcagatgaaggcagcagcagtccgtggttcaaacacacggatgtttggtcttgatgggaatgtcggagaagcccacgaaaatacagaacgccatacagctggcgatgttagtcgcaatatgcactccctcctgggagttcagcaggggcactgagacggggttgaacttcaccacaatagctctcgtgccgaattcggcacgagatgggcaggagcctggaggacaccgtgaagctcttcggcaaggacgcggacgacgaggacgtcggcgacagccgtcgtcacgcgcccagtaagaagccctccccttccactgagcttgagctcagtgctcagcactgagtaatgtgccatccaccacgggtcctcccaggtgtgaccgaagcttatgtctaaagcttcgatgatacagtctactcctagtatcttgtgtgctcgaactgtggtgaatcttttgtagatcccgggcctctccttttttttctgttagatttgtagattttttttgttgatctcgtggcatagtgcgtgtaagaagcaagggattggggcacccaacactttagtctaatttggatactctagtaatgagtgtgattggagtggattgaaaggtattgagaaaaaatttgatctattggtgatttcccccaaaaaaaaaaaaaaaaaaaaaaaaaaaaaaaaaaaaaaccttag

SEQ ID NO: 3442 - DNA, 708 bp, Zea mays
  misc_feature (658)..(658): n is a, c, g, or t
  misc_feature (668)..(668): n is a, c, g, or t
  misc_feature (679)..(679): n is a, c, g, or t
ccggggtatatcccgcgcctcttttgtttattagatttgtacattttttgttgatctcgtggcatggtgcgtgtgcgtagaaaaaatattattaaaaaaaaaacggacgggactgctgccgcggcagcccatgcccatcatccagcacgcacacacagacacgtacagagctggtagataggataaaagcagtaatgacttccacgaccaccaccatgtcctctcttgccttggccctcgcgctgctgctcttgagcggtgacatcggcggcgccgcgcggcagctacaggagctcccgaagcctgacctgccgccgttgcccaagcccgtaggtgccaccgaggccggacctgccgccgctccccaagcccgaggagcagccgccgttgcccaagccggagctgccggtgccaccgcagccactccccatcccgccgcagccgttgcccaagccagagctgccggtgccaccggagcctcttccccgtcccaccgcagccacttcccgtcccgccgcagccgttgcccaagccagaggcagagctgccggtgccaccggagcctctccccgtcccaccgcagccacttcccgtcccgccgcagccgttgcccaagccagaggcagagctgccggtgccaccggagcccctccccgtnccaccgcagncactccccgtnccgccgcagccgttggccaatcccccctg

SEQ ID NO: 3443 - DNA, 1333 bp, Zea mays
ggctcctcgccccccgggcgggcacagctacctcggtaccagcaggcttaacggacggacggacgtcatgggaaactcctcatctcgcggccgatcagagccgaggcagggcgagcagaggaccatgaagtggagcgtcgatgggttcgcctcactcctggacaagggcgacggatggacctactccagagtgttcgagctcatgggctacaactggtacctgaagctgaacccgagggacaagaagagcggtgacgacggcacggagtacgtctccctcgtgcttcagctggatgacctctcggtgaagccggatactgtcgtgaaggcctccttcaagctgctgatctacgaccaggcgtatggaaagcacagcgagcatcaagttcggcacagtttccagaccgcaagcacgagctcgggagcctcgtgcatggtttccctcgaaaagctgaaggaacggccgtctaagttcatcgtcaacaacagctgcaccttcggtgtcgagttcatcagagtcaaggcttccaaagtgagcacgacgtctgaaacgctgtttgtgcggaagccgagcgtcttcgacgaggccaggacctacacctgggacatcgaggacttcttcgcgctcaagaactccggccactcgccggagttcgaagtcggaggacacaaatggagtatcggtgtctatacgtccagcgatgggaaccacctcaccttggacctgtgcatgaagaacacagatggtgtccagcatgacggctctgcaaacctggtagaattcagcttggccatcaaacaccaggagggcggcaatcactggaaagcaacaggccggagccagtttacaagcaacgctcgttgctggggatggacgaagttcatctcgctggaggatttcaaggactcctcgaatggctatctcgtcaaaaacaagtgctgcattgaagctgaggttgcactcgttggttcctcaaagatgaagtagtgtgtcctctgtccttgtctatatatgtgtgtgtgggctgaatgactgaatcacacgatagatgtgcagaggtttggacgtgcgtgtaacgtgtcttgtgttgtgtgttcgttttgttcgtgctgaagacactaaaagtgtgcatgccaaataaggttcgatcggcgcccaagatattgctcagttttgttcccacacgcatgtcttcgctggtgcatgcggtatatcatcaactgttatctatttgtagtaactggtggcagtgtaagtgctacacacacacggtaaaaaaagtattatatatatacatgatatatatatatatatattattttttggtcttcc

SEQ ID NO: 3444 - DNA, 1140 bp, Zea mays
cccacgcgtccgcccgcgcccccgcccccgcccccgcttcctcctcctgtcctccacccaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcctcctcctcctcctcctccgccaccacgacgccgcggtccgtgctggcggcggcgccggcgccggcgctggagatcccgcggcgggagctggaggccgtgctgcggcgcctgggccacgcggagccgtccgacgccgagctcgacgccgtggccgcgctcgccgcgcagcccccgccgtgcgacgccgacgccgacgccgacggcgacctcatggaggcgttccgcgtgttcgacgcggacggcgacggccgcatcaccgccgaggagctccgcgccgtcctggacgccgtcctcggcggcgggtgcagcctcgacgactgccgccgcatgatcggcggcgtcgacgctgacggcgacggcttcgtcggcttccaggacttcgcgcgcatgatgatggccagcgccggcacggccgacgcacgggccttctagtttagtgatccgccaagcatcgccgccatagccctgatgcgcgccggggaagggatcatctaaaatctactgcggccgcgagagcaagacgaggccagccttttgtgtccaaaaaaaaaaacagtgtcttttcggcgcgcaggatgataggctacccacccacctgcttgctagtaggactacttgctccagattgttataaaatgtttgcttgctgctgctaatccatgcacgattagtagaacgcccccgccccgtgcatgcagcttgcaaaattcgttcgagagagtcatgtgtagtgaccggccggcatgcatgcacgcaaaattcgttctttcaatctgccgtatgggatgaatggatgtacgaatacgaatgattggagattcgagttcgcctgtaacaaaaaaaaaaaaaaaa

SEQ ID NO: 3445 - DNA, 1248 bp, Zea mays
ccgctccgagccggcccggccgggagtccctcccctataataaacgggcgccacgcacgccacagccgcggcctgcgagcgaggcatacacatccacgggccacgcccaccggcatctcacggcggaagcagccaagcagccggccgggcgcctcccgtgccgccgctgagcatggccgctgctcccgtgggcgctcagaatcgctgcgtcttcgttggcaacataccatacgatgcgacagaggagcagctcgtgcagatttgcgaagaggttggcccagtcgtatccttcaggttggtgattgacaaagagactggcaagccaaaaggttatggcttttgcgagtacaaggacgaggaaactgctctaagtgcacggcggaaccttcagggttacgagatcaatggtcgtcagttacgggttgattttgctgaaaatgggaggaacactgacagaaatagagaaaaggtcgacgatcctcaaatttttactgtagaagagcctttcctaccacctttggagttctctgttaatctgagaagttgtattgtcttcgttctgtgaatgataatagttgcgccttctccaaaaaaaaaaaaaaaaaaaaagccccccttttttttttttttttagtttaactcattgattcattcgtatttgtattccataaaacatgtatgaatatccacaaaattcatattacattgataccttcggcttgctcgaaggtgaagacacgagagagtgattaaaatttagcgtgaacagtacgatgctactgttcgtctatttataggcacgggatgcagcccgggtaaaagtacatttatgtccccaatattcacttatgatcgtaatgcaagtcattaaggactaaatagtctttttttccttcggtcatcatcatcatactttatctctgatatgagctgaagctgtcaatctggcgatggcttcagcttttgttcttatcatctttggatctatcttcatctcgtatgccttcatcatgagcaaaaggcttgcatcttgaagacgaagctccatgtaatagcttatgctaaaagcaaatggttaattatgtttttgaggaccttcggaagaggaaggccccagcacaatcatttttcaacggccagagaccgccaaaaataggccatatatcattgaaaataggctacttttggcggcatatgccgtattttcggcagtctctggccgccaaacaaatttagccaaaataagct

SEQ ID NO: 3446 - DNA, 2800 bp, Zea mays
attttcgttgaagccgcatccgtcgcgtttcataatgtcaaatctctcgcgagcgaggcagacccacgggccgcggccatctcacggtggaagcagccaagcagccggcctggcgcccctccccttccgtcccgccgctgctgccgtgcctcgtgcctgccagcggcggatgccgccccgccccgctgctgaccaccgccgctgctgagcatggccgccgctcccgcgggcgctcagaaccgctgcgtcttcgttggcaacataccatatgatgcgacggaggagcagctcgtgcagatttgcgaagaagtcggcccagtcgtatccttcagattggtgattgacaaagagaccggcaagccaaaaggttatggcttttgcgagtacaaggatgaggaaactgctttaagtgcacgccggaaccttcagggttacgagattaatggtcgtcagttacgtgttgattttgctgaaagtgggaggaacactgatagaaatagagaaaagggtcgtggaggaccagggatggcatctaatgttgatagtcaaaaacggttagctgggacttctgttgttggagagacaaactttcatcagcctgttggtctcccaccggcaatacatgctgcatctgtgatggctggtgcccttggtggagctcagactgcaaatgttcaaaacggtttacctgtccagtatggacttggaaacgaccctcttactcattatttggccagaatgtcaaggcatcagttgcacgaagtcatggctgaattgaagttcctaactactcaaaacaaagaacattccaaaactttgctgcaaggaattccacagctgcccgggcccgtggttcaggcacaaataatgcttgggatggtgacaccacagatgatgcagatggcaaagagccatcagccgttgggctccttagcacaatcttcatctcacctcaatgagccatatccacagccagagccagatgctatggttccagtagtctcaagaccatcaagtttgccaactaacgtactaccaaacccagttatcctacaggaacaaacagctgcaatacatagttttcctcagcatcaacatgcatctcagccccaagtcaaaatgtttccacatggacaaccgtctgggatcaccacacaatctccaatgcttcatcagccccttggtggttcttccagtgttcctattcaatctcttgtgacctcagtaggcttaacctcacaggttcagcctccatttgtgccagagcaccctggaccacctgtcatgcctacaaatgtacaacagctacctttgacccaccctcatcttgctctggtagccgccgcacctgagactctaccaaatgaaataagggttgctgatcaagcaagtcatttgacagagtttactcatccttcaaaattgagaaaattggaggatggaacctcggtgcctggaatggtgaacagcagccatgctatttatacagctccactgcaagcagtgggccctagtggaccatcagggagctatagtgctggtgctgttagcttacaacaaccagggaatgaagggcagattacgcctgatgtggagtcagctcttctgcagcaagtcttgcagctgacacccgagcagctgagttcgttgccaccagagcaacagcagcaggtgattgaactccagaagatgctttcagctggtaaatagaagcaaccgagctagtgcagcaatattgccggtcgaggatctggcacgtcacataatggcgagttggcaactagtggaagctggaagtgatcctcagatttgttatcaagtcactaggccgcttcataacctgtcagcattttcttgtgggcatcttgatgccatcagttttgctcagaagtatccatatggctttctttcttcagatcagagataaaagaaatgttacaggagatggtagtttaaagaaagggatacacattatccatcactgctgtatcattatagggagaaaataacaataatctgtatccaaaggagctgtttttttttctgcttctccaaaatgggatatagcatcagatttttgtcctttccatttcgtgcaacagttgcaggtaggaaatgaattttgcgtaagcttgttatgttatcgagtagcatcctttatatttattctttatatcccttctttttctttatatcccttctttaccatttcttctaatgctccgtttggatatcggtattggagggcatgaagttgaattgatttcaataccaaatcagctatgatattaaaatgagatgcaatttcaattctattgtttgaatgtcactgcatttgagtttggaatttgatggtctaatttcaagcaatacaaggagggagagtttctagttatagtccaatgccacagaattaactctaattctaaatctcagttccatgtggaaccaaacaatagaattgaattgatttcaataccaaatcagctatgatattaaaatgagatgcaatttcaattctattgtttgaatgtcactgcattggagtttggaatttgatggtctaatttcaagcaatacagggagggagagtttctaattatagtccaatgccacggaattaactctaattctaaatctcagttccatgtggaaccaaacaatagaattcaggaaagctgaatccaatctccaattctatgcaccaatatatacatctaaacaaggtataaaagattccctcctctatatctcctctctagcaacatcctttatatcttgccctctatatgtaaataca

SEQ ID NO: 3447 - DNA, 3634 bp, Zea mays
  misc_feature (1048)..(1048): n is a, c, g, or t
ccttcctactgttgctgccgctcacgcccacctcatgaccccctccgctgtgtggcactagagtcttggtcaccccgccatgctaccttagctaccctacaaaataccagagtcatctctgtaaaaaaaaacttggccggggagggaaagaccgccctcccggtattatattaagaagagaccgaaacatggtcccgaccgagaaaatccccgaaccctggcccagtcatctctgtaataaaatagatcgctctatttaccactcctgtcagcttagtaaacatatgtggttaccttttgctagttcgaactcatgcacttccgccccttcgagtttcttcattgtgatgtctagatttgtccagttcctagtattccgggttgtctttactatcttgtcattctggatgatttttagtcatttttgcttgacgtttctcatgcaacataagtctgaagtgcatcagctagtcactaatttctttcactatgcgcgtgtttagttcaactcacccatcaagtgtttttaggttgataatgacatagaatttgttaacaatgctatctgttccttccttgcttctcatggcactatgttatgcctaccctgcccttacggctctactcataatggcaaagctgaatgcatccccggtacgcttaacaactccgttcacaccctgctccttaacgcctccatgtcgcttcggcctctggcatgtccctatttgtttacaaagatggagaccatgctacctacctgcttctttacgttgatgacatcattctcatcgcatcctcaactctgctgcaatagttcaccgtgcatcttcaattcgagttcaccatggacttggacactcttcaccacttcctcagcatcatcgtcacacgctccactgaaggcctcttcaccgagttcaccatggacttggacactcttcaccacttccttggcatctccgtcacatgctccaccgaaggcctcttcctctcctagcggcagtatgttgttgacctcttgtagcggacgagcatgatcgagtgncactctacatcaactcctgttgacactcatgccaaactctcttcaactgccgtcacgcttgttgctgatccgatcaagtatagaagccccattatcactttgcagtgtcttacgctcactcatcctgacttggtgtatgttgtacaacaggtctatctctttatacatgatccctttgagcgccaacttgtgttgatcaagcataccctttagtatgtcaatagcatgttgtcctatgaccttcacatcggtagtggctcggattggtccttgtttgcttatacaaatgcagattgggctggccgtcctaattcccgacgttctacggttctaccttcgggtagtgtgtcttccatggtgataatctcgtctcttggttctcaaaacggcagactactctctcgctctagtgccgagatagagtatcatgccatcgcccatgtcgtcatctagtgtggtttagacaactgctataggaacttcacatccctgttccttcgaggaccattgtgtattgtgataatgtgagtgttgtctatatgacggccaacccagtgcttcaccgtcgcacatagcatattgagattgacatacactttgtcatgagtcatgacaagggcttaatgttcagttgttaactgatttttggtccagtctttgggtaagtgattctcggattctcacgctgcgactgcgggtgggtgttagagattgtataggattgtatctagacatatcttttagatgattaggtctgtaattgccttgtactccaagccatattagccataaatacatgaaggccacccccacctaagcgtgtgtgttttttcccatctatctttctataggtgctactatatatttattgaacttttgttgttcatgttttgcacttctctttttaggattgtccatagaataacattcatgattatcttgtgaccctgggtggaagaaagagtattccttccatcttattaaacactgaacaatttggtttgtgtgcatgttctgatgtaagaaagatttggcatgtttacttgtgggtcaactgttaataaaagttgagacttgactccctatttctttattttattttgtgtacgtatgcaacgaaataagcttgttgctttgtttgagaaaagcaaatcatgaagctgttctctatcataagaacgaaagattaggaacttaaatttttgccttattgtaatgcaggcacaaataatgcttggaatggtgacaccacagatggttagttcttatttgtctttgagccttaggcacccattgttttctctgccctgatataattaatgtatgttctatacaaattgcagatgcacatggcaaagagccaacagccctcgggctccttatcacaatcttcatctcacctcaatgagccatatccacagacagatgctatgattccgctagtctcaagaccttcaagtttgccaactaacataccaccgaacccaactgtcctacaggaacaaactgcaacactacatagtattcctcagcatcaacatgcatcccagcccctagtcaaaatgtttccacatggacatcagctacgtaggccccccccccccccccatgctacatcagcccctcgatggttcttctagtgttcctactcaatctcttgtgacctcagtaggcttaacctcacaagttcagctaccattggtgccacagcaccctggaccatctgtcatgcctacaagtgtacaacagctacctttgacccaccctcatcttgctcaggtagctgttgcacctgagaccctaccaaatgaaataagtactttggcagagtttacccatccctcaaagttgagaaaattggaggatggaacctcggtgcctggaatggtgaacagcagccatgctgtttatacagttccactgcaagcagtgggccctagcggaccatcagggagctatagtgctggttctgttagcttacagcaaccagggaatgaagagcagcttacgcctgatgtggagtcagctcttctgcagcaagtcttgcagctgacacccgagcagctgagttcgttgccaccagagcaacagcagcaggtgattgagctccagaagatgctttcagttagtaaatagaagcaactgagagctaacgcagcaaaaatgctggttgagaatctggcacatcacataatggcgagttggtaactagtggaaactggaaatgatcctcagatttgtttatgaagtcaccacgccgcctgtaacctgtaagcattgtcggcatcctgatgccatcaggatccatatggttttctttcttcagctcggagataaaagaaatgtgataggagaagagtagtgtggaaaaagggatacgcattatccatcactgttgtatcattatagggagaaaaaaataatatgtattcaaaggaactttttttcggcgcttctcgaatgggctgtagcatcacacatttttgtccttagagttttcttgcaaaaaatgtaggtaggaaatgaattttgtgtaagcttatgacgaagagatttttttttatatttgttgtcataggtctgttt

SEQ ID NO: 3448 - DNA, 1875 bp, Zea mays
ggggttcaccccgtttttttttttttttttgttttacacacacaaaccgtgtagctcctgtttgattattgtcgatctgggtagattgtcgatctacacagcaaacctttggcatggtgttccacgcgtgcgtacgtgcgcagcctgggctagctccaagctagacctagagcaggtcggccatgagcctgaactcctcaatggtgatggcgccgtcgccgtcgccgtccaggcactcaacaatagccgcgcagtcctcggcgctagcgctgccgagggcgccgagcgcccgggcgagctcgtccgcgccgaccagcgcgcctcccgcggcctccagcgtggggagcgccgactgcagcaccgccccgagcgcgcccagtccgagctccccggcgttcatcacgtccaggaactcctcgacgctgagacggccgtcgcggtcggcgtcggcgcgcgccagcatgtcgcgcgcctcggcctccgacttggccaggcccagcgacgccagcaggccccggagctcgggcgccgtcaccagcccgtcgttgtcggagtcgaacgcctggaacgcctccaccaggctgctgatgtagctcagcgcctcgaagtccaccgccagcggccgctctggagccgccgccatggctgcgcgcttagcttgcgtttcgggggtgacttgagctgggtgccggtctgtgcggatgaatgagccccctgctatatggccagcttcccggcccgcccggcctcgtggggcctttaaaagagttggagagccagcgcgtggtccatcgccattgaaagtctcgataagggtctggaacatagaacctgaacctttgcctgctttgtgtcgacatgcaatgggacatgattctcgttgagcatcgtgttcccgcgccgcgatgccatagagatagagccggtcagggtgggacggacggatggggtggggggtggggggtgggaacctttttttttttaggattttattttccaagagaaaataaactatttttgtggagaaaataaaaacctcttagaaaaatgaggtttctaaactagcccttaaacttttacttcatcattttggtagcagagggtgataaaggagcttcgactgtctcacccaccttcgactcagcggaggaagttgtatcgagccttcgttttttagaaggtgtcgccttcggctcgagagctgttgtcgctttcttcaaaaaaatttcatcttttatcagccggacagcttgcctattcaggatgctgacaacccgtttcctcttcaccccttcactccctttgttaagcctttcatagtcagggtattcgaagttcaaggcgtccattatctggttcaatcttcgtttcggtcgggtaccgaaggctgcgatcatcaactgatcttctttcttggtataattaccaagtatttcgttgcacatggtctcaatcatatctagccattcttggcaaggctttttaaattgtttctcgaacttaaagcgataagggagccatacaagctcgtgcttcttccccacttcttttctcttcggcattccccaaccactagaagtcagatatgttctgtttgacaaatactcttgcactaagtctctagtactaatgtgctcggctaccactctaaattctacttcaaccagctggcagggtaaccccaattgcatattgcataagggtcgagtcataccgaagttcaactctaacggactcataaccatgctcattagcttctccctctttttctcatctgctttcatgtaaaaccactcattagtccatccagtcggccacttggtacggtagccaataacaggggccttcgtatccttccggatacacaaaatgtag

SEQ ID NO: 3449 - DNA, 814 bp, Zea mays
  misc_feature (809)..(809): n is a, c, g, or t
  misc_feature (814)..(814): n is a, c, g, or t
gaaaatttggcgccattccaggaatcgcgaaaagaaaaggtcctaccccgcgtcgccgccaattgctttgctcattctcgtgctcggcaggggaacggtgcgaagcggaggagcggcgatgcagatccgggtgcagtgcgcgtgcggcgagtcgtcgtgcccggaatgggccgtcgtggagctgcagggcgtggtgcagccgcaggcctccttcgccggcgacatccggggactccacatcggccgcctctgctcctccccttccccagcctccgcctcgtccaaggcagggttcaccttcacggtggggtaccacgagctcgccggcacaaaggtgacgctcaagaagcccctgctggtgctcaggaagaagaaggttaatgctggtgctcaggaagaagagccaccgacggcggcggaggtggagctggaggtgatcggcatcatccggcacaagatcctattcaaggaccgccccaaggccctcatctcaaagccgccaaccaaggagaagaaggccgtgcagccagcagcaaagtgacgcgacgccagcaactccgtgccccttgagaatctgaagctctcttggtttggctgcgtattccctgaatattgcgcctgttgtagtcatgcctggtttggccgatacttagtcagttgtagtcgcacgttcttttttatttgtcacattttaatttaaaaatgaacttgtgagtgacaaatattttagaatggaaaaagtataagtttaaggatgtttcctctcggaaaaaaaagtttaaggatgatcacttgtattggcaagcggncctcn

SEQ ID NO: 3450 - DNA, 1996 bp, Zea mays
aaatatagtctaattataaaactaattacacaaatagagactaaaacatgagacatatttattaaacctagttaagcatatatttaatactcgtaattgatatttaaatatttgatgtgacacaagctaaagtttagtaagagaaaccacatattcacttaatcatgttgtgtagtgtcactggacatgacaacacttgtggtactgacactatcagtactgaagacaagatctcaagcaatatagaaccaaattaaactttatatcacaaaacaggtagtctctatcacattaaacgtttaaaataataattacaatattaaatatattctaattgaaaaattagttacacatatgaagactaaaatgtgagacgaatttattaaatttatatttaatatttataattgatttttaaatatttaatatgatataaactaaacttttatgagaatcaaatacaccataagttttattggtattttctagagctgagaacttttgacagtattttttagagacggcgaactttggtggctatagaaccaattttccctttataagagatgaggcaaaatacacttcctacgagaccatgaaccatgatcgctcgccccctacggtctctcctctgattggtccttgccttctcacacggatcgctgagccccatccaacagctcgtatcaaccgaaaccaatgccacgcaacgctccagattgcagtaccgccctccacacaacgaaaacacaaacgcacacaagcacacgacgcaagggtgacgactgacgagagggggagagagagacgcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgaggtcagtcggaccacacctattccccacccgtcgcggaagacgcggaaggcctgatttgtctcgcgttgcctcgtgtctccttcctatttttagctcctcgagttggcggggacgcagcgcgggacaacaagaagaaccggatcatcccgcggcacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgcttccaaaaaaaaaaaaaaaaaaaaaagaagacgtcggctgccatccctggggggcctttgttgtgttttatgcttgcatctgctgtggttagctggttatagtaactgtagagtgttgtcttgtttatgttagtgttgcttctcatcagctcgtgttaaagtttaaaactttaaactaaaaactggttatgttctataccctgtatttgtcaactatggtgaggaattattgacatattaattcaggtgatgcttaaataacag

SEQ ID NO: 3451 - DNA, 1058 bp, Zea mays
acgcaacgctccagattgcagtaccgccctccacacaacgaaaacacaaacgcacacaagcacacgacgcaagggtgacgactgacgagagggggagagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcactaggtgctgtttgtaataagattgcaaagatgtgtaaaatttgttttgtgcttccaaaaaaaaaaaaaaaaaaccggcgccgagcgccagctacaaaaagtcaaaaaaaaaaaaaaaaaaaaaaaaaaaaaaaaaaaaaaaaaaaaaaaaaaaaaaaaaaaaaaaaaaaaaaa

SEQ ID NO: 3452 - DNA, 2292 bp, Zea mays
gattggtgtaattcctgccacattagatccaaaccgtttaattgctaacaacgcctggtccctttcagcggctgaaagagaccaggcgttgttatcaattggtgtaattcctgccacattagatccaaaccgtttaattgattattcttacctattgaagttatccagcttagctgataatctagcactgctgggccatacagtccttgaggatcgcgctaatgcttcaatagggcttgaacagggcagtgaacatgctatagacttttggaacatcagtgaaaatgatgaattctgctatggtggggcatgtgaagtccgtgctctgtcttcattacaagctttagcatctagagaaaatcaatcggtgttcatggaatgtttccagtgtgaaaagacagtttgcaaagcttgctgtgctgggaaaggggccttccttttgcttaacacctacagggagttgaagatatatggtgggagtcaaagtggtggctactcagcactcacagatagttttgtgtgcaaatcgtgctgcagtgaaattatcaaacgtgcattgtatgtggattatgtccgggttcttcatagtttgcgcagaaaagatcgtcccgcgccgccggcactgagtgctgtgaatcaggtctgccaactggagtacaagaaagcatctgatttatctcaaagtattcaatttggtcagagacaattgaagcagatccttgatggtgaagaatcccttgcagaatttccatatgcaaactttttacaaatggttgaaactgccaatgactctgaaccactgctttcattactggcgccttttggtactggagagtacacgtcttactggaaagctccacaaggtatcacttcagtggaattctcaattgttcttggtggtttatcagatattgcaggagtttccataattgtcagttcttgcggttactcagcatctgactgcccaattgtagagatatgggcgagtaataaaatacaccgagaagatcgtacatttataggaaagtgggatgtacaggatataatatcttcatctccacagcttcgtggacctgaaaaatctagtagattgagtgaagaaccaagacacattaaatttcacttcccaaatcctatccgttgtcgtataatttcaataaaaatgacactttcccatagaggttctcattcaaccaagtttagtggaggagtttgatcttctatcattgaatgatagctcatcttatgaatcgaagccaaccaatttacataattcatttatccatgcaaaaagaattgtagtttttggcagtttgttgagaaaggagatggagcctgacacatcaggggggataatgagaatgaaaagttatttagacagatcaccggccttggggagatttaggatcccagttgaagctgagaggctgagagataatgatcttgttcttgagcaatatctcttagctaattcacctggaatagctggattccggcttgattctttcagtgttataagacctcgtgtgacccattcaccttcttcatcagagttggacatgagggagttttcattgacacgaatggaagatagatttataaacccagcaattctgtatatacaggtcacagttgttaaggagtccggcaagttggttgtagaggaataccgtttaccagaagtaaaagcaaacacgccactatattttgatttcccagatctacaacaggatgcgcgctgtgttatctttagattgcttggtgacgtcactgcctttgtcgacgacatttctgagcttgagaacttaaacttgcggaatcttcctttggcgtcgggactgtctttgtcaaataagatcaagttgtactactatgctgatacatatgagatgggaaagatcggcagtctctcagctgtataatgtatgtgaggtcgtcgtacatgccaacctgggatggtaaccgtccctagaagattgttgtaacctactgtttctacgtgttgttgtggaagtaagagctgctgctacagatacatgatgctttttttttactgcttctgtattcttgcttctttttgcttttgattagatgaccccagtttgagggatgtagggattttgcctgtagaatttctggaaattcatctctttttttaatgtagaatagccggaaattcaattcgatcgcagtccacgaaactgccagctacgtttgtcgatacctgtattgggacctggattattgtatagagccaagaacttgcattgataaaaaaaaaaaaaaaaaagc

SEQ ID NO: 3453 - DNA, 1935 bp, Zea mays
ctctcgcgaacgcttgtaacccctactgcaagcgcatccccctggcgcaggataacacgagccgcgtttctccccttgtgtttcatctcgtgccaacctatctgggctaggacacgcagcgacaattttactcgtcggtccagagacccccggggtcgaaacgccgacagcctgatatgcgaattcgctacccaaccaaagcgcaaagcatctatgtacactgtgtagtttcaaaagattcctccggtcttggctgacctctcgagcatctatctgtattaacttgaatccatccagaaggtggaggttactatagaatagagtggatcaccagagctttgtgtggtttccctttaagccccaacacccgaagtctaagcagatcagtctgcgaaagtgtgcttgagcccagttgagctttctaagttctcacgtgtggattggaagcgcgaatgctagcccgttgcattggtcgaatcgggttgggtcagattttttcggatggattgagtcgggttggtcgggtggcccatgatgggagcatgtgacggacgatttgacttgttcatgtgaatgcaaacggtactggaaggcgtatttaaagtttacgtaaacgctttaggaaggcgtcttctggtgcgaggaatggccaaatccaacaccaacacacgagacggggacgccacgcccgcgcctcacacggcaacggacgggacgcaccaccagtccaccgccaccccatccaatcccatccccacaaccgggtgccgccgccttctatggcggacttcggcgacgagctctttctcgacgtcggggacgatggtttcggagacctctcctacgtctccttctccgagtccatcgagttggatctcgcctgcccacgcgacgtcttttccgcggggtttgatcccgaaaccctaacccacatcccggggtccccaatctccttcgactccgaccccgacctccgccacctctctccctcgctgacctgctccccgcccttctgggactgcctcgatgacgccgctagcttcgagtgggaggagatcgcggacgctgccctcggcgtcggcggtggcgctggcggcgccggagggggaggacaaggactagaaggagacgccgatgccgacgccgacgtgttcgggttcctcgacgagcgggagatgctgggcgtgatggagggcatcgacagcggtgacgacgactcgatcttctccgatgagcctccgtttgacttcggcgatggcgacacggagcttgaaggcatcttccggagcggtgtcgggtgggagctgctcccggtgccgctggacgaggacgagttcgaggtgctgccggggcacgtcgtggaagtgggcggcgccccgccggcggcgcgcgcagtggtggagcggctccaggtggtggccgtcagaggcgaggaggttgtgcaggagtgcgctgtttgcaaggaagggatggaacagggggagctcaccactgggctgccgtgtgggcatttctaccacggggcgtgcattggtccatggcttgccatccggaacacgtgcccggtgtgccggtatgagctgcctactgatgaccctgagtatgagaagcggaggacgaggcgccattctgctggtggttcaacaccacagttgggtgcaccgatgcaggtttgagctagggctgattggtgctatgtcttggatgcaattccatcattccacggaagttagaaacctcactcattgaattggcgctaggatgtttacatgccagtagaattatacttctatgatcttgattttttcaggatttagcttttgtgctcgagagttgaatggtaagaacaattatcttaacaatttgtacatacatcttgtttcaatcaaattcttccttgcttttcagagggtatagttactaccatatttgtac

SEQ ID NO: 3454 - DNA, 1818 bp, Zea mays
ggacctgtccggatttcccttgtcgattcacgcccccgattatcccgcccggaccaagcgcccaacaactgccgccccaagccaagggaagggaaaaggctatcgttctcgtcagtcgtcacgagagccgcgacggcgcgcatggcggcgacggcagcggcgctccggtgctgcttccccggatcctccggtgtcggtagtggcttcgtcaagcccaactcctccaggcgaggctggtgcgcagcggccgtggcggcgccgtcgcgggaggcggaaccggtttcgtcgctggggcaccgcacccgcgtcgacttccccatccttcaccaggaatttgatgatgccaaattagtttacttcgacaatggtgcaacatcgcagaaaccatgtagtgtgatgaaaacattagatgagtactaccgatcgtacaattcgaatgttcatcgtggtatccatgcactcagtgcgaaggctactcatgcatatgaggatgcaagaagaaaagttgcaaattttgtcaacgcagctgatagcagagagattgttttcactcgtaatgctactgaagctattaatctggtagcctattcatggggactatctaacttgaaagaaggagatgaaattgttcttacagttgcagagcatcatagtgctattgttccatggcaatttgtttcccagaagactggtgccaccttaaaatatgttggattgactaaagaaaatgtcccagacattgagcagttaaaagggtttctgtcgaacaagacaaagatagttgttgttcatcatgtctcaaatgttctaggttccatgcttcctatcgaggagattgtaacatggtcaaacagagttggagctaaagtccttgtagatgcttgccaaagtgttccccatatgccagttgatgttcagaaacttggcgcggactttcttgtcgcatcctctcataagatgtgtggccctacaggcgtcggatttttgcatggtaaatttgagattttgtcgtctatggagcctttcttaggtggtggtgaaatgattgcggatgtattcgaagacaaatccacatatgctgagcctccctctagatttgaggctggaactcctgcaattggagaagctataggactgggagcagccatcgactatttatcatgcattggcatggagcagatccacgaatatgagaaagagctggggacatacctctacgaaagccttctctctgttccaaatgtccagatatatggcccggcgccttcccagactgtccaccgtgctccgttgtgctccttcaatatcgagaacgtccatcctacagatatcgcagagattcttgatctgcagcatagcgtagcgattcggtcggggcatcactgcgcgcagatcttgcataggacccttggcatcaacgcaagtgctcgtgcgagtcttcacttctacaacacaaaagacgaggtggataccttcgtcgacgcgcttaaagccaccgttgatttcctcacggatcgatactagtgcggttcagttcagttcccttttttttttgccagtttcatcgctctctcgtttgaactgttgtatgcacacacaaaaaagtatgcatatatatttggtataaagaaaacatacaaagtgtacggcttggcaaagtgagctcccttatttggagttttggactgtactcccttatttggcggttgttgttgaattaaacgtagttcaaaaaaaaaaaaaaacaaacgactcgaccatggtcactgttatgcaggaaaacattgttatacgaggcggccagccggcagttaactc

SEQ ID NO: 3455 - DNA, 4397 bp, Zea mays
tcgtccactcaaacaagtcaactttagacacatcgccggcccccgcgggaaatgctgtacacagttccaatcagacggtgaaaaaccatgacacaaaaccagtggcagttcaagccgcgacaggtaaccctgttatgggtcatcgtgctacaccaggcgtggcatttgctccaccaaaacctactttcatcaatcacaatgagatagcaaagaatgttctacaatttcttcaccaacctgcaaaccatcctagctggactccaccatcaactgagtacatgcattctcgtttgtgctgtcaaatatgcaaagttgatatcattggtacagacaatttacttgtttgtgatgcttgcgagaggggagtacacttgaaatgccttcatcagtatggcaataagggcgtccccaaagctgagtggcattgttctgcatgcctgactcagagtaagggaaaacccttgccaccaaaatatggcaaggttacaaggactgtagttgcatcaaagactgctccacctggtggtggagcacagctttctttgcaggaatcagcagaaaacatggctgcaaaggaaaatcaccaaaagttggctgcaaatggaaatcttatgaagccattctccattcatggtggcagcacagtacccgacagtaatgtattggcactgagtgctgtcatggctggttcacaatcacaattagtttctaccttgagaccatcaatagtcgttaaagctgaaacaccctctaatggaaaggaaggaactgggcaaccatgcaatactgcaatacaacctaatgtgcgatcatcttctcttaacaacagattgagaagtgattcctgtttgaaccctgctgattcagcaaatgaaatcatgcatggtaagcatgctgcagaaatttctggtgttgaagcaaaggtcaagtctgaagcaaactctgaggttgttgtgagtacagatgaggaattggttcatagcagtggaacatcaatcgaaactgaacgagccaaggttgtcgctattgaagaaaacagggcacaatcaacctttgagacagataaaatgaaagttggggaaacaactatcaacacaggaacaacagatcaatgcatcaatactgaagaaaagctccccagtttagcaacttctgaggcacacacaatcactgacgtgaagatgactagcaatacaggaataccagtacagcaacacaacattgctactattgaagagaagacccagattgatgcagtgtctgatccacatccacatgcaatccaagatattcaagatatggaaatgggcaccaacaatggaccacccatagatcaaacaagcagtcttgttgaagaaaacccccctggacaatcctcttcaattgctgatgcgtgtgtcactgctaatactggaataccaacagatcaaacacagcatccaaatgagtcaactgaaaatgcagtaaagaaatctcccaacagagaactatataaagaaaaaccgggctgcaacataacctcagatattacccaaaaagtaacttcaaatggcatcatgtgccctgaggacaaaactttatgtgttcatgaagataaagcagtgggttgtgacacagaagcaaaagaagaaaactaatttagtagcaggttgcatccaattttcattttccaggtgtgtttgtaatcaaactagttattagaagtcttatgtctgaaaatcttgcctattttgatttatgctgatagtgattcttttaaagtacattatttgaaactgatgtttgtagttattctttacttattatagatatgtcaatcacattagcttatttgaactcatggtaataagtatgcttaagtgacctttaaggcctgtattttattgcagcacatgcttttcccccaactctggaaactgaaaccttgtatggccttttggattgaacatttgtatcttaccttaccttaaatctttccacagatggaactgttctgaatctaccattattttaccaacgtcagtgattgactgtgttctctacattctcttggacagcattatacatttagccattgccaaccatttttccaggaggtttgttctgtgccccttggaaacatgctcaccaggcttactccattcgtaatttactggtacaccacatttttacaaaaaaaataaaaataatattggtgttcctgctgacatgaggtttactaaactctgcaggtatccattgcctcctggtgtagtttagagaatcccagaacacaggaaatataatcgtgatgttgtactttatgtagattgataatcttgagttcctgactattgaattccatttccccctttatttgttccgtgctcatctggaatgctgtaactagatagggtttagctgagttaggactggattatcaagtcataataatgatacgtgccttcgccatcccttcggaccatgttccaatgtgatacaatctactaccatgcaatatatcaccatcagcctgctaacgcacgccactagctttaagtttccaatccttctgtcagtttgtaatgtttgcagctacttcatccgtttcaatttacacttcctatgtccaatctaatggtgtgtttggttgaaatgatgggatgggatgggacgattgtttggttcatggccatcaggtggggcgagttcaggtttccgtaggcaccaacgcgtcctggaggtcggcgattagttctcccgccattttgatgagaacatcatttatctccattgccgtcttgccgagctagcgcagccgcagcaaccacctgggcggctgcgccggcagaggtccatcgagcatggcaacagactcctgcaacgcaatttcaacatgtgtcttgggtcgatttttggcgaggcgtgcactgcgacgtaccgttgacatgtccaggactcggcgcggttgctgtactgcttgtggcgcattccgtgggctgggcatgctccgaaggtgtggtggtgaagaacgtagcaacacctgttgatatttgttcctccattgtgaggactgccacatcacttagtatttttgaagatttggacctgcaaccctaaaccttcgagaactcaactgagaaacaataaaaaattcaagacctttaggcccagtttttaacaatttggtttatagaaattgagatggtttcaaacaaatcagtttatgacttagattatagaaattatattttcagtttcttaaaaattggtctcttctacctaaaagatacttaaaaattaggttgcttcggaatagggccttagtgggttgctttcgaacagggtcttagtcgggcacattttactcttttatattctcgatatagggagtgtttgaatgtattagagctaataattagttgactaaaaaatgctagtggaattagctagctaacaaataactaactaaatattaactaatttactaaaaatagctaataattgctagggtgtttggatgtctttaactaattttagccactaactattagctagtgcattcaaacacccctataatatggagactgctctagaatttctgcggagcaatgtactagtaccttacaatcatgagcgatgtacctggacgcattgtgtttgattgaacgttcattgcaaatttccttggggggaaacaaagcaaccctttgttcatgaatcatgacactactatgacagtgatagtgacagtgtacgtgaagtgaccagtgagcagtgtgacttcttcatcatacaactggagtacggtgacgagcgctcatacacaacacggattttacatgatgcgtccaattcatcgcacctggacatatggaagctgtatacgatgaacctggacacgtttacagtcaggctctatctccgcccagtccgcacgcccaccgaaacatacataacagcacaaccgtcgtggaactacacgccaatcgccaagtagggcaggccgagtttgcaacagccggcacaaacaaccacccacacacccatacaattggtgcttcacgttccaccaaccgaggccttgatcagcgcagcaatcggcgtggtgacaatggagttcttcccgggtgcgtacaagaaggcaacagcggcgctcgacgaggcggcgagggcgcggctacggggcccgttcatcagcgacaccgtcgcgccatcgccggcgccgtccggcggcgctgcggacgccgacgacgatctgatggattcggtcgacgagttctacaacggatacggcgagcacggcacggacggcggcgccgtcgccaaggatgccgtacggatccgcgcccgagcggagcgcattgtccgagacgccgggccagccgcccgtggcgggcgcggcggggataggaagc

SEQ ID NO: 3456 - DNA, 2128 bp, Zea mays
  misc_feature (476)..(476): n is a, c, g, or t
  misc_feature (521)..(521): n is a, c, g, or t
cattgcccaccccgccgccccccccggccgcgctcccggtccctgcgcgtgtttatccacgcctcacgccgcgctcgcttcggccacggcggtaatggcggcggcccgacgcctcttctccttccacctccaagcgcgtcctctcgccgccggtgttgccgtcgcgaccccgcactgccacggaaagcatgacgcggtctcgtgcaaggccacggggaaaaccaagcccaaggcgaaggcgggcaagggcggcgagcggcagcataggcgggcgctggaggagcatctcaagcggcgcacccgttccgcagctgccttcgatgccgacctgtacggtcggcgcgcccacgagcaccatatccccgtcttgcttggcgaggtcctcgccgccttccgcaggccccgcccgctccgctccttcgtcgactgcaccctcggcgccgcaggacactccctcgccatgatggaggcgcacnccggagttggagttgtacattgggcatggacgtcgacccctccgnctctggggattggccatgggcacattgaggccttccttgctggtagggaaagggaagcgaatggaggggaagacgatgccttgcttgggacgctgcgtgcctacactcatgtcaagaacttcaagtacatcaagcaagttctcagtagcgtcgatgagagtctagtggttggatcttctggagttgatggtatcctcattgaccttggcatgtcatccatgcaggtgaataaatctaataggggattcagtgtactccaggatggtcctcttgatatgcgcatggaccctaaggcaactttaagagcagaggacattttgaattcttggccggagcttgaacttgggcgtatcctgcgtgaatatggggaggaaagcaactggcaatccgtccagaagcaaattgttaaagcccggtctgtgggcggtttacactctactggggatcttgtcaaactaatccaaaggatgtgtaccatatcaagcgggcggcagggctggatcaagacttcaacaagagtgtttcaggccctcaggattgcagtcaatgatgagctccgggttctagaagattcactccattcatgctttgactgtctggcgacaggtggtcggcttgctgtaatctcattccacagtctggaggatagaattgtgaagaaaactttcttggagctcatccatgggggtgaagcaaatgaagaagacgacaaagacgaccaggcactcactgatatcgaagacggagatgaaccatggtctggccagagagtgcaaggaaggaatggaaccgtcctcacaaaaagaccaataaccccctcgcaagaggaggaaaaactaaaccagaggtgcagaagcgcaaagcttagagtcattcagaagacctgaataatttcggataaattttgaaggattcctgggcacatcggcgtgtagttgtttatagccagagaaatgtgaatgggattctcacttgcgtgcacagccagctgcagtctggatcaccagaaattttacatcagccggatgtggtggtgctatttatcctcgacaagaaatctagaggcttaggttagtcgaaaaaaaactcactgtatctgcatcagtttctgaacttcgttcatgtatatcgcctcatgaactctgtaaacctttcacttgcaagacacgataatcagtttagggttttcgagccctccttcaaaactaaaaaaaaagccagccagccccgccgccccaatgaggtgtcggtcctggagaagaacacctgatctgatcagcgagctagtgacctgtggaattactcgtgcacaggttacccttctgctgctgtgtattgtaatgtaaggccatcaacatgtataccgccgcaacagctgggcagtgggacccggcgggaagtacaggtacagggtgtgatgctctgtttggtagaatgttatagcctttgcgcatcattcggaaatttgaaatatgtctggctttttttttgcaatattcgtcctctaattaaaatatgttatcctggttgtgacaatgtttcctacagtagactaatcatgtctgttgtgacaaatgttccacgtggtagactaatcgtgttagctg

SEQ ID NO: 3457 - DNA, 2011 bp, Zea mays
attcggctcgagggaggagctgcggcggctcctggagctgctccctagggagctgagtgggcgggtggagacccacccagagctcccggcgctcgtggaggtggtcatggacctcggccggcccccgctcgcgcgcttcccgtccggagacttcctcctctcccaacgccccatctccttcgacgacctccgtcacgctacctcccaggttggggactttggagcggataatcgtgctggaatcagccgcacgctgcaccggatcagcgccattaggaatcggaagggcgtcattgtcggcctcacatgccgtgttgggcgtgcagtgcccgggagcgctaatttgcttcaggatttggttaaggacggtggctcattgctgctcatcggcccacctggggtggggaagactactgtcataagagaaattgcccgtatgttagctgatgactataagaagcgcgtgatgattgtcgacacatctaatgagattggtggggatggtgatattcctcacccaggaataggcaatgcacgtaggttgcaagtgcctaaccaagacatgcagcataaggtactgatagaagctgtggaaaaccatatgcctcaggcgattgttattgatgaaattggaactaaactagaggccatggctgcaagcaccattgcacagaggggcatacagcttgtggcaactgcccatggggtaacgatagagaatctgatcatgaacccatcactagagatgcttgtgggaggaatacagagtgtcacacttggtgatgaagaagctaaccggagaggagttcaaaaaactgttctggagcgcaagggcccatcaacatttacttgtgctgcagagatcgtctccaaaaaagaattacgtgtccatcgtagtttggaagccacggtagatgctttactcgcaggtaagctgcctaattttgaaattcgaaagttgggttcaaagggatctatgcaggaagtttctgtgcaaaaggaacaatcacatcttggtatttatgatgcaactgaatttggcagtgactctctaaggaatgccagaagaagcttagactctgcatttagtcttgactctgctgaagggcatatagtgaggtcagatggagctgattcaagctttaatctttatgcatatgggatctccgagtcgactgccttgcaagccattcatcagctggagttggacggcagtgttactttaacttataatatcagtgaagctgatgcagtgatcgcgttacattcaaagctcaagaagaactctcagattcaggctgtgctgaaatctcaagatataccggttttcctcgtaaagacaaactccctgcctcaaatcaccagggcactccgtgctcttgtcgacgatcacatggacgaagtgatagactacaatgataaagaagaagcaaggtcatcagaagaaaccgatgctctggaggaggcaaggctggcaatcgagcaagtagtgattccgaaaggcgagagcgtgcagctactgccgaggccatcaagcatcatctcgtcccaagtgggtctcgtcgaaagcttcagcctcaagtgggaggtcgtaggccaggagcctaaggcatgcgtgaggatccttccgcactttgcgccaaaacaagtcgaagctgtcgcgcgagaaaccccagcggagcccgccgactcggactgggagagccacgatgactcggatcatacccagagtggcatcaccaggctacctttcctaccggattagcgcggcgtctggcgtatcctttcagttcttcgtggccctgccgcctgctgtgtatgtattccatttatttatcttggtaataacttgcaccagaaagcacttgcgtggttgcgtctatctacctacgtaatataagtggatagtgctccgatccggcctctacgcgcgcgtacagatatatatacagtatctaatctgttgtcgacccgtacagtcatatcattcatgcatctcttaccatttttt

SEQ ID NO: 3458 - DNA, 1529 bp, Zea mays
gctctataaatacgtacaccagttcaccgcccgagctagctccaccagttcaccttccccttcccctgcccctgcgtgcgtgaccggcgacctagctcgcagtcgcactacactactcctcgaccaccactccgatccttcctgcctcgacgacggtcgcgcgcgcggcagcccatgaagaagaagcaggcgcgggcgaggcggcagcgcgtcccggcgttcggggagtggaaccatgcctacagctacggcggcggcggcggcgaccaacggcccgtcgtcacccactacgacctggactccgccatgcagatgcaggccaggcgactcgtcgtggcgataccggcggtgccgcccaagcctgccagcaaggtggtgaagtggaggcaaagtgccacagccacgcttgagctggaggacgaagatggcgagcacgagcacgaggacgagaagaagcagctgcagcagcagcatttgggtttggacgtggtggtgggactgggactgggcggccacggcggcgctggtggcgctgccaggaagcagcaggggaagcagcagagcccggtggtgggctaccaggcgcgacggaggagggcggcggtcaagaccgtggaccaggacctctaccacatcccgcccgacatgctctgccacgagcccaggaaacgtctgacaaggaagaagagcctgtggacgggctccctgggtctcagctgcgtcgtcgcatagggatccgccattgcccacctgctgacagctcatcatgagtcgcccctcggccctcgcctggcctgccttgttttgcgtgttgtgccaccccgtactgtaaagacactcggctgctccatagcagaaaaccatggccatcatgttgtcacaccaccatcatcatcatctccacagtgttgtgctggctcgtcaactcgtcgtcgtactacgcgcgcgtgggagcagtgggcggacgggaaacgacttgttgttggatgtcgccgccgtgcccccgacgtgcgcggccgcccgccccggcagcgtcatttccccgtgccccgagacccactcgagcgctgcttttccaatttccacggcgtgcggtggcgttgcgttgcgacctgcgacctgctgctgtacggcgcccccggtgaagccggcgggaaaaggttgtgcgtcgtcgaaaggtcgatgacatgacagtgacatcgatgccttgtacgactattaacttcgcaccactctaaaaaaacacttctctggaatacgtaaaaaaggagctccaaaaggccttgttctgcgcggggtgtcgccgtgttcaagcttaagatcccatcttggggatttggagttgacgatgatgggcgaatgacgccggacacccccctgcatggcccctcaatcatgctacctagctagctaacggtgtgttgatcgagcgcggttttcatgtccgccctgtttatagcgtgttccccaaaaaaaaaaaaaataaaaaaaaaaacaaaaaaaccaaaaagggaaaaaaaaaaaaaaaa

SEQ ID NO: 3459 - DNA, 3588 bp, Zea mays
tgatgcttctgtagagcttacacggcggtgcaggcacgcagctgccgcggttggtgatttgatatttgtgtatggaggttgccccgcaggtgtgctgttagatgacctcctagttgctgaagatcttgctgctgctgaaacaaccagtgcagctaatcatgcagcagcagcagctgctgcatcctcaaatgtacaaagagaaccgggtagatatgcctacaacgatgaacaatcaggacaaacagttacagtttcaagtcctgatggagctgttgttcttgggactccagttgctcctccagtcaatggggacatgtatactgatattagtcctgagaatgccattatccagggacagagaagattgagcaaaggtgttgattacttggttgaagcatcagctgcagaggctgaggcaatcagtgctactttagctgctgtaaaggctaggcaagttaacggtgagatggagcattcacctgacagggaacaatctccagatgctgcaccaagtgccaagcaaaattcaagccttataaaaccagatcctgctcttatgaacaattcaacaccaccacctggggttcggttgcaccatagagcagttgtggtagcagcagaaactggaggtgccttaggtggcatggttagacagctctcgattgaccagtttgagaatgaaggtagaagggtcatttatggcacccctgagaatgcaactgcggcaaggaaattgctggatcgacaaatgtctattaatagcgtgcccaaaaaggtaattgcttctctgctgaaacctcgtggttggaagccccctgtgcgaaggcagttctttcttgactgcaatgagattgcagatctatgtgataatgctgaaagaatattttcaagtgaacctagtgtcttacagcttaaggctcccattaagatatttggtgatctgcacggtcaatttggtgacctcatgcgcttgtttgatgaatacggtgctccttcaactgctggagacattgcgtacgtcgcttgtcttttcttgggtgttttgctcgttcctgtttcctggatttgactaatattgttttggattctggaactcaaattattttggattccaagagtccctaaatgcctattctctaaaagaaacaatagaaagatgttaagttgtaagttcttcatttatttgtgataaacactgctgacatttatgtagcaggcactcctgactttgtatgtactttttttgaattgaaaatgcagttacatcgattatcttttcttgggagattatgtcgatcgtggtcagcatagtctggagacaatcagtcttctccttgcactgaaggttgaatatcctcacaatgtacacttaatccgagggaatcatgaagcagcggatatcaatgctctatttgggttccgaatcgagtgcatagaaagaatgggtgagcgggatggaatctggacctggcaccgtgtgaacaggttatttaattggcttcctttggctgcactaatagaaaagaagataatctgtatgcacggtggtattggtcggtccatcaaccatatagagcaaatagaaaatcttcatagaccaattaccatggaagcaggctcagttgttctgatggatcttctatggtctgatccgactgagaacgatagtgtagagggtctcaggccaaatgcacggggccctggtcttgttaccttcgggcccgacagagttatggagttctgcaacaacaatgacctgcagttgattgtgcgagcacacgagtgcgtgatggatggcttcgagcgtttcgctcaaggtcacctgatcactcttttctcagcgacaaattactgcggaacggcaaacaacgcaggagcgatcttagttctcggaagggatctggtcgttgttccaaagctcatccatcctttgccgcctgccattacgtcacctgagacctcaccagagcaccacattgaggacacatggatgcaggagttgaatgccaatagaccgccaacaccaaccaggggccgccctcaagcgcccaataacgaccgaggctctgttgcttggatatagcggcctggccatattatgaaacagtcagatttctcgcctcccaccagtggcttgaggcttatattatccatccatcttgggcacatgcaggcggtctgtgctgaaagcacatgcttagcccaaaacaacatcgaaagggaactgttcagggagcgagactaagcggtgctctgaagacagaaggccagagaagactcaccagtcaccgtcgacagtgctctccaaatccttcccctccaaatgacatgagaagtagaagaacagaaccaagtgttggcaaaccacagggtcttgcctgaggtcacgcctgtacatactcagatgccagcagataggcggggttgtgtactgtgttctttttgtcgagcgtccaaagtggtagcagcagtccattgtgctaggtattcatttgctgtagggtttttgtttcttgtccctcatgttgcagagtatggaagtgataaaaatgggtcgttctgtcaggtcgtgtataatagcgttgtcgcttgtttatgggtagtagcagcgagtcagctgtcagcacgccttacacctccctcgtgttgtaattcccgtcacctgtgctgagagtgtgcacaatatatcgtcgtctgttgtccaaagttttgggtcatggacgggtttggtgatttgagttgatttattagagaagcaatgtgttgttcgattttgagctttatggctgtgcacctctgggcttttgggacgcgacactgacagcgtgagcaaggcgactaaccgaattggatgctatcctgcatatttgcgcctgaattaaggatctatttgggtttaataagctaagagctaaaattaactaaggaggtgtttgattttctttagtcatcctcctaaacttcagcatttagaaatcttatctagaagacattttggtcatttcgtttggtattttagttactaaaagtgacaaattttagtaactaaggttcaggagttgagaaacaccctctaaattgatattttttttttaccatttgtcagttttagttttttttaatctttagctctaagtgactaaacttttagctacttttactttagcttttaaggatcaaattatccgctatgtaggaccttattttcaaaatatctaaaacgaatcaatagttttttctggatgtatagaggtcattagaagttgcaatcaaaagatattttttgtctggaaacaccagaggacctgacttaaggttgcaaactcaggtgtgaaaacaactgccccagataaaggaacaattcactagcgcaatatgtagtattgttagcacaatgcgatgatggcatcatgtgaaggattactatattagtatctcttgattccagttagatttgtgcttgaatagtacttgagaaataatcacattcagcggcagtgtgttgtagctgcaccatcaccactagcagcagcagcagtagcatgacctgtttttcaattgtttctttgtaagatgctgtagaatcag

SEQ ID NO: 3460 - DNA, 2969 bp, Zea mays
caagataaccatactcccagtgacacctttttcaatatatattctcttatactgcaaacataatgaaaaaggtgtcactgggggtatggttatcttgctagatctgctagtgcccgttctgatggcctccttttgctttgtggtggaagggatgccaatagtgtgccactatcaagtgcatatgggcttgctaagcatagagatggacgctgggagtgggcaattgcccctggtgtgtctccatcacccagatatcaacatgcagctgtttttgtcaatgcacggcttcatgtctcaggaggggctcttgggggtggtcgcatggtagaagactcctcaagcgttgcagtattggacactgctgctggggtttggtgtcacaccaaatctgtagttacaactccaaggacaggaagatatagtgcagatgcagcaggtggtgatgcttctgtagagctcacacggcggtgcaggcatgcagcagccgctgttggtgatttgatatttgtttatggaggtttaaggggaggtgtgctgctagatgacctcctagttgctgaagatcttgctgctgctgaaacaaccagtgcagctaatcatgcagcagcagcagctgcatccacaaatggacaaagagaacctggtagatatgcctacaacgatgaacaatcaggacaaactgttacagtttcaagtcctgatggagctgttgttcttgggactcctgttgctcctccggtcaatggggacatgtatactgatattagtcctgagaatgccattatccagggacagagaaaaatgagcaaaggtgttgattatttggttgaagcatcagctgcagaggctgaggcaatcagtgctactttagctgctgtaaaggctaggcaagttaatggtgagatggagcattcacctgatagggaacagtctccagatgctgcaccaagtaccaagcaaaattcaagcctcataaaaccagatgttgctcttgtcaacaattcaacagcacctcctggtgttcggttgcaccatagagcagttgtggtggctgcagaaactggaggtgccttaggtggcatggttaggcagttgtccattgatcagtttgagaatgaaggtagaagggtcatttatggaacccctgagaatgcaactgcggcaaggaaattattagatcgacaaatgtctattaatagtgtgcccaaaaaggtaattgcttctcttctgaaacctcgtggctggaagccccctgttcgaaggcagttctttcttgactgcaatgagattgcagatctatgtgatagtgctgaaagaatattttcaagtgaacctagtgtcttacagctgaaagctcccattaagatatttggtgatctgcatggtcaatttggtgacctcatgcgcttatttgatgaatatggcgctccttcaacagctggagacattgcttacattgattatcttttcttgggagattatgtcgatcgtggtcagcatagtctggagacaatcagtcttctccttgcactgaaggttgaatatcctcacaatgtacatttaattcgagggaatcatgaagcagcggatatcaatgctctttttgggttccgaatagagtgcatagagagaatgggtgagcgggatggaatctggacctggcaccgtgtgaacaggttatttaattggcttcctttggctgcactaatagaaaagaagataatttgtatgcatggtggtattggtcggtccatcaaccatatagagcaaattgaaaatcttcaaagaccaattaccatggaagcaggctcagttgttctgatggatcttctgtggtctgatccaactgagaatgatagcgtagagggactcaggccgaatgcacggggccctggtcttgttacctttgggcctgatagagttatggagttctgcaacaacaatgacctgcagttgattgtgcgagcacatgagtgtgtgatggatggctttgagcgattcgcccaaggtcacttgatcactcttttctcggcaacgaattactgtggaacggcaaacaacgcaggtgcaattttagttctcggaagggatctggtggttgttccgaaactcatccatcctttgccgcctgctatcacgtcacctgagacctctccggagcatcatattgaggacacatggatgcaggagttgaatgcaaacagaccaccaacaccaaccaggggccgccctcaagcccccaacaatgaccgaggctcccttgcctggatataacaggctggccatattattaaacaattgatttcttgtctcctatcattggcttgaggctaaaattatccatccattctggacacatggaagcactctgctgaaagcacacactggcccaaaacaatgtcgaaagaaaactgttcagggagcgagactaagcggtgctctgaaggcgaaggccagagaagagtcactgtcgacagcgctccccaaatcctttccacaaacaagtagaagagcagaaccaagtgttggtaaaccacaggatcttgcctgggatcgcgcctgtacatactcagacgccagcagatagaggaggggttgtgtatgtgttctttttgtcttagcgtcgaaagggatagcagcgtccattgtactaggtattcatttgctgtagattttgatttgttgcctcatgttgcaaagtatggagtgggaaagttggtttcctcgtgtgacggacggtggtctgtcaggtcttgtataatagcgttgtcggctgtttatgtttgcagcgcgtcagctgttacttagcacaccttacacctccctcatgttgtaattcccatcaccggtgctgatgaatgtgcacaatatattgttgtctgttgtccaaagttttgggtcctggacgggttaggtgatttgatttggtttattggagaagcaatacgttgtttgattttgaaaaaaaa

SEQ ID NO: 3461 - DNA, 756 bp, Zea mays
aggcacggcattgccatcagtggtgacgacggaagccgcagtgggagctgagtcctcggcgacggggttcttgggtttcggcggacgtccgcgcccgcgcttgacaggcacggcagcggcggcgacgggagctgtagcgggcttaccaccgtagccctcagcaacggggtccttgggcttcgggggccgtccgcgtccccgcttggtatgaacagggttgacatcagcgctgacaacgggagctggagcaagcacgtcaatgtcgtcgacatcagcggtgacaacgggagctggagcaggcacgtcaatgtcgacggcgtcagcgtcgatgacgagaggggaagcaagcaacacatcgtcaccaacgtccaacacgccagtagactcctcggcggcggcggggcccttgtgcccaccggtgctcagcggggaggcttcgtcctcgttggggaggagatagttgttcctgaggaaggcgagctcaccggtagccttcatgcgggcgaggtggcccgtgaggacggcgttgtgctgggcagggaggttggagccgtagctgcccttgatgtagtccgagatcgcagtcttgttgcagccgttctcgagtcccagcgcccggattgcctccacgatcatctcagggtaggatgggagccggggaggaggcggggaagggacggagccgtctttgccggccatggatccggcggctcgttgcggtgagtggggtttggagaagaggaaattcccgcccgg

SEQ ID NO: 3462 - DNA, 1809 bp, Zea mays
  misc_feature (1805)..(1809): n is a, c, g, or t
ggaccctcgggccgccctgaacgagtgccctcaacggtcctagcaatcgcgtcaccgtcttctccatcgccggtgctcccttactctcgatggcatcctcggccgccgctcgccgccttctcctcctccgccaccgccatgggcaccttctccccaaacgccacttctcttcctcatccgctcccgacggcctcgatgacggcggtggccgcgtcaagatcttcgaccgcgacctgaagcgccggcaccgggaccgcgcggcgtgggcgatgcgtgagaccgatgggctcgtggatgcggtcgctgagaacctcctagaccgcctcgaggactgcaggaaagccttcccctccgcactctgccttgggggctccgccggcgccgtccgccgcttgctccgtggccgcggtgggattgagaggctgatcatgatggacatgtcagccgatatggtgaagaagtggcgagagtcagagaatgccactggtgatgggcctgagacccactttgttatcggcgatgaggagtttcttccaatcaaagagagctcacaggatttgataatgagctgtcttggacttcattggacaaatgatctacctggagcaatgatacagtgtaggctggcgttgcaacctgatggcctttttctggcagcaattcttggtggagaaacactgaaggagcttagaattgcatgcacaattgctcaaatggaacgcgaagggggcatcagtcctcgaatgtcccctttagcgcaagtccgtgacgcaggaaaccttttgacaagggcaggctttacccttccaggagttgatgttgatcagtataccgttagatacaataatgctttggaacttgttgaacatcttagagcaatgggggaaacaaatgctctctttcaaagaaatcctgtgttgaaaagggatacggccttggcaactgcagcaatttaccagtcaatgtttgggttagaagacggatctattccagcaacctttcaagtaatttacatgactggctggagggagcatccatcacagcaaaaggctaagagaaggggttctgcgaccatatcattcggtgatatacagaaacaatttggtcccagtgagaactgagcctcactgcttcagaaatgtgttcccaaaccccactcaggctttgtttgggtaaagaggaactgaagtggattgaggtgtattgaaaggattaaaagggaaattagttcatgttacactttaatgcactccataccacctcaatccactccaataagagattacccaaacaaggcctcatgcgggagcttccggagctgggtctaaccattttagtattcccaaacccttgatcgaaaattaaaaaaaaaacaacacttgaggaaagaaaagaaatcctctggtggttccacccaacggctttgtattcctgaaggttgatgtttgtggtgggcttctgttgcctgttgtatgaacatactgagtttgatggaatccagcaattgtcaaattcatctgtagtgttactccacccacaaggttcgctagtggcgtgctgcaatgttacaagacaccaccactgttgtggtagacctgtgagtgcaaagaaacttagaaatttatttactcccttaacaaatgtgttcaagttttcgctggtggtatggcttagcaatcctttacattatatttcagaaactgttacttttttttttttgaggagccacaacaattgttttcttcgaaactttcagattcgaaatgtcgattccaccttcttaaaaaaaaaaaaaggagaggagnnnnn

SEQ ID NO: 3463 - DNA, 1251 bp, Zea mays
ttttttttttttttttgtaattaacacgcaacaatgagaagaaaatagcaatgattaagtcaagtcttcagcagcagtcaactattacgcatcatccgccattcaatgtacagaaaccatccagattattgagattagtcttccgatgctatgcacccaactggataagatagttcagaactcaatttgatacaccaagctactcccaaaccattaccaccataggattcaatgttcatggtttaagactcagacggcttcccagtcactgcagctgcaggactcatcttgggggccgtccacgcccacgcttgacatgtacagcactggcatcagcaacaacgtctcgagctgcagcaggttcacctctgggatcttccacggcgaccttggccttcttgggcgggcgcccacggccacgtgggctcagcatgccgctggtggcctggtcagtggccacattgatggggtccttgagctttggggggcgtccgcgcccacgcttcacaggcacggcattgccatcagtggtgacaacggaagccgcagtgggagctgagtcctcggcgacggggttcttgggtttcggcggacgtccgcgcccgcgcttgacaggcacggcagcggcggcgacgggagctgtagcgggcttaccaccgtagccctcagcaacggggtccttgggcttcgggggccgtccgcgtccccgcttggtatgaacagggttgacatcagcggtgacaacgggagctggagcaggcacgtcaatatcgtcgacatcagcggtgacaacgggagctggagcaggcacatcaatgtcgacggcgtcagcgtcgatgacgagaggggaagcaagcaacacatcgtcaccaacgtccaacacgccagtagactcctcctcggcggcggcggggcccttgtgcccaccggtgctcagcggggaggcttcgtcctcgttggggaggagatagttgttcctgaggaaggcgagctcgccggtagccttcatgcgggcgaggtgacccgtgaggacggcgttgtgctgggcagggaggttggagccgtagctgcccttgatgtagtccgagatcgcagtcttgttgcagccgttctcgagtcccagcgcccggattgcctccacgatcatctcagggtaggatgggagcgggggaggaggcggggacccgtctttgccggccatggatccggcggctcgttgcggtgagtggggtttggagaagaggaaatggg

SEQ ID NO: 3464 - DNA, 1206 bp, Zea mays
  misc_feature (3)..(4): n is a, c, g, or t
ttnnttttttttttttcgaagctacgattgcagtaactatccattttagcataagtttgttccacagaagaatataacttttctattcaattttgaatagtaagggattttaactcactcaattccctccaatccccttctcccaaacaagtcagtagaatcataaaatcccctatcaactggacttgacaagctgcaactacaaaggttatgttcaatggctctatgtccgctactatcccaacagtgttgatgcaatttcacaggttaggccatgcaaaactagagtacaagcatctgcagaccagcaacactcgtcatcctcacttctcatgctcctgcaacatgttgcattgagatacaatgctgcggaaatccttgaggtttatcttaccatcaccgtcactatcaaagcaacggaccatcttagatatctcagaatctgtccagatgaaatcatttattgtagccattctttcaagatcccatggtgtaatatatcctttaccaacttcatcaaataagaagaagaattgaaccacatcatcttctgtcagctgaatcctgctcttacccagctttttaatcttcttgttcttagctgagtcctgaatggatgctttgctgttcttctggggagtactttcactcgctcttgttactgtgcttgatgtttctgcacacaatgaagtcacaggcttttctgaatattccgccagggagagagcaatagcctgctgtaaggctgtatcatcatccaccacctcagcaaaagaagcactacccttagtaggcgtgttctttgtagatttaccagattttgacaatttctttttctttcccttggcgcgtgacatagaagctgatttcccctctccatccacctcttcgtcttgcgcgctctccgacgagctctcgtccttctcctcaccgccgctatcggacgggacgtactcctcgtcctcgtcgacggacctcttcttctgcttccccttggccgtccccggcgacgagctgcggagaagaggggacgctgcgaggctgcggaggcccagggcctcgagtcgggcctcgttctcgcgtatccgcgacagccgctgcttctcgtactcggtcagctgttcgtcggtttctcttcccgccgccatggggacgctgcggcaaaaaaatcctcctcccacgcttctcttcctattcgtgccttgt

SEQ ID NO: 3465 - DNA, 2576 bp, Zea mays
  misc_feature (505)..(505): n is a, c, g, or t
  misc_feature (893)..(893): n is a, c, g, or t
ccggttagaaatcgtttcgatttatcaatccggtacaaatgataaggcctaacatgtttttttctgggtggattggcgtgtgccactctgccagacacgtacgagtctggtacaaaccacaatagctctggaatgccttctttaatgtcacctaaaaatttagtgcagcccggaaatcagggtgtttatagtcccccacaaaaagaaagatagatcctaccagcagcagaaataactaaaacgttatctaatagtaagtttataggtgggatatatctttttttctgtgaggggctataaatatcctagtttgcatccggtctgtaccattttttttccgtcgcatggcggtgcgctttggtcgtttaaatagaacttgttttgacacgggaggagtatcttttatcgatggtacctataatacaacatctgagatcttctgttatttcaactttccactgaacctccttatcaaacaaacagacagacagaccgaaatctactnaacgaaccttataaaaacagtcgctaaagaacaagcagctgaaccatcgatagattatcatagccacaaaatatctagtactgatagtaataaaaaaatatattaaccgtcagcctatttaaatagatccccatggctactatcgatgttcatgattagagtctactgatgaatcaaattccatatgcttctggttattacgagaattcagcgtggtgtcttcgttgagaaatctaattaatcgttgaatatatatatttataataaatttatatagatatactccagtagaccagtagcgaaattcgatgttttccgtacgagatgtatgactcatgtatgtaactgccagggacgtctgcatctgaatctgataggccagggcagntgtctctgttgcatcagcaaacgtggaagtggaaagggaccgctccgcgcacagatacgacgaaggcagcgcggaaaccatgtcctcgagcccgctggtttgaagtccctccgcccgtctctcccatagttcttgacgctgattcgtgtcccagaggccagagcatgtggtaaaaaaaaaacctgcagctcactgttcactcgtgtcgaaacatatatatgttggtgagagagagaaaaacaacaacaagtcccacggctggcttgtcgggtgagctgcaaattttgccacatgacgcgatttcctgttaggatcaggatcaggatcactgactgacacacaagtgcagagtaccaggctacgcggccactagaccagaccagagcacgcccacgtcttaaccaagctactaggtgcgtgatggaggtgtggtggacacggccggccgcattcggagcaagtggttagcacaccgacgacaggtgacaactgacagggcacacagcacaagcattttccggttattaaaggccgaggcagacgctgcccgctggcgctctgcacccggttttcaggagcttccccccactgttttccacgcgccggcggcggagccccaaaaccacgtgccgcgtggccggccgggccggctggctataagagaccaccggccgcacgacactgtctccccaagacgtacaagcacacggccaccgaaccaagcaagcagcatcggaccagcgggcgcatcgatcgagccagtactcctcgaccggcccggccatagaagcataataacactacagggggtgtggagcggagaggtagatggcgagcgggagcggcaaggcgaaggcgtcgtcgtgggcggcggcgatgagcgtcggcaccgtggaggcgctcaaggaccaggccggcctgtgccgctggaactacgcgttccggcaggcggcgcagcagcgcgccaggaggccagcggcaggcgcgagcggctcagtcggccccggcagcggcagcggcagcgcgcacgcgccgcctgcttctgctccctcgggctgcgccgcggcggcgaggaggagagccaggcagcagcaggaggaggagctccggacggtcatgtacctcagcaactggggtcccaacaactagcagctacgaactaccagtagctggtgatcgcgcgagcaggcgaagcgaagctggcagtggccgggcaacaatctgagatgcatgacccttcgtgactacccctactctgttgtacgaacgatacgatcggcaaggccagtgcttgtggggagacattggcaattttgccattatgatttgtgggcttcgctagtatgccatcgggcccacaaatcatagacacagatggtcccaccagtcatagacacgggatggcataataacagacaaccaaaattgagagtggcacaatcacaaatttctcgcttgtggggcagcggccgatgaaatgaatcgtcgtccagcaagtatatatgcgtggatgagcatgtgtacgcctcccccaggaagctgatggacacgatgtacaccaccatgcgcgcgcatggagcttaattttgcatgctggtttcattccattccatcaagtgtccgtggtttatagactttataaatgcgcatttcgtggcaaaaaaaaaaaaaaaaaaagggtta

SEQ ID NO: 3466 - DNA, 820 bp, Zea mays
  misc_feature (41)..(41): n is a, c, g, or t
cttgagctttggggggcgtccgcgcccacgctttcacaggncacgggcattgccatcagtggtgacaacggaagccgcagtgggagctgagtcctcggcgacggggttcttgggtttcggcggacgtccgcgcccgcgcttgacaggcacggcagcggcggcgacgggagctgtagcgggcttaccaccgtagccctcagcaacggggtccttgggcttcgggggccgtccgcgtccccgcttggtatgaacagggttgacatcagcggtgacaacgggagctggagcaggcacgtcaatgtcgtcgacatcagcggtgacaacgggagctggagcaggcacgtcaatgtcgacggcgtcagcgtcgatgacgagaggggaagcaagcaacacatcgtcaccaacgtccaacacgccagtagactcctcggcggcggcggggcccttgtgcccaccggtgctcagcggggaggcttcgtcctcgttggggaggagatagttgttcctgaggaaggcgagctcaccggtagccttcatgcgggcgaggtggcccgtgaggacggcgttgtgctgggcagggaggttggagccgtagctgcccttgatgtagtccgagatcgcagtcttgttgcagccgttctcgagtcccagcgcccggattgcctccacgatcatctcagggtaggatgggagcgggggaggaggcggggacccgtctttgccggccatggatccggcggctcgttgcggtgagtggggtttggagaagaggaaaatggggttttcggtcggtgaccccctggcctcgaggcccccaatg

SEQ ID NO: 3467 - DNA, 2133 bp, Zea mays
ccggccgggccgggttcgtcccttttcgatcgccctgccggctgccgctcgcacttttcctctgtttcccaattcccatacgcatggaaacatctcgtcgacccaaacccatccacccacaaggcggaatacacgatccagtccgatcctcgccccgcgcgctgctccaaaccctggcgatgtcgacggcggcggccgcgaagactccgatcaaggccctgggctccgcggccgcgggtgccatgactccgaccaaatctcagccccccgcggcggccaagacgccctgtacctctcgcgcgcggtcctcccacgcatccgagaattccaaccccaacatcccgggcacgccgcctcccccgcagtcgacgccgtccaagcccagcctgaactccccggcgggcgcgggagccaggtccgccaccgcgaagaaaaagccctccacgcccgcgcccgccgcgccaccgctggagcgggagcggcgattcctcgtggcgaagaagggcgcgcggcggaggcgcaacgtcgggaccatgggacgcggcgggggcggccgcgggggagagatcgacttcgacaagtgccgcgaggcccgctcgcgaggcgctacgcgcgtcgcagggggagttcttccgcaaggagctcgccgcatccacagccaccggagaggatcaattgggacaggaggaggaggggaagccgctggctgaagaggatgtgaaaggtggagcattcgaggagcggcaggaggaggagaccgacgcggagctggaggggagcagcaaggttagggcgatgaggacgaaggcgatggctaaggcgatgagcagcgttccgaatcctggctctggccgcgtcaagcacatggtgcaggccttcgagagcctgctcaacatctccggcgccacctccgacgctgaaagggccggtgagggctcatgggcgctgcccgggttgcagctatggaaggaggatgataagggtgatctggggttcccaccagtgtcggtgttctcttctgctgatttccagaatgcagggtctaatcgactctgctcgtcactagatggaaacaccgtcaggtcgagctgggacagcagaacatcgactggcgagtgcagcaggagaaattcatctgagtcactaaggagaagaacatcggctggcgggcgcagaagcaggagaaactcatctgagtcactaaggagcagctggaacaaaaagctcaaggtcaccagccagcatccattcaagttgaggacagagcaaaggggaaagtttaaggaacagcagttcgtccaaaaggtgcaagagatgcttgcagaggaagagaagaagcgtattcatattgcgcaaggattgccatggactaccgatgaacccgagtgcttgataaagcctgcagtcaaagaaagaactgagcctatagaccttgttttgcatagcgatgtgcgtgctcttgaacgtgcagaatttgatcagcatgttttggataggaacaagttcgctgagcaacaaagattagaatgggaaaggcaacaggaattagacgaacaagaaaggataaggcaactgaggagaaccgagctgattcctaaagctcagcccatgccatactttgaccgcccattcatccccaaaaggtccacaaaacctgctacagttcccatggaaccgaaattctacctcaggccagaaaagctatcctgttactatcgacagcaatgtatggagcttggaaagctgaatccacaacatcagtgccaacatccgctcgcaatcgagaaatgcagagcatcgacacacatgatcaaacaactgtttccatttcctggcatcgtcttattcattcttgattcgtcttcttccatgtgcgaagaaattgctatcaagcgtgtttttgtagctttgcttggatcgccttgcctccaagttctgttaatcgctggctctgtgcttcagatgcaatcccaccgaggtttgaaatttgtcgttcaagaaactgataaggaaattcaaggatgaattttctgtggtcaaaaaaaaaaaaaaaataatgttggttcttgcccgctatgcatgagcccgccagttcccagtgtgcttttatatggtagtttctatttgtgctta

SEQ ID NO: 3468 - DNA, 1707 bp, Zea mays
aagtttccgccgcggcacgagaccattacctagaacatcctaatcgaaaagcgtcgaagtgatgacccctcgttccatccgtcctcactgagcggcagcaaagcacgccgtgccattcccatcactaagcgcttgcgcgcggcggagaaacccaagcgaagccccgcaagagcgaggcgagggagagtggggcgagtgggtgagccgctggctagcgggatggcgtcgccgggggtggtggccgcggcgctgctggtggcggtcctggcggcattctgtggcacggatccgctgcggatgggcagcatggcgggcttcccggggttcgaggcgcacttcgtcgacctccccgatcccgccgagatgccgccgcacgcggacgagcgggagcggctccgcggggccgaggtgcggttccgcggcgatgtgcagggtcccgagagtgtcgccttcgaccctcagggtcgcggcccgtacacgggcgtcgccgacggccgggtcgtcttctgggacggcgagcggtgggtccccttcgcgactgcctccccgcgctggacgcaggagctctgcggcgggcctaaagcctcgccggtggagtacctccccaacgagcacatctgcggccgcccgctcgggctccgcttcgataagaagaccggggacctgtacatcgccgacgcctacttcggcttgcttaaggtcggtcccgaaggcgggctggccacgccgctcgcaacggaggccgagggcgtgcgcctcaacttcaccaacgacctcgatctcgacgacgagggcaatgtgtacttcacggactccagcatccactaccagagacggaatttcatgcagttagttttctcgggggatccctctgggagacttctgaaatataacccacagacaaaggaaacgacagtactgcatcgcaacctccaatttcccaacggtgtgtccatgagcaaggatggctcattctttgttttctgtgaaggatcgcgtggcaggttgagcagatactggttgaaaggcgagaaggcaggcactgtggatcttttcgctatcttgcctggcttcccagacaatgtgagaacgaatgagaagggcgagttctgggtggcaatccactgccgccgaggtctgtacgcccggcttatgagccgccatgtcaagctgaggaagtttttgctcagcctcccgatccccgccaagtaccactacctgatgcagatcggtggcaggctccacgcggtcatcatcaagtacagcccagagggccaggtgcttgacatcttggaggacaccaagggcgaggtggtgagagccgtcagcgaagtggaggagaaagacgggaagctctggatagggtccgtcctgatgccgttcatcgctgtctttgacctcgcgaaggcgtcttagccgcctcaagtttgattggaaacattgttgctttaagacatggagtccatggttaccgctgcacgcttctctgagaggatcagtgatcccaataatttggttctggtgcaacctggagctgtatataatgctccagcttcttttagtagcaaatgtaagttgctgacatgttctttagattgtcactagaactatgaacgaacagctcgtgcttccgagtccagaattaccagatgtgcttcttgtgtttgtgcttcttgagttgaaataaaaaaaaaaaaaaaagcgggc

SEQ ID NO: 3469 - DNA, 840 bp, Zea mays
ctctgggagacttctgaaatataacccacagacaaaggaaacgacagtactgcatcgcaacctccaatttcccaacggtgtgtccatgagcaaggatggctcattctttgttttctgtgaaggatcacgcggcaggttgagcagatactggtggaaaggcgagaaggcaggcactgtggatcttttcgctatcttgcctggcttcccagacaatgtgagaacgaatgagaagggcgagttctgggtggcaatccactgccgccgaggtctgtacgcccggcttatgagccgccatgtcaagctgaggaagtttttgctcagcctcccgatccccgccaagtaccactacctgatgcagatcggtggcaggctccacgcgctcatcatcaagtacagcccagagggccaggtgcttgacatcttggaggacaccaagggcgaggtggtgagagccgtcagcgaagtggaggagaaggacgggaagctctggatagggtccgtcctgatgccgttcatcgctgtctttgacctcgcgaaggcgtcttagccgcctcaagtttgattggaaacattgttgctttaagacatgaagtccatggttaccgctgcacgcttctctgagaggatcagtgatcccaataatgctccagcttcttttagtagcaaatgtaagttgctgacatgttctttagattgtcactagaactatgaacgaacagctcgtgcttccgagtccagaattaccagatgtgcttcttgagtttgatccgttttgatttttatttgggcaacaaaagaaagttttcaatttttatttcgccaacaaaaaaaaaaaaaaaa

SEQ ID NO: 3470 - DNA, 2193 bp, Zea mays
cttgcatgcctgcagtccgcgtgtccataataattcttttattaagtttttacttgtgtctgatgatgaatagataagaaatttgtttacttatgctattgaatttttgaaaaataattgtgtttgtcgtattcaacaaatatatgaaattgttcgaaatccgataaatacgaactttgatataaatttttacccgcaaatatgagcacagttagatattggttcaacaataaatatgattacagacggatattaatatccgatcggttgtcatatctatatgtacaaaacaatgtatttgcatctagttggcgtgaggccaatgacctcatccgatccctttccctttcccatccgcgcgtccctactcctccccctccctcctcaacgacgcgagaagacgcaatcctgggagctccgaaccctagctcctaatttgagccccggtgtcatcgattcctcaggagcccgccgcgattcggctcccgtagcagcatagggctccaccgctccccagctgcatcagcatcgacggcggcggcgcgccgccgcgactacgctcgaggaagcacctagtctcggcgggttctcgttcttggaggccttccataaggcggtttcgtggtgtccgagcccggatctacggcgatctgcaagcggaaggcgatagatgaggcgattcagtggtaacccccaatccggtgggtttccggctggcagaggcggaaaggttcgggccttcggcgggtgatcagatttctccgtgcggcgcgcggcttgtgtctaccgcaacggtgtaggactggagcgcaggagccgacgaggcggtggagatacaaaaaaattgcttgcttgtacacttgttcatgttcatttgttcctgctatctgttgtggtttaaagcatcaattttccgctcaatttaagggcgaagacaaaaaaaaaaaaccttccttgttggtttctatggaataatctctatattacagaagaggagtgtggaaaagcaacaaaaaagaggaatataaaatacaaaaaagatataaccagcagaaaaaagagattttttttgagtgggcaagcaaatggctgtgtattacaagttcaagagtgctagagactttgactcgattccgattgaggggcaattcatctctgttgccaacttgaaggagcggatttttgagtccaagcatctcggcaggggcacagattttgaccttatgatctcaaatgctcagactgatgaaggttggttctttgtcagatctattgtgtgggtgaataagcgcgtaagttgataggtcctggtaaaagttgtgacataccagtttgtagggctgtataatctttatttatatagaatcagcgattatttggttcatgcagtcgagttgtgtcaactcaaccaaccatgatgaatgctgaatactgatgtttgtttagctagctggtatcaattgttttaatcttgcgtccttttccctgcgttctgaacctgctaagacagtcctgtcccttgttgggcttacggttgaaggattagttgtagtatatgctgggaaatttttgatacatagtcttgcattttgtttggcgaaccttagggttttggatttgatgtaatatgttgagagcatggaccaagtattgccttgatgcatatttagttagtttaattagtggtgctttatttgtttccaagcaaacagccgtttcacattgcattgtaagatgacacgttcaaaacaatatttacttgtactctaaacattcaaattgtcatgtgataaactagtttggactgtgttttcttgtgtggatttgtgatgagctcatgctattgaggtattgcttaatgtttcatggtgatattttaactttcagagtatgctgatgaggccactatgataccgaaaaatacgtcagtattgattcggcggataccaggacgaccaaggaagcctattgtcacagaacctgaagagtactgtcttgatcttggattacttgaacaattaacaatatctctctctttttttagtgaatctttaggatttcacttaaggctgtgtacaagtggtgcattacatttgattatttgactcgaccatgccaccaaaaatggtcagagctttgcttgttggtgaacatattgaaatgtgtatccaatgtgcaggacaaaagctgcag

SEQ ID NO: 3471 - DNA, 713 bp, Zea mays
ccatggcttctatgattgataacaaaggagggtcatggcaaattgcaggaatcttttcctccaatccaagcagagatacagagaggcccagcccagcacattccggccccatacccgacgcgatgcccctcctccttccgtattgccacagcaacaccgggccgcctctcctcctccctcggacagggagagaccctttccatccaagctagccaaaccctagccaccgtcggttccaatctgccaacatctcgtccgctggtgggtggctcggcctcggcggcatggcctcgtccgcctacgcttgggacgccgcggaggaggcggacatcgacgcctccgcatcgcaggaggagctcatcgtccgcgcccgcttcatctcccgtgacaatgaggaggagggggagggggagggggagggggaggaggaggaggaggaggaggtcgaggtgttcagcacgccgcctctcacgcatcaggacccgcagagtccgggggaagaagtcatcgccatgtgctccatccccttcacccagcctgaccccacgcctcctcccgctcccgctccctcccctccctcggacagtaagagtcgccgtccggagcgggtcaaattgaagccgcggaagaaggtctgcaagaggaaagagtgtctgcaatgaggaaggtgagaagagccaaacaagatcaggtctccgactccgaagccgcag

SEQ ID NO: 3472 - DNA, 820 bp, Zea mays
ttccttccgtattgccacagccacaccgggccgcctctcctcctccctcggacagggagagaccctttccatccaagctagccaaaccctagccaccgtcggttccaatctgccaacgtctcgtccgctggttggtggctcggcggcatggcctcgtccgcctacgccgcttgggacgccgcggaggaggcggacatcgacgcctccgcatcgcaggaggagctcatcggccgcgcccgcttcatctcccgtgacaatgaggaggagggggagggggagggggaggaggaggaggaggtcgaggtgttcagcacgccgcctctcacgcatcaggacccgcagagtcagggggaagaagtcatcgtcatgtgctccatccccttcacccagcctgaccccacccctccccccgctcccgctccctcccctccctcggacagtaagagtcgccgtccggagcgggtcaaattgaagccgcggaagaaggtctgcaagaggaagagggtctgcaagaggaaggtgagaagagccaacaagatcaggtctccgactccgagccgcagccccgaactggaccctctcgccagggccgtgctcatgatcccaaccgctccttctacaatcaccggtggtgaggatatcctcgaggttgctcgcagccgcggcatcttctagatctactagttgcctgtgtattttgtgcattgtagcgtagtcccttgtgtttctgccgatcaatccatatgctatggcctggctggattttgtgcattgtccatcgactgcatatgaccttgcttgaaggaaactagttagcagc

SEQ ID NO: 3473 - DNA, 1938 bp, Zea mays
tggacctcagcggcgggcgggctgtccgtcgtccgtctcgctctcgtctcgatcaccacacgcttcccggaaaatccttccacagcccggggccgcccgggacttcaccccgttcatccccagcgaagaaggtaactaccgccatctcccggtaatgatcctcggtatcttccggccagaaaagatttgttttcggtacggatagggtttctgatcagcgcgagccgaggagctaagaatcccagttctttgttcgccgactcgagtttgacattatgcaaaatacttagcacaccagtgatggcggctacttaccaaactggccttgtggccgagccacagttgctgaacactgaaattatcactcggagggccaccaactgtgttgctgacactaacacaaaagacaaatgcgtcggctacttggatgtgtttgtacaccaggcacgcgacatccacaatgtttgtatctatcacaagcaggatgtgtatgcaaagctgagcctcacgagcagccctgatgtttcgtgctcaaccaaggtgatcaacagtgctgggcgcaacccagtatttgaggaaagcctacgccttgatgtgcaaactgtggatgcttctctcaagtgcgagatatggatgttaagcagggtgaggaactacctggaggatcagctccttggctttgcccttgttcctctagtagacattgtaattggtaatggaaagctggtccaggagttctccttgacatctactgacctgttccacacaccagctggatttgtgcacttgtccttgtcatatgctgggtgttccccagatggtgtcctcatctcatcacccaataattccccatcaacagtgtatgattctggaactgatcatgtggttcctgctcagcttgagaagattgtgttcccagacctaagtgtggagaaggaagacgagattatggtctcaaagtatctcgagatgacttcagactctgaaacccctataaaagttgagaacggcatgtcgctgcattctgcaaatgatgatgatgttccttctaaacttgaaaagatcaagttcatagattctgagagccgtgcgaaagctgaaaatggcaagatgctactatttggtgtagctgtgcctagtactgcaatttgtgcagataaggttgaggaataccacgatgaaagccctctaagttgtgtctcagccacaggctcctccactaccctttctgcaacaacacaatcagtttctgagccttcggagaccagtgtcgaggcatcccctagacaatgccatagggagaaaagccaagatgttacaggtggtgaggctaattcttctgaaacaccaccaaaggatgaagttatcaagcctgtgatcagcgttaaccttcagccagagcagtcagttgtccaacaggacatagttgacatgtacatgaagagcatgcaacagttcacagaatctcttgcaaaaatgaaacttccattggacgttgagaatagtagtccctcaaacgaagattcatactccagtacagttgagaagacatccccatccccatcttcatctgcagcaaagggttctagggtcttttatggaagcagggccttcttttaagtttctaatgcaaagtagtacgctagctcagtagctcgttactatctcctacatacatatacatggttccaggtttatcatatatctgctggcatgtaatcacatactttctgtctccataatatgcttctaggactcactcctggtattgctattagtgttatgctttgctagaagataataatttcatctcatagttgtagattaatcccatgtactaatagatacccatgaaatataatgtcatgaaatcagttctgactcgagatgaatccctgcactgtattgtgacctttcgattaatctaaattgtgacca

SEQ ID NO: 3474 - DNA, 600 bp, Zea mays
ccgtctcgctctcgcatcagccaacaacttgcccgcaaaatccttccacagcgggtcacctcgcttcaccccgttaatcccggcgaagaagtacttggcacaccagcaatgtcgtctacttaccaaattggcattgtggctgagccgcagttgctgaacaccgaaattatcactcagagggccaccagctttgttgctgacgctaacaaaaaagacaaatgcattggctacttggatgtgtttgtacaccaggcacgcgacatccacaatgtttgtatctatcacaagcaggacgtgtatgcgaagctgtgcctcacgagcagccctgatgtttcatgctcaaccaaggtgatcaacagtgctggccgcaacccggtgttcgaggaaagcctacggcttgatgtccagactgcggatgcttcgctcaagtgcgagatatggatgttgagcagagtgaggaactacctggaggatcagcttcttggctttgcccttgttcctctggcagacattgtaatgggcgacggaaagctggtccaggagttctccttgacatccactgacctgttccacacaccagctggatttgtgaagctgtcc

SEQ ID NO: 3475 - DNA, 1897 bp, Zea mays
atcctttttatatcttgcctttcccctcccgttccgttcccgtctcgctctcgcatcggccaacaacgcttcacggcaaaatccttccacaggcgggggagtcgcctcacctcacttcaccccgttcatccccagcgaagaaggtaactaccgccatctcccggtaatgatcctcggtatcttccggccagaaaagatttgttttcggtacggatagggtttctgatcaagtgcgcgcgagcccaggagctaagaagaatcccagttctttgttcgccgactcgagtttgacattatgcaaaatacttagcacaccagtgatggcggctacttaccaaactggccttgtggccgagccacagttgctgaacactgaaattatcactcggagggccaccaactctgttgctgacactaacagaaaagacaaatgcgtcggctacttggatgtgtttgtacaccaagcacgcgacatccacaatgtttgtatctatcacaagcaggatgtgtatgcaaagctgtgcctcacgagcagccctgatgtttcgtgctcaaccaaggtgatcaacagtgctgggcgcaacccagtatttgaggaaagcctacgccttgatgtgcaaactgtggatgcttctctcaagtgcgagatatggatgttaagcagagtgaggaactacctggaggatcagctccttggctttgcccttgttcctctggtagacattgtaattggtaatggaaagctggtccaggagttctccttgacatctactgacctgttccacacaccagctggatttgtgcacttgtccttgtcatatgctggttgttccccagatgttgtcctcatctcatcacccaataattccccatcaacagtggatgattctggaattgatcatgtggttccttctcagcttgagaagattgtgttcccagacctaaatgtggagaaggaagacgagattatggtctcaaagtatctcgagatgacttcagactctgaaacccctataaaagttgagaacggcgtgtcactgcattctgcaaatgatgatgatgttccttctaaacttgaaaagatcaagttcatagattctgagagccgtgcgaaagctgaaaatggcaagatgctactatttggtgtagctgtgcctagtactgcaatttgtgcagataaggttgaggaacaccacgatgaaagccctctaagttgtgtctcaaccacaggctcttccactaccctttctgcaacaacacaatcagtttctgagccttcggagaccagtgtcgaggcatcccctagacaatgccatagggagaaaagccaagatgttacaggtggtgaggctaattcttctgaaacaccaccaaaggatgaagttatcaagcctgtgatcagcgttaaccttcagccagagcagtcagttgtccaacaggacatagttgacatgtacatgaagagcatgcaacagttcacagaatctcttgcaaaaatgaaacttccattggacgttgagaatagtagtccctcaaacgaagattcatactccagtacaattgagaagacatccccatccccatcttcatctgcagcaaagggttctagggtcttttatggaagcagggccttcttttaagtttctaatgcaaagtagtacactagctcgttactatctcctacatacatatacatggttccaggtttatcagatatcttctggcatgtaatcacatactttctgtctccataatatgcttctaggactcactcctggtattgctattagtgttatgctttgttagaagataataatttcatctcaaaaaaaaaaaaaaaacccatgtactaatacatacccatgaaatataatgtcatgaaatcagttctgactcg

SEQ ID NO: 3476 - DNA, 1813 bp, Zea mays
  misc_feature (12)..(12): n is a, c, g, or t
ggtacaccccgncctccaggcgggcctgtcccgttccgttcccgtctcgctctcgtctcgcatcagccaacaacgcttcccggcaaaatccttccacaggcgggggagtcgcctcacttcaccccgttaatccccagcgaagaagcaaaatacttagcacaccagcgatggcggctacttaccaaactggccttgtggccgagccacagttgctgaacactgaaattatcactcggagggccaccaactgtgttgctgacactaacagaaaagacaaatgcgtcggctacttggatgtgtttgtacaccaggcacgcgacatccacaatgtttgtatctatcacaagcaggatgtgtatgcaaagctgtgcctcacgagcagccctgatgtttcgtgctcaaccaaggtgatcaacagtgctgggcgcaacccagtatttgaggaaagcctacgccttgatgtgcaaactgtggatgcttctctcaagtgcgagatatggatgttaagcagagtgaggaactacctggaggatcagctccttggctttgcccttgttcctctggtagacattttaattggtaatggaaagctggtccaggagttctccttgacatctactgacctgttccacacaccagctggatttgtgcacttgtccttgtcatatgctggttgttccccagatgttgtcctcatctcatcacccaataattccccatcaacagtgtatgattctggaattgatcatgtggttccttctcagcttgagaagattgtgttcccagacctaaatgtggagaaggaagacgagattatggtctcaaagtatctcgagatgacttcagactctgaaacccctataaaagttgagaacgtcatgtcactgcattctgcaaatgatgatgatgttccttctaaacttgaaaagatcaagttcatagattctgagagccgtgcgaaagctgaaaatggcaagatgctactatttggtgtagctgtgcctagtactgcaatttgtgcagataaggttgaggaacaccgcgatgaaagccctctaagttgtgtctcaaccacaggctcctccactaccctttctgcaacaacacaatcagtttctgagccttcggagaccagtgtcgaggcatcccctacaatgccatagggagaaaagccaagatgttacaggtggtgaggctaattcttctgaaacaccagcaaaggatgaagttatcaagcctgtgatctgcgttaaccttcagccagagcagtcagttgtccaacaggacatagttgacatgtacatgaagagcatgcaacagttcacagaatctcttgcaaaaatgaaacttccattggacgttgagaatagtagtccctcaaacgaagattcatactccagtacagttgagaagacatccccatccccatcttcatctgcagcaaagggttctagggtcttttatggaagcagggccttcttttaagtttctaatgcaaagtagtacgctagctcagtagctcgttactatctcctacatacatatacatggttccaggtttatcatatatctgctggcatgtaatcacatactttctgtctccataatatgcttctaggactcactcctggtattgctattagtgttatgctttgctagaagataataatttcatctcatagttgtagattaatcccatgtactaatagatacccatgaaatataatgtcatgaaatcaaaaaaaaaaaaaaagggcggccgccgactagtgagctcgtcgacccgggaattaattccggaccggtacctgca

SEQ ID NO: 3477 - DNA, 5254 bp, Zea mays
  misc_feature (1004)..(1004): n is a, c, g, or t
  misc_feature (1275)..(1275): n is a, c, g, or t
aacaattacaccgagaaagtacatcatccagtggagcatgtccaggatgttgtactagatgatatttctatgatactgagcaaacctaatgatgtttcagaagacgaagataaaatcagttcagggaatgctgatgatttgtctctccaccctaccaaattgaaccaagaggaaatacaggagttgaagacagaatcggaagaaggcagatctctagaatcaggaagttcacctagcaaagcatcattgccaaataaggatcatgtgtcgatgaatgatgtagaagccgacactgttacaattcctaaagaaactgttgcagatactgcaccaacaggtttggatcctgatggcatcgacgagcgtcaagatggagttgcaccgaaatattcaagcatccacaatagtgtactgtatgaatcatatgatgacaagattgctgaagacacacactctttactagatgatggcctatcaactactttcgatgacgataagcatgttgcagaggatcatcaatttgttgttcttgaacaaaggacttgtccaactagcctcaacacatgcaaggatgattctatgcaaggatgtgccgtggccagggatttcactgatgctgaaaagcttccgggagtcgtttcaggtgtattagcttctcaactggagacagaatctcatgtaggagagacacttgcatccacgtcctatgcattcagtgatgatactgaagcactagagattggtgtccctctagcccctggtacttcctttctacctaacaccagtagttccttggtagaaaaacatgaattgactgaaacagaagaaattgcagaggttggtgaatttgtggttgcaaaagaatcaactactagcgtatttgcagttgatgtggtacctcccaaagagttcattgatgctaacatacatcctgaaaaggtagaggttctggctacaagtttgactgaagaagccactaggctggatttacaactacagtctcnttccagggaagttttggaaacaacggaagctattcacagaaattttggggcagtagatgaatcaagagaagatatctctaagaagagtatgttgcagacagacaatagtcctcttattgtagagactacaagtgaaaaatgtagtgacagggatggtgatacacaatttctagtaaaatctgattatcaagaggaattactaaaagagggcagtcataatgctgaagatcgatctctctgcgatttgaacaaggatggtgcagtaaccttnaaaagtaatgcagttgagaaacaaccagtgaatgctggtcaagatttggcgtgggggatgcacgctcaagattctagtagtacaaacccgttcctggatcctgcctacttgatgagccacactcaaatttattcatcttccagtatgagtagccaaccatgtttccctgaagaagaggatttcctttcagagcttgtaatacaacatgacaatatgggagtaactgctgatgccctttgggaacctgcaactccacctgatgatgcgccattaccatcagaaattatgactgaagatgatttcagatccttctgccaagaatatcatgagatagatttttcatctgtcactaactgttctcacagtgaaccagcctcagattctaacaaaattccaaatgcttttctgatcagagagtcagattttccatgttataactctgccttgccagtgaagttagatcaggaagcctgtattcattctaagttctgttctgagtgtgtcgaatattcatgtgctgtggaaagacaaggcactacatcaatggttgtttctggtaaagaagatcgcgtgggcaaggacgagacaccaggagtagatttccatttaaattttctcgagttttccaatgataacagaagtcctgaattaaatatgctctccgttccagtggatttacggcaggaactgcatggcttgcctgaagttgattctcgtgatagttcccctttgctgcataaggagaagactagtgaagaatgctgcttttctttaagcaacaacgttgttgaagtgaaacaagagctggaaatccgtgctgaccttgttccacattcttctattaatgaaaaagtagatggattagatgaggctgtaccggtggaaccagaggcccatgcctgtgccttggatgaatatgacaaccaagatgtcccacacatttcaactagtgagaagaatgaaacccttactttgggcaaacctgttttagtccaggggccagaagtttgtgcctttggtggatttgaatgtgatcctccaatcattccatcaccttcagttgatgagactaaggacaatctagaagtcagaatgaatatgatcctccaatcattccatcattctttgaggacttcttttcaagcagaacagaagtcagaatgctacacctcaggtgaacatgattctcaaaccgttccatttcctttgcatgatgagaatatcaatgaactggatgatcctcctttgagcaatgctgacgaactggaccgggaatcaaaagcttgtgttccacatgaatgtgatgctcaaatcgctccatgttcaactgatgagcggggacatgaattcgatcaccctcctttgagcagtcccgctttagtggatcttgaatcagaagaccatgtctcggatgaccgtgattccgaagtcaccccatgtttggttaaagataagattgatgaatctgtagatgctcaaccaaacctgcttcctggggagctagagcaggaaactcatgcaccccctgaattagactttcgagttgctccacaatcagcgaaagaatctgattgcccaactgaatttgattcccaggccgcaccatgttcttcaaatataccagtactagctaacacaacagtgtcgacttgtatttctgccatgcctagcagtgaggaaacgtatcagttgtctcctgttccaccacctactgtacaatttcaaaatgattcctacaaagatcctcaagctctactcgctgattcctacaaagatcctcaagcgccaccccctctccctcctctccagtggaggcttggaaagcctcggctaggacttctgagtagaaaaggctgtatgactgaacctgcaagggtaatagatcctgttttgcagatatcaagccaagagatggatattaggccaggtttgcttgatccaacggatagatctatagaaccagtatcctgtcaagaaatcaaagaagatagatgtgagagttctttgatagatcataatgatcaaaatgtggattttgatagattatcgaccagggttgcagtaactgatgttgcaaggactgaacacaggctatccttagagacttcagaggacattaagcaacaggggcatatttcttcatcggcaacaggagttggggaacacctggatgctgggttcacatcaacaatggcagatgaggaacatctggatgattctgggatgacacatggaacagctctatacttatcagaccctctgtttccattacctacatatgaactgcaggaccctcaaccagatactcgagaaaatagcgagcatcccagtcaaacacatggagctgcatctggggatgataagtcaatggatgctgttggcagcatggaaagcaccctaacaaaaggacatgtttctggaaataggtgctaccagcaacctcagcatggtgaatcgtcctcagagacttcagaccataaagagcatattacaaatgcatcagaggatggtgttaagcatcagtcaggtacaagtgaggcaccttcagacacagcaaagcattctgcaccaggcacgctgttgaaagggaatgtccaagagagtcaaattttacaggaacataatgtggggagttccgaggacgatcaaccaggaggcctgttgtacagcttagaaccagtggcacctcaaggggaaaacaaaaaccaggttaacaacccaggcctgttactggaatggcctggagatacaagtgagttggtcactggccttgaaaaaagttgctatgcgcatgctgagcagccacctgtgatgggatggactgttggacctcagatgcttcatcctaaatatggtattttagaagaagagagccaatttgagcctaatatcgccgacaatcatttaatcaggaagcctatttcgataaaaaacatcccaaggaatccactggttgatgctgttgctgctcatgatagaagctcgatgagaaaggtttcagagcttgcaccaccgactgacaagccgaagcctaacgagagaaacatgttgctagaacagataagaaacaagaccttcagcttgaaacctgttgctccagctcagcaaacagcaatgagatcccctgctagaaccagtactagaaacttgaaggttgccgctatcatagaaaaggcaaatgccatacgacaggcagtgggaagtgacgatgaagacgacgcagatagttggagtgatacataaatcccccaccgtttgccctaccctcttggtgcttctttccatggctgaaaggtaccgattcatcaagagcattggggacaggttggggatgcacaaccatgtcatcgtttttgttagtaatataatgctagtcttgtgtatagtatacgcccataatccttttcattttttgtatgtgtattctttcgaccgattgtttgtatacctgcctctctctcccacagcagcaaaggctgttgcggttggcatgatcctaggatagcatgcatggtctatgtaaattaaacagtagtagttaagtaaagaattgttccatcttttctggaaaaaaaagaaagaaaaggccctcatcgattccacacagcaagcatagcagaccttgaattgcaaaaatatgaaaaccaatacacccgcttagacgaatttgttgatccatggcaggtcaaactaacaaactaactattggaggcaataactaaacttaacaccaagatttagtttcaacagtagccgccgcggcggaggcggccgacgagggtcgagcagatgaagccggttgcgcccgtctcccccgccatctcctcgcgtccttcccgtgagctgactagctgagctgggtctcgcgtcactccgagtgtgctgcggctgtgcgagtggctacgtagctgacactgagatgttttttttttttggattatccacaacagtcggtcaccgttcgtgtgtgcaactgcag

SEQ ID NO: 3478 - DNA, 2001 bp, Zea mays
tttattcaataatgagattggtcattgaggagagtgaggatgtgcaaccacagattgcttcatgactactccaaaatgttcgaaacgatgaaaaggaatcttcttcagcttactatgagctggctgaataagggataggcacatgccgcgagaaacttaagctcagttttctgcaatcactaaaaggcactttcttgagcgaatacagccaaatcgtcgcatcgggttgtgaagatgtttcagatgacagggaagataacaatgctgatccttctgggaaggacacggtggatgatggcaagctctctgaaaggactatttctgatgaattgcctcaggaatcttcaaaggcggagcaagatgttagccgtcctgaacaagacggtacttgtatgaatggtaatacaggtactgcgattagcagtggtgctaccctaccagatactagcgaatctgatcaaggaccaccaaaagagaagactgaacaaccttgctatgctgatgacataacagatactgatcagttgaaatctgaccacaatgaaggtgcggagttcgatactgcaaagcccgaaaagaaagctgccgttgattcagacaaaattgctaagcttaaaccgtccgcccacggtgaagcacctgtgcattctgatgctgacactaaaaaggaagcatctgcagagggtaccgatggagccgctgatgatacatcaacgcctgctgattgtacacctaaaccaaagcgaggccgtcctcctggcccaaagtcatcgcagaagaaggctgctggaaaggatcaatcttcaggttcagatttgaaaaaggtcaatgaggcaggtgattcagccggaaagttggcgaaacgatcagcgaaggatgagaagtccacaaagaaggctggtgaaggagaatcatctaagaagacccaaaagtacaattcaaaacaacagaaggatgaaaacctatctgaggatcctgccaaggatctgagcttaaaggaaatgataacgccaaaatcttcgactaaggtcccaggtagaaccaaagggcaaaacacagagaatagcacacctaaaatgaagcaagaacaagaaactgaagagcctcctcgttcaaggaaaagcaaaggacttgataaaagtctagttggtgcaaggatcaaagtttggtggccagatgataagatgttctacaatggtgttgtggagtcatttgattctgtttctaagaggcacaaggtcgcatatgatgatggggatgtagaggtactactgttgagggatgaaaagtgggaattcatcagtgaggagaagggagcttctatggcatctgaaacgccaggaggcagaaaaagaaaagctgatgcagtgaaggaagaaactacagagacacctaaaagtgatgctgttgatcatccaaagaaaagaggacgtccaaaaggtgtaagatccagcaatggcacacctagtaactcagctactccgagcacaaaggggaaaactgccggcaagaataccaaagaaacaccaaaaactggccccaatcttataaaggaacttgagaagagctccaaggacaaagctagtgtatcaactgagacaaaggatgaattgcctaaagatgacaagagtgcaagcagacctaaggaggctattagcaaaggcaaggattcaaaagacgaaggcaagtccactgaaggaaaagctaggccaggtcggaaactaaaaaatgctggtactcctgcgggtgacgctgacaaagagaaggggaaggagaaagaagttaaggcagctgaaatagagcaggaggcaccaggaaacgcttctacaggaaagaagcgcagaaggaaggcttgaagctaacactgatggaacttcttttgtaaatggatgtgcaccttgtattattgagtgttaactcgaaatttcgtctgtttggtctctgatagttaggtgtggaagcaacatttgctatagctgtaatgctaggattaacatgtgt

SEQ ID NO: 3479 - DNA, 3006 bp, Zea mays
  misc_feature (8)..(8): n is a, c, g, or t
  misc_feature (68)..(68): n is a, c, g, or t
  misc_feature (2966)..(2966): n is a, c, g, or t
  misc_feature (2972)..(2972): n is a, c, g, or t
ctgcaggnaccggtccgttattctttggttttcaaccagttcagtactcaccgctaaacccctctcgngctcctggacggctctgacgccgagtgcgacgcctagcgaggtcgcgactcgcgagggggaaccctagcagcgatagatctagagcgggcgctttcgatctgtccgggaaatggcggaggatcctgccgcggaacaggagacgcggcagctagaggaccggctcagggatgtcggggaacggctgcaggcgccttccgacgacgcggtggtcctgcgcttcctcctcctcgaagttgaggaatgtttaattaaagtagagcagtcacctcgcgaaagcatatcaaatgctcttcgcccagcaactgaagctctggtcaagaaagagctgctgggccatgctgattcaaatgttagacttgctgtggcatcatgcatatctgagatcacacggatcacggcgcctgatgctccatatgatgatgatgcaatgaaggatgtattctctttaattgtgggggcctttgagcatctggatgacatagagagccccttctttggaaggagaacttcaattcttgatactgtggcaaaagttcggtcctgcgtggtgatgctagatcttgatggtgatgatttgataaatgatatgttccatcacttcttgaggactgctaattctggacattcagaagccatcatatcctgcatggaaacaataatgagattggtaattgaggagagtgaggatgtccaaccacagattgcttcatgtctactccaaaatgttagaaaagaagaaaaggaatcttcaccttcctttgagcttgctgaaaaagtgataggtacatgtcgtgaaaaacttaagccagtctttctgcaatcactaaaaggcacttccttgagcgaatacagccaaatcgtcgcatcagtttgtgaagaggtttcagatgacagggaagataacaatgctaatccttctgggaaggacatggtggatgatggcaagctctctgaaaggactatttctgatgaattacctcaggaatcttcaaagatggagcaagatgttagccgtcctgaacaagacggtacttctatgaatggtgatacagttactgctattagcagtggtgctactccgccagatactagtgagtctgatcaaggaccaccttccacaaatgagaagattgaacaaccatgctatgcccaaaacatagcagatgctatgcagttgaaatctgaccacaatgaaggtgctgagtccaatgctgcaaagcccaataagaaagctacccttggttcagtaaaaaatactaagctcaaaccgtccgataaatgtgaaccaactgtgcattctgatgctgacactaaaaagcaagatcttgtagcatctgcagagggatccaatggagcagccgatgatacatcaagacctgctgatagtacacctaaacccaagcgaggtcgtcctcctggtccaaagtcattgcagaaggctcctgggaaggatcaatctccaggtttggatttgaaaaaggtcaatgatgattcagctgggaagctggcgaaacgatcagctaaggatgagaagccttctgcaaaaaacactggtgaaggagaaccatctaagaagactcaaaagaacaatttaaaacagcataagggtgaaactctttctgaggatgatcctgccaaggatctgagcttaaaggaaatgatatcgctgaaatcttcgaccaagggcccaggtagaaccaaagggcaaaccacagagaatagcacacctaagttgaagcaagaacaagaaactgatgagcctccacgttcaaggaaaaacaaaggccttgatagaagtctagttggtgcaaggatcaaagtttggtggccagatgataagatgttctacaatggtattgtggagtcatttgatgctgtttctaagaggcacaaggtagcatatgatgatggggatgtagaggtactactgctgagggaggaaaagtgggaattcatcagtgaggagaaggaagcttctatggcatctgaaacgccacgaggcagaaaaagaaaagcggatgcattgaaggaagaaaatacagaaacacctaaaagtgatgctgtggatcctccaaagaaaagaggacgtccaaaaggtgtgggatccagcaatgggacacccagtacctcagctactccgagcacaaaggggaaaactgccggcaaggttaccaaagaaacacctaaaactggccccaaccttaaaaaagaacttgagaagaactccaaggacaaggctaatgtttcaactgggacaaaagatgataagagtgtgagcaaacctaaggaggctattatcaaaggcaaggattcaaaagacgaaggcaagtccactgaaggaaaagctaagcctggtcggaaaccaaaaaatgctggtactcctgcgggtgattctgacaaagagaagcaggaggtagaagtcaaggcagctgaaatagaggaggcatcaggaaatgcttccacagggaagaagcgtaggaggaaggcttgaagttagcgctgatgaacttctcttgtaaatggatgtgctccctcctaggtttgctcctttaggaccttgtattattgagtgttaacttggaatttcgtctgattggtccctagtagttagttaggtgtggaagcaacatttgctatagccgtagtgttaggagtaccatgtgttcgttgtggtcaggtccatggtgcattggtgctgagccttaagcggaatgaaccctatgctcgctgtgaggcccatggcatcgtgttgtcgggtggtgttgtagcttgttgatgccctattttatattattatacgcgattgaagcagtggattttgtagcaaaaaaaaaaatggaagggggggctcggcccggtttcgaagccccccttgtttctctgctgcatggggatantataanaggaagggaaaccgcaatagaagatccaaacttc

SEQ ID NO: 3480 - DNA, 1957 bp, Zea mays
cgcataatgttaatcaaattccatcttagggagtgtttgaatgcactagagctaatagttagttagctaaaaaaattgctagcggaattagctagctaacaaacaactagctaactattagctagactgtttggatgtcttcaactaattttagcggctaactattagctttagtgcattcaaacacctccttagtctggaagttgtttttttttctgaaataagtatgagggagatgttagttgtaaactgcacaatcgcctgctggcaattgatagttggctatttatctaaattccaagcatgccaataatctaatgcctcttgataagtgcttctgttaagttcgtgttattatttgttcaacaggccaggaggcagaaaaagaaaagctgatgcagtgaaggaagaaactacagagacacctaaaaggtactccttctgtcccaaattaaaattcgttttaggcttttaatggattcatacaataattgatgtatatgttttgtaggtgtctagattcgtcatcacccatttgaatatagacataaaaactaagagctaaagtgaatactaatttgggacggagggagtaagtaattgatacaaagaagtcgctcatgcatgtatcttttctgatactgttttctgcatggctccagtgatgctgttgatcatccaaagaaaagaggacgtccaaaaggtgtaagatccagcaatggcacacctagtaactcagctactccgagcacaaaggggaaaactgcgggcaagaataccaaagaaacaccaaaaactggccccaatcttataaaggaactcgagaagagctccaaggacaaagctagtgtatcaactgagacaaaggatgaattgcctaaagatgacaagagtgcaagcagacctaaggaggctattagcaaaggcaaggattcaaaagacgaaggcaagtccactgaaggaaaagctaggccaggtcggaaactaaaaaatgctggtactcctgcgggtgacgctgacaaagagaaggggaaggagaaagaagttaaggcagctgaaatagagcaggaggcaccaggaaatgcttctacaggaaagaagcgcagaaggaaggcttgaagctaacactgatggaacttcttttgtaaatggatgtgcaccttgtattattgagtgttaactcgaaatttcgtctgtttggtctctgatagttaggtgtggaagcaacatttgctatagctgtaatgctaggattaacatgtgttcattgtggtcagatgcatggtgcattggtgttgagctttgagcggaatcaacccaatgctcgctgtgaggcccatggcatcgtgttgtctggtggtgttgtagcttattgatgttctatttattataagcaatttaagcagtggattttgtagcaaaaaaaaaaaaaaagacaccaagggggcccccggtttaagttgggcacggatctcataggcccttcgataaggaagcagcaagggcctcaatctgattttttgtttagagcttgtatttggcacggctttagaaaaggcagccgtatcaaaacttcacttgagaaaaggctaatttctgctgaataaaagtgaagtcggagccttccactaaagtatttttctggtgaataattgataaatcggagtctttttgaaaatagaagagtcttaacgaacaaactcttaatatgacaattaaaatatatgatagtaacaagagtttcttcggttctcaagaaattttggatgtttctcccatggggcaccaaggtccaatgttcacattgcaaatgactgcaacctcaagttttatcagaaaggaagtcgtatacgtgtaagaccgtctccaggcaggttccgcggcaggcaggaagatgctcaatctagttgcttgtgtgctggtcggtgatcgtagtttgtcgctgcaggcatgcaag

SEQ ID NO: 3481 - DNA, 1041 bp, Zea mays
gccggccggggccggccgcgccggcgaacacaacagcccctcccgcgccgaaacctcgtcgcgtcgcgtcgcgcggaagagaggagagggacgggggccgcgggggcgagaagagaacaccactacggattgcctcgtcatccaccaccgctccaccgctaaaccctcgagtgctcttccgcgcggcggggcgccgagcgtgaaagccacctgctctcgtccagtcgcactcgcgccgcgaggggaaaccctaggagcggcagatctagagcgggcgctctcgatccggccgcgtagacgcccgttttggccggggaaatggcggaggatcctgccgccgaacaggagacgcggcagctagaggaccggctcagggaggtcggggaacggctgcaggcgcctcccgacgacgcggaggacctgctcaacctcctcatcgaagttgaggagtgtttacttaaagttgagcagtcacctcctgaaagcacatcgaatgctcttcaactagcaactgcagctcttgtcaagaaagagctgctgggccatgctgattcaaatattagacttgccgtggcatcatgcatatctgagatcacacggatcacagcgccagatgctccatatgatgacgatgcaatgaaggatgtattctctttaattgtggaggccttcaagcatctggatgacatagagagccccttctttggaaggagaacttcaattcttgatacagtcgcaaaagttcggtcctgtgtggtgatgctagatcttgaatgtgacgatttgataaatgatatgttccatcacttcttgaggactgttaattctgggcattcagaagccgtcatatgctgcatggaaaccatatggagattggtaattgaggagagtgaggatgtccaaccacagattgcttcatgtctactccaaaatgttagaaaagaagaaaaggaatcttcttcagcttcctttgagcttgctgaaaaagcgataggcacatgccgtgagaaattaagccagtctttctggaatcactaaaaa

SEQ ID NO: 3482 - DNA, 1275 bp, Zea mays
attaaacagttatactctcgtctcgccgtcgctatcgaggcgagctccgtggaagtttgctggctgctgaggctcgttcgaggcggtggaggacaggcaggcaggcagctctccgttcggcttggcttggcttggacggctgccgcgtcgcgcacctgcgggcgggcagtggccagtggctgggcggtccggggccggggcagccaggggcgtcctcgcgctcgtagccactgaggtcggcggcggtggcaccgtggcagtgcggtgccgagaaaccgtcccaccaaggaggctggggcaccgaacagcgaacaacggaagaagagcagctgaacaggcaggggagaggttccagctatgctcaccgagcagccgccacctgaggtagcgggtgaggatgacagcagtttccaccatgtcttcgtggagtttatgaccaaagccgctcagttcgaggagctcgctgaatctggggagcgattgcttgggagattccgtgaggagcttgagtattttcgtaggccccagattcctaaggaatcagatgtcatgaatcagatacttaaatccaactgcactgtcagaatgaggtcctatgttgaagctggctgcaggcttcactaccaaaacatctcaaacataaatcagttaagctcatccgaagctggacttaaagatcatataaagaaagctaagactttgctcgaagaacttgaatgtctagtcgagaatgtctatggcatcacattaacatccagtttaagtgctctggaagtttcagacagtcattgcctcgacaacatgccaagcaccgattgctatgccatggaggaggataaacgagcagatcatttggacatggacgtatcgctcgttacggtgatggccatggttcgcaacatgctgaagcttgactacacgatgcaggagaagattgtcactgcattgtccttgaaaacaccagcatcggagctcgagggatactgcctcatgtgggatctacgcccgtacatcgatgacgacgtgatgcgtcttgcgtggaacatgtgtccttgaagcattggggctttgagttgtttctgctgggatggatgtctggtctgttcattattttcttatgtatgacaacgtggttgtgtgtgttcatggtcgtcttctggagacgagaaacaatgggtgttgtttggttcacataaattggtaactaataatgttagattatgtttgtttaagttcaaccgtaatcgataccacactataaaaaaaaaaaaaaaa

SEQ ID NO: 3483 - DNA, 2262 bp, Zea mays
tgcgacgcgatgaggaggcgaagcctgaaatccgaatggtcagtttggtttgttggtgcgttgccgtccgtacccggaaatcccgcggttctggcgctccgggaacgcggggtcggcggggcgctcgtccgcagccaccgcgcggcagcgcgtccttggagcggcggcggttgccgagcgcggacgcggacgcggcgaaggggcgggagggtggcggccgtgcggaggccgcagcgcgcgggaggccaatgccgaggcggccatctcggacgtagtcacagaagcggagggcgagcggcgtccggcgatgcgaaggcaactggtgggggagacgacgagcagggcgagtagtgcgagtgaggcgaggccacggctgtggacacgtggcgtctcgacggccgttctccgttcgcggcggccgttgcctcgtccaggacggacccgagataacatgggctgtagtaacgagaccacaaatacaagagatctcctcatccagaactcaaggccacaaagtcgacagggcctgacctccgagatccatccgagccctcgtcgaagcgtcgatgcaaacttgagttattgggctggaccggattgagacaaggccattgcctcaatcggcccatcacgcggcctttcaggcactccctggcggcggcggcccccgcccctagccagcctctcgcgcgtgcgcagccggcaccctgtggctcactcagcagctgcgcgcggcaggccagcagtggtagtggacagcggcagcggctgtgctcggcggcccctgtgttgatgtgcgctgctcagctgctgtgcccagcggccgacacctctgcggctctcctttgctcgacgtcgagttcgtccctgatctggctcaacgatttactggtttttttgccgatgcttcatagttggcgagggagaaattccagcaatgcttgtcgtgcaactgccgccacctgaggtagcgggtgaggatgagagcaatagccgtggtgtcttcgtggagttcatgaccaaggtcgctcagttcaatgagcttgttgaatctggggagcgattgcttgggagatttcgtgaggagcttgagtattttcgtaggccgcagatttctaaggaagcagatgtaatgaatcagatacttaaatcaaactgcactgtcagaatgaggtcctatattgaaactggctgcagggtccactgccaaaacatctcaaacattaatcagctgagctcatgcggaaatggacttaaagatcatataaagaaagttaagaccttgcttgaagagcttgaatgtctggttgaggttgtctatggcatcacactaacagccagtttaagtgctctggaagtttcagacagtcagtgccttgacagcatgctaagtaccaatcgctgctccgtggagggtgtttgtacacagcaggaggacagaagtgcagatcggttggacagggatgtgtcgtttgctacagtaatggtcatggttcgcaacgcgctgaaggctgactacacgatgcaggtaaattgaagtgccaggatgtgcatttgctttttgcgctttacattttgcctttctcttatcttgcctacaggaaaagattgtctgtgcattgtccttgaaaacaccatcatcaaagctcgagggatactgcctcatgtggaatttacgcccgtacatcgatgacgatgtgatgcgtcttgcgtggaaaatgtgtccttagtaggcgcaaggttcgtcattctagcaacaagtaccagaagccggtacggattaaagccaagcttgtttaagctgtttgtcttcaaaaactcacagcagttcacgattacccaaaacattgtttgtattgtacatttcactgtttgcatatgtatacactatattaaagccctctcaaattttcttagatcaaaccaccgtcctctcttccctcgtacccatgtgtcagggatcacaagagataatggagtcagtcagtggcatgtggtgttaaagggacgaagatgtcgtgcccaggcttcagcggcaagccggcaacgacataagaatgtgctaaatgggcttagatgggctatgtaatacattagctgggttcggcctgtatggaacgatatatgtgtctctgtaaactgaggaggacatggtaaaacacataacagaaacgctacttctctgcctcgtctccttcctcgctgccttccttacctcttctccacgaaatctgtcattgctgactcgtttatcttctgcag

SEQ ID NO: 3484 - DNA, 1359 bp, Zea mays
ggggggtgtggggtgggggggggcgggggtgggctgggcccctggggatgcaaaaagagaagagagaatggcggagccaaacccagagttgagtgatcttattactcaaacaaagaagaaaaatatagtgccaaagttcaccgaagccttccccgtggaggacacggcctacccttacagcgccttcatcacctccgtccggaaagacgtgatcaaatactgcaccaaccatacaggcatcgtccagcccgtgctgccgctggagaagaaggtccccgagctctggttctacaccgagctcaaaacgaagaccaggtccatcacgctcgccatacgtatggacaacctctacctggtcggcttcaggacccccggcggggtgtggtgggagttcggcaaggacggcgacacccacctcctcgacgacaacgccaagtgccgccccggtggcggccggtaccaggacctcatcggcagtaagggcctggagaccgtcaccatgggccgtgccgaaatgaccacggccgtcaactacctggcgaagaagacgacgacgacactagcagaggcggcggaggaggaggaggagctgctgctgctgcaggcagcggctgaccccaaagccgaggagaagagcaacctggcgaagctagtgatcatggtatgcgaggggctgcggttcttcaccgtgtcccgcaaggtagacgaggggttcaagaagccgcaagcggtgaccatatcggcgctggaggggaagcaggtgcagaaatgggacaggatctcgaaagccgtcttcaggtgggccgtcgacccgaccgctgagatccccgacatgaaggatcttggcatcaaagataaaaacgcagctgcgcagatcgttgcgctcgttaaggaccaaaactagtgctgctgctgctactacatatgagaacaacgaggaggtctctgatgatccatccacgtggtacagtagcagtatactcctagtgctagtatataggagtatgttactgtgcaaataaatacacccggcgtacgtggtgttcctcgtatccctctacttgcttgcatagcgtcgattgaatttctttgcaaaagaccgcaattaacttcctctatgggtcttatttagggccagtttggaaattaaaatctcctccaaaatttctaaggattgagtgcaaaattaaactactagagattaaaacttaaatctcctccgaaattcttggcaaggattgaggcaaaagttaagctccccaatccctgttaggaatatgagatttaagtttccaaacggtctattgactcagcggacagaggggggaaacttcaacagtacaccaattactccggaca

SEQ ID NO: 3485 - DNA, 1240 bp, Zea mays
  misc_feature (1145)..(1145): n is a, c, g, or t
  misc_feature (1191)..(1191): n is a, c, g, or t
ataaataatgctaccgacgcatcaccacatagtacgtaccatagtcatccttatcctatcgaattacctacatgcccaaccctcccactacatatatctgcgtacctcgaggcccgccgggacaatgcctattgccagcaacccatccatactttcagctgttgatacaaaaagagaagagagaatggcggagccaaacccagagttgagtgatcttattactcaaacaaagaagaaaaatatagtgccaaagttcaccgaaatcttccccgtggaggacacggcctacccttacagcgccttcatcacctccgtccggaaagacgtgatcaaatactgcaccaaccatacaggcatcgtccagcccgtgctgccgctggagaagaatgtccccgagctctggttctacaccgagctcaaaacgaagaccaggtccatcacgctcgccatacgtatggacaacctctacctggtcggcttcaggacccccggcggggtgtggtgggagttcggcaaggacggcgacacccacctcctcgacgacaacgccaagtggctcggctttggcggccggtaccaggacctcatcggcagtaagggcctggagaccgtcaccatgggccgtgccgaaatgaccacggccgtcaactacctggcgaagaagacgacgacgacactagcagaggcggcggaggaggagctgctgctgcaggcagcggctgaccccaaagccgaggagaagagcaacctggcgaagctagtgatcatggtatgcgaggggctgcggttcttcaccgtgtcccgcaaggtagacgaggggttcaagaagccgcaagcggtgaccatatcggcgctggaggggaagcaggtgcagaaatgggacaggatctcgaaagccgtcttcaggtgggccgtcgacccgaccgctgagatccccgacatgaaggatcttggcatcaaagataaaaacgcagcagcgcagatcgttgcgctcgttaaggaccaaaactagtactgctgctactactgcgtatgagaacaacgaggaggtctctgatgatccatccacacatcaagacttgttttgttgctctgcttccacgtggtacagtagcagtatactcctagtgcacccgacgtacgtngtgttcctcgtatccctctacttgcttgcagatcgacagcgtcatntgaatttctttgcaaaagaccgcaattaacttcctctacgggtcttatt

SEQ ID NO: 3486 - DNA, 1256 bp, Zea mays
actccatagggcggtactgttcctccgggccggccggacaatgccaattgccagcaacccatccatactttcagctgttgatacaaaaagagaagagagaatggcggagccaaacccagagttgagtggtcttattactcaaacaaagaagaaaaatatagtgccaaagttcaccgaaatcttccccgtggaggacacggcctacccttacagcgccttcatcacctccgtccggaaagaagtgatcaaatactgcaccaaccatacaggcatcgtccagcccgtgctgccgctggagaagaatgtccccgagctctggttctacaccgagctcaaaacgaagaccaggtccatcacgctcgccatacgtatggacaacctctacctggtcggcttcaggacccccggcggggtgtggtgggagttcggcaaggacggcgacacccacctcctcgacgacaacgccaagtggctcggctttggcggccggtaccaggacctcatcggcagtaagggcctggagaccgtcaccatgggccgtgccgaaatgaccacggccgtcaactacctggcgaagaagacgacgacgacactagcagaggcggcggaggaggaggaggagctgctgctgctgcaggcagcggctgaccccaaagccgaggagaagagcaacctggcgaagctagtgatcatggtatgcgaggggctgcggttcttcaccgtgtcccgcaaggtagacgaggggttcaagaagccgcaagcggtgaccatatcggcgctggaggggaagcaggtgcagaaatgggacaggatctcgaaagccgtcttcaggtgggccgtcgacccgaccgctgagatccccgacatgaaggatcttggcatcaaagataaaaacgcagcagcgcagatcgttgcgctcgttaaggaccaaaactagtactgctgctactactacgtatgagaacaaggaggagttctctgatgatgatacacacatcaagacttgtttgttgctctacttccacgtggtacagtagcagtatactcctagtgctagtatataggagtatgttactgtgcaaataaatacacccggcgtacgtggtgttcctcgtatccctctacttgcttgcagatccacagcgtcgattgaatttctttgcaaaagaccgcaattaacttcctctgtgggtcttattaagggccagtttggaaattaaaatctcctccaaaattcctgaaaaaaaaaaaaaaaa

SEQ ID NO: 3487 - DNA, 779 bp, Zea mays
  misc_feature (85)..(85): n is a, c, g, or t
caagtggtgcatggcatttctcattctcttcgaggaagcctgcgaaacctgcgagacgcgcagatagtgtcgcaaggcacgctgngaaaactgggtcccaattggaggagacatcgtcgagataaatgtggagcggaagagcagcatccgtgagaggaggaagctggaaggcctcgaccttggaatgcaggagctaaggacatatttccggctattcttgctgtcaacattcctgttgatgttcatgttctgcgcgcggatatcaaagaacagaaacagagactcaggtaacttgtttgacccttgaatgaagtaccaaagaaagcatcggtggagtgcaagagcgatcccctcagatcagacgaacaaagcgatctgaaacattcagagctggaacacagctctgccttcgcacccctggtattcggagctggacgtcccgtatactttggacatgaaggatggtggcaggcagtgtctgtttaggttacaacagagacgccagacgatgtggctaattgtttaacaaaattgtagctgtaaaaatcgcccatgccagttttttttttttgtgatgcataggttttactactacattttgatggaaggttgttagtgcacccaacacttggtacggtgccatcagttgatgtaacatctcactgctcgagtggtttatgtggaattgtgttggctcgaatttcttatgggttctcatattcatttcgtaactttcaaagtttaaatatttatatgtatacatatatttaaggtcatgt

SEQ ID NO: 3488 - DNA, 8763 bp, Zea mays
ggacaaatccatccactctttctgtattctcaacgtaaagacaggcagggcgggcacgaagcgaagggaccagccagcgagcggctcgccggcgacgaccctctccccgccccaccccgcccacggaagcacggagaagatgtccgccgcataccctcgtctcctcctctgtctcctgaccctagccctggctctcgcaggggccgccgcgggcaagatctcggccccccgcaccccgatctcgcgcgacatctaccactccagtgactctcttctgcgtgaaatcaaggctttggttgctcggcattccagcaaattgagtatggacactatcaaaacaagcaacaaaggctattctgcagagctgtttgtagttacatttaatcacgtgaaggagcgcatggataatggctcaaaagttcatatccttctgaaaggttcattgtcttccagagctttgggcagcatggcagagaacttatcacctccgaagttgcattacgtcttctctatgttttaacggagaagcctaagatcgctggtgtggatctttcatcctttgagaaactgctggagaaccttgtgatcaaagttgtgccgatggaaaatatgaatggtcgcaaacgtgtcgaagaaggggagctttgtgataggagaaatggaagaggagttgatctcaacagaaattggagtgttgactggggaaagaaagaaaaagactacgacccatacgaggagaatcctggtattgctccttttagcgaacctgaggcccagatcatgagggaattatcaaggtcgtttaaacctcatatttgggtgaacgtgcattctggaatggaggccttatttatgccatatgatcacaagaataccacaccaaatggagcatctgcacattcgatgcggtcagtcttagagaatttgaaccgtcgccatttccaagatagctgcctagttgggtcaggtggtggatctgttggatatcttgcacatggtaccacaactgattacatgtatgacattgcaaaggtgccaatgccgttcacctttgagatatatggagatgagaaagcatcttccgatgactgcttcaaaatgttcaatcctgttgacaagaaaacattcgacagagtcgttaacaagtggtgcatggcatttctcattctcttcgaggaaggcctgcgaaacctgcgagacgcgcagatagtgtcacaaggcacgctggaaaactgggtcccaattggaggagacatcgtcgagataaatgtggagcggaagagcagcatccgtgagaggaggaagctggaaggcctcgaccttggaatgcaggagctaaggacatacttccggctattcttgctgtcaacattcctgttgatgttcatgttctgcgcgcggatatcaaagaacagaaacagagactcaggtaacttgtttgacccttgaatgaagtaccaaagaaagcatcggtgggggtgggccctcctccgagctgaacttcgggtgcaagagcgatcccctcagatcagacgaacaaagcgatctgaaaacattcagagctggaacacagctctgccttcgcacccctggtattcggagctggacgtcccgtatactttggacacgaaggatggtggcaggcagtgtctgtttaggttacagcagagacgccagacgatgtggctaactgtttaacaaaattgtagctgtaaaaatcgcccatgtcagtttttttttggtgatgcataggttttactactacattttgatggaaggttgttagtgcacccaacacttggtacggtgccatcagttgatgtaacatctcactgatcgagcggtttatgtggaattgtgttggctcgaatttcttctgggttctcaaattcatttcgtaactttcaaagtttaaatatttatatgtatacatatatttaaggtcgtgtatgtatataggaccttgtatgagtgtggagggatggaccgtccgctccgctagaacacaaaaaaatagtgtgcttctatgtgttttgccagaccgtacggtaggatgggattcgtctagaacccagaaatcactctggaaatttactatttcgaatcgttcagacaccgttttgagcgatgtttgtttctatagctctctagggacgtggaaaacttcaatcaaggcgtcggattcatgtggggatctcgagctcatacatgttgatgatggccatggactgacaatagtttatagttctaagagatgggtgaaaatttgggacttgctggcggtgtttcacatctagatgtagctcgaccaaacccgctccagaaaaaaatctagctcgacccgactatcgcaacacgtgggtagggaccataattttttactccgcaataaatcgcaggctaggtacatgccatgatttttgcctaaactccgacctaccccgaaaaaccttgatccaaagtaaaaaaaacctaacacatcaaataggaggtatgggttaacccaacactagacacaagtcacacaagtcatgtacgagccgtactaaatggactcacgctcgatccgccttgacgtttaaacaggtctatccacagcccagccgtgacgctctatggaaggagatggatctgaggtttctccaaaagtacatcttttagagtaaatccgaaatgatgttaaaaagtttgtccaaaaaattattattggggacagattgaaagaattagagataaaatatggtgtttactccaacagtttttttttcaaacaaaagctaaaaaactacaaactggatcgaattgaaaaaaacaggcccatctacgaattcggtaccacgttactgcaggctgcccttcgggtgcgtatgcgaaagatgaatttggataatgatgatttaatatatgtattatgtgcactaagcttcaatgtacattagatatgtccttcattcgataagattaaaagacgttcgcaaacaacatattgtaaatatcttggttgcaggagcctgctatgtctttgcgccatctgaaccaaggtgtcatgcatatcactgttcaaatgcttacctacttagattagattagatcaaagccgtcgtcaattcttcttcggtggagtttggagaaggaaagagacggtagttgcacaccaaactggggtccatgggctggctgggccggggccctacacgttggtaacttggtacaccgtacactgatattgaagaggtggcccgtcccatttcatccgcgaaaaaaaaggggttcagggaagctcacgccaagtcgtcccttcaccaacgcaacgcaaggcatcgcatcgcatgtccaaggcaaggcatcgcattggtagcaaaggcagcaaccaaccaagcgggagcggccccttgcttggcaaccgcccgcgtgcctgcgtgcggggccgcgggatcgcagcgcaacgcgggcggcaccacctgcccaccacaccaccatccctccggactcccgtcgccgcgccgtacgtacgtgctgggtggcggcggctgttggctgttgccgccgctgccaccaccgccgccgcggcgccgtgctgtagctagcgatcgagcgagcaacgtagtaggcaggccgggcgcggctgtggccgtgcgtgacgacgaaggaagcaagatgaagcccggcggcggcggcggcggcggcaacggcgtgaccgcgacgacgacggcgatcccgccggacgacctccgctcgcggcgccgcctggccgcgctgctggcgccactcctgctcttcctggcggccgcgctctccttcccctccacgctccacctggccgccgtcccgctcccaacgccgccgatgacgacggtgccgcgccggaccacgcccccgcgggtcgccgtctgcctcgtgggcggcgcgcggcggttcgagctcacggggccctccatcgcgcgccacgtcctgcgcggcggcgcgttcgcggtccccgcggaccgccgcgacgccggccaggcggccgccaccacctcggtggacgtggacgtgttcctgcacgctccgctggacgccgacgcgtacaagctgcccctcctcctggcgcctgcagccgggccgggcggcggcagcggcaccaccagcaggaatagcaacaacgtcgtcagcctcgccgccgtgcgcgtgttccggccggtgtacctcgatgagacgacgccggcggcgcgcgcgcaggtgctcaccgccgacaactcgcccaacggcatccaggtttgcctcttccctcgtcggcggcttgggtttcattgttccttgcgtcgcttgcatgccatgccatgccatgccattcgatcataccgcccgccttggctattttccgagtagattagatcagtttggttttgctgttgctaatacttttagcttaggttccccgttcgactaccgtatcatctttctcgttggtgatttccttttgttggtcgatcgtttgatttcggaaaagcttgcgacttttggtgtcgttcccacaaccacaagcaagcaaaggccaaccccgcattgccttcattttggtcaatcttcaaatctgcccctagctagctagccaaaccaattgaagaagccaccgtatatatatgtactagcacgcaagcaattagctgcgtagctgctttctgcaaagtccatcgtctcgtcaccaccaccacctttgtgtttgttgaagaaaaagacatggaaaagcacgtggctaccgaattcctctttccatgcatgtcctgttgagttgaaggttgaagccaacaccacctctccatgactccatgccatagcagggcctgctgcagtacttccgtctggtggaagggtgcctggacatgatccgcgaccgcgagtcgcgaggcaacttcacctacgccgccgtgctgcgcacccgcctggacggcttctggacggcgccgttccgcctcgacgacgacgaccaactcctgtccgggtccgcctacgtcgtcccggagggctcgcgcttcggcgggctcaacgaccggctgggctacggcgggcggcgcgccacggaggcggcgctggcccggctgtcggcgctcccgcggctggccgccgccggccacgcggggctgaactcggaggcggcgttcgcggcgcagctggagctgtcgggcgtggcggcccgcgagcggcgcctcccgttctgcgtcctcagcgaccgcgcctacgcgttcccgccggcgcccgggtacggcgtgcccgtggcggcgctgggcagcgccggcccgctcagcggcgccaagtgccggccgtgccgccccgcctgcgccggcgcgtgcgcccagcgcagcgtcgcgcggctcgagcccgcgtggagctggaccggcggcgccctggagctgtgcgacgcgtcgggcccctgggagccggggtgggaggcgctgttcgacgccgccgccggccgcgacgccgccagggccaggcgggccgtggcgcggatgggcgccggagagtgcgtcgcccggatggaggcgttcagggccctcgcggaccggtgggacgcgcccagccccgccgagatgtgccggatcgggctccgatcccggtcgtcggcgtcgtcggcgccgcctgcgacggtcagtagtagtgacagcagtgcccactggcacgtaccgtcgttgccgaggcagagcaggcaaccatgagtccatatattgcacgcagacgcagcttcgcgatgcaaagattgttttactgttagttaattagctagctaggaacacgaattgaaggaaggggcaatacataggaacactccgctaggcgctagcaatcgtattagttcaatgtatactttatataagtcgtgttggcagactagatagatacacagtgaataaataatacatgcagttgaaatacactggaatggatggttcttggatccatgggccagggcggccggacagtgacaatggcaacaaacaaggttggtctggtcatggcaacacccaacagaaacgaccgctagtaggtcacagcagcagaaaaggcatctgctttctcctggcgaagcaatcgcttaccctctgtcgtcgtcctgtccttgcattgcatgcagccgtccatccatgttccgacagcaggatggtgttggcgacgctagactagacctggcaaagcgcctgaaggagtgagcctcgtctttgagcaggatttcccgccttcagttgcagatgcagtcaccccggtgaatgaatgctctccccatactgtgcagtatgcctagtttccctgctatatatatcatgccagaaaacaaatgatacctgtagggtcttcacccttggttccttgctctgtgaaacgcattttatcagtccagtgttgcattgcatggacagtttatttttgtatgacacttggtaatagtctcgacaccaagttgccctcaaatgccaggaaacagttcttttttcgtcagttcctcagcccggcccttcgtttttttttttttcgagaggaaaaaaaaagtcatttcataaagattcgtaatctgtgcttgtttacaacaaggcactgcgtgacaacagcatagtagcatagcagacaagaaaggcttggcgccgacaaagacatttgcgccatttctagatctaaatgacttcctgagcttcaattctttggatgatccattactactccatccataccattagtaaaaaaaacgagagaaaaaaagaagatcaccagcgctccacaggattgcaggaaccagcttattgcattgaagacactggcgtacgcatactctccttgcaggcagtttgcgtcatgaactcatcctgcgcagccacttgagggagttctcgagctcagaatacgccgtcacctcggcgaaactcttggtctggatcgcataatcaaacacctcatacgcgtccgcgacgctgcccgatcggcacagcgccctgacgaaggaggcgtacgctggcgactcgagcttcgtcccagccgccgccatggacttgtacacctcgacggccttgtccagcttcttgttcttgcagaggcccatgagcagcgtgctgtaggtgcgctcgttgggctggcaccccttgccctgcatctcctcgagcagcttcagcgccccgagcgcgtcgcccttgacgcacatcccgttcatgagcgaggtgtaggtgacgacgtcggggaggtggccctccgcggccatggcgtccaggaaagccctggccttggcgaccatcccggcgcgcgcgagcccgaagatgagcgtgttgtaggtgacgaggtcggggtccacgccgtcgctcctcatctgccggaacaccctgaggacggccccggggtcgtccgccgcgacgttcgccttcatcagcgcgttgtagaggtgcgcgtcggcgcggacgccgtggtccctgagaaccgggaggacgcgggagatctcgcgcggctcgccgcggcggcacacggcgtccgcgagcgccagcagcgccccgcgcggggccgggttggggcgcgggcagccgtcctcgccggaggggtggagcttgtcgaggaggctccgcgcggcggcgacggagcgggtggtgaacagacggcggagcaggagcgcgagggagtgtgtcggtagcggcacgtccgggggcgcggacagggccagtgcggccgccgcgtcgatgtcggcgtccgccgccgcgcggatggcggccgcgaggtcggccggcgtccggatgggcttccgctcctcgtgcacggccgccacgggggccacggctgtgaagtttttggagctcccgtgggggttcttgccgggcttggtaggattggcgggcggatgagcagacggcggctgcgtggagggagaagcggcatgggatctaagctttgttttggggatgagggcgagggagagcttcgcggcgtgccgcgccttccccatgctgcgcgtcccctcggccgcttcccgcggggcgggcaacggcggcgacgagggcgggagtgcgggtgggtttgtgcggcggcttcgttgagctgtagaagccggcgccgcagcgtggattggtggacaagacgacctgtgttgggctgcgcatggaacgatgcggtttcggcccaagaaactctggcccgttggcttgttgaaatactgggttgtttgcccttttttataaggttctttggttttgcataaataaaatgtaccatatgctcaattatataatccaactgtttattttggttcttgatattttttggacaaatgtcctgcagcttataggctcattctattatcacttcctacgttccaaaatatagttcttgagctcacttttttttcgtctacattcattccaacgataataaatatattcatgttacctaatgtgattagtttaaaatgaattatattttgggacagagtgagtgttacattgaaaatatttcaaatgtttagtgcatatataacgctataattgttattattttgctttttaagtgcctctttctttgcattgaaaacatgtgtaggggcagagtaagcaacaagttcgcaatgctgatccttcctttttgtttgatttttttgtgcatctttaactgaatctttgattttaatttcgagtgttcattataacagattgacaatatcttcaagcaagttttgttcttgagtttagtctcgagatgttatggtgtttgtgcttggtattatattcgtggagatatgtttttcaactgaaaacttat

SEQ ID NO: 3489 - DNA, 1933 bp, Zea mays
  misc_feature (1892)..(1894): n is a, c, g, or t
  misc_feature (1914)..(1914): n is a, c, g, or t
  misc_feature (1933)..(1933): n is a, c, g, or t
caacgtaaaggcaggcagggcgggcacgaagcgaagggaccagccagcgacgcggctcgccggcgacgaccctctccccgccccaccccgcccacggaagcacggagaagatgtccgccgcataccctcgtctcctcctctgtctcctgaccctagcaccggctctcgcaggggccgccgcgggcaagatctcggccccccgcaccccgatctcgcgcgacatctaccactccagtgactctcttctgcgtgaaatcaaggctttggttgctcggcattccagcaaattgagtatggacactatcaaaacaagcaacaaaggctattctgcagagctgtttgtagttacatttaatcatgtgaaggagcgcatggataatggctcaaaagttcatatccttctgagctttgggcagcatggcagagaacttatcacctccgaagttgcattacgtcttctctatgttttaacggagaagcccaagatcgctggtgtggatatttcatcctttgagaaactgctggagaaccttgtgatcaaagttgtgccgatggaaaatatgaatggtcgcaaacgtgtcgaagaaggggagctttgtgataggagaaatggaagaggagttgatctcaacagaaattggagtgttgactggggaaagaaagaaaaagactacgacccatacgaggagaatcctggtattgctccttttagcgaacctgaggcccagatcatgagggaattatcaaggtcgtttaaacctcatatttgggtgaacgtgcattctggaatggaggccttatttatgccatatgatcacaagaataccacaccaaatggagcatctgcacattcgatgcggtcagtcttagagaatttgaaccgtcgccatttccaagatagctgcctagttgggtcaggtggtggatctgttggatatcttgcacatggtaccacaactgattacatgtatgacattgcaaaggtgccaatgccgttcacctttgagatatatggagatgagaaagcatcttccgatgactgcttcaaaatgttcaatcctgttgacaagaaaacattcgacagagtcgttaacaagtggtgcatggcatttctcattctcttcgaggaaggcctgcgaaacctgcgagacgcgcagatagtgtcacaaggcacgctggaaaactgggtcccaatcggaggagacatcgtcgagataaatgtggagcggaagagcagcatccgtgagaggaggaagctggaaggcctcgaccttggaatgcaggagctaaggacatacttccggctattcttgctgtcaacattcctcttgatgttcatgttctgcgcgcggatatcaaagaacagaaacagagactcaggtaacttgtttgacccttgaatgaagtaccaaagaaagcatcggtgggggcccccctcctccgagctgaacttcggggtgcaagagcgatcccctcagatcagacgaacaaagcgatctgaaaacattcagagctggaacacagctctgccttggcacccctggtattcggagctggacgtcccgtatactttggacatgaaggatggtggcaggcagtgtctgtttaggttacagcagagacgccagacgatgttgctaattgtttaacaaaattgtagctgtaaaaatcgcccatgtcagtttttttttttttttggtgatgcataggttttactactacattttgatggaaggttgttagtgcacccaacacttggtacggtgccatcagttgatgtaacatctcactgctcgagtggtttatgtggaattgtgttggctcgaaaaaaaaaaaaaaaaaaaaaaaaaaaaaaaaaaaaaaaaaaaaaaaaaaaaaaaaaaaaaaaaaannnaaaaaaaaaaaaaaaaaaanccaaaaaaaaaaaaaaaan

SEQ ID NO: 3490 - DNA, 847 bp, Zea mays
ctgtgggccgcccggggcggccgggaccattaattcctcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggctttcgccgtgttcatggtgcacctggccaccatccccgtcaccggcaccggcatcaacccggccaggagcctggggcgccgccgtcatctac

SEQ ID NO: 3491 - DNA, 1947 bp, Zea mays
taattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataattggaggttgtcaccatcaccacaaagcatatgttgtgatttgtcgatggcgaggagatgaaacaggtgtaggggcggagcagcaaggacatgacagccatgccgcatccgcgccaccgaggcgctgctaagaagcccatgtggatcatagtgctattgtctttggtttgtgttgcacttatgggggcctatgtctacccaccacggcgctactccgcatgctacttctttgcttcgagtgtctgtactccgttcaaggattggctacctgctgttgctcgtgagcgaactgatgaagagatagtttcatcggtggttattagggatcttctttcaatgcctatggctatgtcaaagaacccaaagattgcctttatgttcttgacaccgggttcattgccttttgagaagttgtgggagaaatttttacagggtcatgatggccgatattctatctatatccatgcatctcgtgaaaaacctgtacattctagctctctttttgttgggcgtgaaattcacagtgaaaaggtagtatgggggaggatttcaatggttgatgcagagaagaggctgttaggaaatgcattggaagatgttgataatcaatttttcgtcttgctttctgacagctgtgttccactacatacatttgattacatatataattatctgatgggaaccaatgtcagtttcattgattgcttcttcgatcctggcccacatggaactggaaggtatacgatggaaatgcttcctgaaatagaacagagggacttcaggaagggtgcccagtggtttgctataacacgaaggcatgctttattgattctggcagacaacctttactacaataagttcaagctgtactgcaagccagcagaaggacgcaactgtattgctgatgagcattatttgccaaccctcttcaatgttagtaattatttttaactctgttatttaccttttttccctcgaccccttgcttcccttttttttagtacagttgtgtttattctttagatggttgaccctggtggaatagctaactggtcagtgactcatgttgattggtccgagggaaaatggcatccaaggtcatatagagctgcagatgttacatatcaactcttaaagaacataacgtctgtcaatgagaatgttcacattacaagtgatgataaaaaagttgtgacacagaccccatgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttttgtgcttcatgtaaattgtggaattgatacttagaggcttaacagagttacagatccagggccttgatgtaattctgagtcccttggtagggctgaggtgatgtttgtttattattgacgctgccctccctgtcattcgtggtgctctctgtatgactatgtttcttttagcccttcacttttttctcttctcttttattcttagattcctagctcccatattctgagtaacaggggttttgtcagttcttactgttattataagattatttttttgtagacacgaagatattatgaaatcagttacactaatagtttaacctggtcttgtgaaaaacagtgac

SEQ ID NO: 3492 - DNA, 834 bp, Zea mays
cattgggtacctcggccccccccacattccactagaacactaccaccacctccacctcgtcgtctcccaccaccgccgcgcgcgagccctagcccgatctagccggcggcaggcactagatcccgccgcttgcggcatcccgggacgcgcctcgccgaattcgccgctcctcgcactgcaacacgcccggaccactaaaaaagaggcaactctggggcataacgtacttcaccttgattacaggttactgcatgccatgtagtattttattattggtggaggttgtcaccacaagacatatgttgtgatttctcgatggcgaggagatgaaacaggtgtgggggcggagcagcaaggacatgacaaccatgccccctccgcgccaccgtggcactgctaagaagcccatgtggatcatagtgctattgtcgttggtttgtgttgcccttatgggggcctatgtctacccaccacggcactactctgcatgctacttctttgcttcgagtgtctgtaccccgttcaaggattggctacctgctgttgttcgggagcgaactgatgaagagatagtgtcatccgtggttattaggaatctcctttcgatgcctatggctgtgtccaagaacccaaagattgcctttatgttcttgacaccaggttcattgccttttgagaagttgtgcgaggaatttttacagggtcatgatggtcgatattccatctatatccatgcatctcgtgaaatacctgtacattctagctcccctccttggtgggacgtgaaattcgcagtgaaaaggtagtatgggggaggatttcgatggttgatgc

SEQ ID NO: 3493 - DNA, 1800 bp, Zea mays
aattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataattggaggttgtcaccatcaccacaaagcatatgttgtgatttgtcgatggcgaggagatgaaacaggtgtaggggcggagcagcaaggacatgacagccatgccgcatccgcgccaccgaggcgctgctaagaagcccatgtggatcatagtgctattgtctttggtttgtgttgcacttatgggggcctatgtctacccaccacggcgctactccgcatgctacttctttgcttcgagtgtctgtactccgttcaaggattggctacctgctgttgctcgtgagcgaactgatgaagagatagtttcatcggtggttattagggatcttctttcaatgcctatggctatgtcaaagaacccaaagattgcctttatgttcttgacaccgggttcattgccttttgagaagttgtgggagaaatttttacagggtcatgatggccgatattctatctatatccatgcatctcgtgaaaaacctgtacattctagctctctttttgttgggcgtgaaattcacagtgaaaaggtagtatgggggaggatttcaatggttgatgcagagaagaggctgttaggaaatgcattggaagatgttgataatcaatttttcgtcttgctttctgacagctgtgttccactacatacatttgattacatatataattatctgatgggaaccaatgtcagtttcattgattgcttcttcgatcctggcccacatggaactggaaggtatacgatggaaatgcttcctgaaatagaacagagggacttcaggaagggtgcccagtggtttgctataacacgaaggcatgctttattgattctggcagacaacctttactacaataagttcaagctgtactgcaagccagcagaaggacgcaactgtattgctgatgagcattatttgccaaccctcttcaatatggttgaccctggtggaatagctaactggtcagtgactcatgttgattggtccgagggaaaatggcatccaaggtcatatagagctgcagatgttacatatcaactcttaaagaacataacgtctgtcaatgagaatgttcacattacaagtgatgataaaaaagttgtgacacagaccccatgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttttgtgcttcatgtaaattgtggaattgatacttagaggcttaacagagttacagatccagggccttgatgtaattctgagtcccttggtagggctgaggtgatgtttgtttattattgacgctgccctccctgtcattcgtggtgctctctgtatgactatgtttcttttagcccttcacttttttctcttctcttttattcttagattcctagctcccatattctgagtaacaggggttttgtcagttcttactgttattataagattatttttttgtagacacgaag

SEQ ID NO: 3494 - DNA, 1807 bp, Zea mays
ttgggaccctcgaggccggccctgctctcacccctctccgcccctcccccccccattccactagaacactaccaccacctccacctcgtcgtctcccaccaccgccgcgcgcgagccctagcccgatctagccggcggcaggcactagatcccgccgcttgcggcatcccgggacgcgcctcgccgaattcgccgctccccgcactgcaacacgcccggaccactgttactgcatgccatgtagtattttattattggtggaggttgtcaccacaagacatatgttgtgatttctcgatggcgaggagatgaaacaggtgtgggggcggagcagcaaggacatgacaaccatgccccctccgcgccaccgtggcgctgctaagaagcccatgtggatcatagtgctattgtcgttgatttgtgttgcccttatgggggcctatgtctacccaccacggcactactctgcatgctacttctttgcttcgagtgtctgtaccccgttcaaggattggctacctgctgttgttcgggagcgaactgatgaagagatagtgtcatccgtggttattaggaatctcctttcgatgcctatggctgtgtcgaagaacccaaagattgcctttatgttcttgacaccaggttcattgccttttgagaagttgtgggaggaatttttacagggtcatgatggtcgatattccatctatatccatgcatctcgtgaaatacctgtacattctagctccctctttgttggacgtgaaattcgcagtgaaaaggtagtatgggggaggatttcgatggttgatgcagagaagaggctgttagcaaatgcattggaagatgtcgataatcaattttttgtcttgctttctgacagctgtgttccagtacatacatttgattacatatataattatctgatgggaacaaatgtcagcttcattgattgcttcctggatcctggcccacatggaactggaaggtattccatggaaatgcttcctgaaatagaacagagggacttcaggaagggtgcccagtggtttgctataacacgaaggcatgctttattgattctggctgacaacctttactacaataagttcaagctgtactgcaagccagcagaggaacgcaactgtattgctgatgagcattatttgccaaccttcttcaatatggtcgatcctggtggaatagctaactggtcagtgactcatgttgattggtccgagggaaaatggcatccaaggtcatatagagctgcagatgttacctatgaactcttaaagaacataacgtctgtcaatgagaatttccgcattacaagtgatgataagaaagttgtgacacggatcccatgtatgtggaatggaacaaaaaggccatgctacctttttgctagaaagttctacccagaatctctgaacaacttgctgaagctattttccagttacacatcggcttgattcgacatttttttgttcatttggcctaggagattcccctagttttttttctgcttcatgtaaattgtgaaattgatacttagaggcttaacacagagttacgggtacagggccagtgatgtaattctgtgagtcccttggtagggctgaggtgctgtttgtttagtattgacctgccctccctgtcgttcttggtgccgtctgttaggttcctagcgcccattccctgagtaacagggtttttgtcagttattactgattaattctttgtagacatgaagagattcgaaatcagttacacttcatagtttaccgaaaaaaaaaaaaaaaaa

SEQ ID NO: 3495 - DNA, 2785 bp, Zea mays
  misc_feature (314)..(314): n is a, c, g, or t
cagaagaagaagaaagaagctggcaagatagatatgtagtatagggcatggcagcaagcacagataacaatatgcattattctatggcctcaaaatttagcagcttgcttacaacctccctcctggggtttgcaattgcaactagtatcttgttgataaggtcccaagatcccccaccaagcacctcaccgcaggagcaccctttttgttctctctgatccctcctcctcctcctcctctctctctctctctcacagtctctctctctttccttcagtgccttctgcctgtgttgagagtcccaagaagcactngagaattttgttgcatctacccttgagagtgaggggagctaggagctctctgggcgccattggccttttcttgctcgctctctcatcatggtttccattgtgccgctgcagagaacagaagcgtcagcagcaccagcaagaagcatcttctctctggagcggcgcctccgaaaagaagacgacggatcgggaccaggaggcatggatctatctggcacgcagggcgagctcgcgatcccaatgcacgccaacgtcgcgtcgccctacggaggcggcgtcggcggccatgtcctgcagctgcaccgtgacgcacggcagcaacaacggccagtctccggcgccgctgctgccaccgccgcctgccgcggcggaggagacggagagctcggcgaagaagcgcggtccggcagccggggccggcggcggcggaggcagctccgcggtgaagtaccgggagtgcctcaagaatcacgcggcggccatcggcgggaacgccaccgacgggtgtggcgagttcatgccaagcggcgaggagggctcgttggaggcgctcaagtgctccgcctgcggctgccaccgcaatttccaccgcaaggaggtggacgacgaggacgacgacatgtacggcgccgccgaaggcttcagcggcctcggtctcggcctcggcctcgggcacggccacggccaccgtgccgcccgccgcctcctggcccccgccatggcgcacccgcaccacaagagcggcggcggggggctcctgatctccggggccgacccctacgccgcctacgcgtcggcgcgcgcgctccctccggcgctgccgccgccgccagggcacgcccaccaccaccaccagtacgtgatgccgctgaacatgatgcacacctcggagtccgacgacatggagggcggccgcggcggctgcggggacgcggcgcgcggcagcggcgggtcgtcgtcgtccaggaagcggttccgcaccaagttcaccccggagcagaaggcgcgcatgctggagttcgcggagcgcgtggggtggcgcctccagaagctggacgacggcatggtgcaggccttctgccaggagatcggcgtgaagcggcgcgtgctcaaggtgtggatgcacaacaacaagcacaacctcgccaccaagcgcctcgaggcctcgccggcgcaggagcaggcgatggcgggcatggcgtcgccgccgccgccgccgccacccccacagctgcacttgcctctgcagatgcccgctggagtcatgccgccgccgccgccgccgccgcaggccgggtcgtcctgtcaccgcggcggtcccggctccccgctgccgctcaagctcgagtgaccaccgacaacctgacaaaaaacaagaagagggtgaccaccattggtggccgttgatccgtcctggtggtaagtggtaaactagctagctagcagaccgacggaccgcatcgatggctatttcactgttccattagtccattccttcccaagtgatctatctaccgtcgtcgtccaagcagggagagaagtgggcgatgaacttttcttgaaacaacaaaacgaacaaagtccaggttattatcgtctcttttttttccttcccttttccggtgctcgttgctttgtcacaaggtaggggagcaagcaaccaagcatgcatgatagtagtagctgatttcgactggactggactgatttccttccaattttttttcctgatggtgaagaaaactaaatatcctactagtatctatcctccatttatgttatgtgttagtattcattttcttggctgctgacctcttactctatttcatcgttgatcgaaattgggggatgaagacgaattgaggtgtcgttatggacaacatcttttcgttgagttctgtgccggggatttggaattgtgtgcgtgcatgatggcatgacgcggcagagcgagggttcaggatcactgtttgctcttgtgccattgattttagatgccagcgtagcgtcgagatcatccatactctgcatctgcatatggcggtcccgcatgatcccatatgactagttgccagatgccagtgtactggttgctaagggcctgcatgcaaatattttgaaagctaattttagcacattaggctcaaaataggttgctcataaattggctaattgttagctagaggcttgataatttgtttgcagattagccatttaatctttactaataagtgttaatacatcataaaaagataaaaagacgattcatgccttagttggtttcatttctttcttttgtgcctatttgtttgccgactatttattatattttaaacatctattagccaggactacatatatattctagataattgtttgtcagctaattattagccactagtcaataactagtaggaggatccaaataggacctaagggggtttttgaatgcactagagctaatagttagt

SEQ ID NO: 3496 - DNA, 6342 bp, Zea mays
  misc_feature (322)..(322): n is a, c, g, or t
  misc_feature (482)..(482): n is a, c, g, or t
gacaacgaatcagatagcaaattttaggacaagcttgcaggtgaaagattcttaattctacatcgttatgataccgtgtcacatgatttgagacaatttgtctggttgccattgccatggaattccacaaaaagcgcattttaatcaagtttagctattatcatgtagtatataatatgaagtaatttttacgaggctccaaagtacaacggaattgcagaagctaaacatggtagtagcaaaattatgtacattaaccttatatacacataaataaaattgatctttgataaacatgtaaagatatcttgcctataaaatnataggccacaagtcacaagagtcgaccaaaagcatcctaagataacgatgatttatgggaaaacgataaaatttgtttgatgtttaagtcaacctgaatttacaaagatcggttcaaatttttgaagaattaccgagttcatttccgacggcaaaatagngagtacatgcgatgattttcggaaacgaccggaatagactcaaaccgtttcatattccgtttctgatttttttaatatattctaccgattctatttcagtatcttcagcaaccggttccgtttagcactgaatttcggtaaaatttttataaacggttcccgatgacccgaaacgccggatgtgcttcgccccctacgttgaacaaacgttgccttcttggtgcatgttatatataatgcgagaaaaatggtggtgagcgatcaagagccaaacgggtggcgtaactttggatccagctaaaccctagatcgcacactgaacatttgtcttcggggatcttgtgaacgacagtcgccttgcagcgaatgcttgtagcagtagcagccattctagcgcagcgcaggtgacgcacaactgttaaaatcacaaaccctaaaaactgaggaaggcgaagcgggaagcgagctgggaaagatccagcctggtctgggcttcgtggacctcctcaacagatcgaagcggatgtgcttcatgggccccggaaagcgggaaggcggtccaccgttagcgattctatattttttttataagatgtttctcttgcatagagtgcccaacgctctgaataaacctaatatttctttcatcacactaataaatcgaatacttttttcccattacaattctatagattcgaatataacgtttctttcaccgtagctacactgtacatacgtgtcacgtgtgtgtacaatgtatggtacggtacgcctttttgcacatcctgccaatcttccgaccgtttcccgagtcggtcgttttttttttttggcacttgtgcagatgtgcatggtgactcagattacgtgcgcaaagagtacagaggttttttttgttttttgtttttgaaggcgaaacattaaggagagagagagagagacggtcaaacatggaactgtaccgtgtgcacttgcgcacagatcatcggatagatatcctctcgaggagtccagtcaagtgtgagccatccgttgcttatccagagttgcacaccgatcaacccttggatcccctacgtgtaccgtgatgtacagtaacggtgtggttcgttgctgtggcaggctagccaggcttcccgcagcagagccaggatacgcagcatggggttaaactttatgcaagacatacttgtttagtttttgtttacacggactcacgcaggctaattatagaatttgtttggttgattgtactgaatatattagagaaaggttcataaataaattttgaaatgtcatatagtatgagtggtctagttttattcacaaaaattttacaaacataaacataaaatcatcagttagatgattaaatctcttaattcaaactcattaatgaaaaaacaaacaaactgaaatatcatttcatgttccggcttgcatgcagcctgcacgcgtggaggttgcagggaatccacgaaatcggcttatactgtttttatatggttttgtctctatatattacagttgcaaccgtccgaacaactggctttaatacgaaacaaaatagaaattatagagaatccataaaaataaatcttttactattcaaaatgaaacaacaaatgattttacatctctagatctcctattcacttgccatcaaaccacctcatagtgacggtgcgaggatatctacgatacaaggctcctgttttacacgatctgctgctgcggacaagcttgtagattcatttgttgaccaaagtctatattgttttctcgtgactagtaatagcgactgatagatatattcaaactttacagttgtttttttaaggatcttacagtagtaaaagaggtattcctaaccgtgtgtttggttcatatatcctcgaagcttgatccaaccttaagatgtatccaccgggcctttatgcgagtaaacgctcgatgtcttgcgtatgggtggaggcgtggagcctgccctcggaggtcttcgtctgcacgcagagtctaaaatctagtacagggaaccaaacaattgccatcaaaccactccataatgagtgctgggtcaccgtgccgaggagaaaaggaggtagtagaacgcagcgacgtgatgtactgagccactgtaagacagtgataccacatgtgtcagtgtcactcaaaggacaccccctcgtggtgtcagggatggcacgtcccgtcgctatgtgttgttgcacacgctttggagtcttttaattgatggcgtgttttttttcttcttcttctctcaatcgtacttgcttgctcgtgtggaccatacaatacaggtaacagtactgtgactcgtgagtttggaatgatgagtgttcccttgttcatatgatcactgtgtttcggttggatgatgacatgatggtacgacaaagccgcaagctttttctcttgctgcagatgtaagctttaccacctggttcttgttaaaacaagtgtaggatgcaagctagaattaagccacaagatcccactcgtggttacttgatacttacttggaacacagatcgtgcaacacacacacacgcacacacatgttgttttcgaaaaacataagcgcataacatgtgttgggaaaagcaaactcgtttagtatgattcaagaacagtatgaacctctccgggagtccttttgtattgtaagggtctctttgtaatagaggaaatacgaaggatttatcattgcctacaagaaaattcccttcataagcctttagaacaaaggattcagtcccatcaatttctatggattcctttcgacctttcctccatgcaagttttggaggaaaaatgacaagatgtaatatatttacctctttgtatcttttatatgactcttatctctctattcaaattctcattgaaaggctaggtataggtaataaatttacatgcgttcttaaatcttaattcatgtagaattgcaattcatagctaaactttgtgctccaaataggcttaaacttgtttggcatgactaatgaggatgtgagtaccttgttctagcatcacacactagttgtgagagccttctgcgttggcaattggcagtacaagacaaatcacatccgcaaccgcaaccacagaatcgtccgtccacgtggcccccatcacttccctttatgtacccgcgtccccccggccgggccgcaccaacaagcgcagtcaccccagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcgcgctccgacctctccacgggcaactccgcgcacgcgtccctgctgctccgctccggctccctctccttcctcttcacggcgccctacgcgcacggcgccgacgccgccaccgctgcgctgccctccttctccgccgccgccgcgcggcgcttcgcggccgaccacggcctcgcggtgcgcgccgtcgcgctccgcgtcgccgacgccgaggaggccttccgcaccagcgtcgcggccggggcgcgcccggctttcggccccgtcgacctcggccgcggcttccgcctcgccgaggtcgagctctacggcgacgtcgtgctccggtacgtgagctacccggacggctcggcgggcgagcccttcctgccggggttcgagggcgtggccagccccggggcggccgactacgggctgagcaggttcgaccacatcgtcggcaacgtgccggagctggcgcccgccgccgcctacttcgccggcttcacggggttccacgagttcgccgagttcacgacggaggacgtgggcaccgcggagagcggcctcaactccatggtgctcgccaacaactcggagaacgtgctgctcccgctcaacgagccggtgcacggcaccaagcgccgcagccagatacaaacgttcctggaccaccacggcggccccggcgtgcagcacatggcgctggccagcgacgacgtgctcaggacgctgagggagatgcaggcgcgctcggccatgggcggcttcgagttcatggcgcctcccacatccgactactatgacggcgtgaggcggcgcgccggggacgtgctcacggaagcacagattaaggagtgccaggagctaggggtgctggtggacagggatgaccagggcgtgctgctccaaatcttcaccaagccagtgggggacaggtaaaatcgttatctttttcaccttttttgttttacaagtgtgcatgatgcatctagaattgcaaaggaacaattccaggataaggtattcagctagttcaggattgcaggcatatatagaatatatatacagtacgaaggtatcaaaccctctttttgtgcctccatgcatgatgcatctttatgaagaccgtgacagcaaaaaagaggatcctttttgcatgctgtgaatcataattcgagctcccatgtcccagctgattacatgatggtcaacattccattctcatcattaatcccctgcactttaattctgaagatcatagctcagcattctagtgtcaatgccatggtttccttgacccctatgcaatccaaaatctaactggaccagctgcgtcattcaggccaacgctgttcttggaaatcatccaaaggatcgggtgcatggagaaggatgagaaggggcaagaataccaaaagggtggctgcggcgggttcggcaagggaaacttctcgcagctgttcaagtccatcgaggattatgagaagtcccttgaagccaagcaagctgctgcagcagctgcagctcagggatcctaggacagtgcttggagacgagcaactgctgtggcactttgtatcatggaacagaaataatgaagcgtgttctttgtgacacttgacatgcaaatgtttgtgttctgtaaccgttgaatatatgggacgatgctatgatggtgtaatagatggtagagagggtacaaccctgatactaatgatgcactattgcatctctgttgtacaagtttgcatgaaaataacgacgagggtcagtatgaggcataatgaatctgttcctgggattcttgtactcacctggtgctttttttttatgagaagacagctgtcgttggctcctgtcgatgtgatcctgcggcaagaatacaacagattgcgcattgatctcagtaacctgaaagaagcagaggtaaaatagaaatgcagagtaagataagcgcatctagacatcttgtttggtgtatcaggcattcacgtgttgatattgagttctgtgacctagctagaacagcacaaaatggacctggcaagcctcttgtctactagcagtctagcactgggctgtagattattatatatgcatcaatatcaggtaactacttaaacgtacagaaatcacttggagccatcagccatggccatggaaggctgctagttttgtccagggatatgtatcgtgtatggctgtaaaattaaagaaatgctattcatcaatatattatgctgtagatctgttccatatatctgatgcagacatgcagtgtttgtatagaatgctgtagattatcatatgcatcaatatcagacaacttaaagcacactaag

SEQ ID NO: 3497 - DNA, 1524 bp, Zea mays
  misc_feature (11)..(11): n is a, c, g, or t
  misc_feature (547)..(549): n is a, c, g, or t
  misc_feature (551)..(551): n is a, c, g, or t
  misc_feature (562)..(563): n is a, c, g, or t
  misc_feature (1479)..(1479): n is a, c, g, or t
gggtacctcgnagccggccgaccaacaagcgcagtcaccccagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcgcgctccgacctctccacgggcaactccgcgcacgcgtccctgctgctccgctccggctccctctccttcctcttcacggcgccctacgcgcacggcgccgacgccgccaccgctgcgctgccctccttctccgccgccgccgcgcggcgcttcgcggccgaccacggcctcgcggtgcgcgccnnngngctccgcgtcnncgacgccgaggaggccttccgcaccagcgtcgcggccggggcgcgcccggctttcggccccgtcgacctcggccgcggcttccgcctcgccgaggtcgagctctacggcgacgtcgtgctccggtacgtgagctacccggacggctcggcgggcgagcccttcctgccggggttcgagggcgtggccagccccggggcggccgactacgggctgagcaggttcgaccacatcgtcggcaacgtgccggagctggcgcccgccgccgcctacttcgccggcttcacggggttccacgagttcgccgagttcacgacggaggacgtggggcaccgcggagagcggcctcaactccatggtgctcgccaacaactcggagaacgtgctgctcccgctcaacgagccggtgcacggcaccaagcgccgcagccagatacagacgttcctggaccaccacggcggccccggcgtgcagcacatggcgctggccagcgacgacgtgctcaggacgctgagggagatgcaggcgcgctcggccatgggcggcttcgagttcatggcgcctcccacatccgactactatgacggcgtgaggcggcgcgccggggacgtgctcacggaagcacagattaaggagtgccaggagctaggggtgctggtggatagggatgaccagggcgtgctgctccaaatcttcaccaagccagtgggggacaggccaacgctgttcttggagatcatccaaaggatcgggtgcatggagaaggatgagaaggggcaagaataccagaagggtggctgcggcgggttcggcaagggaaacttctcgcagctgttcaaatccatcgaggattatgagaagtcccttgaagccaagcaagctgctgcagcagctgcagctcagggatcctaggacanagcttcctttttacgttaacatgtttttcctgtgtggtttgttgt

SEQ ID NO: 3498 - DNA, 867 bp, Zea mays
  misc_feature (813)..(813): n is a, c, g, or t
ctcaactccatggtgctcgccaacaactcggagaacgtgctgctcccgctcaacgagccggtgcacggcaccaagcgccgcagccagatacaaacgttcctggaccaccacggcggccccggcgtgcagcacatggcgctggccagcgacgacgtgctcaggacgctgagggagatgcaggcgcgctcggccatgggcggcttcgagttcatggcgcctcccacatccgactactatgacggcgtgaggcggcgcgccggggacgtgctcacggaagcacagattaaggagtgccaggagctaggggtgctggtggatagggatgaccagggcgtgctgctccaaatcttcaccaagccagtgggggacaggccaacgctgttcttggagatcatccaaaggatcgggtgcatggagaaggatgagaaggggcaagaataccagaagggtggctgcggcgggttcggcaagggaaacttctcgcagctgttcaaatccatcgaggattatgagaagtcccttgaagccaagcaagctgctgcagcagctgcagctcagggatcctaggacagagcttggagacgagcaattgctgtggcactttgtatcatggaacagaaataatgaagcgtgttctttgtgacacttgacatgcaaatgtttgtgttctgtaaccgttgaatatatgggacgatgctatgatggtgtaatagatggtagagagggtacaaccctaatactaatgatgcactattgcatctctgttgtacaagtttgcatgaaaataacgacgagggtcagtatgaggcctanaaaaaaaaaaacaaaaaaaataaaaaaaaaaaaaaaactttactaaaatctcat

SEQ ID NO: 3499 - DNA, 703 bp, Zea mays
  misc_feature (55)..(55): n is a, c, g, or t
ctttcatgaatttgtacacgagtacttgcaaaaaccagagttcgccgagctgatncggaggctgggtgccctcggtgatggaaggcagcaccaaagtacactgtcccaagatgagtgggaggttttcctatctctatctcgcgtttgtcctgcggaagcgaggccaaccgcctacccaacgaagagccagcaacgcaaacagagggaaaatgtttctcaccgagggtgacatcgaggttctcggtgtataagcatgagtatatcctggaagggcttgctaacagcttaccgattatatgctccacagaccacatagcataaaagaaagttgtaacattagtggctcacctgctactccatccgtttataaataaatgacaacgttgacttttttttaaaaaaaattgaccactagtcttatttaaaaaagttatcatttattttttgtaatttgttttatcacttaagttagtttgtgcttgacttaaaattttacattttgaataaatattttaaaatgaatattttgaataagatgagtggtcaaagttttcgaaaaaaaaatcaacggtgtcatatatttgtaaatggaggtagtatttgtttctccaatttatatcttttgtataatttcacatatagcacttcccaaacttttttctattgacaatgtcaacattttaaggatcagctgactggcacc

SEQ ID NO: 3500 - DNA, 1197 bp, Zea mays
  misc_feature (1193)..(1193): n is a, c, g, or t
cattgggccggccggcccgcggcggctggctcccaccgaattcattccacccccgtctcctccgatcggaccaccgggccagcagcggggcggatcgtgacgtcagcagccatggtgaaggcctaccccacggtgaacgaggactacctcaaggcggtcgacaaggccaagcgcaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccccgggaggcaggacaagcctgagcctccaccggaaggccgccttcctgatgccacccaaggttctgatcacctcaggcaggttttctccacacagatgggtttgagcgaccaggacattgttgcgctttctggtggtcacaccctgggaagatgccacaaggacaggtctggatttgagggagcctggacgtccaaccctttgatctttgacaactcttacttcaaggagcttctgagcggagagaaggaaggccttctgcagctaccaagtgacaaagccctcctctctgatccatccttccgcccacttgttgacaaatacgcagcggacgaggacgctttctttgctgactacgccgaggcccacctgaagctttcagaattgggatttgctgaggcataacgaaccagaagagtgtggtggctgtcgtcggccggccggccttgtgtttttgttgtctgcttttctcttgaatgaagatgtgatgaactcagctgaagatgtagtgtgtatgttgtcatggtttatttttctattttatttatctatctataatatctatcggagaaggtttgatatgaagcggaacactgattaacgatgccaatgcctccacatccaaacccgttatgtttttgcatgcaggtgggtttcaagcaactcttataacaagtgtttgaagcatacaccagggtcctttctaatattaattatatatgccacataattgnaccc

SEQ ID NO: 3501 - DNA, 1785 bp, Zea mays
caacctttggttaaccttcctgttatatttggcaacaaagctatttcacacagcatcctccagcaatgttgttccccttcggttcggaccattgtcccgcgccgccgcccaacgaagcagtataggtacgccaatccatccaatcttacggtctgagcctgacaccttaccttgaagcaagcagggggaccagaccccatgacggcgatgctcgactcattcatcaagcaatgcacgacgtcactggacgacctcgccggccaggagctttacaccattttcggcatcggggacgacattaggggcctcctggccacactgtctcgcatcaacgccatcatctcccatgacccatcccctcactcgatctacatcctaccctaccctacccgtgacacatgaggatttatatgaagtcattttttaagacaagcctgagcctccactggaaggccgccttcctgatgccacccaaggttctgatcacctcaggcaggttttctcgacacggatgggtttgagcgaccaggacattgttgcgctttctggtggtcacaccctgggaagatgccacaaggataggtctaggtttgagggagcctggacgtctaaccctttgatctttgacaactcttacttcaaggagcttctgagcggagagaaggaaggccttctgcagctaccaagtgataaagccctcctctctgatccatccttccgcccacttgttgacaaatacgcaacggacaaggacactttctttgctgactacgccgaggcccacctgaagctttcagaattgggatttgctgaggcgtaacgaaccagaagagtgtggtggctgtcgtcggccggccggccttgtgtttttattgtctacttctcttgaatgaagatgtgatgaactcagctgaagatgtagtagaagagtgtggtggctgtcgtcggccggccggccttgtgtttttgttgtctgcttttctcttgaatgaagatgtgatgaactcagctgaagatgtagtgtgtatgttgtcatggttcatttttctattttatttatctatctataatatctatcggagaagctttgatatgaaaaaaaaggaaaaaaaaaaaaaacaaaaaaaaaaaaaaaaaaaaaaaaaaaaaaaaaaaaaaaaagaagcgagagagatccggagcagccgcagtcccaccgaccccgccgccggtcgccctccatctcctcgccgctgcctctcgtttctcttttcaaaaatcaaaatgagccgggggggaagtgccggggggggtcaaagttctctgggttatctctttggaagcggggagccccccaaaccagcaggggcaccagctgcaagggctccacctgttgaaaaaccatctgctgcaaaaactgatgcggccaagcaggttgctgctggggttaccagccaaaccaataactaccacagggctgatggtcaaaacactggcaacttccttacggaccgtccttcaaccaaggtccacgctgctcctggcgggggctcttccctgggctacctgttcggtggcaactgatgcccgtgctggtgcgctcaccaaagttatcctcccctgcctgctgcgtgctatgtctgaatcgtgaaaaccgttgtcatttcatgtgtgtaccccgtgcaatgctttgtgcgcatggttgatttctctgtggcaaacttcccgtcctgcatggggttgaaagttgtctctaaattcacggcaagtcgggtgcctgaacctccatcttaaagttgttggcgg

SEQ ID NO: 3502 - DNA, 781 bp, Zea mays
cgaggacgctttctttgctgactacgccgaggcccacctgaagctttcagaattgggatttgctgaggcataacgaaccagaagagtgtggtggctgtcgtcggccggccggccttgtgtttttgttgtctgcttttctcttgaatgaagatgtgacgaactcagctgaagatgtagtgtgtatgttgtcatggtttatttttctattttatttatctatctataatatctatcggagaaggtttgatatgaagcggaacactgattaacacaaaaaaaaaaaaaaaaaaaaaaaaagcttgtacctgcccgggcggccgctcgaaaaaaaaaaaaaaaaaaaaaaaaaaaaaaaaaaaaaaaaaaaaaacccccgaaatcttaaatccccccagaaatcccaagaaaaagccttccatcctcactcgctcaagggcccgaacaaagaaaacggggagaaagcccaccgggggaaaggccccaagaaaaaagttggcaacaaagggggcccgaaagtttgcccctgcaaccgggggagtaaaaaagccccaccgtttccgccccggaaccgtcgcgctccggaaaatccgcaagaaccaaaaaagcacggagttgctgatccgaaagttgccgtcccagcccctggggcggaaaatcgcgcaggacttcaaaaccgacctacgtttccaaagctccgttgtctccccgctgaagaagggggttgaggccaacctggtcgggctcttcaaggaaacaaacctcggcgccatccacgcaaagg

SEQ ID NO: 3503 - DNA, 893 bp, Zea mays
cattgggtccctccacgcgggccgggcccaccgaattcattccacccccgtctcctccgatcggacggaccaccgggccagcagcggggcggatcgcgtcagcagccatggtgaaggcctaccccacggtgaacgaggactacctcaaggcggtcgacaaggccaagcgtaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccctgggaggcaggacaagcctgagcctccaccggaaggccgccttcctgatgccacccaaggttctgatcacctcaggcaggttttctccacacagatgggtttgagcgaccaggacattgttgcgctttctggtggtcacaccctgggaagatgccacaaggacaggtctggatttgagggagcctggacgtccaaccctttgatctttgacaactcttacttcaaggagcttctgagcggagagaaggaaggccttctgcagctaccaagtgacaaagccctcctctctgatccatccttccgcccacttgttgacaaatacgcagcggacgaggatgctttctttgctgactacgccgaggcccacctgaagctttcagaattgggatttgctgaggcgtaacgaaccagaagagtgtgggtgctgtcgccggcc

SEQ ID NO: 3504 - DNA, 1812 bp, Zea mays
gctagagatagactaatgctggaaagtgagagagagggcagctcgcttcctcgtggaatctctctgttcttagttctgttctacttctccaccaagtccctaacacgcgggtggcgggtccgccgccgccgccgttcgaagactcgaggctcgagcacctcgtctgctcgcccggcccctcctatccctcgcgcgactgtctccgccgacgaccataagccgcctgcctcatcgctggccacacaacgatccgtggcaaggaaagcacgaggacgtacagtagaattgtgaatcgccggaaaaacatctgttggcggcgtcatgaataagcggccccgcgacgaccactccttcgcctccgcgcccaagcgccagtatggcgcaggcggagggtatggcccgcagcagggttactcggaagagcggagcagcgcgcggcgggtggccgaccactacagcgcgcggtccaaccagacactcgaggaacgcgagaacagccccatcatccacctcaagaagctcaacaactggatcaagagtgttttggtccagttgtatgcacgcccgggtgactgcgttcttgatcttgcttgcgggaagggaggtgatttgataaagtgggataaagccaaggttggctactatgtaggggttgatattgctgaaggctcgataaaagattgcatgactcgctacaatggtgacacagatcaacaaagaaggaaaaggttcagtttccctgcacggcttatttgtactgattgctatgaggctcgtttggatgaatatttatatgaggatgctccgtttgatatatgtagctgtcagtttgctttacactattcatggtcaactgaagcacgcgctagacaagccttggcaaatgtgtctgcattacttcgtcctggaggcatttttattgggacaatgcctgatgccaatgtcattatcaaaaggcttcgagaatctgaagggttggaatttgggaacagtgtttactggattagctttggcaatgagtacgctgaaaagaaattccctgcatccagaccgtttggtatcaagtacaagtttcacttagaggatgctgttgattgcccagaatgggttgttccattccatctcttcaaattattggcagaggagtatgatctcgagctggttctgatgaagaacttccatgaatttgtacacgagtacttgcaaaaaccagagttcgccgagctgatgcggaggctgggtgccctcggtgatggaaggcaggaccaaagtacactgtcacaagatgagtgggaggtttcctatctctatctcgcgtttgtcctgcggaagcgaggccaaccgcctacccaacgaagagccagcaacgcaaacagagggaaaatgtttctcaccgagggtgacatcgaggttctcggtgtataagcatgagtatatcctggaagggcttgctaacagcttaccgattatatgctccacagaccacatagcataaaagaaagttgtaacattagtggctcacctgctactccatccgtttataaataaatgacaacgttgactttttttaaaaaaaaaaaaaaaatcgtcttatttagtcttatttaaaaaagtcatcatttattttttgtaatttattttatcatttaagttagtttgtgcttgacttaaaattttacattttaaataaatattttaaaatgaatattttgaataggatgagtggtcaaagttttcgaaaaaaatcaacagtgtcatatatttataaacaaaatcatatttataaacaaaatcaacagtgtcatatattta

SEQ ID NO: 3505 - DNA, 2516 bp, Zea mays
cctaaaaaatctaaatctacagcagactgctaataaccaatctataaaatgtttaaaacaaccacgtggccacggcagtatgttatattgctatcccctgttgtgccgcccgctacagcagccgatgagctgatgggtattaatcctagtactctacaatgtgaggtgatgtgagatgatgcatcaaaaaacaagaacatatatattcatcgttcactttgttccacgagaccatgactgaagaagcaagcaccggagccatctggaagaagcaaacattggagcctagtacgcggacgtcgtgctttctctaccaaaagaactgcgcgcgaaaaaaaacccgccgggacccggtgcactgaagcaattggaaaacaatgtgtgacaagtaaatttgagggaggaaagtcaatagatgcgaggcacgaagaatatggggaaagaagagggaagtgttggagagcttaaaaagtatttttttcactaaaagcgtttttttgggttagtttacatgttttcttggagatgctcggtatcattggagggagagtgcgagacagagcggattacgcacctccacggctccccagccgccacgcaggccgctctgttctgccagcagttggcacaagcagcttgggcgcaaaagaacaactgcgatcgagcaagggacaatggcccgcaccgcggcgccggccgcgggctacggagaggacggagtgtaccgctccccgcgcccggccgtgcgcatcgagtccgacacaggcctctccctcaacgacctcctcttccgccgcgccgacgtgtgcccctccgctctcgcgctggtcgactccgccaccggccaatccctcaccttcgccgcctttcgctccgccgtcctcaccacggccgtcgccctctcctcgcgcgcgggcgtccggcgcggcgacgtcgtcctcttcttcgcccccaactgcttcctctaccccgtctgcttcttcgccgtcaccgccctcggcgccgtcgctaccacggccaaccccctctacacccctcgggaggtcgctaaacaggccaccgactcgcgggccaagctcgcaatcacggtctctgaactccttcccaaaatcgtggacctcggcttccccaccatcctgctcgacggcggcggcgacggcgacgcggccagtgccgccgcctccaagcctcagggagccagcgtgacgctttactcagacctcgtttccggggcgcgggagacggagtaccgccgcccgccgacgaagcagagcgacacgaccgcgctgatgtactcgtccggcacgacgggggcgagcaagggcgtaatcctgacacaccgcaacttcatctcggcggcggccatgatgacagcggaccaggacgcgctcggagaggggcccaacgtcttcctctgcttcctgcccatgttccacatcttcggcttgtccgtcatcacgttcgcgcagatgcagcgtggcaattccgtcgtcgtgatgtcgcggtttgacatggactctgtgatggccgcggtgcagcggcaccgtgtcactcacctcttctgcgtgccgccggtcatgatagcgctcgccaagctcgggagcgttgggaaatatgacctcagctcgctcaggttcatcggctctggcgcagcaccgctcggcaaggacgtgatggagggagtggccaagaattttccagaagctgtgattgcccaggtaattgacgactcatgattttgcagctcttcaatgtgattatggtatgctgatgaacttcaggacttctttcatataagcatgatgatgacagggactgtatggaccgatttttcatccttatcctgcagtgtctttgaggaggctaacctcgattctgttgtccttatctgtaattgttggattagacgacaaaattctaatctcctttatactgctccaccaaggacataatagtgacgatggaaataccaaatggaaggctatatgcttgattttgcttgttgaaacagagagagtgagaaagtgactctccctcttgcgttttttaactataggaagtggaactttgatgctttatacttggacactcggcatataacttgaagtaaggcacaagatgggcggttatccgccctaggtgtgcatcctttgcttagttttaggccattggttgtcatattcccatactctgtgctgctccaatctgcaaaattatggagcacgatgttgatattccaaagtcatatgcatattgtgttgcttagcatgtgattagatctgttaatgtgatgtggtctgtcttatttttttatcctacaggtcattttgagatattaaatagggtgatttacttattttccactggttgttttgtttggcaaatatgcaattgtttctattatacatgatgctgctgatcagatgtcagacatgtgatccacatgataataaaaaagtagcatcaaggaactgaataacatgtccacctgcaaacataagatgcctggtctgcag

SEQ ID NO: 3506 - DNA, 1611 bp, Zea mays
  misc_feature (15)..(16): n is a, c, g, or t
  misc_feature (1604)..(1604): n is a, c, g, or t
gcacgagaccattanntagaacatcctaatcgaaaagtttctcgagtaacagtcaacagacaacggcacgtcggcacatcatcttccctggaccctggttgcggctgcaacacagggactcgatggcgtcctcctccctcccggcgcccgcggccggccgcgccgagctcctcaaggccttcgacgacgcccgcacgggcgtgcgaggcctcgtggagtcggttgtctcgtccgtcccggagctcttccgccacgcggacccctacgcctccatcccgctcgccccgcccggcgtttccatccccgtcgtagacctctccctcccgccccacctcgccgcggcggccgccgcggcggccgcccgcacctggggcttcttccacctcgtcaaccacctccacgccctccccgcggccgccgccgccgccgacgacgactaccccgagcgcgccttcgcggcggtgcgcgccttcaacgaactccccgcccacgagcgcgcgccgcactacagccgcgccgtggacggcggggtcaactactcctccaacgtcgacctgtacaactcccccgcggccagctggcgcgacaccatccagatcctgctgggccccaaccgccacccggacctcgccgaccggatcccggccgcctgccgcgccgaggtgctcgagtgggaggtccgcgccaccgccgtcgcccgcgccttgctcaggctcctctcccaggggctcggcctccgccccgaggcgctggaggacgcgtcctgcgccgacgggaagctcatggtgtgccactactacccgcactgccccgagccggagcggaccatgggcatcgtcccgcacacggaccccggcgtgctcaccgtgctcgcgcaggacggcgtcgggggcctgcaggtgaagcaccaggatgaggacggcaaaatctcatgggtggatgtgaagcccgtgcccggagcgctcgtcatcaacgtcggggacctcttgcagataatgtctaatgacgagtacacgagcgtcgagcatcgggtggtcatgaacacgcgtgaagaacccagggtttccatcggcatcttcttcagccctgggaagagaggggactcggtgttctatgggccgctgccagagctggtctcttcagagaacccgcccaagtacaggaacttcaccatgtccgagttttacgggaccttcttctcacgagaccttgccagcaaggctctactcgataacttcaagctgtcaccgtaaagtgtcgactccagctcgaagagtttagatagactcgtgtatactatagtcatgcgtgaattgtgattgccggctggcaatgtatagaaattgttctgtcttggcctgcatcagtcgtacgcaggtcaccagccgccaccgcagcgtgcccggccgcgctgggcacgctgcatgaccggccagagaagcagcgtcacagaaactagccaactgttcaagcgcgttggatgataccagacggcacaaacctgtggtaaacgaaccaaacataactgagctgaaaccgcgcttcgacttttctcatatgcacgaataaagtggaccaaacacctgacctagagttcagtgtcnatgcaaa

SEQ ID NO: 3507 - DNA, 3821 bp, Zea mays
cgcttcgcccctccaacggtcggctcgggttcaaaaggcactagagacggtgaaaaggacgcgagaccgcacgcaacggtcagcgctctgtcgcgggcgtccagcacggcaaaaggaatccggtccggtcgcatcggcatctccctccctccgccctgaccgctcgtagccgttgggcgttggccgttgtttgttgggcgaggctccgccgctcgcgcacgcaccagctcgaggtggcccagattcaaaccaaacgtgccttgcatttgaaccattcagggatcggcagcacgcattgaaacgcaaaacagaggcagtgtcgacacaactgcagaaacactgctcgtgggctcgtgcgtagcgtaaccagccctggggcctgcaaagcaaaactgtcctccgtccgatctcgcaaactccctcgcgtgcgattggctttcaccgtgcgttacccgtcacaatgacgattattaacagagcacagtaccagaccaaagttcatcacctagcttagcaatacacgcgtgtctggtgacggctggtgctggtcccgttttttttttaagacgagatgatgaaataatcaaggcccaggccccgcgatgttgtaacggatagcgaccccaccgagccccccgggtccaactcctgtggacgtattcctcgtagaccacactgaccgaggcgatgcatccttccgtccccgcccgtcggtccacggcagcaccgtgagccgccaacgtcccccacgttcgttcgtgcgtgcgcgcacgagcctcgaggtcatccatccgatccgcacaagagaggatttcaaatccccgtctcgctctcgcatcagcatccgctttgcgtttgctctcatcacaggcgcgcggtacgggttacggagcactaactaacacagagcacgacgcacgctgacacaaaaattatttcgcctaagcgcacctccccacgcgtgcttatataccacccaagtcaccagcgcaccaagtcacagtccaacggactctttccttcactccactccactcccagtcgcagagtcgcagtccgtaccgtagctcctcctgccaccagaacccaccatgggcctctgcttcagcaagaagaagccaccggccaagccgggaaaggtcgccgccgcggtctccgacgacaaggccaagaagagtccggcgcagcagcccaagagagcggcggcggcggcggcgaacaaggctgcggtgtccgccaaggacgccgcggtgcccggggaggagaagaggaggcggtcgggatcgcaagggccggcggccgagaagcagctgccggtagtgctggtgccgtcggcgccggtgcgcacgtccagctgcaccaaggaggaggtggacgcgatcctcatccagtgcggccggctcagccggagctcgtccggggccggaagggcggcgtcgaccggcgacacggcagcgtgcggcggcgggcaccgcaggaggcgctcggggtccaagcgcagctacgacttcgaccaggacggcggcgcggacgaggagtgcgactgggagaggcaggggcgcgcggcgcccgtgtccagcagcaggccgtcgccgcaccgaggctcgccgcagcgcaagcggtcgggaagccgggagaggagcggcgccggcgccgggagccggagggccagccggtcgcccgggagacgcgctgatggcgctgctacctctgcgggatccggcggcggggaccgcgccaggcagcagccggggaagatggtgtccgtgcccgccagggagaaggggcgcgcgccgtcgcccgtggccgcgtctgggaagcggtgcgcgtctccgaggtcgagctctcccgcgaggatggcagcggggacggggaacgagaatgctggagcttgcggaccggcggcggggccggcgccggtgctcagccggagctcgtccaggaagaacgagcagtccccgtacaggcgctgccccatggccgagctcgacgacaacgctctccgtaacagcagcaaccacggtgccaggccgcacaaggtaaaaaaatcagccagacaaaactcgaattgaattttgctccggttagtgcaagttctaccgtaccactcgcgaggctcaaacttctgctccgacttcagaaatctgctgagactgccgtcgccgcgacgcccaggaaggctacggggcgtgggaaggagccgacggcggtgaaagaaaagctggagatcacagaagcgtcagagacgagagcgcactcgtccaagacgtcgtcgaagacgaccacgacgcccacgctgagcgtcgtggccgagagcctgacccaaatgcccggtgcggcgcagccaggctgccgatcgcggcgggcttcgcgcgacttcgaccaaaaccccggctcgtacgccacacagctgctcgaagacatccacaactaccatcagcagtccacctccgccacgccggcgacgccgtccatctcgctcccggcgtgcgtcgccaaggcctgctccatcgtcgaggccgtggcggacctcaactcctcgtcgtcggagaaccgcgcctacgagcacgagcctggccactccgccgatgacaaaggctccgtcaacgcgccggtaggcagcggcagcgacggcttcgtcgagccgagcgccgccgcgcggaagcacctgctgccggcgcgggacgcccacgcggaaaccgagccccaggagtcggccgggagcaacagcgtctccggccacccgtggacgccctcctgggagcccacctcggccgagtccacggaccggacgtggagcaccggcgacgaggttgtcgagcagtccggcagtcacggcggccgctgcagcccgatgaacaggcaccaactgagcaagcagaggcagtgccagcccgagctcagtggccggtcccgcgccggctctggaaatgctaacggccagtaccgtgggcgcagcagcgctcatcgtgccagcggcagcgtggcgagcggacggtctggtgtccgagtcgtctcggcgaactcgtagtgtgggtagtagaaattgtagccagaggcaagatggattgctgctctgctccgtgtatgtgtttgtgtttctttgttagccatactttgttcggatgtgattcatggtgtgacattttgcgcgccatttcatgcatgcgttggttcgcttgtagccagaacttcacagcgttactgtttccttctggttgcgatcggagaagacagggagccccatccggtaatgtcaatgttggagagttcactcggccctcgacgttgaacgttttcttgaagggaacataatttctacatggccctaattgagcacctaagagcgttggaatggttagatattaaaattggtcttttggtctaaagtttgagctagaatgaggaaataagttctattgatcagaaatatatggaactatcacttaggttggttggatgaactcttgatatgtttatctaaagtcataaaaatgcacaagaaggcaaccagacaaagagaaagaaaaaagaccaaaaaaggacttaagatcgtgatttgttgcgcactagaccgaatccaggtgtgtactggaccgggtacgcagagagcatttttttgggcagttctggcttggcgcaccagactcgtccgttgtgcaacggacgaagcaccggaccagttatgctaaaagagttgtttcctagaggagattcttagcgcaccgacctatcaggactcatcggtcgtcttccggtcccaacgctatatgagtggcagcatatgtggcgaggtccaatggtgcaccagacgatccagt

SEQ ID NO: 3508 - DNA, 2717 bp, Zea mays
atccgcgccgcgcaggcggcatcacactccagtacagctctcactgcgccctgcccgcatcggctccaccacgccccggcccccccggccccgacacacacacaccccgacactccggacagagggggcgcaggcacgagaacagctcagtcgcggcgagctcccgggtctccagcgaaagtgccggaggagagagtggtggcggctggcgcgggctccctccgaggctctacgcggcgcctcagcgtaatgctggccttccccggggacagatcggcctgagtcgccgttgccgctctcgaatcggcgtcttcctcgcatggttccggccagagcttggatctcgcggcggaagacgcgaggcggaaaagtggggagggtgtcgttccttggttttcttctcgccaaagaggattgaagttatgatggaaaagcttgtatagtagcgctgaatccaattctcttgaagcaagtctcaaccatgcagcgtcttacagcgatagtctttgtggctacttctttcctcgttgcaagtgttccacatgccaaaagtgctgatctgaactctgataagcaggctcttctcgcatttgctgcatcactgcctcatggaaggaagctcaactggagctccaccacacctgtctgcacttcttgggtgggggtgacatgcacaccagataagagtcgtgtacatacactgcgcctacctgctgtaggacttttcggtccaataccatcagacactcttgggaagcttgatgcactggaggtattgagccttaggtcaaatcgccttactgttgacctcccacctgatgtaggatctattcctgccctccattccctctaccttcagcataataacctgtctggaatcataccaacttccctctcttccagtttaacattcttagacctgtcatacaacactttcgatggagaaatcccattgaaagtgcaaaatcttactcaacttactgcattgcttctccagaataactcactttctggacccattcctgacctccaacttcccaaattgagacacttgaatttgagcaacaataacctcagtgggccaataccaccttccttgcagaggtttccatcgagttccttcttagggaattcttttttgtgtgggtttcctttggaaccatgttttggaactgcaccttctccttctccagtatcaccaccatcccccagtaagaccaagaagagcttatggaaaaagatcagaactggtgtgataattggaattgctgttgttggaggggtattgttgcttattttgattctcgtgctcttgatatgtattttcaagagaaagggacacactgaacctaccacagcttcgtccaaaggaaaggctattgcaggtggcagggcagaaaaccctaaggaagactacagcagtggtgttcaggaagcagagaggaataaattggttttcttcgagggcagttcatttaattttgacttggaggatttgttgagagcttctgctgaagtccttggcaaaggaagttatggaactacctacaaagctgttcttgaggatggaaccatagttgttgtcaagagattgaaggaagtggtggttagcaagaaggattttgaacagcagatggagataattggtagggttggccagcatcaaaatgtaattccattgcgggcttactattactccaaggatgagaagttgttggtgtttgattatgtcccatctggtagccttgctgctgttttgcatgggaataaagctgctggaagagctccattgaactgggagacaagagtcaagatatctctggacgtggcccatggaatcgcccaccttcatgccgagggaggagggaagttcatccacggcaacatcaaagcatcgaacgtcctcctatcgcagaacctcgacggctgcgtctccgagttcggcctggcacagatcatgaccaccccacagaccccgccgcggcccgtcgggtaccgggcgcccgaagtcctcgagaacaagaaatcgacccagcagtccgacgtctacagcttcggcgtcctgctcctcgaaatgctcacgggaaaagcccccctcaggtctcccgggcgcgaggacccctccgtcgagcaccttccgaggtgggtgcagtccgtggtccgtgaggagtggaccgccgaggtcttcgacgtggacttgctacggcaccccaacgtcgaggacgagatggtccagatgctccaggtcgcgatggcgtgcgtggccgctcaccccgaggagcggcccaagatggaggaagtgatcaggagggtcacggaggtccggaattcttactcttctgggacgaggacgcccctggaggacaagccatcggagactgcacgagcgccatgagggggtacagcgtagtttagcaggagacggtagctaggttgcatagtggattccttatagagcttcagcaaagttgatagccacctgcatagcgcagtttccctcgcgattcccgatcgtttccagtaaatctgttgtgttgtttcctctcttttttttccccctgattctagcggtctggttgtcgatccatgccattgtattgttgttcagttaaatcagcagctcttctggttagtgttgcactgtaatttgacataatctttgcagcgtgattaatgaatttcatttgccttctgtttctgcaaaaaaaaaaaaaaaa

SEQ ID NO: 3509 - DNA, 1126 bp, Zea mays
gcgggcacccttcagaggtccaacaaatcctaagtttcatattggcacctcgagccggccgggatatggataaatccaattttctctacaggaaacacggcatcctcgctgacgccggagaagccgaagctacaagttcgcccgtcggagccgcagcacaggcgcttgcaaacgcgatggggagcgcggacctggtgctcaagatggcttgcgagggctgcggcaacacgtcggatctctacggcacggggtgcaagcacaccactctctgcagtgactgcgggaagtccatggcacgctcccgtgcccgctgcctcgtctgctccgcgcccatcaccaggctcatccgggaatataatgtacgagctaattctgttatggataagacatactctattggacgatttgtcactggtttacctcctttctcgaaaaagaagaatgccgagaacaagtggtctctccataaggagggtctgcaaggccgtcagatagccgagaatatgcgggaaaaatacaacaagaaaccatggattttggaagacgaaacaggccaatatcagtatcaaggtcaaatggaaggatcacagtcagctacagctacatattatttgttaatgaggcacggcaaggaatttaatgcatatcctgctggctcttggtttaatttcagtaaaattgcacagtacaaacaattgacactggaggaggctgaagaaaagatgaataagaggaagaccagtgcaactggttatgaacgctggatgatgaaagcagcggcaaatggaccagctgcctttggttcagacatgaagaagcttgaggccacaaatggtggggaaaaagaaagtgctcgtcctaagaaaggaaaaaataatgaagagggtaataattctgataagggtgaggaggatgaagaagaggaagcaacacgcaagaatagacttggactaactaaaaagggcatggatgatgatgaggaaggtggaaaacatctacatttcgattcggatgatgaaattgacgaaaggtgatgactgggagcctgaagaaacattcactgacgatgatgaggctgcagacattgttcccagagaacgggcacatttagctccctgaaattcct

SEQ ID NO: 3510 - DNA, 1351 bp, Zea mays
ccggccgggtacctcctgcccggcagccgcagccgccgccgccgcctctctctcccttccctcttctctctgccctcacctctctcccccttccatcacctcgctagtaacaggtcaccgtgtgtgtgcgcgccatggggattcatctgccgccgcctgccctcgccttctgcctctcggcgcccactcggttctagtggccgcttcgaggaggcgctcgcgcgcatcgaggagctccaggagcgcgacactggcgccgacgatagcagcacagcctcgtcgttcttgagcgacggagaggcggcgtcgcggccagcaggcgagcagcagtcgcactccgcagatttcttgagcgacggagaggcggcgtccggtggcattcagagacgtgcgtgacggtcggaggtcgtcgagcgcgtctagatagcatccaagacaaatagcgttgttcgcgatctgaggcagctggtaggcagtctgggcttgggcgcacgcgagccagagagggagggctgggagcacgtcatctccaagagcagcgacgacgtctcctacaaggcctggtgcgacaagcccacggtagttgccaattgcgtacatgcattgcaacagatctgggctctagaagctgctaacttggtagcagaaagattgaggcattgcatagcaaaccactggatcaaagagtttagtgaatggccacagtgcatgttcttgagttgcaatcaaagttccttccatataataataacaaaatatttgacataatgaatctgttggaggatagacttcaacatgcaaatggagtcgttgttttggcaacaattaaagtttttctccattcccatgactgttgttcatcaacaggtacgcatgttactcctagagaggtggtctctggatcatgctgcattattgctattacttctcaaaagcatttctttcttgttttagaatatgagatttagtatatgagcaccttctgttgatgcataaaaacaaaatcttatttagattaagatcccataacggactagcacatgacatcacaacaacaacacacttggtccatagataatgttttatttggaggttaatttacttgaattttttttaattccatggactctttactctggtgggtactggcagtcctaaatagtcattggcccttttatgtgtaaaataacagcttcctggtgttgatcccaatgatccatctgttaaaggtctctgtattgtgatgcaatgaaattcatgttgcctctagactatagcattgttctgcttcaccgtaccttgactaaataagaataaatatattatatgtcaccaaatcttcacatgaact

SEQ ID NO: 3511 - DNA, 2335 bp, Zea mays
agttttcgcggatctcagttccccttgcacctttttctgggtttctcccccatcacggaaagcgcaaagccgcggccacaccgcaacaaagccaacgagcccaacccggacgggtgagcgagcggctcgtgcggaggtacacagagacgcggaccgggtcgccggacgacgagacgcaccatggcaccgtcgcagctgcttggcagcaccgatctctggcggcccgttgccgccgcgcgcgggggcggctgggccacggccgccgtgctcctcctcctccttgcctctcacctcgcagtcctcctcgtccgcctccgccgccgcctccgcggcggaggccgaaacgcccatccggaggccgccgtggcacccgcgcctgcctccacgccccctggttccgcttccgcctcaggaatagagggattagtgacggagggcgatctgaggcagctggtaggcagtctgggcttgggcgcgcacgaaccagagagggagggctgggagcacgtcatctccaagagcagcgacgacgtctcctacaaggcctggtgcgacaagcccacggctggccctcctaaatatctgagtattacaacatacgagagatgctcggcagagcagctgagggacttctacatggataatgagtacagaatggagtgggataacactgtcaaaaaacatgagcagctgcagtatgacgagaacagtggggtggaggtagggcgaacaattaagaagtttccacttctaacaccaagagagtacatattggcatggcgagtctgggaagcaaacgacaagtctttctattgctttatcaaggaatgtgaacaccctcttgcggcacgacagagaaagtttgttagagtgcaacttctaagatcaggatggtgtattaggaaaatcccaggcagggatgcatgccaaatcacggtgctgcatcatgaggacaatggaatgaatatagagatggcaaagctagctttttccaagggcatctggagctacatatgtaaaatgaacaatgctctacgtcggtatcctcagcatggcagtccatcagtgtcaattctgaccatgcagaaacttatgaagaagtttccccaggatttggagactgccgacgcaagcctttctgcttctcagaacactgcagcatcggtcgttccttccacaccgacttccaggacttcaccatgcaagcttgaggggaggaagtctcgccaaatgatcgcgagcgggattctgctggttggaagcatcgtttgtctatctcgaggccgatccaacctcggggcgcagctcgcgatggccttcttcctgaaaaaggccttcaagcaagagaggcaatcaagctcctcatcgacatgaatggtgaaaacaaacgtgactagatgcaggcggtagccgtactggtttgagccgtgcagactccagacaacgtattattagcatttttaacctttctctgattacagaatacgtgactagataacctttgaccctgagccgtgcagacaagttgtaaagagttttttccggaactagttttgtaaataatcgttttcaaatctggaaacatagaattactttgagaatggaagaccgagcatgcctgattttctaagggaaattgcggacgaatgcagaatgtggtagggtggagcttcaaaagtgcaggagttcctggccgggtcgctatccagtaacgccagatctttgttacatctctgatcttcctctgctggtcgtgtataggacctcttttactttttttaggtccttgagtgtcagcagaggtccgtcttgtgtaatcagtctggctttaccggactttgtttttctctccttgacacgcttatgcgttgtttaagggctagtttggaaacctcaattttctaatggatttctattttttcaagggaaattagtttattttcccatggaaaaatataaatcacctggaaaaatgaggttcccaaactagtcttaaggaaataaaaaccccacgaactttttcatccgagtccacacgaaatataccaatttaagtggtacagacagcaactaagagattttttgtattgtcattcctaatttatagattctttgtatactttctaatttgcaagaatataaatgatttgttaacattttgtgacgatgcttttttgctgaaggccaagcaatagtgtcaatattgacaagacgttgatcttcaaagtaaaaacactaaaacctcaccgcatgacctcatattgcttgtgcgccacctcccctcatccgttgttcgtgtcggctgtgcagcccagattggttgttggtactgcag

SEQ ID NO: 3512 - DNA, 2272 bp, Zea mays
aatccgccctgccttctctctcctgtgcaatcttctctctcggtatccctacccttcttcaatccccaaccaaacccctcctctccgctctcactctcgcccgcgtcgcaatcattctcgtgggggcggggggcgctttaatccctccccggatttctgtggcgtctgctccctccacccggattccgccaggattgagttaatcgcatcgcatcctctctcttcctccccccgattgttccatctgggtcgcgttgcttctttcttcccgatttgccgccgccatccacgtcttgcaggagtaggactccgccctgtccgtcctatccacctgtcctcgcttccgtccacgccatcgccgcgctctctctccctgctgctgctttcttgggccggtccggggcttcgtccctgccgggcgtaaatgcgcgtccgtgcagcggatcccagccttcgccgctccaagtcctgtcctcgtctgattccaactaggagcaggaggaggagaatcttctgcgcatgctaatcctagcagcggtggccagagatgacgaaatcgttctgacttcacctgcgctggcggctgctcagctccgagccccgagtactgagcccctccactgctatggacatcttcttgatccgcgcctgtctcctccggctgctgctggtgctcttcgccgccgccgccacctctccggcggcggcgcagtcgcagccgccgtcgcccgccaggatactcgacgcggcgctgcaggactacgcgtaccgggccttcgcgcgcccccgcaccggcattgtctacaacgccacgctcccgggcaacctcaccggcattgccgtctccgcggtccgcctgcgcagcggcagcctccgccggaagggcttcccgggctacttccagttcggcgtccccacgggcgtcgtcgtgcagccgtacgtcgagcgggtggtgctcgtgttccacgacctcggcaactggtccgaccactattacccgctccccgggtacacctacctggcgccggtgctcggcctgctggtctacgacgccgccaatctttccgccgcggggctgcaggagctcaacgtcatcgcgtcgggcggcccaatttcggtgcgcttcggcggtaatgtcagggcggttccggcaggcagtgcagcgccaaggtgcgtggtgttcgatttggatggcgtgccgcagttccgggacctggaggcaaccgatatgtgctcgacgtatcgccaagggcatgtctcgatagtggtgaactccagtgggattgctcctgctccacctccacctggcgcgatagccccgtcgattccgaccactggaggaaataccaagggaagctcaaaggcgtggaagattgccgtcagtgtggttggtgctgccgtagcactgggtctcatggctgcgcttctgctgtgtttggtgaggcataaaagggataagaagcttcaggtgatggaacggaatgcggaggttggagagacattgcggatggcgcatgttgggcggacacaagcaccggtggcgttggggacacggacacagccggtgattgagaacgattacaccgcatagtggagttttggggtcttctgcatgattctactaacatgaagacatcaccatggtgatggctggagatgagattgtccattggttgcttgacgcggacagttttccatatcagcagagggcaactgcagctgctaattttcaggtccaaggttcagctccatgagggttcagcacattattttggtgggtttgttgtgatgctcaagttttctactgcaagacaatggctattgtttgttcatgttcatatgtgaggagttccttttcatttccaagcaagcaggcagtgttgtggaaatcttattcctatcagacttggagtcctcagttattcttttgggggtatctgtattcaatagaaaaacaggcttggcaatggagctgaggtaacattcattgcacattgcgatcacgcagcatgagtcaggcggattcatgctgtgctggagaaattcattcatccagcttcaataattcgattccatttcttttttttcttcttcttcttggtttcatgtttagacaactgctaagatgatgtagtgctgcacatgtttactgcttatctgttgttgtggtagttagtctgattgtgatcatctagatttctggacatttattttacatccgttgtgattgttctcttggaaacaacttatgttctaattgcatcattttttt

SEQ ID NO: 3513 - DNA, 2634 bp, Zea mays
  misc_feature (14)..(14): n is a, c, g, or t
  misc_feature (16)..(16): n is a, c, g, or t
actaaaaacaacangngcgtatatacataatcattgttagattagttatataaaaaaactacgcttccaaatagctcccaacaatatctacgtcggtgtttttttcacttggtatgattaagattcatgtcgcatgaccactcttcatcgtctgtagcgagccagcagcaggccgcgcgctgggcgagcggtagctactagtgcaattgaaccgacgtaggctaaagctttggggctgagctgggcggcaaaagttatttgtacgcgggccgagctgagcctggacggctacggtgtgcgaattaggcccggtcctgtgtcctctacggccatgctcaaatcgcgaccccccccccggcccggcccgaacacagcgaatcaacgctgaattcaccatccaacggactgcacccaacatgcttgcgaacgtctgccggcggcggctcaccatccccctctccccaatcctcgccgccgccgccgccgccgccagcggcaagaatcccatccactccaaccacgcgcgcgccctcctctctcaaagctactactcgtccgccgttcaggcggcgcccgaccgcgagccctgccccactacggtctcctacctggtttcctgcggtgtctcccccgccgtcgccgccgctcgcaaggtccgcatccgggacacggaccgggccgacgcagttcgggccctcctgcgcaagtacggcttctccgaggcggatatcacccgcacggtgcgtttagacccgctgctgctcaccttcgatccagaccgcaccattcgccccaagctcgacttcttcgtctcgctcgggatccagccccgcttgctcgccaccgagccccacatcctcgcccgcagcctggaaaaacacatcataccctgcatcgagtttttccgcaccatccttcgtaccgatgacaacatccgcatcgccgtctcccgcgtgccccgcgcgctcatgaccgatatcgagagcaccatgcgccccgccgtcgaggcgttcctcagccacggtctctccatggaagccatcgccaagcttctcatgattcacatgggaatgatcaagacaccgccggagcgcatccgcgaggccttccatgacctcaaggcgctcggcctccgcgtcacggatacgggcttcctctacggcttccgcgtcatttgcagccttaggagggagactatggtgcgcaaggtggcggttttcaagagcttcggggtgtccgaatctgaccttttcagggcgttcaagacgcagcccaccatactgctcgtcggagatgagaccataaagaagaagttcaggtttttcttggatgtgatgaagcttgagatagctgatgtgatggcgcagccactgactctggcgttgagcttggagaagaatatcatgccaaggtgcgccgtgctgagcatattgatgaaggagggtaagcttaagcggacacagaagttgattccaccactgctttccaattctagggtcttctcggagaggtatgtgttgaggcatgctaaggatgtgcctgatgttgttaaggcatttgagggcaagattaaatttcaagggtttggggaatcagaggttaggacttctgtgccactgaatgactgaagcccaaaccccaggattctgaaatcatgcttatttgttagaggtaaggcagatcaatgcatgtttgcaattgtaatcttgttccattcatactcatagtgaaatgtctatttctggggccatgtcgaatgtcatggttttgcatttttatgatacccatgcatccaggaacatgtacgttgtgacgttctcagctgtggtcgatctggcatgtgtggcctgccagttcttaaatcatgctgtggttcatatgcttatgacccggatggatttgttcattttgaaactctgattatttgtactgctctgctgagtggaaatgctcatgttactggaagttctgtgattttcttctctccccaaatgtaatattcaccctatcgattttgttttggttagtgagagaactatgctgatgatgtgccagtcctccggatatgttatggtattttagtgtagttaaatctgatcacgtatggggaatctgaatatttgtgactggagtcaatctgattcttctgagatccccttccttctttgttagggaccatctttcatttcagacaaatttgttgtgaggcggaagtccattattttttgtcataatttctgatgtggtttaatttcaatgcaccttgaattttgtggcttctgcataaaaaacattaaagacatttatactcatcttcacttcaatccatttgtgttggagtgggttgcggtggaattagttaatttttctccctggccggttctagtgcaccgtctcactctcgaccatgccaccacgatagctatcgactccattctcgtcactgctcctccagtgtatagcctacctcagcctgtagccacattagataatttgagaattaagtaacgcatacgcatttatttgagaattaagtaactcatacatatttatttgaatgcttagaaatcgcacaacataattttttatttaattaaaaataaaaagtgcatactgattaaaaagaaaagtaca

SEQ ID NO: 3514 - DNA, 1548 bp, Zea mays
atccctaggtacaggcacgagaccattacctagaacatcctaatcgagaagcgtccgattgtctccatatcagcgttggtcttcgggggtgagaagtcagcgaaggcaaatctcaagcctgcttgattgcttgagtcagatctgatccagtcttgcggcaccgagaacctaggaggagaacatggcgggtgacggcaacggccgcgcggagcttccccggatcgcggtgatcggcgccggcatctttgcgcgcactcagtacatcccaaggctccgcgagatcgcgcacctcgtcgtcctcaaggccatctggagccgcacccaggaatctgcaaaggcggccgcggagcttgctcgtgacttcgcgcctgacatcgagtgcaaatggggtgatgcggggctggaggagatcatgggagatagttcaatcatgggcgttgctattgttctcgctgggcaagtccaggttgagctttccctaaagatgctcaaggctggaaaacacgttattcaagagaaacctgcttctggatcaacaacagaagcagaaactgcactgtcaatctaccactcatttcaaaacctgttcccgcataaacccatttgggcagtcggagagaactacagatttgagcctgcctttattgagtcaagtaagctgatcaatgatattggggatatgatgcacatccaagttatcatcgaagggtcaatgaacagttcaaatccatatttcaatagcacctggagacggaattttgtgggtggtttcattctggacatgggtgttcacttcattgcaggactacgaatgcttgtaggttcagaaatcacaagcgtatcttctatctcccgtcatgtggatatggctttgccgccaccagataacatatgttccctcttccaactggaaaatggatgcgctggtgtctttgtgtttgccgtcaattcaagatcaccaaagatattatggcgggtcgatggaacaaaaggaacaattcaggtagaacgtggagttgatagtggaaaacatggctaccaggtgttattctctggtgaaaatgggcagtgccagaagacattttacccgttctgtggagtgaatgaagaactgaagacgtttgtccatgacatgttggaagctggcaaagatggagatcacaaggctgcaccccgtggttcttatgtcgaaggcgcccgtgatgttgccgtgctagaagccatgttggaatctagtgcgaagcaaggagccccagttcaagtgaagagattctaacagatccgaaatgtcacataaaagagactacgtttcttctagggtgatttgtccattggatcatatattttcggtagtaaaatgaacattgttccaaattcatgttcataccgtcgaggttatatattaaatatatatgtgaaaaaatgacatacattagaaccaccattcctacactcgtaaaaatcatgtaccttttcttatacactagatatgttgctctattagatattataaatattagtttttttaccgcaaaaaaaaaaaaaaaa

SEQ ID NO: 3515 - DNA, 3810 bp, Zea mays
gatcatatatcaaagaagaagaaaaagatccagagctcagaatacatatgcgagcagatccttccattgttcaagaatcaagaacacgcccccttctggaatgaacgtttgagatgaaagaaaggaaaacagcaaaccgcgacacagacgagaaaaggaaggcgaaccatgactatgacagtatcaataagggtgagggagaattagacctcagaaactccaatgttttttccccccattgctaattaacactggtttcaagcagtccacaccatcttagaagtcaccaccgcatgctctattcgcgcaggcttgtccggtgcgcaaaaagaaacaaccaagtggtggcgcgcgcaagtcaaaaactggcatgatgcgcgtatacaagaaaacgctgaattttggttccattcaaggtctagctagaactcgcgatgattatggtaatagttgctcccagtccggacagccgtagagagggtcaggtgaatttgtcagcagaagcgttgccaacaacggaaaatgtagcgtgtacccgacgagcctttgcgctgtagagcatgtcaaaacgagatccgtggacggggcgagcaattccagtcgtcttcctcggccctcgtcgcgccgctccccgccccttcctgtccctccctggcgagcctccaaatcctcctgcccccaaccgatcccagagttcgcggtcccccccatccatcccactcccaccatcatcacccatccgccatcgcccggccccgcctctctctctctcctccgtccccctcgtcgtcctctgctttttattactcttctccactcattagcttttggttgttgttggttggttcccttcttgcgagttgcgagaacccaccccacccccaaggcgacgacacacacacagagagaggcaagggacggagagggcgaggacgccagccgcagtgggcgcgccacaagcggagcggggggcgcacgcacgcacgcgactctcccgagatccaagacccgcgagatccgcttgccctcgtcgccagccagagcccggagcggatacgtgtccatggcggccggagaggagcaagaagagttctttgactccagggaggtgctgtcgccggcgtccgtctcgtcgtcgccgtcgagttccggtcgccacgacgacggcgggtggctcttcgcccagcagctgctcgaggtctgggtccgggacccgggcagcgtccacgagcgccgccagaggttcgtcaagtccctgggcctcatggatccgagcccccacggcgcgcggcccggcgaggagacgtgctcgaggcctgaggccagagaagaaatcctaccggcaagccccagcaccgagctgttctcggccgtccctacctttgcgagcatgggaggggagccgacagcctccggcggcgacggcgctggcacggaagaggagccggagtgcgtgttcaagaacctggacgatggcacagtgttcgtggtcgacgagatgggaaaggacgggagcttccggagcctcagggagaggctctccaaccggacagtaacagctgcagaattcgagcaggcctttggctcatcacctttcatccgtgagctgatgaggagggtggacgattccgacgaaccctccaccccggagaagactgtgctgaggagaaggaggcggcggcggattgggtggctacgaaggctgggcatcggtgtctgtgttgtcgacgccgacgcagaggaggaagacgatgaggtcaattcgacatcatccacttcttcccggggttgctctaggaaggttgatagggtcaaggtgagaccttacaagaagcggtcaaaggaattatctgcagtgtacaagggccaagtcatcaaggcacatgaaggtgctattgtgaccatgaagttcagctccgatggccagttgctggctactggaggtgaggatggggttgtccgcgtttggcgggtggtggaaggcaagaggcctgatgaccgtcattttgttgacgatgatccttcatgtgtgttcttcactgtcaatgaaaattctgaattggctcccatcaattcctgcgaagggggtaagggcaagcacaataacagctcaaaggtggctactgatccagcttgtgttgtgattcctcaccagacctttgcgctatccgaggaccctgtgcatgaattccgtgggcaccatgatgccatcttggatctttcatggtcaaaaaatagggaattgctttctgcgtccaaggacaaaactgttcgattatggaaagttgggtgcgatagctgcctgaaggttttctcccataataactatgtgacatgtgtacagtttaaacctaccaatgacaattatttcatcagtggttgtattgacgggatggtacgtatttgggatgttcctagatgcctagttgtggactgggctgacagcaaagagataattacagcagtttgttaccgtcctgatggaaagggtgcagtggttgggacaataacaggaaactgccattgctatgaagcatcagaaaaccatctagcactggagtcacaagtccccctgtatggcagaaagaaatctccacttaaaagaatagttggattccagtattgcccatctgatccaaagaaactgatggtgacatctggtgactcacaagttcgcattctcgatggggctcatgtcgtttccagctacaaaggattacgaagtccaagtcaagtccctgcagcatttacaccagatggagatcacattattgctgctagcgacgactctagtatctatatgtggaattatgcaaaccaacttgccccagtcacgagccgtgtgaaaaccgtatggtcatatgagcacttcttctgcaatgacgtgtccgttgcaataccatggaacgccttgcctgcaaggagttctatttctcttgcttgcaacatccccctttcacggcaagaggtctctgaggagctccacaactcgcaagagtctgtgtcatgctgcagtgctgaaggctcacctaaagctgatagctcgtgccggctgccatccggcaatttcactcttagcaatgcattctccgcggagttggcaccaagggggaaagcaacatggccagaagagcagctgccatcatctgattcagtgacaccgtcgtcgtcgtctgctttgcgtaaatctcagtataagttcctgaagacttcttgccagagtgccgccacgcatgcctggggccaggtcatagtcactgcaggttgggatggaaacatcaggtcgttccagaactatggtttacctatgcaagtgtgacacatggtacaagacatgcatctctttgctaattgcttggtcagtgggtatcccaggaatggcagacgagaagtcgcttgcggaactttttacgcctccaggaacttggtttgctgaagggcgacgccccgtccagattatggttacagtacaaagagtttacatgggtgtgtggctgtgctgtgttgctcgtggaccagaagttgtatgtagtccagtggtcctgcgagatctcggcggcacattgtgagagaagggccggggaagatggatcccctcgcagacccaactaactttgcgcgaagagtggttgtatggctgcaatttcattgcattgctgtttgctgcttttctttgttttggcctccctttggggggatctgcagtaaatatatatagagtggatggatgaccctggatggatgaacatattttgtttgctcgattgagttcccctcgccctgatgcaaggcgagcgggggaggtagttg

SEQ ID NO: 3516 - DNA, 2935 bp, Zea mays
gagccggccgggacgaattactgtacctttgatactcgttcaacggagttcgagacctcgtccggtaatgtccgccgcggcggcgcttttaccacggccaccaccgccaaatcctgccgccaccgtccattcactcttcgcctacctatccgacccggccgccctccaccacctacccgccccgctccttgccttctcccaactccgccacctgctgccgcccgccgccgccacccaactcctccttcgccccatcgcctcgctcctccaactccaccgctccgacctccgcataggcctccagcttcacgggctctccctgtccctcggcctctcctgctactcgcacttactgccccgcctcctctccttctactcacaccacccgtcgctcctccccgccgcctcctccctcgccgccggttccacgtgccccgaaccctacaatgtcctcatctccaactgcctcaaccacggcctcccgcaccacgcgctggccgcgtaccatgagatgatcgacaaggatgccgttccccctgatgccttcacttaccccaaagtgctccgtgcctgtgccgagaccgggaacctcgctctcgggcgggcggtgcacgtgcgcgccgtggacgccggcatggacgggcacctgtttttccagaacgcactggtgtccatgtacgccaagtgttgggaccttgcggctgcgcgcacggtgttcgacggaatggaacatagggatgtggtgtcgtggaactcgatgatctctggctacgctgcatctggacagtggagaaaggcagtagagctatttcttcgaatgcaggctgagggtgcggagatgaactcagtgacatggaacacgatcgccggcggttacattcagatgcatgattacagggcagcagttggattaattcgggatatggtgagaggtggtgcgagcattgattttgtgactttggtgattggatcaaacgcatgctcacgggcaggatggttgaggcttgggaaagagatacatgggttggcagtccgaatgcaatgtcacgaaatcgacagtgtgatcaatgcagtgatcacaatgtatgccaggtgcaacgatatggagcgtgctctcatgctgttcaagatgataagatgcccgggtctagtagcatggaatacaatgatagctggttttgcattattggatgatgcagaagcagcttctagacttttccgtgaaatggtggtatgcggtgatgtgcaaccgaattatgttactgtggtcacctaccttgccttgtgtgcccgtgttgctaacctgcagcatgggcgggagcttcacacgcacattgttaagcaaggattcaaagggtatcgtctactgtggaactctcttattgatatgtactcaaaatcagggaggctttcagtggctcaaaatgtatttgatactatggatgaccctgacatgatatccttcacttcaatgatagcaggatatggaatgcaaggaaaaggaattatttctctgcgctttttcaaacagatgattgacagtgggatcatgccagatgccatcatcatggttactgtactctctgcttgtagccactctgggcttgtgggtgaaggggaagagctttttgacaagatggtgaagtcatatggtataaagccccagatggagcactattcttgcatggttgatctatatgcacgtgctggactattggaaaaggcggaagaattgctcaaccagactcccttccctccgacatcaacaatggttgcagcattagtaggagcttgccatgagcaaggtaacataataattggtgaaaggtcagcaaggaggctcttggagatgaagacagagaacgctgggcacttcgttctgattgctaacatgtatgcagctgcaggttgctggaatgagctagcaacagtcagaaaactgatgagagatctgggtgtcatgaaagcacctgggttagcatgggccgatcttggtaacgggtttaccccttttctggttggggataggtcgaaccctctagctccagaaatctatgaggttttggatgaactaactgaacaaatgagtaatatgaataattgcagtgatccggacatactatccatggaggaactcatggagtaatgtgttcatggtaggacaaggacagattgcggctttggtgtaaaatggagctcattaatacactgtagatgagatttcaccatgaagcgaaagggttaaaagggaaaaggtgatgtccttcaagaagcagctcatgtaagtgctactgtgcgagaagatgggcttaccaacatatacccagcgtttatgcatgttgaatgtttcctcgaacgtccaggcaatcacaagttgcttcctcatcgatggtgtcttagctgggacgcatgctaggtgatcgctacggtcacgacaagacttgacggctgtaaggtgaaggtagcctcaactcgatgccaggatagctatactgatttttgagggtctgcattcagttattaaccagctgcctgatttgagatatgtccacaaacgatgtctttttcgccacactctgcaaagtacttcaagcaaatgggttacacagccgtaactcataactcgtagctattcctcctctcccttcctgtactaaaaactgaaaagtgataatcagcacgacccccacccaccccaacatcatgcatgcaacagccgtgcgtcacagtttccactgccacgtcgtcgcgcctacgtcttctgaacaaagcggggtctcttccatccagggttcagtaaagaggagctaaaaatgtcatgtacaacacccgacagaagctgaaggtcaccggcgagcgctaggccgacgacatgcccaggctgaaggtcacagacatgcgccaggtcaacgacagctggtgggctcgcttcctc

SEQ ID NO: 3517 - DNA, 1755 bp, Zea mays
accatacgggcggggccgcaccgaccgaacctaaccgagagcacgagcatacccgtcccgactccgactgcagagcatcagccgaggagaaaagtcgggagaaacgcgcgtgacgtctgcccgcgtcgtatgcgccgcgctgccgtcgccgcgacgacgacgacgaccaggatggcagccgaggagatgagacgggcctccgcctcaacggccacggcggagatgccggcgtcgccggcgccggcgcaagcggggtcgaggtgggcgcgggtgtggccgcgcgcgctccggtggatccccacctccacggaccgcatcatcgccgccgagaagcgactcctcacgatagtcaaaactggatatgtccaggaacgagtcaacattggctctgctccacctgggtcaaaagtaagatggtttaggtcagcaagtgatgaaccaaggttcattaatactgtaacatttgatagcaaggagaatgcccccaccctggttatggtccatggctatggagcttcacaggggttcttctttcgaaactttgatgcccttgcaagccgttttagggtgattgccattgatcagcttggctggggtggttcaagcagacctgacttcacatgtaaaagtaccgaagaaactgaggcatggttcatagattctttcgaggagtggcgcaaggccaagaacctcagtaattttatattgcttggtcactcttttggaggatatgttgctgcaaaatatgcgctaaagcaccctgaacacgttcaacagttgattttggttggtcctgctggcttctcatcagaaacagagcatagctctgagtggttaaccaagtttcgagcaacatggaaaggcatgctaatgaatcgtctttgggagtccaattttactccccaaagggttattaggggattgggtccttggggtccaggtctagtacagagatataccagtgccaggtttggtacaagttctactggtgaattactaacagatgaagaatcggcattgatgacagattatatgtaccatacgttagctgccaaagctagtggagagctgtgcttgaaatatatattttccttcggggcatttgcaaggaaacctcttctgcagtgcgcgtccgattggaaagtgccgactactttcatatatgggcagcaagattggatgaactaccaaggcgctcagcaagcacggaaggacatgaaagttccttgtgaaataatcagggtgccgcagggtggacattttgtgttcatagacaacccttcagggttccactcggctgtcttctatgcgtgccgtaatcttctatcagtaaatggagaggagggattcacatttcctgatggcctaatatctgcgtgaagtggcatgttcaacaagcttgctcaacaacagtttacataaagcaaagatatacgattgtggaaatcattgcccatttccaccaatttgcttgtatacggattatgctgtgtatatattacataacaaatgtattagtatcatttaatgcacgatttgtgaaagggcctgagtttgtatttagcgaattttaggttggtttttttccctttttcttctttcagtgcgcttgctagtcaatcccatactataagccgtgatcattttttgtttatgtctcataatataaggcacatctcactacacacgtttatcgatgcagtgatatatagggaattaaatacaatttttggtttttaaaaaaaaaaaaaaaaa

SEQ ID NO: 3518 - DNA, 1935 bp, Zea mays
  misc_feature (28)..(28): n is a, c, g, or t
cagcaacggcatcctgctgggcatggcnagcgggctggagacgttttgcgggcattcttacggcccaaggcagtaccacatgctgggcatctacctgcagcggtcgtggatcatcctgttcgcgtgcgccgtggcgctgctccccgtgtacctgttcacggagccgctgctggtggcgctggggcaggacccggctatcgcggcggtggccgggaccatctcgcgctggtacatcccagtgatgttctcctacgtgtggtccttcacgctgcagatgtacctgcaggcgcagagcaagaacgcggtgatcacgtacctggccatgctgaacctcggcctccacctgctcctgtcctggctggccaccgccaggctccgcctcggcctcgccggcgtcatgggctccatggttgtcgccatgtggatccccgtgctcggccagctcgccttcgtcttcttcggcgggtgcccgcgcacctggaccggcttctcctccgccgccttcgccgacctcgccgccatcgtcaggctgtcgctgtcgtctggcgtcatgctctgtttggagctgtggtacaacaccatactggtgctgctcactgggtacatgaagaacgcagaggttgcgctggacgccctctcaatatgcctcaacatcaacggctgggagatgatgatttccatcggctttctggcggcaaccggagtacgggtggcgaacgagctgggagccgggagcgcgaggagggccaagttcgccatctacaacgtggtggccacctcctccatcatcgggtccgtgctgttcgtgctgttcctcctcttccgcggaggcctcgcctacatattcaccgacagccaggcggtggcggacgcagtcgccggcctctcgcccctgctggccttctccatactgctcaacagcgtccagccagtgctgtcaggcgtcgctgtcggcgcgggctggcagagcgtcgtcgcctacgttaacatcacttcgtactacctcatcggcatccctcttggagccgtgctgggctacgcgctggggcttcatgtgaagggcatctggatcggcatgctgctcggaacgctggtccagactgttgtgcttctcttcataacgttgaagaccgactgggaaaaacaggtggaggttgctcaagagaggctgaagagatggtacatggaagagaacagaagactccaggggtccagacgaaacccttaggccggccctcagctccactgtgtatctctagttttccactcaccacgagaacaaaacgagggagacgactgctccacgtacaggccgatcgaggctgaaggatcatctctgggctgtatggtattgtagacacaaataatcatctgggctgggctgggcatgcaggtaatagtggtgtgcactagttctgaggttatatctctgccttgttcatcttaattcgatctgccggtgtcttgttgatcagtgcaatcctagctagttgttactgcattgcaatctgggaactcgggtgttgtttttccgagcgaaaccgggtcgatttcccgcgatagtttgaacagctcacaggtgcgccgatcaacccgagaggcacaacgagccagcaaactcggaggacatgacatgacatggtagagggggggaggggacaaaccgatcgaggtggattggactctccaggcgaatgatgggcggcgggctcccggcaaccgtcatggttcgccggagcgccgcctctgctccacccctcctcgattgtttgtgccattgtgtgggctcaggcgctcagctcagcgcataactccgcctctcaaactgacgccatcgctggaacaactccacagttccagcactaggtggatgacaggtcgggctcgtgtgccaggagcgaatgttgccatctctccagagagaggtgtgggaag

SEQ ID NO: 3519 - DNA, 1385 bp, Zea mays
ggattagccgcaaaactgtatcatctcatctctttgggatgtacaaacccgaagcatcagtttggtctcgagcgctcaaggcccgatctccctcactccctgtatgtaatgtaatgtaactatgtatgtgtacagacagctacactactctcagtttccctcctgatgattcccgttcctgaggctgcagctcccctctcagcagcagcagcagcagcagcctctgcatcatttccagccatagctctcggaccgtccgtcttcctcctcgcagctgacggtggccgccgacgagactgcgatgcctgaggtggagaagtggagcgggccgtgggggagacccggactgcgagctgctttgctcctgcggaatccacagccctcccaccagcacgatgggctggctcaccacgccggaccctggcgccctccggttgtgcagccggtatttctgaaggtggcttttcacttcgtcgtttgtgaggccgtccaccttcatcagctccctgatctgctttggggtggcaacttgggggccaccgagctggttcaaggcggcgacgaactggcgatgcagctccgtggaccagcaacgccgagccttcctcgcctgctgcgacggggactggacgccaacgctaagcgaaggggcagctggcgccgtggcggcggccgccctcgtcgccgcctgcgcaaaccccaccacctggcgtcggctctcctcggcggcgctcttggtcgccggcggcgacagcaagcacaggtcgggcatcccggcgcgcgcggcggccttgtcgtccattctcaagccgagcggcgcgaacgccggcgcgccggagcccacggcagccttgagcggcaagaaagcgccgccggcggcgcgagacctggcctcaggcgagctcctctccttgtcttgcttctctggttccgcgtcctcgcggccgcaatcgcccgtccagagctgcgccgtgctcatccacttgctcttgtccccggcggcgccgtcctcctccgccaccgccttccccgcttcctccttcatcacatcgatcacgtctgcgaggaggcgcgcgcagagcggcagctcccgcttgaacatctcgatcttgccccgctcctcctcgaggcggcggatgcaggcgtccatgtccggcgccggcgccggcgcgtagtccttgctctgccgcacggccttggaggcgaagtgcctcagatccaggctcaaatcggcgcccatcccgatctccacgacgtccagccccatcgtcgcgatgaatctgtctacggtgtcctgtgtgctgtgccggaaggaacaagtgcgcgggcggcggatgggaactgccagaggtcgtggaaggtgagctccatttatagcagacgag

SEQ ID NO: 3520 - DNA, 1266 bp, Zea mays
ttcttcggctatccgctggcagccgagcaggcccaagtggtgcgtcctgttcacccacggcgcctgcgtcggccctgcccgaactggcgtgcagagcagtgctccacgacgccgccaccacctgccccagcagcggcacgctccgacaacggcgaccatggcggtgcgggcgcgggggctggggagtgttccctgctagatccagtagatggccgactcatcgaggccctccgtgaacatcatctgcgccggtcgtctgctcggctgcagtggattaggtgagcgggattccggtagaggattgtttagtttgggattctaggttcctcgctcccgtgccggagacggcgctggacgttgaggtcagggccgcggcggcgcggcgcgtcgcggagaggaaggcgcggaagcggtccgagcggcgcacctacctggtggccgccgtgatgtccagcctcggggtcacgtccatggccgtcgccgccgtgtactatcgcttcagctggcaaatggagggcggcgcggtcccggtgagcgagatgttcggcacgtttgcgctctccgtcggcgcggcggtcgggatggagttctgggcgcggtgggcgcaccgggcgctatggcacgcctccctgtggcacatgcacgagtcgcaccaccggccgcgcgagggcccattcgagctcaacgacgtgttcgccatcgtcaacgccgtgccggccatctccctcctcggtgacgtcgcgagcagatacaccacatggacaattttgagggcgtcccgtatgggctcttcctgggaccaaaggagctggaggaggtcggtggcctggacgagctggaaaaggagctcgcgcgaatcggccagaccatctgatggattcgtccggattccggcgcggcgatctccgctccgctccgtgattccggcgcagcctcatggttggggagccgacgaccagaacctccagaagggatttggtttggatgcgcgagcgtagatcttgacctgcatttcggatggtctgtggaggcacagctcgtacctggagatgtctggtgccatggaattacttttcttttcttcttttcctgacattttcacgccggcgtctttatttgtggagacgtcgcacgttctggcccctgtattactgttcttatggctaggattctgtatataacttgtagagacatgttatgaaccaccagctcaatgaagctaaaaattcggtggttggaaaaaaaaaagcaaaaaaaaaaaaaaaa

SEQ ID NO: 3521 - DNA, 1473 bp, Zea mays
  misc_feature (17)..(17): n is a, c, g, or t
ctcgaggccggccgggncgggattttcaaatgaggtcccgggtcccgctcatctgctccctgtcctgtccatctgtaccgttccattccaattccatccccggaaagcgcaagccgcgggagagcggccggcgtacgtaccacgaggaccgccagcccagggccatggccgccggtctgtccggcgccgcgatgaccggcttcgtcgccaagaacccgctgctggcggccgcggcgcgccgcagggcgctgcctcccctcgccgggcgcgccctgccgttctcgccgctcaccaccgccagggccccgcgccgccgcgggctcggtaccgtcacgtgcttcgtgccgcaggacacagagcacccggcggcggcaccggccccggtcgctcccgtgccggagacggcgctggacgaggaggccagggccgcggcggcgcggcgcgtcgcggagaggaaggcgcggaagcggtccgagcggcgcacctacctggtggccgccgtgatgtccagcctcggggtcacgtccatggccgtcgccgccgtgtactatcgcatcagctggcaaatggagggcggcgcggtgccggtgagcgagatgttcggcacgtttgcgctctccgtcggcgcggcggtcgggatggagttttgggcgcggtgggcgcaccgggcgctgtggcacgcctccctgtggcacatgcacgagtcgcaccaccggccgcgcgagggcccattcgagctcaacgacgtgttcgccatcgtcaacgccgtgccggccatctccctcctcgcctacggcttcttccaccgcggcctcgtgcccggcctatgcttcggcgcgggcctcgggattacgctgttcggcatggcctacatgttcgtccacgacggcctggtccaccgccgctttccggtcggccccatcgccaacgtgccctacttccgccgagtggctgccgctcacaagatacaccacatggacaagtttgagggcgtcccgtatgggctcttcctgggaccaaaggagctggaggaggtcggtggcctggacgagctggaaaaggagctcgcgcgaatcggccggaccatctgatggattcgtccggattccggcgcggcgatctccgctccgctccgtgattccggcgcagccttattgtcggtggggagcccacgaccagaacctccagaagaccagaagggatttatttggtttggatgcgcgagcgtagatcttgacctgcatttcggatggtctgtggagggctggaggcacagctcgtacctggagatgtctggtgccatggaattacttttcttttctttttttcctgacattttcttatggctaggattctgtatataacttgtagagacatgttatgaaccaccagctcaatgaagctaaaaattcggtggttggaaacagcgctgaaaaatcagaagctcctcctttcccaaaaaaaaaaaaaaaa

SEQ ID NO: 3522 - DNA, 2211 bp, Zea mays
ttcttggggtcccccccgggttcggccgccacctgtgcacacagcgccgtcttctggagcagcgtccgaaagtgtgtggagaacctgcccgattcctcccgccgcctccgacctcaccgtcggcgggctcagcttgttcctggggtctgatcagccatgttcaagaaacctgttgatgtgaaaaccatacagcgcttgtctggggcagacaaaaagaagctaagaagaactgccaagggaaggtttccacaggcttctgatgctgaccttgatgccattcttcctcccaaggctgagataacagttgctaagtacccgaaccatgttcttgtatatggcatagagggagagttcccaatgattttcaacactgacgcaagaggtcatgaactgtttcctacagtttatgcgctttggaaggtcccccatctgttgccagcttttacgcttaaaggtggtgaggtttcacgtttcgtgattggtggcgctgatctgatgtttcctggtatcagcatacctccagaagggtttccatcttttgaagctggccaaccatgggcagtaaaagttcctggtaaccctgctgcaattgcggttgggagcacaactatgagtagtactgaagctttgaaggcaggactacgtggcaaggctttaaagattttacattactacagggatatgttatgggattcggctgatggttgttatgtccctaatgaaggattttttgatgacattgttgttgaagatcctaatcctgtttcgacatctcaggctcctgattctgctgaagaacctgaagtcacgaatgatggtagtgtttcggctgaagatgcaggagtcgatatttcagacaatcatggtacaaatcctggcatccagattgaagcagtggaagagataactgatgttgttaacgaactaaaacttcccgaagataaaactactgaacaagcacctgttgaaatggaacatcataatttgagaactgaggaaattgattctctcttggacaaatgccttctgcaagcgctatacacaagcataaaagaaaaagatcttccaatgccaggaagtacactatgggcaaatcacatactaccgaacagacctcctggtgttactattgatataaaaaagtcatcacacaaaaagttgtcgaagtggttacaatcaaaatcttcatctggccttatttcagcaaaggaggacaaatataagaaggaagttgtattgcttgctatcaatcacaagcatccagactacatggcctttagaccggaaaagagggtacaggagcttgttgaacacgaaaaggatgttgctgaaagtagtgtcactaagcaattggaggttgcagagatttataagccaagttctcatgttaaacccatatttgtggctgtcgaagctgacatggagaagtattacagtgcaccagaggcttcagatatagtcttcaggtacgttgaaaaggaaaaattggttaaacctacagacagggccaaggtgattcttgatgttacattatgtgatgcattgtacaaaggggctatcaaaaagggctcggcatacccaactgaaatccacaagaaagacttaggttcagcattcttaaaccgcatgcaagttcaccacaaggtatcgagaggaactcaggaggtcatacgcaagggtgccataagaactatccagatcatgacagaaagaagacagggcaacaagaagatgactcggctttctgggctcgagtgtttcctgatggatcctgattcattggcttctgagctccagaaaaaatttgcttgcagcaccaccacagcagagcttccaggtaagaaagggcagtacgagatcttggtacaaggtggagtgattgatgaccttgctaaacaccttgtcgaccattacgatgttcctaaaagatacatcgaggtttatgacaaaacaaagaggtaggaagtgggggctgatcatgtccgtttaggtgttggagcgcttggatggtctacgaaatgatcccaggattgtttcatgatactttttgtcatcacatgtctgagcaatattacgacattgttgatctacgagtaccttacgatatttgttttcgttcctgcctttggttgatggaaaatgctattgtgcttactgaacaaaaaaaaaaaaaaaatggataatgaggtttccccatgcttttggtgctgc

SEQ ID NO: 3523 - DNA, 927 bp, Zea mays
ctgatgacaaactcgcccacttggtgtggttagagtcagagaccagcgctggccgcccggccatggagaagaagccgctgatgccgctggcggtggcgcacaagcacgcccacggtcacggaggcggcgcggagcggacgtgggcgcggccgtggcgatgggccaagaccgccttcgtcctcgcggccatgctcgcgtcgctcctgctcgtgtgcgcgccgccgctgctggtcgtgctcctcgacctcgcgctcccgccggcgctcctgtccgcgaccctccgcggatcgctcgcgccggcggtcgtggcccaggcgcgggccttcgacttccgctcgtcgctcgtcgacctgcccgccgtgtcccgcggcgcgcgcgctgctcatcctctgcgcgcacctcggcgtggcgtacaggaccagctgccgcgagcgccggcgaaggctcgtgtacaggatggacgtcgaaggcgccgtgaggttaaaaggaggccatcaaacacccaaagggctgaagcagtgtatcgtctgacactctgctcccatcatcctcaccattagcgtccgctgcatcaccattcaccatatacacgtacgtacagaaagattaaccaagtttttgttgggttcgccttcgtcaagtgtacactaaggctatctccagtagctttcttatttcactctctatctcatttctccatttcaaacttacaatttacagtaaaaaaatagtactgctgtttgcactaaacggccatatgcttactattacccgtgtaactactgtcagtcctgtcactgctgcaagtgaacatactgtgaatactaaacggccatatgcttaccaaaaaaaaaaagccttcagcgacgcaaacgcaggacgagccccggttcttcgtgttatcttgtgtggggccatacatactgg

SEQ ID NO: 3524 - DNA, 3925 bp, Zea mays
  misc_feature (1713)..(1713): n is a, c, g, or t
cttatcagacacagctaacccagtatccatattatactctcgtctaaatatgcgtggctttgcactggaggtgttcttcggcgtgtgtatgacaagttctaacgaattttggcattccattacaaagaaacacatgagaatcggaccatctccgaaaatacgtggtactattgtagcatggcctattctaacgcccagaatccagcagcccatgcacgatcctctcctccatgctgaagtttccggtgctggtcatctccgcgctggccaccggcgactccccaagaaggctctccatctcctccggtctatgctgcgctggcacccacgggtgctgctgctgcatggccttggccagcacgtccagcctctcggcgacatctctcatggtcggccgcctctcgccgaccatctcccggccctgcagcgcgagctccgcgacctcctcgagcagcgcggcgtcgctgtcggccttgatgcggccgtcgatgatgtccccgagcctgcgctccttcatggcgttcaggaagcgcagcgagaggctccgctcgctctcggggccttccaggttgaacgccgtgctgccggtgagcagctccaggaggacgacgccgaagctgtacacgtcgctcttgtccgtcagctggcaggtctgcatgtactcggggtccaggtacccgcaggtcccctgcaccagggtcatgaactggctcttgtccgccggcgccaggatcgaggccccgaagtccgacaccttcgcctcgtagttctggtccaggagtatgttggacgacttgacgtcgccgtggaggatcggtggcgacgcccacgagtggaggtaggacagcgccagcgcggactcgagggcgatgcgtatccgaaccgagaagggggcgctgcgagagccaccgtcaccatggatgaactggaacagcgtgccattggggatgaactcgtagactagcatcgggacctccacttcgaggcagcagcccaggagcttgacgatgttcttgtggttgatctgggagaggatgagcatctccttgccgaactccttctgctgctgctcgctggccatcgacgagacgcaccgtttaaccgcgacgacaccgccgtccttgagcaggcccctgtagacggtgccgaagccaccgcggccgaggatgttcttgtcagcgaagttgccggtcgcctcgatgagctctgcttctgtgaagacggtgaaggcagttccttgctttaggcttatctcgtgcagcagaagcatcccgccgtgctgttggaaatacttccgcttgattttggtcagcttcttcctctcatgggtcaagtacgtacagacgacggccgaggccacaacagccacaccgatgcttgaacctgtgttgttttcagacaatcacagtcattacagactttatcaagatgatcaacttgtgctcctacatgggctactgatttgagcgtcatacctaatcaaagttgtttatctttgcgccccccccccaatttgttcatattctaagttcgtaacacactatccatacacacgtacaatttaatttgattaaaatgcatcagcggtccttgaatttggcacgctatatcactttgggcaccaaacatggaaaaccacaaaaacgggtccttaaacttcatcgtcccgtgtaaaaccgtccaaaaccagatttgctcagacccgatagcggngtggcacgccatgttggagcctccccacacgtgtcgtgtgccacctagtacgcgtagtcttcaaacccggtatgttgtgtcacttaggtcctcgaacttggcatgttgtgttatttgagttcctaaactttcattagcatgcttcagcatgacacaccatatcgtcatcgatccgatttgagcaaatccggttttagatgattttgcacaggtcccagcgtggcacaccatgtcggcaactagtttgagcaaattcagttgtggacgattttgcacgagtcaacaaattttaaggacctgttttcgtggttttctaagttcgagtgacccaagtaacacaacgtggcatggtcaaaggctgttgatgtattttactcagagataaacttataaatcaggatgcaaatgcctatattgtaattaataataaaatctatcggaatcgtataaattaaaggagtaagagtaaaatacattggcggtctctaaacttagcattgtataacactggttcctaaactcctgaactgcatatctaggttcttaaacttgtaaatttgtaccctaaactttcaatgtacacatttggatccttatacttatatggttgtgtaaaataatttggtagtatgttcatgctctcctgtcctgtcctgggacagcttttgtggattttcattttattccctagtgtgtctcatgagaattaaatgggctctgaaatactaagcctcaaacatatagagagaaaactgtgcttacccactgatagtagcgccgtaatgttcaagggtgtcggacaatcgtaacctccaggtttgttcttgcatctagcgcatggaggtggtttagcaacacactcatcaatgtctgcatacatacatacagagtatatagatctcaaggatactgtatgcatatattcttttgaggaattctttgctgtacttgcacacatttaccaaaaaagatacacacacagttgcaacaccgacctttgcatccatcaggaaggtaaggattgccctcgaacccttggctgcagttgcagaggtagcctccactgctggaattgacgcacacgctgttagcgctgaggcaagcataggaatcctctttcttcgtcgcaacatcgcaggtctcgttgcccacttcccagatcaggatggccgggacacggccgccagcattctcatcaagaaatgctgttgtgttcagatatgttgtcttgaactggaatttgtcggtctccataaccacagcgtagcctcggtaatctgcccgcctgtctgtggcgtttctgtgttcgtagtaatccgtcgtattgtgatccggactgaaacctatgtcgtcaaagttcatgtcgtcggcgagtgcagcctggcagcagccggcactgtcgccgtcacacttgccatcttgtgcctcgaggtcgccgtagggtttgctctgcgacacacacccaatcacatgctgcgtgcataaaacaatatgaggatgcagcctgttattagcagccggtccattgaactgaagaattagacccttccatgcattgaaggaacaaacaaaacaagaacaagaagaagaattaaacccttccatacgctgggctagctagctactcacagtattgtccgccatgtatgcgagagcgttgatgccgataaccgtgaacatgttggacttccctgaatacctaaacggcgtgccggagagatccttgccccagatatcgcagtcgatcttcttggtcgactgattagagaacatggatgagatgtgtttcatgatccgaacctggccgtcgaccagcgatatgttccgcaccgggattatgccgaagatcgtcaagaagctgtggccgtcgacagcactcctgttgcagcggagctcgaacccttccatagcgcagccatggccgaccccgaacgggtactggatctcaacgtcgccgcagtacctgaggcagccgggtcctggcagagccagcgccgtcgtcttgccttggaactgcagcgtcgccgtgaggctgaagaggagcagcagcagcagcaggagcatcggtactgtaccggccgtggagttcttgccatggtagcagtacatcgtgtgtgctatggtggtcacaatgcaaaaaaaaaaaaaattgtgcttgtttgatcagcacatactattactcattagcctccctctctctctatatatacac

SEQ ID NO: 3525 - DNA, 1249 bp, Zea mays
ggactctgttccaacgagccttccctcccaaacttgcacgctgcccccgcgctcgcctccgcccccgatccagatccaggtactcttcctttcgccgcggctgagaagcaactctccctctctgtcctcttcctgtcgccgcactcattttctcttgccggtaaggagtggagatccgcgtccatcttctattgattaggataccggtatggagtggagatccacacggcctttgtgttctataagtccatgtctcgcggatctgcttgctgcatgctccgctgctgctcgtgaaccttagttgatgagcttactatcttcctcttgtgtgaagggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggttgtctattttctgttattactgcatatatatttgcctttgtatgtggttgttttgacgtgccgcttactgtgctttaggggtgatgttgagaagcggactgcgcttgagaacttggatttgatacttctctgcattgatgaaattgtagatgggggaatcatcctggaaacagatgcaaacaccattgctggtaaggttgcaaccaatgctgttgatggttctgtgcccttttctgagcagacgatatctcaggcactagccacagctagggagcaccttgcaagatctttactgaaatgaacaaccagcaatatgtatgacatatatgtgtgttaaaggttgggctactgaatgttaagggtctttgtagtcgttattcatcccaaagtgctgctgtgacagagcctagttgaatatccgagggattggtcacatgctcgttatttttttttgaaccagtgagtttgtagctgccatatttcaggtaaaacataaaataaagagttgtaattgggtgtaatataattttccccatacaaaaaaaaatcatttcaaccatc

SEQ ID NO: 3526 - DNA, 1141 bp, Zea mays
cttgattagcaatcactgctgcgcccgataggtggcagcgagccagcgagccagcgacccacccgactctgttccaacgagccttccctcccaaacttgcacgctgcccccgcgctcgcctccgcccccgatccagatccagggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatgttgagaagcggactgcgcttgagaacttggatttgatacttctctgcattgatgaaattgtagatgggggaatcatcctggaaacagatgcaaacaccattgctggtaaggttgcaaccaatgctgttgatggttctgtgcccttttctgagcagacgatatctcaggcactagccacagctagggagcaccttgcaagatctctactgaaatgaacaaccagcaatatgtatgacatatatgtgtgttaaaggttgggctactgaatgttaagggtctttgtagtcgttattcatcccaaagtgctgctgtgacagagcctagttgaatatccgagggattggtcacatgctcgttattttttttgaaccagtgagtttgtagctgccatatttcaggtaaaacataaaataaagagttgtaattgggtgtaatataattttcaccatacaaaaaaaaatcatctcaactatcaaaccatggtaaaaggttcaaaattatctatcaaatgattatccctaccaggtcggaggaagaaatggatcctccgtcattgaaaaggtatggaggctttaaaaaaaaaaaaaaaaaaaaaaaaaaaaataagaataaacaagaaatagcaataagaaaaagggg

SEQ ID NO: 3527 - DNA, 870 bp, Zea mays
  misc_feature (781)..(781): n is a, c, g, or t
cccaaacttgcacgctgtccccgccctcgcctccgcccccgatccagatccaggtactcttcctttcgccgcggctgagaagcaactctccctctctgtcctcttcctgtcgccgcactcattttctcttgccgggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatgttgagaagcggactgcgcttgagaacttggatttgatacttctctgcatcgatgaaattgtagatgggggaatcatcctggaaacagatgcaaacaccattgctggtaaggttgcaaccaatgctgttgatggttctgtgcccttttctgagcagacgatatctcaggcactagccacagctagggagcaccttgcaagatctctactgaaatgaacaaccagcaatatgtatgacgtatttgtgggcttatatgtgtgtaagttgggctactgaatggtgagggtncttgtagacgttattcgtcccaagtgctgctgtgacagagcctagttgaatatccgagggattggtcacatgctccggtaatttttttt

SEQ ID NO: 3528 - DNA, 1059 bp, Zea mays
gagtagcaatcactgctgcgcccgataggtggcagcgagccagcgacccacccgactctgttccaacgagccttccctcccaaacttgcacgctgcccccgctctcgcctccgcccccgatccagatccagggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatgttgagaagcggactgcgcttgagaacttggatttgatacttctctgcatcgatgaaattgtagatgggggaatcatcctggaaacagatgcaaacaccattgctggtaaggttgcaaccaatgctgttgatggttctgtgcccttttctgagcagacgatatctcaggcactagccacagctagggagcaccttgcaagatctctactgaaatgaacaaccagcaatatgtatgacgtattatatgacatatatgtgtgtaggttgggctactgaatgttgagggtctttgtagacgttattcgtcccaaagtgctgctgtgacagagcctagttgaatatccgagggattggtcacatgctcgttaaattttttttttgaaccagtgagtttgtagctgccatatttcaggtaaaacataaaataaagagttgtaattgggtgtaatataattttcaccatacaaaaaaaaattcatctcaactatcaaaccatggtaaaaggttcaaaaaaaaaaaaaaaatgattatccctccaaaaaaaaaaaaaaaaaactaaagggggggcc

SEQ ID NO: 3529 - DNA, 552 bp, Zea mays
acccgactctgttccaacgagccttccctcccaaacttgcacgctgcccccgcgctcgcctccgcccccgatccagatccagggtggaatagggaacggccatacaccatggcggatttctccaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatgttgagaagcggactgcgcttgagaacttggatttgatacttctctgcattgatgaaattgtagatgggggaatcatcctggaaacagatgcaaacaccattgctggtaaggttgcaaccaatgctgttgatggttctgtgcccttttctgagcagacgatatctcatgcactagccacagctagggagcaccttgcaagatctttactgaaatgaacaaccagcaatatgtatgacatatactgtgtgttaaagagttgggctactgaat

SEQ ID NO: 3530 - DNA, 1417 bp, Zea mays
aatcctgtctactactaccatcgccgtccttgtgtttcatttttaatgaccattctctcatctgctgctggctgcggctatatacccccctctctctgtctctctatctcctcctgttcttagacgtttctccagagcctgaagccaaatctagggggcttgcttcatctgctgtccgagcgtggtttggtttctcggggctggcgcggtcaagagctcacctgagttccaccgaaatctgccacggtagttcttgcctaggtgtgtcgttgcgttgtgacccttgcggattttcttgtttcttttgagttgcgatctttgcaggttagtctcccccccaatccgtaatcatccggcgtctaggaaattgcagtccagtttgcttatttgttcgtctagtgccttctccccatcctggttagaaagaatatcggaaggggggatttttttttttttgcctgttcgtagaggaagcagtgaagacataattgttgcatctgataaagctcgggcgaaatacaagcaaatccttgtaattttgcatccctttgctggctcttttctgattcagagaacccaatgggggatgtgtccttgaatggacccgttaaggccgagccaactgccggtggcattgccaagggaaaccgagttctggacacgatgtccgccgggtggacggacgagagacacatgctgtatataagctccatggaggcttctttcgtcgaccagctatacaaccatggaaaccatccgcacgacgcaaatggcgccggcttcaaggttctccgcaggggggtgtgggagtacatcaagtatgagaagaccagtgcccctgtgcgaagtggggctaaatgctgcgtctctgcaaatccttggatccggcatttcaggccacgtgactgcggtagtaacgcacagagtgacgcggtcgaggcttcggtgggcgaccatgagtcgggtactcaggcaagccgcaagagcccttcagtgtctcatggaagggaacggggagcttgtaagggaggaccccagattcttcatgaaagcacagaggtctctgatcaaaattttgctgacgatgaggctgaagctgaaacagaatcgatgaaagcatgcaagaaaaggagactaagcagggcgtcgcgctactgtgctgaatgatcaagtaaaattcgcaggaacaattagcgtagcctgttgcaagaatcgatatgacttatcctaaaagaaggtgctaagatgatgggacatggctctcaaaactttcagctgttgcctgctggtagccaagacacactgaatccgaaggaaggcgttgaagggtagctgttagtgattttgtgatataaagagtaccgcggccgcgaccacccgcatttttagcggatttaagttcttgttatgtgtatct

SEQ ID NO: 3531 - DNA, 4809 bp, Zea mays
cccacgcgtccgcggacgcgtggggggctttacaggtgtaatggttatggctgcaaaaaacggatccgtctagaccatggcatggaatgaagcttcctattcagcagcaagcaactgactgggggagatcactagcctagccttcaaactcgtcgaagtcttggaactcctagagatctgctccggcagcttcatctgagcaagggttgcaccgagggcaaccttgtgtctatataaaaagcaaagtgaatattacgcaccgggtatccaagtgaccaaaccaacacaatgcattgaaaaaggtgtgcttgcctcgaaggtaataaacccaacgcttttgtctgttgttcccaaggatggcgtaattgcagaagcaaagagaaaggccaagccagatcttgacaagaatgtgatggctgctgcaagtagacccaaaacaatgcccgaagttgtaaaaaatgagttcgctataaaggtgagagataatcagaacgatgagcttaacaaaaaggtaacaaaggtgaaagcaaaggcagtctataaggatctcctgaattcaaagacgagaacaaaggcaaagccagatgttgccagtgatgagttaatagcaaaggtgatcgatcatcataggagaggtgagctgcgtttactgccagtcagtgatctgaagtgcttcctcggtgcgaagaaagcaaaggttggaggaacgaaggaagtgctaatacaaagagtggctgagctcttgcttgacaaatgcattgctattagcaactgagaagtctgaacataacaagcatgtgatgatgtgaacctacgcaaagtaccctttttttgtgtttctacttgttgcaatttgaagagccgcaatcaaccaatagccgaaacactgtgtgctagaacaaaatgacgacagcaacttgaattgtgtgtgtgtgtgtgtgtgtgtgtgtgtgtgtgtgtgtgtgtgtgtgtgtgtgtgtgtgtgttttgcgggaacacaactataatttttcacttggattttgatacgtcaataccagaaaggcttaaagcctaactgtaggtagtcatctaaaaggccatatcatatattgatacctaagattttaggtaatgtagaggatagagtgaggagagagagaggaagaggttccctcacaaggtcaatgtttaggactgagatgagcccagccaacattattatgttaatagttagttgcttgtacattgatatggtttctgtatattactagtaatttactcgcgctccgctcgagtctttaaccatttgtttcccaagctaagagagcattgctgtagaaatattggcatggcacgcacctcagggcggtggtagatcccggggcggtggtagatcccggagcctctcagcgccactgcctgctgcattgcattggcatgaactgagaaatttggagaacacgcagcaggtgatggtcatcagaagcttcaagtgtcaaaaggtattaataatgttgcttgttttgatacagatatgatatatagctctaaagtcacatacatgatcacattatcgagtgaaggccgcataggaaagttgcagatctgagtatccatttgttatttcagtgggaccctaaaaaagaaataatgaactttcatttttgtagagttgttcaagttttggcaataaatctgtaagataaggactttaggaccacacaaagctcacatttttaaaactattaacatctagattatgtctgaacatttatgtctaatttgtgtagcgcgggagaattatttcagttattgtcaactgctaatgacagtatctgctgaatatgtccaattgatcctaattataagaaagggattaaaatgaatatattaatatatgaatacataattaaaactctctggaatccaaatagatcacaaaaatctacatatgaatttagacacgcctgacgaacaacgaaaccacctattaattcaataatccttatctgctctctttttaaaataaacatagaacctccatatcaaggaagaaaaaacattatttcagggtagtgcacccctgcagcatgagcctcctggttctggagcatataaactgcatgcggagagtagagacaaaaaaattatttatgagagggagaatcacaacaagttttttcattcattcatttcagcaaacgaatgcacatatcagtagcagatgatctacatttttatcctagcattccactctaaacatacaaacaaaacaattgtagaatgtttgagagatgtattttcctatatatttgttcgaagagaatcccacgaatgaaattacactaaatcaaagtctacagaccaatacttctttattttcaaagcctttgaaatttgaatgatgccaatgtaatgcaatattcggagaagcattttctaagagacatttcaacaaacactaagagggatgtccaagatatggaagtgctgacattctcaagacgctgatcatagaggaagacctggtaacctgcgcaaaatcaaatagaaataaggcaccgcgagtgctcgagtgccccaaccagacttcgctatcgtcgtcgcacaaccactgtgcaccgctcgctgcacaacacccgcgcaccgcccgctggacagcccacgagcactgtccacagctcgctcttgcgtaggtcgtaggcgcgtcctcgcccttgcgtcctcgcctgctccgccaattcgctctcgcgcgcaactcgctcctgccatcacgctcaacatcaccctcgctcgtgccatcgtgcgtagcctcgcccctgcgcccatcccgtgacgcactgcccacccctccgaccctctctatctcactctctattcattttccccaccacacgctcgtttgtcgtatagaactctcgcaactgttcagcgaggcagatcattttgtgaccgtccaaagatgatagagtggttgaaaatttaaaagaggacgtggacgaacgtcgtgccgactagcgcctagctttaatatatagaaatataggtaaaccatacataaattaaatatttattcaaatatcattatgttgtattgtttttaaattattagtatatgtatatatttacaatatatctcgtttgtataatataaacaaacatgagtcgtagtagtggaagccttttttttgaatattttctatgatggagggagcactcgttggaggggcgacatacgaaaaagctcataaataggatgtttgggactgcttttcagctctaaaaatttggtggaataaatcattagatactccaggaaatcatggaaatggagttataaacctcgttttgctaattatttaaattaaaaataatttaaaaaattaaatttatattataaactacagctccacactggagctgaaacctgaaccaatcctagacacccccttaaaaatatagtagagattttgtcgctgccatacaattcaaagcatttattatgttattttgtccccttttttttgagttctttgattttaggcacgctcctttctagatgtatttttaagaggctttgtacatatcttttgagtgaaacaggtagctctcctatcctgtttgttttagaaaaaaaaaacaaatacaaagaaaaaaggctaatcgagtcgtactagtgtttctatcaagaaagtaattgtgccgtaacctcggggccgaatacacatacatgtagtgcaccaaggggactatcagttgccacaggcaactggcaactccctcttctcccaggcttcagcccaaccaccagccgccacgaaatcgagaccccagccaatcagtgtacttctggtttggagcaaattaatgaccacatgttcttatataagctcacttctgccccgccgcccggcgttattaaagggcacttgcatgcagcaatatggccacgtcgtccaagacgcaggaagctctggccttgatggccctcgccatgctcgtcaccaacgccgccgtcgctgcagacgatgcgtcgccgtcctgccccaggctcacccttcacaacctctgtccttacccggtctggccgctcgtcaccgctaacgccgggtacccctccgtcgccggcactgactcccggctcaacgggaacggcgagggcctggttaccatggcgctgccgcaaggcgcgtggtcgggccgtgtggtggcgcgcacggggtgcgctgacgatggcatgtcgtgcgatgacaactgctctccgcagtgcaagaccggcaacacgccgccggttacggtggcgcaggtgagcgtgggcgggtccggcgggctggcggagtacagcgtgagcctggtggacgggttcaacgtgcccatggtggtgacgccgtgcgacttcgcggcgggggcgcagtgcccgacgctggggtgcgccgtggacctcacccaggaccaggagtgctgccccgccgccggcgccggcgccagggcgcccgagggcggctgcggggcagcggggactgaagcggcactgttcaagaacaggtgcccggacacgaggacaacctccacagacgtggaggcaacgccgcagaactgcatcgcgcccggtgagctcaaggtcgtcttctgcccggcacgtgactgcccgcccagttgtaactagctaggcgtacgtcctggtcgctcgctcacttggcgcatggaggctactgtgcctgttttgcactgcaatatgcatgtagccatgtaggtgtaccaaatggtttgaggaactaataatatagagctaatatatctagtgttaaaatgattatatacctaaca

SEQ ID NO: 3532 - DNA, 2752 bp, Zea mays
ggcctcagaagagctgaatctgaatcgctggtgctccttgcctctggctctacggttgtgccacagagcagctgctcccacgggcacagcacaactgtcttccgctatagaagtttggaatatttaaaacataaggcgaggagctgcagcgatgagttgctatatttatgctaggctgaaaggaataacataacctgaaagcttgtataaggttatttatgctaggctgctggcaacctttcaggttatatgctaggctgctggcaatctttcaggttatgttattcctttcatacttctattatagtattcattaggacaacagtcactcaaaatcattacttcattttcatttatcatttgttactctgatctcatatgggctgcctttttggaaataatgctggtgagtttcaggcctcattggaatctattcagaattcactagcagatgagttgctaaaactgacagaacaagtaacttctgacaataggagtattgcatctttatttatatgtatgcacattgggttgaaattctatgcagtagtcagtgcgtgctgttacccactaggcctagccgtagtcagtgactgcacaaccacaacccgctcttgtgtattttgcgtttgtggatcgcatcacatgttattttggtccttctatattcatgctacaaggctgcaaactgtgatgctcatacatttatgtaaccagtaacctataacgactttgatgtatattatattttgtaactgtgaacttgactatcgtagatatgtagcttgctttacagcaacatatgccactcgaacgattttttaatgtacaactgtgctacaataactgtagcgcccggtagggcgctgccctattctagtccagctttagggtgtgtttggtttgaggtcaaagtaggatgagtcgggggcgccaccgtcccctcgattttttgggatcacgccgccccaaaaatcactccggtgtccacctcgcccccgcttgactctcaaccaaacactatagaaaacatggtcgcctcattctatctctctttgtacattcaaccaaacgcacccttacatcccaccaacaccaaggctcgttctcagcccagtcaaggcctccggttcgaatacaccatgacagcgcggcccgtagtcgtgttcttgtgcggccggtgctcccggtgctccccatcacaccaccaaacggaccaggcgaggcgtcctccaggccctagctctgtggtgtgcgcctctgcgatactgcgactgcggggcgccggtgcccgtcccatcggccgccgaactgtgcgccccggttgcccactaggccactactgcagtctgcactctgcagataacacagaggaaggcggaagccgatggccgccgtggcaagccccgccctccggctccgcccgagagccgcctctacgtcggcgacctcctcctccgcccctcctcgctgtcgcttcggctccttctctcactcctgtttcaagtttgggaggtcatttccagttcagagagtcaatggaagcacgatgcagcatttcggtactctaaaagctcaagtttttagcagcactggcgaccatgatggacgatttcatattaagaggactatatgctttgctgctacggacaagcaggagccggtcgtttcacgttactcagacatgccggttttgcatgaggcagaaagtggtactaaagttacccctgcatctgaaaactcctacttcgctggcagaggtgctggaaaaccaggattcatctcttttcaagaaagcaccttccgaaagtcaactgtggagagcgtgccacatcctggcaaggaagcatctcgattagtttggtttattggccctactattctcgtgtctttcttggttcttccatctctttacttgcgcaaagtactctcagcagtgtttgaagattccttgttgacagattttcttatactattctttaccgaggctttattttatggaggagttgcaatttttgtcttcttgattgataaagtctggagacctttgcagcaagtagcaccaaagagttacatttggtcaaaatccagatttttccgtatttcctcactaacaacaatggttctgagcttgataatacctcttttaacaatgggcatggtatggccctggactggaccagcagcatcagcgactcttgccccttatttggttggactggttgtacagtttgcatttgaacagtatgcacggcatcggaaatcaccttcttggccagtgattcctattatcttcaaggtatacaggctacaccaactgaacagggcagctcagctggtgacggcactcacattttctgtcagaggaacagagacaacaaatcaaaccctagccatcatgaactcattaggagcattactgactgtccttcaaattcttggcgttatctgtgtttggtccctctcaagctttctgatgaggtttcttccctcttcagacattcctgatccctgactcctagacgttttggtagaacttttggagcgtgggcatagcttcccattgtaaattggttacacggaaccagtttcacatgtttgcaatgtttagcatttctttagggcatcttgatgcaatcttcggctgagtaattggaagagaaactgacgctggaatcaaataaacatcaaattaaaaggtccaaaaaaaaaaaaaaatccaaaaaaaaaaaaaaaaaaaaaaaaaaaaaag

SEQ ID NO: 3533 - DNA, 1170 bp, Zea mays
gccgggcccgggtgccacaagtacacaccacaaacacccatctcctccgcctctgctcccttctgctcacccgcacgatggcgccggaggcgcgaggtgaggcggcgctggtgtacagagacgcattggcgccagtggaggaaagggtgcgagacctgctgggccgcatgacgctgcgtgagaaggcagcgcagatggcccagatcgagcgcaccgtcgcgacgccgcgaaccctcacggagctcggggctggcagcgttctcaacgccgggggaagcacgccctgcgagcaagcctcccccgccgactgggccgccatggtcgacggcttccagcgccttgcgatctcctcccgcctcggcgtccccatcctctacggcactgacgccatccacggccacaacaacgtctacggcgccaccgttttcccccacaacgtcggtctcggcgcctgcagggacggagagctcgcgcgtaggatcggcgaggcgacggcgctcgaggttcgcgccactggcatccactggacctttgcgccgtgcgtcgccgtctgtcgggatcctaggtggggcagatgctacgaaagctacagcgaggacccagagatcgtgcgctcgttgaccaccatcgtcagcggtttgcaggggcagccgccagcagaccatcctcatggttaccccttcctcgcttcgcctagggagaatgtacttgcttgtgctaaacatttcgtaggggatggtggcacggacaagggggtcaatgaggggaacgccatttgctcctatgagggattggaagcaatccatatgacaccttacccggattgtatagctcaaggggtggccacagtaatggcgtcctactctaagtggaatggggagccattgcattcaagtcgctacttgttaacagatgttctgaagggcaagttaggctttaagggttttctcatttcagattgggagggcattgacaggatctgtgagccacaaaagcctcgagggtctgattatcgctattgcattgcacaatcagtaaatgcaggaatggacatgattatgatacctcacaggtttgagaaatttttggatgatattgtgttcttggtggaggcgggggagataccaatgtctcggattgatgatgctgttgaacgaattctgagggtta

SEQ ID NO: 3534 - DNA, 955 bp, Zea mays
  misc_feature (268)..(268): n is a, c, g, or t
gttccacttcccactcccatctctcccgtttctctacacttcctgacccagatggcggcggcaccctgctctaccaccttctccggcgacgtgtgggcggagctgcgcctggcctccgccagcgatgtgccgcacatccaccgcctgatacaccagatggccgagttcgagctcctcaccgacctcttcgccgccaccgaagagccgctcacctccacgctcttcccctcgccgacgccgcctcccttcacctccttcacagccctcnatcctcgacctatccccctcccccgtcgcccccgactcctcgtccaccatcgcctcccgccgcctcgacctctccgcgtccccgctcgcggaccccgaggccgccgccttcgcctccccgcgcggaggcgggcgcgtcacggccgggttcgtgatctgcttccccaactactccaccttcctctccaagcccgggctgtacgtggaggacatcttcgtgcgcgcgccctggcgccgccgcgggctcggccggatgatgctgtccgccgtcgccggcagggcggccgagctcgggatgggccgggtggagtggtgcgtgctcgactggaacaagaacgccatcgacttctacgagggcatgggcgctgacgtgctcccgcagtggcgcatctgccggctcgccggcaaagcgctggacaagtacaagggctccgccggcgggaaggctgcggctgcggaataggagggcctggaaaattgcttcttgagttgagtgtctgccaataataaaggtggcgtggatttgctcccgtctatcatggtttagataggatcggtgattgtggcaaacgttggtggattatgctaaattgtcgtctgattagatgcacaagtatgtctttatgattagccatttcagcctgaacatgcctctttgttgtcggtcggagtctcagagctgtttcaa

SEQ ID NO: 3535 - DNA, 4172 bp, Zea mays
  misc_feature (1878)..(1878): n is a, c, g, or t
  misc_feature (2115)..(2115): n is a, c, g, or t
  misc_feature (2271)..(2271): n is a, c, g, or t
tatatatatatatatatatatatatatatatataggtttacgggcacgggtacaacattttcatacccacgagaaaaaacctgccgggttgagaatcaaacccgtacccacgggtacaaactcacactcaaatctgcatcctatagggtttttacccgcggacacgcgggtaaaatgtgctcatggccgcccccgcgaaaccatatcccgcatccataatactctgttccactccccacatcccactcccatctctcccgtttctctacacttcctgacccagatggcggcggcaccctgctctaccaccttctccggcgacgtgtgggcggagctgcgcctggcctccgccagcgatgtgccgcacatccaccgcctgatacaccagatggccgagttcgagctcctcaccgacctcttcgccgccaccgaagagctgctcacctccacgctcttcccctcgccgacgccgcctcccttcacctccttcacagccctcatcctcgacctatccccctcccccgtcgcccccgacccctcgtccaccatcgcctcccgccgcctcgacctctccgcgtccccgctcgcggaccccgaggccgccgccttcgcctccccgcgcggaggcgggcgcgtcacggccgggttcgtgatctgcttccccaactactccaccttcctctccaagcccgggctgtacgtggaggacatcttcgtgcgcgcgccctggcgccgccgcgggctcggccggatgatgctgtccgccgtcgccggcagggcggccgagctcgggatgggccgggtggagtggtgcgtgctcgactggaacaagaacgccatcgacttctacgagggcatgggcgctgacgtgctcccgcagtggcgcatctgccggctcgccggcaaagcgctggacaagtacaaggggtccgccggcgggaaggctgcggctgcggaataggagggcctggaaaattgcttcctgagttgagtatctgccaataataataatgtggcgtagatttgctcccgtctggcatggtttagatacgatcggtgatttagcgcatttgatcagctcgttgtggcaactgttggcgcattatgctcaattatcttctgattagatgcacaagtatgtctttatgattagccatttcagcctgaacatgcctctttgttgtcggtcggagtctcagagctgtttcaaatgaattcctgcctttttaataacaacataaaatcctgcttgaccagggcccatgatctgttcgagtatctcaatttggataaaagattttcggatttgatggtcgtgcgtctcactctttttcctagaacaatgcaagtcttcttgtgagcattccttctccgtgtaattttgttaaattgatgaaatcgcgcacaggaaacataccggctgattggttgttcggctgggtagagcctgcaggctgagcctagcatgtatacatggacgcaactagttaatttgttacgtgtttgattttctgtaccgactcagctaggatttaatgagctcgtgtttggtttcctgtaccgactcatccaggatttaatgagctcgtatttggttttcctgtactgactgattaaatctaccctacgctgtttggttttcaggtgtatatacttgtatttgctcaaaacagaaaagaacagaaaattaaacgtctaataatcacttgtaaacgtctgattaaagatctgaggctgaaaacaagtaaattgtattaaagagtatatacaagtatatacaagcataaaacaagaaaaagatctttaaccagaaaagatcttttctgtttaacagacgtcaaaagaacagatctttaaacaagtaaattaaacagacgntgtaataaacagtaaacaatagtatgaattaaccagatttacacagatttacacaaattaaacatatgctgtaataaacagtaaaccgtaaccaaattagcctcaaaagaacagatctttaaccagatttacacagcataccaatatgaaattacacaagtctaaaattacaccaatacgcttaagtaaattgctaaactaagagacgatttttctttctcaaatcatcacacaacnggtgactgaaaacttcaaactgtttactgaaaactaagagacgatttttctttctcaaatcatagataaaagaaaactggaaatcattctaaacagctggtgactgaaaacttcaaacagctggtgaccaataagataaaagaaaacttcaaacanctgattacacaataagaaataaatcaaacagctgtgtaaaccaaacagctggttactgaaaacttcaaaaccaaatcaagtgtagccagctgatcaaacatttgtaaatatgaaataaatcaaacagctgatcaaacagctgatcaaacagctggttactgatatttacactaggacttgtaaatatgaaatagttattaatattagcctcagctcagtaaaattgatcctacatgacagtgtagccagctactaaatagtgataaaggatatagataggagtatcagttctcaaaaaccaaaaccaaatcaagtgtagcatatctgttcaaacagctgatcaaacagctgattactgaaaacttcaaacagctgattacagtgtagattacacaacagttcaagtgaatcggaatcaagtgtagcatatctgttcttaaacaccaaaaacaacaaaacaacataaatgactattattagtggctggctaactgagtaggcttaatattcacttttgttatcatcattggcataaaggacacacacatcagatcaagtgtagcatatcagttctcaaacagggaaatccataggactcagggaaacatcattgttctcaaataccaaatctgttcttaatcaggataaaggagagacacatcagataaactgttcttaaacagggaaacccatcgaactcagggatacatcattgttcttaagtagcatctagtatagatggaatagagcaagtggaccaaatctgttcttaaacagtatagatgccctaaacccatagacccatagaactcagggatacatcattgttctagacagacattgctgcactcagggatacatcagttgtggtagtgcttggctaggaaagtcttgagccataggtcacgatcatcaggagtcatgtccaggaacaccagggaggtggccttgtgctccatcatgtggtttagggcatacatgagagcctccctagagaacccaggacagttgattacaacattatacatcctcatcagtcatgaacctcttcctcttccctaagttaggcttgttatcattggactcaccaggggtacccttgtcaacagtcttccccttgttagttagattggaacaatcaacaaactttgaggtcacttcaatgccatcatctaggatgtcaacaatgtcagttggcttgcccaaaggctcatttgaacccattgcaaacttacctgtggcaaccccacttccaaatatgatttgcataggcatatagttctctatgggcctattgaggtaatcagcatcttttgggtgatcctattgagttagcaactcaagttagaacaagagaatttgaagtggaagagtggcattaacaggttagaaaaatagaaggtattggtcctaaccttgatgtaagaagcataatgaccctcttctaagcttatgacaaagttatcctgatcccaaagagcgccactaatgtccttcagtttgcaaaccttgacccacctagacctccacttacgaaggtgattgtacacttgttggcctgttacttcttggccacagaactcagatacatttttagcaacagagttaaggtggatttccttaaaacccttgtcagtcttaaccccatttcctatcaagtcaacaaaacaacggagaacaaacccagacattacagcagtccacctaagagcaggcctagccccctgaccagcaacctcagagaccatgtcagccatagctggaacaaagtaaagattagggggagatagagattaggggggagatagtagaagtagaagaaatagcagagtagcatagaagtatatagatagtagagtagcatagagagtaacaaagaagtatgacataggaaagtcatc

SEQ ID NO: 3536 - DNA, 2222 bp, Zea mays
gcacgagaccattacctagaacatcctaatcaaaaagcctctgctccctactccacagacgcgcgctcgtgggtccctcgaggccggccgggactgtctcccctgtcccctctcccgcgtgctcgtctaccttcggctcccccatgggatgagagcgccttcctcgccatggccgcctcccacctgccccccgcagccaccctcgtcaagaagtacccaactctcctccacccgttcggcgccaaaccacacgcccagaggctgatcttcaggtgccgcgcgaccagcagcgagggtgcggacgatggctgggcgtcctttgtggacgagctcaagaggtcgctgcaggtggacccgtccgacgcggtgattagcaacgccggcgcgggtctcacatcaaataacgacctcgtcaccgcgctgccactggaaccctccgctggtccggctgcgggagacgcgaccactgccgctgccggcgcggtgagcgagctcctgggcgtggacgcgtcaggcgcggtggccacccccgaccgcctcctgagctccctgctgcacctggacgcgtccaacccggtggcgagcgtggcgggcggcgcgctgtctcgcctggacgcgctcacgtcgggactgtcggacgcgcagcggtgggcgctgttcgggttcctggccgcgacgtggctgtacctgaccgcgcggcccggggtgctgagcggcgccgtggacatgtacgtgctggcgccgctgcagctggcgctggacagcgtgctgggccggcggagcctcaagatgagcgacttcgtcgtcggcgagcgcatcggggagggctccttcggggtggtgtatgccggcgccgtggtgccgaagaacggcgccgtcgtggaggagcggtccggcaaggccaagacgagcctccagaacgacgacaggtacaaggagaaggtcatactcaagaagatcaaggtcatgacggtgggggcgaaggagtgtggggactacgaggagtggttcaactaccgcgtgtcgagagcggcgccggagtcgtgcgccgacttcctcgggagcttcgtcgccgacaagaacaaggcggagttcgtcaagggcggcaagtggctcgtctggaagtttgagggcgacaggacgctggccaattacctgagcgagcgcggcttcccgtccaacctggagcgtctcatgttcgggcgcgtgctgcagggcctgggcccgctggagcgcgaggcgctggtggtgaagcaggtgatgcggcagctgatcacgtcgctgaagcgcatccacgccacgggcatcgtgcaccgcgacatcaagccgtccaacctcgtcgtgacccgccgcgggcaggtgaagctcatcgacttcggagccgccaccgacctccgcatcggcaagaactacgtgcccgaccgcgcgctgctcgacccggactactgcccgcccgagctctacgtcctccccgaggagacgcccgagcccccgccggagcccatcgccgccatcctctccccgatcctctggcagctgaacagcccggacctgttcgacatgtactcggcggggatagtgctgatgcagatggccataccgacgctgcggacgcagtcggggctcaagaacttcaacgccgagctcaggtccgccggctacgacctcaacaggtggcggcagagcgcgcggcggaggcccgacctgcagatcctggacctcgactccggccgaggctgggacctcgccaccaagctcatctcggagaggggcgccaacggcggtggccgcctgtctgccgcggccgcgttgcgccacccgtattttctcctgggtggcgaccaggccgcggcggtgctgtccaagttctcgctcagtaaatagcatccatccatggcccatggctgggtacctacgacctacgggatatatacacatcggcttattggaatcctccgatcgattcaccatccttgtatattgcgcattattgaatccttgggcataccataccggcagtgggaggcatcccaaattcaaaagggagtcatctggtaactgatgttacaacttttctgtatgggaatgctgtgaacaatgtggtgcagagtttcataaaaaaaaaaaaaaaacattatgctagacagagatcctacttcctttgcttcagttcctcgaatctatgcagatgcagacactcgcagagagagctcatcaactgg

SEQ ID NO: 3537 - DNA, 489 bp, Zea mays
cgagagacgggcagcagcagcggcctgacctgcgcaaaaccccgccgctctcatcttgccaaaaccccaagaagccgcagggggacggaactccctccccagctttttccccagaggaagcaaccgcagaggaggagaagctgcgcagaaggggaagcggcggcggcggcggcggcggcgtgtaggctgcgcagagagagagagagagagagagccggcagggagggagcgtaagctttttggcagtggtggttctggaatgcagcagcaacacctgatgcagatgaaccagaacatgatggggggctacacctcgcctgccgccgtgaccaccgatctcatccagcagtacctggacgagaacaagcagctgatcctggccatcctcgacaaccagaacaatggcaaggcggaggagtgcgaacggcaccaagctaagctccagcacaacctcatgtacctggccgccatcgctgacagcgagccgcc

SEQ ID NO: 3538 - DNA, 747 bp, Zea mays
tcgaggcagccgccggcccggcccccactcccggccgccgccaccacttgctcgcctttgccccttccccttctgtcacccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctctgccaaccaaccggtgggaaggccaggctcaccgaggggtgctccttccgtcgcaagggcgattaggtcctgcttctcttaacgtgagaagagataaatttggtgttttgcaactttctcaggatatgtgctgtgctcggtgaggattttgttaattattatggctgttagcgtggcctgacaatgcttgtgtaaacctgcactttgtttgagcgtagtgagacagctaatatgggtcaaggcaaatgaaatcaactggtggcgttatttgtcagggtttaactgaaagtgccatttgtttggttggcttggataatgctttccatttaggtggcgttcggttcagcaaacacagtggtaatggtaacgtaaagaaaaaacagcactatttgttacaatgtaatgattaactgaccttgtttgg

SEQ ID NO: 3539 - DNA, 660 bp, Zea mays
gccgccgccaccacttgctcgccttcgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtggattgcgggcgcggcggcggcttgagaggaacaggacggtgggagacagagagggggtgtgtggtggcggcgacgacgcaggagaggaaggtggaggggcgtggtgtcatcgtggcatcgccgcagcgagcaagtaggcgcgaagttagatcagaacgggttcggatcaaattatattgatatgtgcctctctaatggatacatccgatcattttttttaattgagtcagatctttttagctttgggttagatttgattttagatttttaaaaaagttggtctgtgtccgatcgaccaatcgatccgtggtcaaaaatatggtttgtgtctgttcgtagaatttgatcggttggattgaatttttttcaagcgagttaaaacaaaaaaaaaaaaaaaa

SEQ ID NO: 3540 - DNA, 2628 bp, Zea mays
cttgtattaatattaatatctgctcttatgcctgtttggagactgactctaatcatctacttttttcgtttttcttctccctttgtgtccaggatgtcaagtgccagggctgtttcagcatgtaagggttcttggctcttgctgttgttttagtatttggttacttcaattgcaattgatatcgacgctgtgtcatttgatttttacattgaatgtttagcatgcccagtttagtagtaggtactagctagttgatatgttaaaattacttaagaaacctgtacaattgcattctttttggggtgggggtaatagttggtaacaagggtgaagcaacacttttggattataatcagtctgggatggtagcaggctagactgaaagcaacctgcaaaactaagtctaaactaagcctggatgttggtttgtgggctagtctgctctcatcacagtatgcatgtgaagaaaataatgttgattggtactgattctgatcttggtgcaaattgcatattttagttagtttctagttttgctgatataagtatgtaggtcactcatttgaatttggtacaataattgcaattgatagtgatggctagcttatttgatttgcttgctctttggaatgatgtagaaactgtatcttggtcaaagttgtttcactcagctgttgtttcaaggaggttgagagatgacacaccttgccccacttgcatccctaatcacagcattcatgtgcagaaaaaaatttaattgatactgaaactgatcttggtgcaatttatttgcaattgatagtgatatcagttgatttgttcatgagtaggtcttccgtgtgttgtgatggctagcttgtttgatctttgtagtgggtgtgcaaacagtattttggtcaaattcagctgatgttccaaagaggttgagtgatcacgcacctagcaaatgtttggactgctaagctttcttgcaattatctgtgatatttaaacattatcctttgttgaaggtgattacaagttgtatggttcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtgctccttccgtcgcaagggcgattaggtcctgcttctcttaacgtgagaagagataaatttggtgttttgcaactttctcaggatatgtactcggtgaggattttgttaattattatggctgttagcgtggcctgacaatgcttgtgtaaacctgcactttgtttgagcgtagtgacagctaatatggtgctgtttggcttttgctgagggagtggcaatgcaaatgaaatcaactggtggcgttatttgtcagggtttaactgaaagtgccatttgtttggttagcttggataatgctctttccatttaggtgatgtttggtttaaggatgtaaatggtcggtaaaattcggtaaatttctggtaccgtttaccagatttttccgaccgttttcagatttttcgggatatacggaaaacgggacggaaacaggatgtgttattacgaaaacggtacggtaaatggtgagacatatttaccgtccgttttcggaagttttgggaaaatccggtattttcccgtattttaaccgtattttcccggtcaaaagaaaacaagagaggcaagaactatacccgttagggtttagagattagggttttagatgtcatagaagatatatcaagtgatccagacgacatgccacatgatttttagtttatgtatcgtgtgtttaagacttatatactatgtggataaaacttccgtgaacatgtatgattatttatgtgtggtcatgactatgtattgtatatttgtgtggttgagacttgtatgtgaatgtgaatgaacaatcgtgttttaagacttatatatgtgttgtgtgttaaaatttaagagtggacatgtatgagtgtatgaccaattatatgtggacaagattgtgttttgtgtacttttgtgaatgagacttgtatgtggatgtgaatgaacatctgtgtggttaggatttgtttattgtgagcttttccgattatagttaccgtttcccgatcaatttcgagctattttgctcaaatttatgcgttttcaatataccggaatttaccggccgttatccgtttccgactttcctgtttaccgcttccgaccgaacaaaaaaatatgcacgtgaaaacggtgaggttttttccgaccgttttcacccttagtctcgaggctcaaagaagttgagaaatgctggaaactctgaacagtagcagcaacaatcgaaccagcgagacgctctaatgcgtattgcacaacagatagttaaaaacaataccaaatcaaaatacaatacacatatactctttcaaattataagatgactcggcttttctagatgtatattttttactgtaggctcaaatatacactttatctaacaatatatacataaaaagtcaaaacatcttataatttaaaactgacagttatttttacaactgcag

SEQ ID NO: 3541 - DNA, 697 bp, Zea mays
ggccgggggccccctcgggccgcccggcggcggactccccgccgccgccaccacttgctcgcctttgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctctgccaacctaccggtgggaaggccaggctcaccgaggggtgctccttccgtcgcaagggcgattaggtcctgcttctcttaacgtgagaagagataaatttggtgttttgcaactttctcaggatatgtactgtactcggtgaggattttgttaattattatggctgttagcgtggcctgacaatgcttgtgtgtaaacctgcactttgtttgagcgtagtgacatctaatatggtgctgtttggcttttgctgagggagtggcaatgcaaatgaaatcaactggtggcgttatttgtcagggtttaactgaaaaaaaaaaaaaaaaacgacgcctagggcccaaaaaaaaaaaaaaaaaggcccctagggcc

SEQ ID NO: 3542 - DNA, 830 bp, Zea mays
ttgggcactcctacgggccattgggtccctcgaggccggccgggactccccgccgccgccgccacttgctcgcctttgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtgctccttccgtcgcaagggcgattaggtcctgcttctcttaacgtgagaagagataaatttggtgttttgcaactttctcaggatatgtactcggtgaggattttgttaattattatggctgttagcgtggcctgacaatgcttgtgtaaacctgcactttgtttgagcgtagtgacagctaatatggtgctgtttggcttttgctgagggagtggcaatgcaaatgaaatcaactggtggcgttatttgtcagggtttaacaaaaaaaaacaaaagtttggttagcttggataatgctctttccaaaaaggagaaaaaaaatttaacgatgtaaatgggtcggtaaaattcgggtaaatttccggtaccggttaccagatttttccgaccgtttgccgcctttttcgggatatacgggaaaacgggacggaaacaggatgtgttattacgaaaa

SEQ ID NO: 3543 - DNA, 927 bp, Zea mays
cccggtcgacccagcgtccgctagttctagaacgcgagcggccgtccttttttttttttttttgccactcatacgaatgatgattaagatattttctctgatttgtgccgcaaatccatccgctctctcaaattctagtatacagtacaccgacatacataacatgacaacatgacccgtcacccgtcgctgcgaataccggtggtgcggtgcgcgttcttctgcacggcgacggcaccggcgagtgcgccggagtcacccacagcctctcacaggaatccgtctctgcggtcttgctcctcggcctctctgttggccgtctgcacggccttgaaccacagaaacgcggaggtcgggatgccggtgaagacgaagaagcccaggagcggcgcgtacaggacgctgtcggggccgacgatcccgaacaccggccgctggttggtgtactcgaagatggagccgatcgcggcgatggcggtgatcgtggacgcgagcaggtacgcgtagaaggggacctgccgggcctcctgtccacgcgcggccccgccctcgcgctcccagggtggcggctcgtccgcgccgggcttggcccacgcggggacctgctcctccgcctcgcccggcgtcttgcccgtcgcggccaaggccgtctgcagcctccggcgcggcgacggcctgcctaggagcggacgggcctggggcctcacgttcggacagcccgtgctacgccttgaggacgtgcacacagaggtggagacggccaccgctgcggccgccatggagacgagacgagcttcttcgctcggcgcggcgcggcgcttggagaatcgatacgagaggtggtcccgcccggacggctggcagatggggaagtggataggaggtgggcgggcggtgactcggcccgcgttcgtgagtggctaggac

SEQ ID NO: 3544 - DNA, 2000 bp, Zea mays
cctgccgggccccccaaaccccccgaccaagaggattcgaggggaattaaaggagggcgcggcggtggcgagcaccttccgctcagcgaggtagctgcacctgcaccggcgagctagccgcggcctctatgctcgcggggatctgaactagccgccgctgccccatcgcggcgatgactgcggcgccctctcctcatatcccattcccaacacaacactcattttctccattcccacgtaaaagatagaaaggcgagcatcgcagtgcacacgcgcaatggaaggctcgccggtggcgcgcctcccggaggctaattctctccccgacggcttcgtccccgacagcgagagctcagacacggacgcggctcctccctcctccgcgcccatagttgacgatgcaatcgactccgatagtcccgacgccaccaaccccggtggtgaggaaaccctaagtgatccctcccttcccgcgtccaccgccgaagatgcctcctcagccgccgctgctgaagcattggacacactttgtctggacgttgttgcggatccggagcgcgctctaggggagcacggacccaccactgctgcaagaggtgaaggatccttgaaggaaaatcgtgcatcagagcaagtgggcgctccaagtgatcaaaaggtggtcaaggggagcggtgagccaaaacgcaaggtcatcaagcatagcaagcttgagaaggacaaagagttatttcaactagcccagcaataccacaaagtggttgcagaaagggatcaagccattgcagtcaaagatagactagaatctctttgtagggaatttcagcgtcaaaacaaaatgctaaaggaagagtgccaaagggtatcgacagagggacagaacatgcgtacggaattgtctgaaaaatttgatcatgccataaagggtgtcagtgccaaacttgaggagcagagagttgagcgcatttctcagctagaagagaacaatacgttgagaagtaaactgaaagaccttgctgatcaatataacattactcagcagaaatatgctcaccaattgaaagagaaaatgctggaacttgaacttgctgatctgagacttcaacaacatcaagagaaggctgctcaggaacatacacaaatgcagttgtatgctgaacaagtttctcagcttatgactactgagaagaacctgcggttgcaactagcttctgacggggaaagatttcagcactttcaggatgccttgtcaaaaagcaatgaagtctttgaaacttacaagcaggagatggaaaagatgatttcagtgataaagaatcttaagaaggagaacgaatttctgaagggaaaatgtgagaactcagatattgctattgtgaagctcattgaagagcgtgagctaacaaagaagcaaatagagaaattgaaaaatcaaagggagaagctcgaatccctgtgtcgaacactacaggcagaaaggaaacaaggcccctccgccagtattccagatgccccttctagccaagaagtgtcagcgacaagtcaagaatcttaacattccagttgccccttctagccaagatgtgtcagcaacaagtcaagaatcttggcagttgtgcttgtcaatataccgttggtgccagctacagcttgcggagatttctgaagcctgacattcagctgtcaacctaccgtccgtctcaggccttttgatattgtggctagagcctagtggtgcattcctactcggtgttgttaccaagcatataagctctcggctgattccatctcttgtttttgtttgagacaaagcctgctgcattggagataattagatttttgccaatcataatattgtcttcttgttataattaccactgtgtctatgaattgtgggtctagctgggtctatgaaatgtgagtctgatgacaattttacaaacttgtttcttgctgatggtaaatatcagaatctctcgctgctaaaaaaaaaaaaaaaa

SEQ ID NO: 3545 - DNA, 1803 bp, Zea mays
ggccgggccgggactgtggcgctcactcctcatctcccggttcctccacgccggccgatatttcccaccttcccaaacgccacttaaaagagaaaggagagcatcgcagtggcacacgcgcaatggaaggctcgccggtgacgcgcctcccggaggctaactccctccccgacggcttcgttcccgactccgagagccctggcacggacgcgacgtttcccttctccgcgcccatcgttgatgatgcgctcaactccgatatccccgccgcgaccaacccaggcggcgaggaaaccctaaacgatccccccctccctgcgtccagcgccgaagatgcctcctcggccgccgctgctgaagccttgggcacactttctctggacgctgccgccgagccagaacgcgctctagaggagaacggacccaccggcgctgcaagaggtgaagcatccttgaagaattgtgcatcagagctagtgggcgctccaactgctcaaaaagggagcgttgagccgaaacgtaaggttgtgaaacgtagcaagcttgagaaggacagagagttgtttgaactggcccagcaataccacaaagttgttgcagaaagggatgcagccattggagttaaagaaaaactagaatctctttgtagggagtttcagcgtcaaaacaaaatgctaaaggaagagtgccaaagggtgtcgacggagggacagaacatgcgtatggaattgtctgaaaaatttgatatcgccataaagggtgtcagtgtcaagcttgaggagcagagggttgagtgcattgctcagctagaagagaacaatatgttgagaagtaaactcaaagacattgctgatcagtataacattactcagcagaaatatgctcaccaattgaaagagaaaatgatggaacttgagcttgctgatctgagacttcaacaacatcaagagaaggctgctcacgaacatacccaaatgcagttgtatgccgagcaagtttctcagcttatgactactgagaagaacctgcggttgcaactagcttcggatggagaaagatttcagcactttcaggatgccctgtcaaaaagcaatgaagtctttgaaacttacaagcaggagatggaaaaaatgattttggtgataaaaaatcttaagaaggacaatgaatttctgaagggaaaatgtgagaactcagatattgctcttgtgaagctcattgaagagcgtgagctaacgaagaagcaaatagagaaattgaaaaaccaaaaggagacacttgagtccctgtgtcgatcactacaggcagaaaggaaacaaggccgctccgccagtattccagacgccccttctagccaagaagacatgccagcgacaagtcaagaatcttagcatatgtgcttgtcaatattccgttggtgtccgttacagcttgccgggacttctgaagcctgagaaatgaatatgttactgatatcttgttttgcttgagtttgcggaagttctggtcccatttaacacatactcagctgtcaacctactcaggcctttggggattgtaactataacctagagttgcattcctctacaagtaactcggtattgttactaaccatataagctatccgttgttccttgttttttgttcgagacaaaggctgttgctggtaaatgttaccaatcatataagctctcagtcgttccttttcttgattttgtttgagacccgctgttgcattgtgggtgtgttggttcctctgatcttttgttcccgttttgtccctaattaatggcctttttgttc

SEQ ID NO: 3546 - DNA, 1980 bp, Zea mays
catcttctatagccagcatgtcacaaaaaaaacgaacaaggatctgaactagccgccgctgccccatcgcgccgaggactgcggcgccctctcctcatatcccattcccaacacaacacttattttctccattcccacgtaaaagatagaaaggcgagcatcgcagtgcacacgcgcaatggaaggctcgccggtggcgcgcctcccggaggctaattctctccccgacggcttcgtccccgacagcgagagctcagacacggacgcggctcctccctcctccgcgcccatagttgacgatgcaatcgactccgatagtcccgacgccaccaaccccggtggtgaggaaaccctaagtgatccctcccttcccgcgtccaccgccgaagatgcctcctcagccgccgctgctgaagcattggacacactttgtctggacgttgttgcggatccggagcgcgctctaggggagcacggacccaccactgctgcaagaggtgaaggatccttgaaggaaaatcgtgcatcagagcaagtgggcgctccaagtgatcaaaaggggagcggtgagccaaaacgcaaggtcatcaagcatagcaagcttgagaaggacaaagagttatttcaactagcccagcaataccacaaagtggttgcagaaagggatcaagccattgcagtcaaagatagactagaatctctttgtagggaatttcagcgtcaaaacaaaatgctaaaggaagagtgccaaagggtatcgacagagggacagaacatgcgtacggaattgtctgaaaaatttgatcatgccataaagggtgtcagtgccaaacttgaggagcagagagttgagcgcatttctcagctagaagagaacaatacgttgagaagtaaactgaaagaccttgctgatcaatataacattactcagcagaaatatgctcaccaattgaaagagaaaatgctggaacttgaacttgctgatctgagacttcaacaacatcaagagaaggctgctcaggaacatacacaaatgcagttgtatgctgaacaagtttctcagcttatgactactgagaagaacctgcggttgcaactagcttctgacggggaaagatttcagcactttcaggatgccttgtcaaaaagcaatgaagtctttgaaacttacaagcaggagatggaaaagatgatttcagtgataaagaatcttaagaaggagaacgaatttctgaagggaaaatgtgagaactcagatattgctattgtgaagctcattgaagagcgtgagctaacaaagaagcaaatagagaaattgaaaaatcaaagggagaagctcgaatccctgtgtcgaacactacaggcagaaaggaaacaaggcccctccgccagtattccagatgccccttctagccaagaagtgtcagcgacaagtcaagaatcttaacattccagttgccccttctagccaagatgtgtcagcaacaagtcaagaatcttggcagttgtgcttgtcaatataccgttggtgccagctacagcttgcggagatttctgaagcctgacattcagctgtcaacctaccgtccgtctcaggccttttgatattgtggctagagcctagtggtgcattcctactcggtgttgttaccaagcatataagctctcggctgattccatctcttgtttttgtttgagacaaagcctgctgcattggagataattagatttttgccaatcataatattgtcttcttgttataattaccactgtgtctatgaattgtgggtctagctgggtctatgaaatgtgagtctgatgacaattttacaaacttgtttcttgctgatggtaaatatcagaatctctcgctgctttgtgagtgtgttaaaaaaagatacaaaatgctatagaaaaaaataaaacaaaacactcaacaatgcatgctaataaaaaatgatacaaaaggacaatagcata

SEQ ID NO: 3547 - DNA, 793 bp, Zea mays
ggggcatcgttagaatcagccttacacgagacagaattcagggaaaggaggagggagggcgcagcggcgacgagctcagcgatacagcggcaccggagagctagccgcggcctccatgctcgcggggatctgaactagtgccgctgcccaatcgcgccgacgactgaggcgcccactcctcatatcccatttccatcactcgtttctccatttcccaccttcctaaacgccacttaaaagagaaaggagagcatcgcagtggcacacgcgcaatggaaggctcgccggtgacgcgcctcccggaggctaactccctccccgacggcttcgttcctgactctgagagccctggcacggacgcgacgtttcccttctccgcgcccatcgttgatgatgcgctcaactccgatatccccggcgcgaccaacccaggcggcgaggaaaccctaaacgatccccccctccctgcgtccagcgccgaagatgcctcctcggccgccgctgctgaagccttgggcacactttctccggacgctgccgccgagccagaacgcgctctagaggagaacggacccaccggcgctgcaagaggtgaagcatccttgaagaattgtgcatcagagctagtgggcgctccaactgctcaaaaagggagcgttgagccgaaacgtaaggttgtgaaacgtagcaagcttgagaaggatagagagttggtttgaactggccccaacataccacaaagttgttgcagaaagggatgcagccattggagttaaagaaaactagaatctct

SEQ ID NO: 3548 - DNA, 1156 bp, Zea mays
  misc_feature (3)..(3): n is a, c, g, or t
ggnaggtgaatctaactacttgcaagtggaggggaagactgcaccattcgtctatggtctatgagtacgagggcgaaaaacacccactaatagcaacatttcatgggcatgaaaggcactgtcatttttatctgttgcgtggcataaatcgtccctgttggtgagctgttccaaagactcaaaggttaaagtttgggacacagtggctccttcgagtggttcatcatcatgtgtaggcagtgctcacctcaactcaaacggtccaccaattgctatgaaatgccatgaatccctttgctatatcgctgctggagctgaagtgacagcgattgacttgaggacaatgaagaaggcttctgtccttgcactccagaaccacagaatactttcttgtgagatgatgccttctgaatggttaatatgtactggcacgaaagacagggctcttctgtgggacatccgcaaggctcaggaactcccaaacacagtggcggagatgcaatcgaacggcccggtgacattgcttcacttggaccaatacaaggtggtgaccggagtgccgtcggacggccaggtccacgtctgggaaacacggacgggggactcgctgaacacgttgggctgtggcgaaccttcgagactgggcgtgcggagcagggtgtcggccatggccgtggacgggtgcaggatcgccatggcgggcagctctccggaaggctgcatgctgcactaccgtgacttcgcgacggcttctgcccctgtagtgtccttgccaggcaaggagaaggaggtctccaggttctggaggccccaggaattcgacgacagcgaggaagaggagtattgattaatcattacatccccagttccaaattatatgtcactttgacttttttttacgtaaattttgccatgcatagtaaaattgatgtcccaaaaaaagagtcaaagctacatagtttggaactgaattagtattacgctatctcggtgagcttccagttctgctacatgcagacaagagaaacgcttgtatatataaaaagaaagaaaggtatgtcaactgggcctgggtccgcggcgtgcttgcaggatgctagagctagaagtaataccagaggttgcattaccatgggcgccgcatgtgttggtcgct

SEQ ID NO: 3549 - DNA, 830 bp, Zea mays
tcgcgatctagaactagtcccacccttccccttcgtctcaactccctccatccaatccaccccctctcccccttctcgtcgtcgccgccgccgccgcccacccggggcttggactgtcctttccccgttctgctggtagtgggtggatgcgtctttgactgcccggcgcccgcccgcaccccgcagcagcaatggacgacggggacctggatttctccaacccggacacgtacctgtgtccggccctcggcaccgacccgcccagcagctgctccatggacagctacttccgacgagatcctcaaggacacggagcacctcgcctgcacgcacacccacacctgcaacccgccggtgcacgacctctcgcacacccacacctgcgtccacgtccataccaagatcgtcgcggcctcgccgggcgacgccgagtcgccgtccgagaacaacagcaacggcaacgccgcctctaagaagcgcccgtcgggtaaccgcgccgccgtcaggaagtaccgggagaagaagaaggcccacaccgcatcgctcgaggaggaggtggtgcacctccgggcgctcaaccagcagctcatgaaaaagctccagagccacgccgcgctcgaggcggagccggccaggctccgctgcctgctcgtcgacatcaggggcaggatcgagggggagatcggtgcgttcccgtatcagaggccgccggcggtcaagaacgtcgacctccctgtctagtgttgaccaggaaagcctccttggcagcgctgctgcccggttgccaactcctgtgattttagatgaaccatcagatgtactgcacccct

SEQ ID NO: 3550 - DNA, 5814 bp, Zea mays
  misc_feature (4781)..(4781): n is a, c, g, or t
tgtcacactaacagtaaaaataaaggttatttattggggtttaaacgttagtaattgctacaaagtatcataatttatatggagcacatccagtttttattgatgcctgactttagaaatcactccatattttgatctatcttttttataagtttgagttcatgtgacttattttagaaacttgagctcacaaattttctcttatttagtctatgtatggtggaattatgtcattttataatctctgttcgttcagtcagtcgttgtgaactcttttctaattgctcacttcattggtcgtgttgtaccaatacatattgcatggagtaaataataacatcagttagccaaatcaaaaaatattatactgagagtggagacaattgataaaaaatcttgaattttttaagtgaatagtttacgtgggtattgttgtaaccgtcgcaacgcactggcaaccgactagtataattaatagttcatctattaactactcactcctttttttatttatcgcggtttagttaaaatttcagctactaactactcacttcattttttatttatcgcggtttagttaaaaataaatagcggatgacgaatatttgagaataaatgcagtactttttagttaattagttaatagttagtttttagctagctaattttatcagtaagtttttaacaactaactctagtgtatttaatcatgtcctaaaccagtaatccgcatatacaatcgcgatgaccgcgtagacgacgaccagcccacccgcgtctgctggccccccacggccacggtccaccagaccaccaccacccattcgtctgggctccatgtccatgggtatggtgatgggccccagagattcccctccgcgcacacaaggcccaacacgtccccgtccagattcatccaccctccccctttcccttcgtctccgtccgctcccggcatcgtcccctcttccccgtctcgcggtcgccgcccacgggcttcgattgatcttcttccggtgctggtggcaggtaaggaacctttccctatcctcggttcgatggattcgctcgttcgttttgtctccggttgaatccgatttttttccacgttcccaggtggacggatcgtgtccttgcttggccgcccacagcagcaatggacgacggggacctggacttctccaacccggacacgtacctgtgcccggcgctcggcactgacccgcccagcagctgctccatggacagctacttcgacgagatcctcaaggacacggagcaccacgcctgcacgcacacccacacctgcaacccgccggtgcacgacctatcgcacacccacacctgcgtccacgtccacaccaagatcgtcgcggcctcgcccggcgacgacactgccgactcgccgtccgagaacaacaccaacggcagcggcggcaacggcagcaacgccgcctccaagaagcgcccctcggggaaccgcgccgccgtcaggaagtaccgggagaagaagaaggcccacaccgcgtcgctggaggaggaggtggtccatctcagggcgctcaaccagcagctcgtgaagaagctccagagccacgccgcgctcgaggcggaggtggccaggctccgctgcctgctcgtcgacatcaggggcaggatcgagggggagattggcgcgtttccgtaccagaggccgccgccagcggccaagaacgtcgacctcgtgtccggtgttgaccaaggagggttccttgccggggctgctgcccaggttaccagttcctgtgatttcagatgcaacgatcaaatgtactgcagccctggaatgcagggcgctgttggcggccaggtgttgggacaaggtgcctgcgatgtctcgagtatccaatgcgttggaagcaccaggtctgcgtccactaagctacctgtctgcggggggatggatgcagtacctgctgcctgcttgccaaatgttcaaaacaagtgacggtacataactttcgtttccctgctatgcttttaacaacttctgtctagtggctagatgtattagtttcagtcattgttttgttagcaatccgtaaatgcatttaagctcgtgattgtatatatcgctcagtagccttctgttatgtgtaggattatataactgaagaagaatataactcggctctcttgtcgccgagccattgttttgtggttccattggtttccttctgtctggctgaatgcaattttgagtgaattgccatctaattgtcaacgatgaagatcagatttgcttctgtcccatcctgtcaatccagagctagacttgctcttgtctattttcagccggatgtcttgtgccccttttaaaggcattgctagtcttgttgacacaccagaaactaagatgctctgtatgaatcaactggctgtttattctctgagatttgagaaaaattcttattagccttcttaagtctatttatcatgattattgtgtaatcatggtgtatgttgttgtttattcattttgctgtggcctattcaatttgttgtggcctgattgaatgtatttttagtgaatcggcatcttatcatggaagggcaggcctgatgcacgggatttgtcttactgagtcaccaggtcgcgggttctaagcagggaggcttgcctcggtttatcccttccctagacctcactcatgtgggagcctccgacactgggtttgtcccctttagcaccttatcattactgaagatgagattcctggcgattctgattttttcaaatccatagctagagttttattttcaattggatgatttctaccttttcagacctcctaggccatctatgtctgcttgaaaaaaaacagcattatccattttatcgtgcttttgtatacatttattagtttcaagcaccaaaactattttaaacatggaaataacttagcctgggtttcagctgttagtattcaaggctcaagccatggtactgttttgacctaatagagtagcacttgttttcgacatagtcctatactcccatatgtagctgctgccggtagttgagcaaaagcaggaagtaaaaaaaaattcctacatgctaccaacgcctgcagtgcacctcgcctgcagttccatgctttgaaagaggtcaatgcattcagtttatgggttagttagatttatagtcagggagagccacatttagttgtttcatgtttggtcaattgagcaattctgaagtacattggatttttccccttgacaatccagatgtgagctgtgacggagccattttttggtgaattatgataccagaaattagtaaattaggacactacattgtgcttgtttcacgaaaaaaaaagaaaacatatttcataaaataataattaggacattgtaccatgctaccatatagcagtattatagacatcaataacctccaaattttgctacttctgaagagtattttgttttacagtgattttgtattagctattggagactgtaatacttgggttggtgtctaatctttttttgtgtggaaatatatattttttgaaagtgttaagaacagtacatcaagaagatacaaaggtttagctcagaaaacttctggcctctactaacacgcacacagccaaaaaggcgaaaaaggggagcaaataccaagcacatctctaatgaccttcaatctgtagattagatcgtcgagcggccgcccgggagaggaaaaccttggccgtttgcaccaaaagttgcgatcctgccacaacccgctcctacaaatccgactgtcccagtatagtgtgttcccagttttaaaggcagttctttaggtcgtgccatttgtttatcatgcagagcatctgtttttgttatgaaatttaatacaattatttttggtatgtccatttgattttcagttactggactgctgtgagtcgttggtagaatttgttaatgaatgttcgtactgctcagatcttgcaatggaacttattcaagaaaaaaaaaacaggatatgatgtcttattcttcaaatagtcctaaggtgtagccatctggataagttcatatatgtacctaaacactcgatacccccctgtctgcataatttacagcaaataaacctgatacatgttcccgctgctaggaactttccaagttctaaacgcacaagtaacactaacacatgttctattgctcttttttcaggactcccggcagtgtttatggtcccttccttttcagagactgctgggacttcccgttctgcctcgaaggaacgctgtataaaccgctagcttttctatgtagggccgaatctggttcaaactgctacgtgtgtgagttcgtcgtcgccgatgatgcttctatagtgcctgaggcgattcaagtttgttagctctagagctgataggatatcctcgtttactttgcttagttctcagatgctctccgtctccgatgaagtgcagcaactgaaccggatccgaaggagttggacatgaacaggttaaaatttggcatatgtggtctaagaagacgctgagatgtttgtagcgaatctcaagttcaatgcgaacccctgttgcctatgtatattcacatcctttgtgtaggtgtcatgtctctcttctgttacgtgcgtggatctgagggaacccccaaaagtttaattgccggctggttcaattgtgtctgtctagacccaattgtggatctgatgaacagaatatgtgccggatagcgctagaaacacatcagcctgacgctgnagttcactagcataccagatgggttcagaacttcagatgaacagaatggtagcccgctttccctcttagactatctccaataatattctctgtatctactctaaaagatttagtcttagccctctacacgttaaggtcatgttttatctagatttctgtacccttacggaatgaaagtgggaacgccataaaagcaagtttaataatatagtcaataataggtaattaaaatcctacctatataattactctctaatatgatatgagaggtatatttaataactggtccacctctttctctcgtaaactgttctggagtggagtccgtgaatctctctcgtaaactgttttggactccgtgaatctctctctcgtaaactgttttggagtggagtccgtgaattgctgactttcaaattaagagtgggtgttcaggttactcgaaaattttaggtcaggtaaattttgggtttttgagaatcgctacctgaatttacaacggtttttacaatatctgaaaattcgggtatctagcctattaaattagtataaaaatatagtttaaatagtgatatatatggacataaaaaacacaagcaatctacaatcacaagtcatgtacacttacacataattatagatgcacaaaatagtaattaagaatgacattagtatatgacacataaaagttcggataattcaagtattttaggtacccgattatgatactcaaattacccgaaataaaattgggttttgcaagttgctacccgaatctcccgaatgaaatttgggtttcggatatttcgagtttgggttacgagtttttttgcccagcgctatttcagctgcctactagtgaacagcccgcttttctttctctctccatttctctttcttttacgtcatcataaatctgacatatcatcttttgcagtccacctatatcaccttattatacttgccctaaggctgtctctagcagctaactattccaaacttcaccacgtaaatagtataatctatagtacaa

SEQ ID NO: 3551 - DNA, 1840 bp, Zea mays
  misc_feature (22)..(22): n is a, c, g, or t
cctcgaggggccggccgggaanaaaaaaaaaaacaccggccgccgcctacgcgcccaccacgtccccgtccagattcatccacccttccccttcgtctccctccctccatccaatccaccccctctcccccttctcgtcgtcgccgccgccgccgcccatccggggcttggactgtcctttccccgttctgctggtaggtaaggaattcctcttctggctccgacggattctctcgctccgtttgtctctggtacaattcgttcgctgctgcgagccctcgaatccgtttgtatccggagcagcggcggagtagtaatactagtacaattccttagtcgtgttcccaagtgggtggatgcgtctttgactgcccggcgcccgcccgcaccccgcagcagcaatggacgacggggacctggatttctccaacccggacacgtacctgtgtccggccctcggcaccgacccgcccagcagctgctccatggacagctacttcgacgagatcctcaaggacacggagcacctcgcctgcacgcacacccacacctgcaacccgccggtgcacgacctctcgcacacccacacctgcgtccacgtccataccaagatcgtcgcggcctcgccgggcgacgccgagtcgccgtccgagaacaacagcaacggcaacgccgcctctaagaagcgcccgtcggggaaccgcgccgccgtcaggaagtaccgggagaagaagaaggcccacaccgcatcgctcgaggaggaggtggtgcacctccgggcgctcaaccagcagctcatgaaaaagctccagagccacgccgcgctcgaggcggaggcggccaggctccgctgcctgctcgtcgacatcaggggcaggatcgagggggagattggtgcgttcccgtatcagaggccgccggcggtcaagaacgtcgacctcctgtctagtgttgaccaggaaagcctccttggcagcgctgctgcccaggttgccaactcctgtgattttagatgcaaccatcagatgtactgcaaccctgggatgcagggcgctatcagcggtcaggtgttgggacaaggtgcctgtgatgtcgccagtatgcaatgcattggaagcaccaagtctggatccactaagctacctgtttgtgggggtctggatacactacctgctgtctgcttaccaaatgttgaaaagaagtgatggactcctggcggtgtttatggtctctcctttccagagacatgctgtataaactgctagcttttctatgtaggactgcatctggttcaaactgctatactgctatgttagtatgtcactgagtttgtcgcccatgatgcttctatggtgtctgaggcgattcaagtttgttagctctaaagctgacaggacatcctcgtttactttgcctagtttccagacggtctatgatcaagtgcagaactgaaccggatcgtaaggagttgaacatgaacttgttaaaatctggcatatgtagatgcatggatcgcgaaatccctcgtgtaggtgcagtgtccctcttctgctatgtgcgagatctgagggaacctggattcatttattgtttgaatgtttcactgtttctgtcgcaagtaaataatttattgcatgggaagtttataactccaaaaaaaaaaaaaaaatgagtagcagcaattctacatcttaccctgtgatgttaccgaccagacactgcaagtttggggcagccgtgcagggcgttacttttgtttgggggtgtttgaaaacatctcattctgtttggtgttgactgacttgtgggcattattattattaagggctagtttgggaac

SEQ ID NO: 3552 - DNA, 1444 bp, Zea mays
ggctcggccggacacgcccaacacgtccccgtccgccggcatccacccttcccctttctcttcgtctccgtccgctcccggcatcgtcccctcttccccgtctcgcggtcgccgcccacgggcttcgattgatcttcttccggtgctggtggcaggtggacggatcgtgtccttgcttggccgcccacagcagcaatggacgacggggacctggacttctccaacccggacacgtacctgtgcccggcgctcggcactgacccgcccagcagctgctccatggacagctacttcgacgagatcctcaaggacacggagcaccacgcctgcacgcacacccacacctgcaacccgccggtgcacgacctatcgcacacccacacctgcgtccacgtccacaccaagatcgtcgcggcctcgcccggcgacgacactgccgactcgccgtccgagaacaacaccaacggcagcggcggcaacggcagcaacgccgcctccaagaagcgcccctcggggaaccgcgccgccgtcaggaagtaccgggagaagaagaaggcccacaccgcgtcgctggaggaggaggtggtccatctcagggcgctcaaccagcagctcgtgaagaagctccagagccacgccgcgctcgaggcggaggtggccaggctccgctgcctgctcgtcgacatcaggggcaggatcgagggggagattggcgcgtttccgtaccagaggccgccgccagcggccaagaacgtcgacctcgtgtccggtgttgaccaaggagggttccttgccggggctgctgcccaggttaccagttcctgtgatttcagatgcaacgatcaaatgtactgcagccctggaatgcagggcgctgttggcggccaggtgttgggacaaggtgcctgtgatgtctcgagtatccaatgcgttggaagcaccaggtctgcgtccactaagctacctgtctgcggggggatggatgcagtacctgctgcctgcttgccaaatgttcaaaacaagtgatggattatataactgaagaagagtataactcggctctcttgtcgccgagccattgttttgtggttccattggtttcctgctgtctggctgaatgcaattttgagtgaattgccatctaattgtcaacgatgaagatcagatttgcttctgtcccatcttgtcaatccagagctagacttgctcttgtctattttcagctggatgtcttgtgccccttttaaaggcattgctagtcttgttgacacaccagaaactaagatgctctgtatgaatcaactggctgtttattctctgagatttgagaaaaattcttattagccttcttaagtctatttatcatgattattgtgtaatcatggtgtatgttgttgtttattcattttgctgtggcctattcaaaaaaaaaaaaaaaaaaaag

SEQ ID NO: 3553 - DNA, 1604 bp, Zea mays
cctcgagccggcgggactgttcgttacatcccattggtgccggggtgggtgggtgcctgggtggtgaggactggactcgttcggctcgggattcccctccgccgcctgcgcgcccaacacgtccccgtccagattcatccacccttccccttcgtctccctccctccatccaatccaccccctctcccccttctcgtcgtcgccgccgccgccgcccatccggggcttggactgtcctttccccgttctgctggtagcagcaatggacgacggggacctggatttctccaacccggacacgtacctgtgtccggccctcggcaccgacccgcccagcagctgctccatggacagctacttcgacgagatcctcaaggacacggagcacctcgcctgcacgcacacccacacctgcaacccgccggtgcacgacctctcgcacacccacacctgcgtccacgtccataccaagatcgtcgcggcctcgccgggcgacgccgagtcgccgtccgagaacaacagcaacggcaacgccgcctctaagaagcgcccgtcggggaaccgcgccgccgtcaggaagtaccgggagaagaagaaggcccacaccgcatcgctcgaggaggaggtggtgcacctccgggcgctcaaccagcagctcatgaaaaagctccagagccacgccgcgctcgaggcggaggcggccaggctccgctgcctgctcgtcgacatcaggggcaggatcgagggggagattggcgcgttcccgtaccagaggccgccgccagcggccaagaacgtcgacctccgtgtccggtgttgaccagggaggcctccttgccggcgctgctgcccaggttaccagttcctgtgatttcagatgcaacgatcagatgtactgcagccctggaatgcagggcgctgttagcggccaggtgttgggacaaggtgcctgcgatgtctcgagtatccaatgcgttggaagcaccaggtctgcgtccactaagctacctgtctgcggggggatggatgcagtacctgctgcctgcttgccaaatgttcaaaacaagtgacggactcccggcagtgtttatggtcccttccttttcagagactgctgggacttcccgttctgcctcgaaggaacgctgtataaaccgctagcttttctatgtagggccgaatctggttcaaactgctacgtgtgtgagttcgtcgtcgccgatgatgcttctatagtgcctgacgcgattcaagtttgttagctctagagctgataggatatcctcgtttactttgcttagttctcagatgctctccgtctccgatgaagtgcagcaactgaaccggatccgaaggagttggacatgaacaggttaaaatttggcatatgtggtctaagaagacgctgagatgtttgtagcgaatctcaagttcaatgcgaaccctgttgcctatgtatattcacatccagatgcatcgttcctgaaatccctttgtgggtgccatgtctctctgctgctgtgtgcgtgatctgagggaacctggattcgtttattgtttgaatgttttactatttcattcgcaaataaataatttgttgcatt

SEQ ID NO: 3554 - DNA, 4215 bp, Zea mays
agagtttctggtaccctatacgaacctgtgctagtgttctcagggatagaaagaaaagtaggagcatttgttctacccgtatcttgcaactaaattttagttttagtagagacacgggatgcagctcagttccatgacatttcttgaagggtgtggtgacattactacgactgaccagcgaatagaattcaccgaattggtaccatcagtgcgataataataagagagtaaataacttttgaaaagcagttggaaatccccttatggtttgggtctcaagagtgacaagaaacggtgagattgtgagtggctaaaaatgatgcacgtagtaaagctaaagccctagttagggtttgtgatttaaattctgcatatggaggccgtgttggcgagcggtatatattagtgaccctaattagggtttgttgtgcatggtcattatttactcctcttgaaagccgctgtttacgaacgacgttctataaacagtccacatattagtgaaggtttcgcctggctggtgcctgtggtttttcccttcgcattgaagggttttccacgtaaatctgtgtgtcgtgctctgtgatttgttggttgatctacttcgtttttcctgccgtttctgctaacaacttgtactgtaatcttgtatttacttaagaacttctattatgtttgaacaatttatattgtcatggtttccacgtttcgaacttatttgttgaaatcaaggaacttatcaaacctcacttccccgtgtcttgccaagaggtacaaatccacatcctctgtttcttttcctccccctttggattgagattttcatttgcgtgaggcgcacaaatagtaaggtttggtaagatgtgacggttgtgatctcaattgtttcagtccaacatctatttctgaaaaatattgtattttgctactgatggtattcttggatagtgaaatggcgataacttttatcttgcgctagtacaacaacaagtagctgaaacttaaggtggaacaaatctattcattcagtggttgatgcactgcgttgtgttcatcaaagtttctgacttgcagctgccaaaatgcagtagtatcttgagcacatgctggtaaaacatgcaagtcttgcaaaaatgttcttaagaagctagctttgtttctttaaatattttttcattatctttttctcgctgagctgagagtgcaatttctacaatttccgaaaaaggaaggtcactccaggttggtaggattaaaggatctatctagctagctatatttttgaagatataagtactttttaagtaaaaaatttatttgtttctggaacatatgagaaacatatgtattaagtagtagctctaatttctgttcagagtaagaacatggggagcaggggaatggagctatgtgtttgatggaggatttatctaatcatgttcaagtgagtgctgctttaagtagtttgcagtcgttagtgagtgcttcttgctctctcaaccttcaacgtcaatttaacaaaaccacattttctgtgaagaacttgccgaccaatcatttcccattggatgctgctttgataaaattggatttcaatttttagggtatggagattctcttgtcgaacaaggtctttaatattgtatctgtaattctgtttagcagcttccgtgcttattgaataatctgactgaaattactcatttatgtgagaatggagaaccatcagttgcagttgattagatcaaaatgaattcacgtcatccctggttagcatgagaaagttaaagcaaacagcaagtttgtgctcttgacattttattaaaggatttagattaatcatggtgaagttctgtgcttgtttgacacagtccacaagttctgaacctttctacaagctctaaacctttatgttttgtcctttgactaattccaaacatctgctgcatgtcaggtctgcggaatggaatgggcatgggtactctcgcctgcggtggtgtttgacacatggttcacaagctctgcctctcttgccatttccatctccgcatagcgtctcccctggtcccagacctgtgcccattccatctccgcatcgtctctcccaggtcctaagcctctgccatttacagccaactgcttcccacggtggtttccttcatagatctgaccaggattgtctccgtgaggtggaaggggttgtcaaggaggcaaacggatggcggctcagcgcctgctcttcctgaaatgttgtcgcggctactccacctctgctgaggacatggtcatctcctccctccgcctcatcccctccccttctgttagtggtaccaccccacctccactccctactattcttcattctactgactctcctcctgacccccatccaccgcttaccaccatgctcttatctgccgctgatcgtctccgcggggtcttcctccgcaagccctctggtcgcaacgtgcttcaccaggcgctatcctccacaggcattggcgctaccatggcactgtctccagaggtgcttgcgaatgtcgtcaataccagcaacctgagtggtgccgccactgtgacctactttgattgggcagtcactaactccaagcctcccccatctgtccacacctgcaacattgtcatcagggcattggggaggaagaaattttttgattatcttgatgacgcccttcagatcatgcgcagaaacaacatctttccagacctgaccacattggagatcatcatggatagcctagttgctgccaggcatgtcagtagggctgttgaggtgatcagtaccgatcaatttggatttgggattggaaaaacctgccacagaaaggatgcatttaccatcctcattaggtgtctttgccggaggtcacatgttggccttgctagctcgctcttgcaggctgctcgtaaggagttgtttggtcttgatagcaatgtgtacaatgatgtcatgggtggctgggcgaggtttgggagtgttgataaactgcaggaggtttggacaaagatgcaggaggatgggctggttccaaatgaggtttcacattgccatttaattgagggattgggtagagtcgggcagactgaggacgcactcaaggcgtttgagtatatggtacatgagagatatggtccaactacaatggccctcaatgtacttattttcaattttatccacattggggatttggacagttgcatcaagtattacaaggatatgttggataagaattgctccccaaacatcgaaacgtactccaagatgattaaagcctttttgagaggtcgcagggtagctgatgcgctccaaatgtttgatgacatgttgattcaaggagttctgccaaatactgggatgataacatcatttatcaatccactgtgtacatttggaccgcctcatgctgctttgatgatctacaaaaagagtaggaaggctggttgtgtaatatccttgaaagcttataagcttttgctggaaagactcgctaaatttgggaagagtggaatcgttttggacatttgggaagagatgcaggagtgtggatatcaacctgataaagagatttacgaatttattgtaaatgggctttgcaatgtgggtaaggtcgatgctgctgtgtctgtggtggaggaatcacttcggaatggcttctgtcttgggagagttgtttacagcaaactgaacaacaagctgttggaaatggacaaagttgagaccgcatataatttgttcaagaaagtcaaacatgcacgtgcacttacgaattcacgcaattattgccgtgctaatggttggcatttttgagcataaccagtttgtctgcagaagagccatggagtccgttccgcatcggggaacgctgtttacgtgcacccaggtcgtcctccaaccaacatctagcaattcaagtgggcagaacggcgatagaggatgtgagctacaacacttgaaggtcaaagtgacatctggtgatgatgctcaatgtaatcttctatatggacactttgtacgcatgaggaaaaattatgctgcactaatattcaagagagaaagctcgtggatgccagtaggtcttttgtatactgcttgctcaacacatgtcatgtcgaggctgcccttttgtgtattgcttggtaaatgctgcgaaacgttcctgaatatatggggtaattgcaatgtcttaatcctac

SEQ ID NO: 3555 - DNA, 3081 bp, Zea mays
ttttagctctatatttaactctctattttaccatttgataaagattataatttgtatatagcatctcactccaatagattatctatctagtttggctactcagagtggctagccaagtttagctagcgagggagccaatttaaagactgatagcttggtgagtcaaatagtgagtttgttggagagttattttgccgttcagtagccaaaatttggctttacgagccatttgactagtctcttggagatgctctcagagtggttagctaagtttggctagtgagggagccaatttaaagagttggatagctttgggagttagatggctagtctgttgaaggattattttgctgttgagtagccaaaatttggcttggcgagccatttggctagtctcaactattgtgatcatgaaaacgctagtatgatacctattgcagtgttttttttaaagttttagcttttgttgcttgctatcttcttttgggagattctgccaaaaggttgactcccgaaacattggcttatttttttaatcattatttaaaaatctattgcctcttgttgcagctgtatggatagacccctcgtggagtgtaggagctggtgacaacagcaaggagcttgaggttcaaacacagaggaaccggcgtgaaaaggaaaccttttatacaagccagaaggacgtcccaatgaatccaaaggacccatgggatctggaaatggacttcgatgacagcctgaccccagaggttccaattgaccaggtgccagatgtggacgccatggaaacggaaagcgttggcgcggcgcctagcgctgtggctcctgttaaggacaagcagattgaatctgcctcatcgacatcaggcgcagttgctgatgatgaggaagctaataccgattacgaattgcttacggtgctactcaggaacccggagcttgtctttgcattaacctctaacaagggggagaacatgcctaacgagcagaccattgcgcttctggatacactgaagcagaccggccttagcctatcagagcttgttaaccgtctggggaacggcgctgggctcccaaaagagccagagccggagccagaacctattcccgcttcgcttccgtcaccaactccgccagaccgtacatcaagggtttgtttgtccgctggctttccatgtcatacattgttcattgggaaattctgtcttccgttattcacgttagatcattctttggcaggctgtctggataccagaacacgcaatgcaggtgagggctgctccaaccttgcatctgccaagccgggggagtacacctcctgttgcaaatgccgtgcaacaaggcttctcaaacgttgtcagttcgttaccctcacaaccttacgcccctccagtctcggtcttgccggcacagattcaagctaacgcacccccatctcttcctctgctggcggtctctgtaaacccgccagtccaacatgtttcccctgtgaataaccttctgaacagagcttcagtgcatcagcatggacagcagcaatacgctttgttgtctgaccctgttgccacgcccttgcatcaacaagcagcggggagcaaaccagctgtagcagcacatccgtcgttgcctgagcctaatgcatcatctcacacagcattcccttggcaatctaatgctgctgacatgacccacgctggacggaatgcgacggctgatccatgggccgccgcccgcgcagctaactcgtatagtacagcatcagcaagcacagtgccgtctgctaaccagaatgcttacggcgatcaaggcaagcagggtgcgtacagctcttatggatcttcggcagcctcgtcccgtcctgttgttctaccagggcacgggcatgacagaaatggctacagccggtctgccctggtggagtacccatgggacgggcaccaccagcggcactcgaggtcaccagatcctggcgtggtccgggactacgacaccgactatggcggtgcgcagggctacagtcagcagcctctgacgcagtggagtgcagggaaagtgcagcagcagagctacaatcctgagccgtcaaggcagtggagttcttcccaggcgcaccagggcggctacgcacccgccgagccgtcgaggcagtggagttcttcccaggcgcatcagagctacgctcccgagctaccgaggcagtggagctccgaacgccgtggctacgatgatgcggagccctcgaggacatggagctccggccagcagaacccggaggcgtccaggcagtggagccgcgggaagcaggatccttactacagtccgagccatggccgaagatcgtacgatcagcaccggaggagatagcaaaagcttgctgtattactactaccacattagctagatcctggatggaggcggtcggtcggtcggttcttgggagggtttgtttcatttgattcgatgtgaggccgggtattcgttgcatttgggctttgtgattgccaccacaagggccattgagaaaagctataggttattatgtatcgatgtagtttttgtctcgaaattaaaaaaaaaatgtatctatctaggtagctggagaggggaaagaagaagaaaaaatgaatgaatgaatgatataactcagggagggtcaagaggccccccggctcgaattgattgcagtcttgaatgctgagtcgaacggttggccaaatttgtcgtctgtgctcgtggttgtccactcaaggtccgtcaattctaggcgtggttgtttgtgccaaatcgtagcgaactctagggctgcggctttctttcggtttctctccagagaaaaataagcgtgggtgttgggtccttgttgctttctgcctgatgctctcgtgaaatatcttcgaaagagttgagctcgcagtgcacgcgtgtgagtgagagcgattccgacgtgccgggcctacagtactggttggtggctgagcgtggcacacgtgcacgtatgatgggcagtcagacacggatcggtcactcgtggtcggggcgtctggcggctgctgctggtcggcgcacatgcgcccgcgc

SEQ ID NO: 3556 - DNA, 1691 bp, Zea mays
gcgggtagcgtagctgttgcagtgacaggcgagccgcgagcgtacagccattggagttttagagaaccagcacagaggcccgcgggccggagatggtgccctgcgcccagcagccgcagctgcccacagctcctcctttccacactttccgtcaagcgtgcaggagggttattccgcttcctcgtttacatcgccgcagccgccgtaccatcgccaccatggcctccgcctccggcacccccaacccagtcgtgctagggtgcggcggcatctccgtcgactacctggccacggtggcatccttccccaaccccgacgataagatccgcagcctcgccctcaaggtgcaggggggcgggaacactggcaacgcgctcactgcagctgcacgcctcggcctccgtcccaggatcatttccaaggtagccaacgatgctcaaggaagaagcatcctcagcgaactccaaactgatggcgtggacacatcctacatcctggtcgcagagaacgggaactcacccttcacctacataatagttgatgaacagacgaaaactcgtacatgtatacacactcctggttctcctcccatggtgccagaagagctcacaaaggcaaactcgtcgtccgctttagatggcgtggacatcgtctacttcgatgtacgattgcatgacattgctttgcttgttgctgaagaggcaagtcaaagaaaaatccctattttgattgatgccgaaagaaagagggaggggctggacgagcttctcaactttgcatcttacgttgtatgctctgcaaagtttcctcaggcttggacaggagcctcatcaatacctgttgctttagtatccatgctttcaaggttaccaaacatcaaatttgttattgtaactctgggggagaaaggttgcttgatgcttgagagaagcagtacagatgcttctgaggcaggggaaatagatgcagaggctttattcgaatcactagagaagagcattgatcagagttctactataccaaaatgtgttgcttccaagtcaaacttgagaataagcgcggatggagtaggctcgataagtggcaggttacttctaggtacggccgaagttataccacctggtgaactcgtagatacaactggcgctggagatgcattcattggagcagttctatatggtttatgcaccagcatgccaccggagaggatgctaccttttgctgcacgagtggctggttgtggttgcagaggtctgggggctcgaaccagccttccccatcgcgcagacccacgcctggctggctattgatccgaattcagaagggctgcatcctccatgaccacctgcctgcaccccgtccaatggttgtgaatattccagtcccgatcagatcaaataagtcatcaactattagcagcacatcatgactatcattgtgatagctattattttgcgatgattatgcaactatatggttccaacttgctagctccaggcataccaggcctgtgcaccttttacgggtgtagaaagttatacaaattccgattgtcacgaggtgtgccctaatctaagctaaaggtgaaattatcaaaacgatacaaaatcgattgtaaagaggtcttgaagttcccaaaaagacccattaaattttctatcaataaatgtagtctaatgtatcattcaccc

SEQ ID NO: 3557 - DNA, 2205 bp, Zea mays
ttgggactcgcgccgcccgccggccgggaccggtccgacctcgcacgcaccaccccggtccgccgcgatgcctcccttcccggcggcgaccaccacctcccacctcgccctcctcgtgctcctctcatcttcctccctcttcttcctctacaaatccctccgcctccgccgcaaaccgtcccccgcccccgcccgcactgccactcctacccttctcttcgcctctgtaaccggcacctccaaaaccctcgctgcgcgtctctccgcccgactgaccgccgatgccggtttccccgtccgcgccaccgacgctgccaccttcgaccccgacgaccttccttcagtccatctcctcctgctcgtaatccccacccacgacggcggtgcgccgcccccttctgcggccttcctttcgcgctggcttgaggagtccgccgctgacttccgcgcgggtgcactcctcctttccggtctccgcttcgccgtcttcggggttggttcccgggcctatggggagaccttcaacgctgccgcgaggaacttctcgcggtggttgcgcgcgctcggcgccgttgaagtggtccctctcggggagggcgacatcgatagcggggatctcgaagcggtgttcgaggagtggaataggagggtgctgagggtggtgaagggcgaggaggttagttatggggctaatgaaaaaaacaatggtcttgacgagttggagttggaaggggaggattgggatgacgacgatgaggagatggtggatgcggaggttgacatggaagatattgctgggaaagcaccggcgaggaggaagaacgggaatttggagggtgttctagctaatggagtgcataacggtgtaaaggacatggtcacaccaatcattaggacgagtttggagaagcaaggttacaaaattattggttctcatagcggagtgaagatttgcagatggactaagtcgcagctgcgaggtcgtggagggtgttataagcactcattttacggcatagaaagtcacagatgcatggaagcaactccaagtttggcttgtgcaaataaatgtgtattttgttggagacatcacacaaatcctgttggaaagagctggaaatggaagatggatgaccctcttgacattgtgaatgctgcaattgaccagcatactaagatggttaagcaaatgaagggcgtaccaggagtaaagccagaaaaacttgacgagggtctgtcacctagacattgtgcgttatctctggttggtgaaccaattatgtaccctgagataaatgctcttgtggatgagctacaccgaagacacatatctacgtttctggttacaaatgctcaatttcctgaaaagattaaggcattaaaaccaatcactcagctgtatgtcagtgtggatgcagctacaaaggagagcttgaaggctgttgataggccactattttcagacttctgggagcgtttcctggattcactcaagtcactgcatgaaaaagatcaaagaacggtttaccgactaacactggttaaaggctggaatgcagaagagatagatgcatatgcgaaactgctagatcttggccagcccgatttcattgaaatcaagggtgtaacatactgtggctcgtcagcaacttcaaagttgactatggaaaatgtaccttggcactctgatgtaaaggaattctccgaggtgttggcatcgaaaagcggtggtgtatacgaagtagcgtgtgagcatgctcattcatgttgtgtcctacttgcaaaggtagataaattcaagatcaacggcaaatggcatacctggatagattatgaccgtttccatgaactggtgacatctggaaagcctttcaagagccgagattacatggccatgacgccctcatgggctgtctatggtgcagaggaaggtggattcgatccggatcaatctcgtttcaagaaggaaaggcgccatggaactgctgccctcagaagttgaagttgatcttattgagaagacatggacctgctactcccgaacactgacctatgttactgctttttagaggcaaaaactttggaagcaaggatttttgaaatgttagcttccaagccatacattttctgtttgtcgtgtgaatcagtttccgaaagttcattttttgatagtttttattggaacatgcaaaaaaaaaaaaaaaa

SEQ ID NO: 3558 - DNA, 2068 bp, Zea mays
ggccaataccaaatgggagcattaacatgaattctgttagaaatacaggtgatgcgagtcccaggatagcaggtcttattggatatgatcgaatgccaaacccatttactccgcccaatggcagcatactatatagagttggtgggcatgatgttcctgcagctatggagaacactagtgcttttggtcctaggtctaatccaactgctgctcagtatgttcagccttttattgctcctggggcaatccagcatcaacctggagttcccttgagggaggtttatcctgaaagagcataccctgaacccatgccgtcatcatatgctgatggcaaagtagctgtttctgcattgcccctcaccgaccaattattcaggttggatataaacacaatgaagaaacttgaaggacaagatgatgggaactctactcgaaatgtgaatgaaacaactcttttgcatgctgtggatgaaccaagtaccttaccccaccatgttggatctgtacatgaagtcgatcctaagcaggagaagctaaccgaaaaagaaagcaggcaaaagcaacatgaagctggggctacagcactgcaggaatgtggggatatttcagaggatatgttgaatttccttcctgaattaattgcctctgttaaaaaggtaacactggaagatgctgctgagacacaaatagcccaatcagatgctaatgctgctgtttcacctgttcctgatgatgacgataatggaaagaagctggatgaggcaacagctggtaatacaaatgcaaatcaggaccctgatttgcaaggaagccttgatcggcagaagagtttcaagattgagtctacaactgctgaagctgaagctttgtcgaaaggactacagactattaaaaatgatgatttagaggaaattagagagctgggttcaggtacttatggggcggtctatcatggtaaatggaggggatgcgatgttgctattaaaagaataaaagcaagttgctttgctggaagaccatctgaaagagagcgtttgatcacggatttctggaaagaagctctgatcctaagctcacttcatcatccaaatgtggttgcattttatggtgtagttcgtgatggtccagatggaagcttagcaactgttactgagtttatggttaatgggtctctcaaacagttcctgaggaaaaaagacaggacaatagatcgccggaagagagtaatattagccatggatgcggcacccgcctcggcggccgggcacgggaagaatatagtccattttgacctgttgtgtgagaatctactggtgaacatgagggatccacagcgaccaatctgcaagatcggtgatctcgggctatcaaaggttaaacagcatactttggtatctggtggtgttagaggaaccttaccgtggatggcaccagagcttctgagtgggaaaaacaatatggtgtcagagaagattgacgtctattcgtttggaattgtcatgtgggagctgcttactggggaagagccatactctgatatgcgtgctgctgaaattattggggccattgtaaacgattccctacgccctcaaatcccttcatggtgtgatcctgagtggaagggattgatggaaagctgttggtccagtgatccagccgagagaccgtccttcactgatatatctcaaaggttgaggaaaatggccgctgcaatgaatgtgaagtgaaggttcggaagccatatttgtcttgattttccttagtcctggagtaacccggctgtcatttgccttgtgtcgaaaataagtatgctataaagcgttctgtcttgatgggaactgttgggctgtaattgtaaataagttttgacttgcttcatcttgctgtgcaaagtagtaattaataggcacgatcaaagctgggcacagttatcttttccccccatacaaaagtgtgtcctaggactaggaggagagatggatcgaacacgactagagctgtacatagtatactgtttgctctgtatataatcatcacttcctatttgaatgctcataagtttgcccat

SEQ ID NO: 3559 - DNA, 1805 bp, Zea mays
  misc_feature (9)..(9): n is a, c, g, or t
atgtcaggnaaatgttaggtcgggggctcgggcggggccgccggccttgccctcgtcgccgagtcaccactcaggcactcaccacacaccaaacaaagcagggggcaggggagcccacttcgaggccgcggcgttggctgtctcggtgtcatcgtctcctctcgtctcgttctcttctcctcacctccttcgtttcgcggagcagagcgagcagccggcaccggacctccaaggagcgcaccgcggaggccagcgaagatgcccgggctcacggcaccgtccgactacgcggaggagccgccgcgtcacccggccctcaagatcaactccaaggagccattcaatgctgagcctcaccgatcagagctagtcgcatcttacatcaccccagtggatttcttctacaagaggaatcatggacccatccctaaagtcgaggacctctcaagatacgctgtttccatttctggtctcgtcaacaagtccattcagctatcgatggctgacatttggtctcttccaaagtacaatgtcacagcaactttacagtgtgcaggaaacaggaggactgcgatgagtaacgtacggaaagtgagaggtgttgggtgggacatatctgctcttggaactgcaacttggggaggtgccaaactatctgatgtccttgagctagttggaataccaaaactcagttcagtcacgtctctaggagggaaacacgttgagtttgttagcgttgacaaatgtaaagaggaaaaaggtggtccttatacagcatctattccattaaatcaggcaacaaatcctgatgctgatgtattacttgcatatgaaatgaatggagaggtactcaaccgggaccacggatacccgctccgggttgttgtacctggcgttattggtgcacgctctgtaaaatggctggacagtatcaacgtaaaagaggaggaatgccaggggttttttatgcaaaaagattacaaaatgtttccgccaaccgtggactgggacaacattaactggtcaactagaaggccacagatggatttccctgtgcagtctgctatctgtacactggaagatgtagatgttatcaaggaaggacaggctaggattgctggatatgcactttcaggtggtggccgtggcattgagagagtggatgtatcagctgatgggggtaagacctgggtcgaggctcgtagataccagaaagacaatgtggcgtatgtgtcagatggacctcaaagtgacaagtgggcttgggttctctttgaggccacattagacgtaccagcgaatcctgagatcgtagttaaggcggtggactcagctgcaaatgttcagcccgagaaggtagaagacatatggaatctgagaggaatcctcaacacgtcttggcatcggatcaaaattcagagatctttgtgcgttgaaagatctaagctgtgaaattaagtacgcagctgatcacttggagcaagcagactcactttaccattgtcccagaataataattagtcacttcaactttctgcgtctgtggagtaaggttgtacgagtgttggggctgtgtcattatgggatttgagctcacttggtttctgtgtaaatgtcagctgctgcggtttttttggtcactggatgactgctgctgttggctggtcaggtttgatatcgagaaatatccattgcattctgcgtttgaaaaaaaaaaaagcaaaaaaaaaaaaaaaatgggcaaatggcagctctgggaagaggtgagcttcatatcgcagctgagaaataccaatacaagagat

SEQ ID NO: 3560 - DNA, 858 bp, Zea mays
tttcagtgatctagatcgaaggaaaccaacgaagcattgatatgccaaattactgatgagcaatggattagccatacaggccctaagtgctgccagctaccccatcgtgagttcgtgaccggtgttcctgccatcagttgccatttggtccctggttgagaacaagtccttcagcattttgtccaaagaatccttagctaacggagacttcttcacttctttctgtcctgattctagagaacccttaacaggtgctgcaccgttctgaagctctgcattagcagcatctcggtgctctgacgtgtctccattttggttcgattggcactctgccgcgctggagtgcagcgcggcttcctgatccttggcggcatccgcctgccactccggctggaacttctgcagcagcaaggtgagcagcttctgcagctcggggggcacctcctcggggaagagcttggggatgtcgtccttggcgaagtcctcgttgacgcaccgtctgatcagtatcctcaggcacaccagcagagggtcgagctcggcgtcggaggagagctggagggcgtcgcgggcgacggtgcggtcggcggcgtcgaggcccgtgcggcgcgtgcgccagagcgcctgcaggatgtactcgaccgactccttggacccggcgcgcgccagcagtgggaggtgcgcgtgcccccacagcgccgccgacgcgccgcgctcccgctccatctccggtgttctgttctgccctaccgccgccgacggggacgcgcggtggaccggtggggggctgctggaaggtggcggtggtgaggtgaggtgtcgtatcggttatcccggccggcctcgaggtacccaatg

SEQ ID NO: 3561 - DNA, 1766 bp, Zea mays
gtacacctcgggcccgccgggggccctttccccttctttgcccttggcccttggcctccttccgtcgagagagagagagagagagctgtgctggctgctgctgccccgggtccgtcgggacgggtagatgaggaggaagagaacagctcgtgactgactgactccctccctcagcgtgagtgggttgcggacgaccacatccatccgttcccaccattcccttctcccacctcgcctcctccccttgcccttgcccttccacagccggaatcagggggtaatgggccagatgggaggacccgacggcgacggcgacggcggcgcgggcccgcaccaccagtaccactaccaggcgcttctcgccgccgtgcagaaccccagccagggcctgcacccctttcccctccccttccacgtgcctctccacgcaggagcgggagcacccgccgccggaccaggacctggagctgatgctgatgcctccacacacaatgccaatgccgctcaccactctcagcctccaagaggtttcaccgattggagcgcgtccaacagtgccttcgccgccgttgcctcacagcccgcacctgctaccaccaatacacccttccattacaacctctcccagtcttatgccctatggacccattacatgcttaacaagaatgtatcctactctacttaccctacaccacatgaggagcatccccacccattgcgccatacccacatccaggagaatccccacccattacgccatacccacatcccggataaggattcaggttgtgcatctagccttggatttgactctttcactacaatgtcacttggaccaaatatttgttcccacatgacgcccatggaaggatctatatctgccaaagaacccgagaattcagaggatttgcctgcaatagttaggagcagtgatgaaatggacactagaaacagtggcaaagttcatcgtgacacagttggcactcttcctgagtcgaagcagagccatgaaagttgtgcttccgtgaataacaagttcaactctggagagtaccaagtcattttgcgcaaggagttgacaaagagtgatgtcgcaaattccggacgaattgtgcttcccaagaaggatgctgaggctggtcttccaccattggtgcaaggggatcctctgatactgcagatggatgacatggtgcttccaattatatggaaatttaagtatagattttggccaaacaacaaaagcagaatgtatatcttggaagctgcaggtgaattcgtgaagacacatggccttcaggcaggggatgcgctcattatctacaaaaactccgtgcctggcaaatttattatccgtggggagaagtccattcagcagacaaacccctagacacaatttgatgtgactgtgcaccatcagatatggcgtccgaggatacaccatatgttcacgttccagttgttatcgacttttataatgtctcaccgtcacactgagataagtcgaaaaaggagatacaccgcgtggatggagaaaaagagaagaaattttgggagacattggaagtgctgccagtgaggctacgtctaagctcagaacaaatggtttatgttttttcccctaattcggtcgtatttggatgcttgagtcctgcattgcatgatgaagaacattctcaatctctctttttttgtaaatattttaattcaggatctataaggtaaaggaagtggtttggaagcagatttctgattcaaaagcggcc

SEQ ID NO: 3562 - DNA, 1726 bp, Zea mays
gagggcgtctgcgtctggccctttcaccttctctgcgtagctccgtagaggcacggggccgccgccgccgcctgcatcctgctaccacgggtcgagacgggtagatgaggaggaggaggagaacagctcgtcactgacgctgtgagttgcggggcgaccacatccatccgttccccctttcccttctccatttcccctttccggagccagggtaatggggcagatgggaggaccagacggcgacggcccgcaccaccagtaccactaccaggcgctcctcgccgccgtgcagaaccccagccagggcctgcacgtgcctctccacgcaggagcgggagcgcccgccgccggaccaggacccagacctggagctgatgctgatgcctcctccacgcataatgccaatgccactccccactctcagcctccaagagctttcactgattggagcgcgtccaacagtgcctttgccgcacagcccgcccctgctaccaccaatacacccttccactacaacctctcccagtcttatgccctatggacccattacatgctcaacaagaatgtatcctactctacttactctacaccacatgagccgttgcgccatacccacatcccggataagtattcaggttgtgcattcagccttgggtttgactctttcactacgatgtcccttggaccaaatatttgtgccaacatgacgcccatggaaagatctatatctgccaaagaacctgagaattcagaggatttgcctacagtagttagaagcagtgatgaaatggacactagaaacagtggcgacgttcgtcgtgacacagttgacactcttcctgagtcgaagcagagccatgaaagttgcgcttctgttagtaacaagttcgactctggagagtaccaagtcattttgcgcaaggagttgactaagagtgacgttgcaaattccgggcgaattgtgcttcccaagaaggatgctgaggctggtcttccaccattggtgcaaggagatcctctgatactacagatggatgacatggtgcttccgattatatggaaatttaagtatagattttggccaaacaacaaaagcagaatgtatattctggaagctgcaggtgaattcgtgaagacacatggccttcaggcaggggatacactcattatctacaaaaactccgtacctggcaaatttattatccgtggggagaagtccattcagcagacaaacctgtagacacaaattgatgtgattgacaccatcagatatggtgctcgaggatacaccatacgttcagaattgagttgttatcgacttctgtaatgtttcaccatcacattgggataagtcgaaaaggagaatcacgagtctgagacaccgcgtgaatggagggaaggaggaagacattggaagtgcgcctaagttcagaacaagtggttcatgtcctacgcccccccccccccccccccccaaccggttgtatttggatggctgagtcctgctgcacattgcattctgaagaacattcgtagtctttttgttttgtaaatattttggatctataagataaaggaagcggtttggaacttacgcaaattctgatacatccttctcttgtctcattcatttttaccaatatatttgataattttgagattgttctatgctcgtaaagtgtatttgcttcttcctcgcggtatccactctgtcccttacacttag

SEQ ID NO: 3563 - DNA, 933 bp, Zea mays
  misc_feature (773)..(773): n is a, c, g, or t
  misc_feature (808)..(808): n is a, c, g, or t
gccccccgggccgggacgtagacaattccagtaccgcatctgccgccagtgaggcaccaccgccgttcgcttcctctccagcctccactccgccagatctcattgcctcctaagtcctatcgcccaccccgatcaccgcgcgggtatcggagcatggcgtctgcggcggcggtggacgccggcgacgcgccggagcccacggtgcggaacctcctagaccaggagtccctcaagtgggtcttcgtcggcggcaagggcggcgtaggcaagaccacctgcagctccatcctttccgtcctcctcgcgggggtccgccagtccgtgctagtcatctccaccgaccccgcgcacaacctcagcgatgccttccagcagcggttcaccaagtttcccactctcgtccgcggattcaccaacctctacgccatggaaattgacccgaaggtagaaaatgatgatttagccaatgaaggaatggagggattcctttcagaactgacaaatgcgattccaggagtagatgaagctatgagttttgctgaaatgctaaaattagtccaaacaatggattactctgttgtagtttttgatactgctcctacagggcatacattgcggttgcttcagttcccagcaactttagagaagggtcttgagaaaatgatggagttgaaaaatagatttggtggtctgttgaatcaggccagtcgattgtttggtcttggcgatgagctgaacgaggatgcaatgcttgggagacttgaggggtatgnaaggacgtgatcgaacaagtgaacaggcaatttanagatccagatttgaaactttttggtatgtggttggatcccggaaattctttcattgttgaaaacagagagattggtggcagagttagcaaagtttgagattgatcgcacacattattataatcag

SEQ ID NO: 3564 - DNA, 825 bp, Zea mays
cggttgagttgagaaaatgatggagttgaaaaatagatttggtggtctgttgaatcaggccagtcgattgtttggtcttggcgatgagctgaacgaggatgcaatgcttgggagacttgagggtatgaaggacgtgatcgaacaagtgaacaggcaatttaaagatccagatttgacaacttttgtatgtgtttgtatcccggaatttctttcattgtatgaaacagagagattggtgcaagagttagcaaagtttgagattgattcgcacaacattattattaatcaagttatatttgatgaggaagttgtcgagtcaaaattgctaaaagcacggataaaaatgcaacagaaatacattgaccagttccatatgttatatgatgacttcaacatcaccaaacttcccttgctttcagaagaggtttgtggtgttcaagctctacaaaacttttcccaccgcttccttacaccatacaagtctgctcgtaaaaggggcaccatcgaggagctggaggagagaataactatactaaaatctgcattgcaagaagctgaggcagaattagataggattaggaaaggaaagcagtcagcgtgatccttttcccccataggttaaggtatgtaaagcctggcagaagctactaagaaaacagagttagagagacgctcaaatgtcattacactcttgttgatttcactaccatgtttcctcatcgaaatgtttagatttgtcatagctatcggaagagaagtgtttgattcacacgagatatatataggtccattctttttaaaaaaagaaaaaaaaaaaaaaaaaag

SEQ ID NO: 3565 - DNA, 1527 bp, Zea mays
taatttatcaaacgatgaaaagttgaaaacgtccagaagaggaaaggtattttccaattattccattttccacctagacaattccagtaccgcttctgcccccagcaggtgccagcgccaccgccgttcgcctcctctccacactccgccagatcccatccctctcgcccaccgcgcgggtatcggagtcggagcatggcgtctgcagtggtggtggacgccggcgacgcgccggagcccacggttcgtaacctcctggaccaggagtccctcaagtgggtcttcgtcggcgggaagggcggcgtcggcaagactacctgcagctccatcctctccgtcctcctcgccggggtccgcccgtccgtgctcgtcatctccaccgaccccgcgcacaacctcagcgacgccttccagcagcgcttcaccaagttccccactctcgtccgcggattcaccaacctctacgccatggaaattgacccaaaggtagaaaatgatgatttatccaatgaaggaatggaaggattcctgtcagaactgacaaatgcgattccaggagtagatgaagctatgagttttgctgaaatgctaaaattagtccaaacaatggattactctgttgttgtttttgatactgctcctacagggcatacattacggttgcttcagttcccagcaaccctagagaagggtcttgagaaaatgatggagttgaaaaatagatttggcggtctgttgaatcaggccagtcgcttgtttggtcttggtgatgagctgaacgaggatgcaatgcttgggaaacttgagggtatgaaggatgtgatcgaacaagtgaacaggcaatttaaagatccagacttgacaacttttgtatgtgtttgtatcccggaatttctttcattgtatgaaacagaaagattggtgcaagagttagcgaagtttgagattgattcacacaatattattattaatcaagttatatttgatgaggaagctgtcgagtcaaaactgctaaaagcacggatgaaaatgcaacaaaaatacattgatcagttccatatgttatacgatgacttcaacatcaccaagcttcccttgctttcagaagaggtttgtggtgttcaagctctccaaaacttttcccagcacttccttacaccatacaagtctactcttaaaaggggcaccgtcgaggagctcgaacagagaataactatattaaaatctgcactgcaagaagctgagacagagttagatagggttaggaaagggaagcagtcagtgtgattttttttccacaggtcaagtgtgtaaaaccagagagacgatcaattttttcgtgtcattacactcttgttgatttcactatcatgtttcctcatcgaggagtttagacttgtaatagctatcggcagagaagtgtttgattcacacaagatatatagatccattctttttgccggttaaaaaaaaaaaaaaaaaaaagaacggcgccccccctctagtgtcctcgcctacccgtgaatt

SEQ ID NO: 3566 - DNA, 1862 bp, Zea mays
  misc_feature (724)..(724): n is a, c, g, or t
ctttcgggtactgctcctagctatttgatggtcgagacagagcggctatggggtcctcataaataccctgcaacgatgaaaagatgagcatgcgccggtcggatcaagctgggggacccgcccaattcgcacgttcggttcaacggacttcgatttgttggttggagatcaagctgacaggcgggacccacctggcagacagggtccccaagcgtgtatgcggacttcggttctggcaaggcggccccagtggtcagtgagtgggcgcgggccagatgaagggatgctgggtcgaggagaggaagcaagaatgggtcgaccatgacaattcgacccatgtggcaggtgcttttccctttttattttgatatttcctttctattttagttttctactttccaattcaatttgaatctaggttttggaatttcagatttccaaatagctaataccatcctaatgtaaatataaattctactgtttacaatattattgtttattattctccctattatttaattatggaagtaacaaatgactttattaaaatttcctttctcattttctgttttatattttcttttataatttgagatcaaatttaagttatgattcctttatttaaataaaatgcatcacacaaaaaataacatcggcatgagatgcatatttctttatttatttattggtttcttggctaatttgatactattaattgaatatnaaaagggaaaggaactatttaatctccaatggctccaaaaaatctcaaaacactaatataattatatttatttatttatatcattattttttctctaatacaatttttgggctttagaggtataaaggtaaaacatcactgtggttacaaataaactaaaataaacaattattggatagcttattttaattttttttgtactatcaaagtgatattttatccaattacacttctatcataatctaacttatattctacgagataaacaatcgaggcctacttatgagttctaatccctcccagacccagattagaaacggggcaaggcaaaattaaccaacgataccatcaaacaaccaggcaactcttcttaactatttcccctttggccgtcggcgcgcggaggcaggggtggcgtacggcggcggcggcaaccatgaacatcaacgcgaacggcggcatcctgtcgtacgggaacatggaggggtacgcccgttgggtggccacgggcgtggcgtcggccttcttcgcgtccctggagcgcttctcctgcatccacctccacaccgccgaggacgacggcagcgacgaggaccccgacgaggccaaggaccgccccctcatcttctcccgccccgacgccctccccgagtactactacagccgttccgcatcctccgtctccttcgccaagatgtgacatgcatgatctgatctgagacgggatcgcgcgcggtgccgtcgtcgtctgtgcgccaaacgatccgatccggccgtctcctcataggttaggttggtcatgtcttgcaaattgtgaaattgtattgtatccgcacgattccccggcgcgtttgtgttcttgccatgtcctggcctcctgtctgatttgggcgtacttctgatctgatggatttgtaattaggcacctgcgttgtatggtgtggattattctgtttttacttctccctcttcttttgttaataccttttttttgaaaggttcttcctttattaatatcggacggcattgttgtgcctgcccatcttggatccaaaaaaaaaaaaaaaaaaaaaaaaacattgatcttttgaacgtccctgttttcgtcgaatgcatcccttatcagagttcattcgcc

SEQ ID NO: 3567 - DNA, 2184 bp, Zea mays
ggctttgccggccggcccggggccattgaaaatgtcacatgctaaactttcccccctacataatcggcaatagtgcgggctgcggcaccgcagcagcgccatgaacgccgtcgaaccctccgccgccgccatcgccgaagaccccattactccggccgcctccgcagccccgtaccctggccgcctccgcgaagcacttaccgccctttccgaggcttgcgagtccggcaacttcaatgcttccgaaaccgcctccttcaccatctccgacattcttgacaccgcagccggcgtaagtggcgagctcgatgacgggagcgacgacagccaagacgcgtcgaggtcaggggcctccgaagtgctgcttcgcgaggtgctcgagttcctctctcgcccgtcatcgatctcgaaccagatggcccttgacgcgctctcgcttgtgcttcccaaacccgtggcgaagctaggggctcgaatggggagatgccgggatgttgccgcagctatcctaaagttcttcgtgacgaattgcaatccgagggacatgctctccatcctctgtgaggcattagatgcaccaatggagctaccaaatggcttatccagttttgttcttctactcgatgcacttgctaaagtgtttactttaattcagaggcgacatatcgagcaagtaaaggtggcactgcccgttgtacttaaagttatgcatgctactgtatcagaatgtgttgaggaacatggaagtgctgctgttgatcttttcaatgcagcacatggtgttggcaaggccattcaagaaatgtgcatatcaatgttcaacaaaaacaaagatctctgtgcaattcttggtttatactcccttcagaatatagctcttgtatcacgaagcagacagcaggatattctctctgcttgtggttcagttgtttttcagagtttcagatttcttaaaactagtggattcacctatcgtggcctactaactggcagtgatgtcacagctgcaacggttgaactttccaaagaggaagatgctgattttatggagcatttttcctttgctatggatggtgcagcactttcagttgtgtggacacttatgcatgatgataaagatatgtcaaagtatgctggagaagagttggaattagcagtaaaggaagttcagggcaaccatatggaaaaatgggaagcaattaacatgcttaaatatgtcctatcctcaattcattacccatggataatcaaatcccacagtttaaacttaatgctgattctatccggtgaagatcatgttgaagagatcaataatcatgtagatttcacatgctttgctcatcgcatttttgaaacactcaaggccattgaaagcgttatgattgctgcccctatggcattggtgcggaaaaaagcatttgctgctttgaaaaaggttatttcaatggtgccatcatcccagagatttgacatcttacatggtcttgtaaacaatagtacatctccagctttgactgcaattctccttgatctagtgaggcaggaagtttcgagagagagtcgccaagctgacaatgattgtattgaagacgaaggatttcgaggtaatgggttaccgcgctgggcatctcatgcacttgagttagttgagctgattttgaggcctccagaaggtggtcctccttgccttcctgatcacagtgaacaggtaatatcagctctaaacttgctaagatttattctgataatagattcaagaggacaaagatctgcaaaattgtttcggaaagagacattgcacaaggtgcactcggagtggctgaccccattaagaccaatcgcggagcaaattcagttggaaaatgaaaaggatgctgatgagattacaaaacaaatagtgtgcatgttaaatcttgttcaactggtgctataccgctgcatcgagttggtggaggaaaagatgaaaggctgctaatgtttttggtacctgtcatttctatacagtagcatctgctgtatctggatggaatgttcttgaggatataaattccatcttctcaggttattgtatatttacatggccaggaagtctggttttatttaaagtgtgcataacgtattcacaggaaaaaaaggtgttattatcataaaaaaaagggcgacagatagcgatctagaactagt

SEQ ID NO: 3568 - DNA, 7282 bp, Zea mays
  misc_feature (4764)..(4764): n is a, c, g, or t
tacaggcgacctgcagcaaggagatgagattctcagtgaagtgccatgtgccactgcttgcttgacagcggagtacgtataccaggcaacgatccgagcgagcaagagagattcccgatctcgcatcccgcggcgggctactcgtgtcgaaccctcctcaatatcaataatacacggacggacccgtttctccctcccgcacgttatttacacctgccggtgaccgctggtcagccatctctgtttttaattatactagtttttttgtttgtttgcttgggaagctccagctgcattctttattggcggggcaggaaaattgtgttcccccaaaacacaagaagttaaaaaatgtaaaatactaatgacagtctactgtcaacagggcggggcgtgacagatggagttatggagaggaataaatggaggtggcccgcggggccggcccggacgaaacggacggacgccacgccctgcccgccggggctgcttgccactcctctctcttcctcatccatcctcgccccggccccgcccccagaaccaaaccagcctccctccccagcagctcacgagagagcgcaagcaagtattactgcgcaccgcctcgcccgcgggcgtcagcgtgaagctgccgcacagctaccccgcgaggcatggggatggacgccggcggcgggaagctgccgtacagctaccccgcccaccaggacggcaagctggtgaagagcttcagccgcgtggagccccgcaagttcggcctcggcctcgtcgcgggcttcctgctcgtcacctgcgcctacttctccaccgccaagttcgacgccatccacgtcgccatgacagtcagccccgtctccggcaatgcggctgggatcggcccgctagtgggcgccgccaacgccgacacctccgactccaagcagcgattagatttgggcaagcaagacccggacgacgcgctgtccaggtccgaggaggaggaggggagcagggccgacgaggtgctggagaaggacgacggcaaggcatcctcgtcgtcggggacagattccggcagcaatgcgccgctggaggacacgaggagagacgagacctttgtgggggacagcggtggtgcatcttccgcggcgggcgccaggagtgaggcggttcctgccaggcacgagcacgacgatgacgcccccgctgccgccctgcttcctcccgtgacgtcagagggagccgcgaacagcacgcaaggatcaggagttcttgaggacgaggagctgcaggtgcaggacgctgtcgccaatccttccaagaggagcaacgattcagccgccacgcgcagcagcagcagtggccgctcgccctctgtggttcactctgatcctgccatcctccctgctccctcgcagcagattgctcctgctgctcctcaagaggcagataaggctcttgctgttcagcatattccagcgatacctgaggttaagcaatcagattcggagacgccggcgcgggagtggaagccgctgtgcgacatcacctcgaaccgccgcatcgactggtgcgagctcgacggcgacgtccgcgtgctgggcgccaacgcgagcgtcacgctggtggcgccgcccggcggggcggacggccgcaccttccgcgcggagtcgtggcgcatcaagccgtacccgcgcaaggcggacccgaacgcgatgcgcgtcgtccgcgtgctgacggtgcggtcggtgcccggcgaggcgcccgcgtgcacggaccggcacggcgtcccggcgctggtgttctcggaccgcgggtacacggggaactacttccacgcgttcacggacgtgatcctgccgctgttcctgacggcgcggcagtacgccggcgaggtgcggctgctggtgacggacctccaggcgtggtgggtgggcaagttcgcgccggtgttcaggagcatctccaactacgagctggtggacctggaccgcgacccgcgcgtgcactgcttccgccacgtccaggtggggctcaccagccacgacgacttcagcatcgacccactccgcgcccccaacggctactccatgctggacttcaccgggttcatgcgcgccgcctacgggctcccgcgcggcgacgtcgccgccgctggcccgtcgtcgaagcggcggccgaggctgctggtgatcgcgcgcgcgcggacgcggcggttcgtgaacgcggaggagatcgtgcgcggcgccgtgaagctcgggttcgaggtggtggtgtcggaggggacgcacgaggtggcgcccttcgctgagctggccaacagctgcgacgccatcatgggcgtgcacggcgccgggctgaccaacatggtgttcgtgccgacgggcggggtggtcatccaggtggtgccgctgggcgggctggagttcgtggcgggctacttccggggcccgtccagggacatggggctgcgctacctcgagtaccggatcacgccggaggagagcacgctgatcaaccagtacccgcgcgaccaccccatcttcacggaccccaatgggatcaagagcaagggctgggagtccctcaaggatgcctacctcgacaagcaggacgtgtcgctggacatgaagaggttccgccccacgctcaagaaggccatcgcgcacatcaggaaggccagggccaaggccaacgccggcggcggcggcaacaactaggcatcgccgtacatgtgctcattcatcctcctcttactctacttttgtttttcctcccctccttctcgggttatggcagtacttgtatgtagcaagcagaaatcgatcaaaatgtataatatggcagggaaagaagttagagcaaatcatatattctctttttacccccgcttttcggtgagggtcaatggtggatggagagtatgatcaaaaaaaaaaaaaaaatataaacattttagatttagtttctctcgaggaaaaaaaaaattcagatagcgaatagtacctacttagtacataatagtaattttttatacaaatttaataaaatatagtttaacaaattgctatcctaaaattacatccttgggacgaggaagtactttatttgcttcgtgattctctctaatcattgcactgtcacgccaatgatgcgtccacaacgtcctatatcacttctcgctacagaaacaatcgtgtaggagtaagagtactcctaatttgtcattgtgccatgggaacaaggatgggtccttccagagtgttctcggtctagcatatttaattaagcatatgcatgctgatttattcatttcctgatcataaattgttctaactgttttagagagtcaaaatagttcgagtttgatgaaaaatgatagaaaaaaataaataaatatgtatgattgtttcatgaaacacttttattataaaaaatattcgaatagattataatttaggaccgagagagtactggggcgtttgaattgaaaagctaaacttaagtccctgtcgcattggatgtttggatgctagttacgagtattcaatatagtctaattatacaactagttatacaaatgaggagtaaaagacaaaacaaatttattaagcctaattagctcatgactcatccatgtaatgctacactaaccatttgccaatcatatattaattaggcttaaaattgtgtctcgtcgtttagcctttggccgtataattagtctatatttaatactcgtaatagttattgaaacatatgatataagctaaactcaaaggatttttcatttttgtgtaagggaaactagtttatttttatattgggaaataagaatccttggtaagaaaaaacaaactgagaattactacaagtactctgtttctgccgagtgccgacagagacacctcgtcacatgatctgcgtgggtgcatgggagagaacgtgagctctggaccaggcgcacgttgcggggcccgccagaccaccaacaagcgacgaggatctcgcgctcacacggcactgcgctgcacgtaaactaaagaaaaatccaggagagacgagagggtccgtggtttttttttacttgatgacgactgagctctcatcagtttagtttagctctaaatgacatggaagtatatatacatgctctcaagaagcactttttttgtttgacggcacccgtaaaacagcacgttgcggggcccgccagaccaccaacaagcgacgaggatctcgcgctcacacggcactgcgctgcacgtaaactaaagaaaaatccaggagagacgagagggtccgtggttttttttacttgatgacgactgagctctcatcagtttagtttagctctaaatgacatggaagtatatatacatgctctcaagaagcactttttttgtttgacggcacccgtaaaacagcacgttgcggcggagaaagtcggcattgaccatcaccaatacgacacctagttgctaaatttctgacgctgccgctactcatcatggatgtacacgtattccggtggtgtacctacgacgtacgtaggagtacgatctagcctgctctagagcaagaattggttggtgaggaataaacactagtagtacctaccaaggcagcgagaggaccaggaatgatatgatatacggaccgtgtgtgtgtgatctgtgatgtgatgtcataggggatcagcattcgcatctctctctctgtgcaaatttccatccgcaccgcctcttgcgtggaccattttcaattctgcatgtgcatgcntggtcaagttgcgatatgcacgcgactcttgctgctttgtttattattttgttttattttttttggttcaatcaagcgacaacagtacctgcctctgcctgcgtgtttgaacaataggggtaggggcagctgggcgggggaatcaaagcacacacacgcagagtagtgagtgtaatccacctagcagtttggcagttagtatcacatagaaaactacataccaacgtagtaattacatattattgtggtgtactgaaaacgagattcatagaagtgcaaaattatagcatccgttcatttttctaagggtgattacatacatatacagggctcgtttaggagagctctggtgtcatatgatgatttgtgatactgtctacaaaatatagatttgaccgatagagtttttttgtttgttaaaatacaaataaacttttaataaatttatatttttatagaagtatttttagacatataaatattaggtttcaaaactaaataaaacagatatttatagtcaaagtttttataagtttgacttaaaccttttacaaaacgataactaataggacaccggaacaattatgtttattaggaaaaatgaattaagctgaaaccttttgaaaaaggcagtggaactgggataccggaatggagccaaccagccgtcagcatatgcacctcggcctcactgaatccagtgcgccacgttttcatgcatgtgcgcgagagagcgagctagcgaggccaaggccgatcgaggcgacagcagcgagcgagcatagcagcacatttctttcttttgtttttttcgcttctggtttcagtggggaacactgatgcatggagaaaaagcagccagcattgcatgcatggggctccgctgctggactcgtgatcgtgaccgcctgtggtggctgtggctgtgtgggaagatccggaaccggaagtagcagtcggcctctcatcagggaaatatttcatttgctggacctgatcatgggcttgttcgctgcggctttaatccgactgcggctgcggcttctacagtattttatctctagggattgcagctgcaacagtattttgcagctgcaacagtgctcctacatggtcttcttccggatgatggcggtgggaagtggatccctgacctgacctgacttggccgccgcgcgctagcatggcacggccacctttccagcctccatctcctccagctcgcctcctgtgtgtgtgtgcgcgtgtccactagccgtcagccgtcgctaagtgtcggttcgggcgtcgggcgtggcttggaagacccgtaagcccgccaaaactagtgtacgaaagcatgtgatgctcatggtcacggccgacggcaatcaagcaaaggtgttgacgggtagggaatcatcgtccagttttatggtgatatcctggcctgtatggattatgatattctagtctaagacttaacataattgatagaatattcatactaataagatttttttttccgaaattctatctggagaggacttctgcgttaaacatgtttcgatatgagcaattttttgaatggtcaactaacagagaggtttctcgagtgcgcatgagcaaagacaaggagtaagtgacatttggttctagaatggactatgaccttagagacctgatagaagtaagcattatcggtacgaaggtgtttagatttataaaagccatctttaagctcctcatatcaaataaccattttagagtagtttctccttaaaaagaccccaagaaatactcttgccgcatttttctcatcttaatctctgttatctctcctgacatactgttcgtcggagaataaaatttagtccctaccttgtttgattctagtagggactaaaagtatttagaacgtattaaatgacttataaaaagactaaaatggccctaaacattatctcgttgttagtgaaactgaaataaacgagggataaaaatttggaattaatatagtttagtcccttttatcatgtgtttggttgagaggcgaatggagtgacttcgttgctttctggatgtttaatttccaataaatgatgagcctagcgactcctcgagtctctatataaaaatgtattataaatagttgaaatattctcgctctaccaacacaaccggacgcgaacgctcttcttctatcttttatacactcatatatcttttcaaccaaataaagaacaggatcttttataattttttctgatccacatgggacaccgaagaaggccatacaatttcgtgtggagaactggagcgagaccggcagaccgcgggcgggcgaccggccggcgcgtacgtacgtgtctgtcggtactcagtacgaaactacgaatcgatgccgacgacgttgggcgctgccgaaggtctacgttttcctcggccgtcgctttcgggccccgtcctctgtacggagtccggcagggtcatcagacattgcctgctggatcggcgcagagacaaaacagaaaaaggt

SEQ ID NO: 3569 - DNA, 2407 bp, Zea mays
ttctgtcccttgtctgcctgccactcctgtcctgctctcttgggtgcccctggcgtattcactttcactcgttcgtccatccttccacgccccccacagaaccgtctccccagcccggcgcctcacggtcggcacgagaccattacctagaacatcctaatcgaaaagtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggccggcgtcggagtcggctcgctgggagtgggcgccgccgccgccgacacctccaacgcctccaggcagggattagatttgggcgcgatgtccatggccgaggaggggagcgaggccgaggcgctcgagaaagacggcggcaaggcttcttcaccttcggggccaggttcttggtcaggcgttcctgccgctctccttcctcccgtgtcgtcagaggaagccgcgaacagcacgcaggaatcaggcggtcttgaggacgaggagctacaggtgcaggatgcagttgccagtggttccaagaggagcaaagactccgccgccgccacacccagcgccaatgtcagctcaccctctgtggttcactctcaccatgccatcctccctgctcccgcgcagcggattccagaggttaagcaaccagactcggagacgacgccggcgcgggagcgggagtggaagccgctgtgccgacgtcacctcgaaccggcgcatcgactggtgcgagctggacggcgacgtccgcgtggtcggcgccaacgcgagcgtgacgctggtggcgccgccgggcgcggacaaccggaccttccgcgcggagtcgtggcgcatcaagccgtacccgcgcaaggcggacccgaacgcgatgcgcttcgtgcgcgtgctgacggtgcggtcggtggcgtccggctccggcgaggcggcgtgcacggacggcgggcgcggcgacgacgtgccggcgctggtgttctcggaccgcgggtacacgggcaactacttccacgcgttcacggacgtgatcctgccgctgttcctgacggcgcggcggtacgcgggcgaggtgcggctgctggtggccgacctccagccgtggtgggtgggcaagttcctgcccgtgttgaggagcatctccaagtacgagctggtggacctggaccgcgacccgcgcgtgcgctgcttccgccacgtccaggtggggctgaccagccacgccgacttcagcatcgacccgcgccgcgcgcccaacggctactccatgctggacttcacccggttcatgcgcgccgcctacgggctcccgcgcggcgacgtcgcggcggcggcgaggaggccgaggctgctggtggtggcgcgcgcgcggacgcggcggttcgtcaacacggaggagatcgtgcgcggcgccgaggccgtcgggttcgaggcggtggtgtcggaggggacgcacgaggtggcgcccttcgcggagctggccaacggctgcgacgccatcatgggcgtgcacggcgccgggctgaccaacatggtgttcctgcccacgggcggggtggtgatccaggtggtgccgctgggagggctggagttcgtggccggatacttccgaggcccgtccgtggacatggggctgcgctacctcgagtaccggatcgagccggaggagagcacgctggtggaccagtacccgcgcgaccaccccatcttcacggaccccaacgggatcaagagcaagggctgggagtccctcaaggacgcctacctcgacaagcaggacgtgaggctggacatggagaggttccggccgacgctccaggaggccatcgcgcacctcaggaaggccaaggccaaggccaatggcgacggaaacaactaggcatcgccgtgcgtatgtagcgtgttcattcatcctcttattaatctactcttctttttcttctttccttttcggggtatgtcggtgtatgtagcgtgcagaaatcgagcaaatgtatgatatgtggtagggaaagaagctagagcgaataatatgttctctctcttgtcatccagttttcgattgaatggcaaaaaaaaaaaaaaaacgg

SEQ ID NO: 3570 - DNA, 1557 bp, Zea mays
catccacctataatttcttactatacttggtctgatgatgacgtcttcttgctttcctggaaacaattttaattgctagtgaacctcaaggattgggggtgataaatgcgtgcttaatttttgaggatctagtaatcaagagtgagaggaggcaaaacatcgattcttcatagtgcttaaatagaaaagagtgataatactactcctttgttcgtcgagtactaaaagactactacatccattttacaattattttttagatacataaactttattattataaatctagacgtagttaagtgcaatgcaaacaacttatattttagtaatacataccattaataaataatactagtagatagtatatatatctaataagatgatattaaaggatgataataataacaattaataaatactactagtacacaaaagataagtttagcaacaattaagtttagtagtgcatgaagttgttttacgatattgataatatttatcacgcaaattttgtatattatagtgatgttttttgttccatatctatgttttatacaaattttttactgccgcaatgcactgcacatatctagttttagtactatatacaattaataaataatagataatactagcacatagtatatatctaatgaaacgatattaaaaggatggtaataatagcaattaataaatactagtagtatacaaaagataagtttagcaacaatcaaactaaaagatagccagtagaattttatttattttatattactgaaaacatcctcaagtgttcaccctgcagcccatcgcctattctatcgagtcagccacggaggcccccccccgctatcactcaagcctattctccattgtggaaccaacaaatctccaagctctcccaatttagaaacgagagatggccatgacgatgaccctcggttccatgctcatcgccgccgccgcagttgtcggcctgtgctccgtcgctcccgctgcatcagcgcgcgaggagccactacagccgcagatcgtcggcgggtggaaaccgatcaagaacgtgaacgacccccacgtccaagagatcggccggtgggcggtttcggagcacatcaagacggccaacgacgggctgggcttcggcagggtggtgagcggcgaggagcagatcgtcgccgggaaaaactacaggctgcgcattcaagcgacgaaggtcggcgggcagaaggcgatgtaccgtgcggtggtgtacgagcagcttaccaacacaaggcagctcctatcgtttgatccggcgaactgatctaattatggcgtcgctggacaacaacggttcgagtcgccttctaggatttcagattaaaattctgcaagtaccgcgtgtaacaaaccaactgatgtgttgccctagtcatatcgtggaattagaataagatccagcctatctttatctgtttttaatgttaaaaggaaataatgaactcagagtcgagataaaattaaaaaaaagaaaaccaaaaaagacccccccaggccgagtactgagcttccaataac

SEQ ID NO: 3571 - DNA, 3398 bp, Zea mays
gattgatacgataaatctgaagaagtttgaacgttcgttggtgaagccagggtctatgtggagagagattctaatatcaagtggacaccctacctgggttttaaacttctataccaccttgcgccaaaagtactcatatgatacactgtggggtgattctccaattgctgtctcttgcagacagcttatagtgcagttatgctccttggcaggctctgtgtttcctaatgataatggggatgcacagattaaacaccttatgctgatattatctgctgttgttcaatggattgaacctcctgatgtaatcacagcatcaatccgaaatgggggaagtgaaagtgagttcatagatggttgccatgccttgctttcaatcgcatctttaactactggctcactttttgacaacctcctaaaatctataaggccctatggtacagttaatctgctttctgctttgacgtcagaagctgtcaagtcggttctgaataaccagagtgaagaggaaacctggggcatagattcccttgatattttgttagaaacatggaatgttcttttgggggacgtagatgccgataaaaatccaatctcaaccgatggagcacttgcatcttcaagtttgtttaagatgattgtggagtcacacttgaaggctgctgctgattctgcgttcgaggatactgatgatactgaatattttcatgtttctgtttcaagtatgcttaaattcccgacagttcatctgttctagtatctctacctcttttggattcatcaaataataatgaagtacttcttccagaacgtgatgaacagttagccttgtatgctctaatagcacgggcttctgcaaatactactattccatttcttgcacagttgttttcagaacgatttgcccggctaaatcagagaaatggtgaaagtgatcctactcaaacactggaagagctctattggctgttgttggttactagtcatgtcctaactgactctggcgaaggagaaacactacttatccctgaagcattacaggctggattccctaatgtgattgaagcagcacatcatcctgttgttacactctcctggtctataataaatttttccaggcagtgtttagatccaggaattagggcaaaatacttcagtccacgactaatggaggctgtgatctggttcttggccagatgggttgcaacctatttagtgccacttgacgtgagtagaggaaaagtaagcagagaaattgataatgtgggtacaaatggatcccaacattccagaaaactgctaaacagttttgcttgggaaaataaccaaggagagcttgttcttgattttgttgttctcatttcaatgttagctcttactacctatcagggagaaaatgagttgcagacactgacatgccagaagctacttgctacagtcgttcgccggaaacacacatgcacttatcttgttcaactggattcatggcgtgatcttacaagagcttttgcaagtggacggtctttgctttcattgagtggacgtttacaaaggtctctagcagaaacacttgcctctggagcttcctgcatcaaagatcctgaagcatctgcacagtacctgagggatctcatgggaccagtggcagggtgcctggtagaaaatgctagcaggagtgatctaaaatctgtggcacagcaagcagatgttatttacatggtctgttgcctattggaacgactaagaggcgctgctagagctactcaaccccgaactcaaaaagttctatttgagatggctcatactgtgatgaacccacttttgactcttctggaggtctacaaaaatcattccacagtcgtatacatcgtatacatatactcaagtttgtggtggactttgttgatggtcaagctgtattcctggatgctaaagagacatcagctttggtgagcttttgcttgcaactactccagatatactcctctcataacattgggaaggtaatgctctctctttcttcaagtctgcgtaatgagtcacaagcagaaaaatataaggatctgcgagctttgcttcgtcttctgacaaatatatgttcgaaggatttggttggctttctgtctgattgtggcggtgaaggttcacctgatatcgcagaggttatctacattggtcttgatattgtgacccccttgatatctttggatcttctgaaataccctaaacttagtcgtgattattttgtgcttatatcgcacttgttggaactgtacccggaaaaggttgctcacttaaatagtgatgcttttacaaggattattggaagtcttgacttcgggctccgtaatcaggatagcgatgttgttgagaggtgcctggcagcagtaaatgctcttgcttcatacaatttcaaagaaagattaggagggagaggaagactgaactcgcagctcatggaatctgaaggatctaatggcaaactgcaggaaagcatatcaagtcacttcttgagacttctgttgcaaatacttctttttgaagatttcagatcggagttagcaggttatgctgccgatgctttgcttcctttattgttctgtgaacaggagctatatcagaggttggtccatgagttgctggataaacagcagaatccgaccgtaaaatcaaggctggcaactgcgttccataaccttacaagttcaaacaatctctcaagctcactcgaccggccaaacaggcagagattcaggaaaaacctccttagcttcatggcggatgtatcgggcttcatgcagataaagtagatgcgatggcagggaacaggtgatgtttgaccggtcaattaaaccccgaggaagcactgcaccactgtggtaggggtgcatgtgggcaccacatgtctgtggattgatgagagcgaagactgccacgacaagtctagtagatcttgaagagctagtgtcaccagaaaagacagggagatgagctagtcttagggttggcattcatagcgcatttgctggacaagatggaggcgtccctggccacgagatcgtcgtgtaaatgcgtttgttagacgcacagaaacggtggggattttgtggtggcgactcgttttgttcaattcccacaggcagaaggtagagatgttaagttgatgtaaataccgtttgatttaaacatgccttattcgtaggagaaagcgacacggcttgctgtaacttagggtttattactctttctcgtggcataggatccccaaagaagtctttgctggggtatttgcagccaaacgatgaccagtatgattgcgagaggttttcaatcttttgtaccaaatttggcctgcagttatgatgacactgagtgccgatacaggcatgaggcattcc

SEQ ID NO: 3572 - DNA, 2125 bp, Zea mays
gtaccccctcgcggcctctcaagtctcgactacaccccaaagaggaaaggaaataatccccaattaccgacatcgacgccgacggcgatgtccctccgcaagcgccagcgctcggcgagcagctcccgcctcaccgccttctgctcgccaccgtcccctcccgctcccccgtctacttccagctctcccaacccgcataccttccccaacgccgacgtcgtcctccgcctcttcctcaacccctcctcccccgacgacgtggacgtcaagcccgacatcgaccgccacctctccgcagccgtctcatccggaaccttcgtcgacctgcacgtctcgtccgcgtccctcctccgctcccgctacttcgccgccctcctttccgaccgctggcccaccgccgcgactggccgcctctccctcgcggtggtggcgcccccctcttgtccccgcccgttcgatgcccacatcgaggtgctccgcctcctccacactctcgatttcgcgggtgccatccgctcccccgacgatgccctcgacctcctccccgtcgcgctcctgctcctcttcgacgcctgcgtcgaggcctgcatccgcttcctcgaggccgtgccctggtccgaggacgaggaggcccgcatcatcgacctggcgcggctcctccccgccgatgaggcagccgacctgctcgccagggtttctcctcctcccgtcgccgccggcccttccgctgcgggggtggcccccaggtcgccctccgaggcgatgctgcacggcctgatccactcggcgatccatggccaccccgtccacgctgccaccaaggcgttcgtagcgatgctccttaaggactatccgtcgcggaactgcgtccacaaggtgctcgacgaggcatttcagtcgcgcctggacacaatcaaggagctcatggggaagtacgctagcccggatttcagggttgcggtggacagtgatgaacgcgaggccatacagaggcttaacctgcagtctgcggtgttgaatgtgaaacacctgtattggctcatcgagaggatggtcgatctgagggtggcagataatgcggtgacgctgtggagtgatcaagctgccctggctactgatttgcagaagttgctgaatgatgcagacatgtggcggaacatgacgcctgggcttccaatgcttgtgactcgttgcacactcaagctcgccaattcagtcatcactggggagactctggtacctcggcaggtgaggaggatgctcgtcagaagctggctccctgtcctaaacgtctgccgggacattgttcaaccaatgcactcccagaaatcaaccaactgccaagagctggagggggcgtttcttcagatcatctccacattgccttttctagaagcacaggagctgctgcagcaatgcctggggttctcgactcgcaatgtcgatgactgcccgcatctggtcacggcattcaagacgtggttccggcgcgctggccgggctcctctaggcggggaaaactgaaacatgagcggatgtctgtatgcgcccaatcggtgcttgtgtcgctttgtattctcacatcacatagtctgctatcggcctacctacatcctctggatttggtatagtgcttgcctctctctctctctcgaatttgtctgtatatactgtcggtcgtttttgcacttaattgcacctactacttttagctattgtctataatcaataaccaaggtaaatgtatgcagcgtaaaaaaaaaaaaaaaaactctaacaatgaggtctgcgtgcctattttcactcaatgtgtagtgtctgttggccgcactaatatttccagagtactacaactggttgtgaaaattgctctcaacaaagataagttgtataaatccgcgctctattcgttatcagccaaaaacatattaaagaattctaatttgtcagccagtaatatgtttttttagagtacaactagtgcatcattatcagccaaagtttgagctccgaatcaaaggtaggcagtttttgagccagtctgatcactgtgtagtgtattaacctttaaaacctttgtgtgcaaccaacatacaacaaacaagctaaaggaaaccctcaaaat

SEQ ID NO: 3573 - DNA, 2313 bp, Zea mays
  misc_feature (2173)..(2173): n is a, c, g, or t
  misc_feature (2220)..(2220): n is a, c, g, or t
gcacgagaccattacctagaacatcctaatcgaaaagattggatttaaacccgggtttgcgcggggccggccgggatcatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaagaaagaggaagggaatgcattgttcaaatcgggcaaatatgctagagcttccaagcgatatgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtagcttttggggtggaggatgttgtggtgaagcgaagggattaaaaacaccgatttctgctgccgaaggacttcgcccgttgcttaacttctcgcttttcgcatactttgtagtcaattagtgtgcacggatgcttggatatgtgaaactgaggaacatgtacttcgaggattattattggttctgaatttttatgttttctggttcttgttaggaccattgaatgttctctctatataattttcggacacatgttcttaataaaccacgggagcaaaagtttatgcttaaaaaaaaaaaaaaaaagccccttgggccctggngaatttttttttttttggctgtctttcttgactctacgtggcgtgcnctcctgcatttaaaactccccccccgcctcctagtggcacaaataaaaaaaaatatatctcgctggcccacccctgggggagagtttttctct

SEQ ID NO: 3574 - DNA, 2135 bp, Zea mays
ctcgaggccggccggaaacccgggtctgggtggcgtcgcctttcatcattcccccctcgtgctctctctcgaaccttcttccaaagcacccgaaccctagtgatctcggaaccctagccgcgcgcggatctcggcttttccccttcctccacgccagccatggacggggacttcgagatgcctcccgccggcgccgatgacatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatacgaggcctgtctggaagatggtactgttgtatccaagtctgagggggttgagtttactgtgaaagatggctacttttgtcctgccctggctaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaatgagggtgctgttgttgaagtcaaaattatcggaaagcttctggatggcgcggtgtttacaaagaaggggcatgacgaagagctatttaaattcaagaccgatgaagaggaagttattgccggtcttgatcgtgctgtgttgaacatgaagaagggcgaggttgctcttgtcacaattcctcctgaatatgcatttggttcaaccgagtctagaacgcaggatcttgctgttgttccacctaacagcacagtgatatatgaagttgagcttatttcatttgtgaaggacaaggagtcgtgggacttgaacaatgaagagaagattgaggctgctggtaagaagaaagaggaagggaatgcattgttcaaatcaggcaaatatactagagcttccaagcgatacgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaacttgacagccaaaatgtcaaagctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtaactgtcactgccctaagtcagcgtagcttttggggtggaggatgttgtggtgaagcaaagggattaaaaacaccgatttctgctgccaaaggacttcgcccgttgcttaacttctcgcttttcgcatactttgtagtcaactagtgtgcacggatgcttggatatgtgaaactgaggaacatgtacttcgaggattattattggttctgaatttttatgttttctggttcttgttaggaccattgaatgttctctatatataattttcggacgcaggttcttaataaaccacgggagcaaaagttggatccg

SEQ ID NO: 3575 - DNA, 2622 bp, Zea mays
gaaactagaaaatttgggataggaagtatgtagtgacgattagggcatgtacaaactagattttcctgaccatgtttataaacacaaaagacacctaaaaactgtatgatacaatggagtgttcttagaatcagtcacattataaatacaattaagagactacacatggagagtcgtgtagagacactctttaaaagtgtctctcttctattttttatttaacctcctagagacccattaagaccttgttcggttgggataggtcgagattgagagattaaatatcttcctatttaattttgactagaagtggatttaatattctctaattctctttgatgcctttcaaaacgaaccagccctaagagatatggaatgaggttgtccatgcccttaaatttcgcgagaggtgttacaatttcattaatctaggtgatatcttattgggtcagatactcaggccgaggcctgaagaatatcccttttgttgcaggaaaaccaagagcctatgaatgaatcaacacctaattatctaccgactatgctacttctgcatagtattagtattcttttctaatactacctccgatttttaatatttatcgttcactagtttatttttaaaataaaatatgacaaataaaaaaaacggatgaagtattatataataatttgtaacaacaaaacaagaaccacgccacagaagaatagtgaaaagaagactttgctaacgtactattcataaatttgaagagtttgaaatgatgcatcagtatatgcaaggtagaaataaatgatacgtattattcagatatcacactgcaccgccattgatttgtttaggcatatgatgagataatacatgctcgaaagtcttgtttctcctcgctatctggtggtgcatcctaacgtggctcggcctaaacaaccacgattacacagcaatttagcgagttagggcggtgggtcggccaatatgctcacaaaacaaggccaaaatttaaattatcattcttgtggtgatcattgcacgccgcccatagtattgtactgcacatctgaggcaaggtaccaggccattagcggcttatgatgtgtatttaagcagactaagctgataggctatggccatcttctctagccggaggaccgaaacaccgtcagagaaaagatggtgaagcctgcatttggaagcttcggcgactctttcagcgccgcgtccctcaaggcctatgcggccgagttcattgccacgctcctcttcgtgttcgccggcgtcgggtccgccattgcctactgtgagcttctctactgtcacaagcacctccgtcctctcatacctcgcttcactttccgcacgcactgaccagggatgccaacccccaaattcgccttgtgcagcgcaactgacaaagggtggcgctctggaccccgccggcctggtggccatcgccatcgcccatgcgttcgcgctcttcgtcggtgtctccatggccgccaacatctccggcggccacctgaaccccgccgtcaccttcggcctcgccgtcggcggccacatcaccatcctcaccggcgttttctactgggtcgcccagctgctcggcgcctccgtggcgtgccttctcctgcagttcgtcacccacggacaggttcgactcgacgagttttcactgcgcgccttctccctcccgagagagaaaatccaattaattaactaaagcgctgactctgaagcttaacgaactgtgcaggctatcccgacgcacggcgtctccgggatcagcgagatcgagggcgtggtgatggagatcgtgatcaccttcgcgctcgtgtacaccgtgtacgccaccgcggccgacccgaagaaggggtccctgggcaccatcgcgcccatggccatcggcttcatcgtcggcgccaacatcctggccgccggccccttcagcggcggctccatgaacccggcccgctccttcggccccgccgtggcggccggcaacttcgccggcaactgggtctactgggtcggccccctcatcggcggcggcctggccgggctcgtctacggcgacgtgttcatcgcctcctaccagccggtcggccagcaggagtacccatgaaagtcgatccggacccgacccgacccgtcgtgttgatctcaccatcgtcgtcatgtcatcgccttgtgcttgtgaagttgtgattatgtttgatcttatttgcatttcccttctggttttcattcattcagcaacggtgccaagatgctgtaagcgagaggaccgtcgttcgatctatatttatgtatataaatctctattcttataaaccaccgattttgacggtcgtcgtaaaccaattttttttttaaaaatcccttagcattctttgaatgaacccaccatttctccggatataatataatcagcaacgcccggccatctagggctaggcattcggtttgaaatttcggttcgttttttggttttaaaaaacttcagttttctagacattagaaatcgatcggttttctcgaaaataaaaaactgagaagttcagttttggttttttatttcggtttttcggtaaaaaccgaatatcaaacttatactcaagaca

SEQ ID NO: 3576 - DNA, 1143 bp, Zea mays
  misc_feature (853)..(853): n is a, c, g, or t
  misc_feature (857)..(857): n is a, c, g, or t
  misc_feature (1015)..(1016): n is a, c, g, or t
  misc_feature (1033)..(1033): n is a, c, g, or t
taagctatagcccgggctgcaggaattcggcaccagatcttcttctctgaattccagtccaagggccggaataccgtcagagggagtgggagagggggggaaaaaagatggtgaagctcgcatttggaagctttcgcgactctttgagcgccgcgtcgctcaaggcctatgtggccgagttcattgccacgctgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccggcggccacctgaaccccgccgtcaccttcggccccttcgacggcgcgtccatgaacccggcccgctccttcggccccgccgtggcggccggtaacttcgccggcaactgggtgtactgggtcggccccctcgtcggcggtggcctggcggggctcgtctacggcgacgtgttcatcgcctcctaccagccggtcggccagcaggagtacccatgaaagtccggatgagctagcccgatcgatccgtctgtgttgatttcaccatcgtcgtcgtcgtgtcatctggcgcttcgtgctgtgatcatgttttgtcctgtttgcatttcccaacgtctggttttcatttccattcaccaacggtgccaagatgccgtactgcaagcgagagaagtgtgttcggtctgtatctgtataaatgcaatgcacagttcggcgtttccaaaaaaaaaaaaaaaaacctcggggggggccccggaccccaatcccccctataggagtgaaaataaaaaacnccgntgttagcgaccgtctgcatgtattacaatatgcgtctatttatcttcccgcagtatttaaataaccctcgcgagcacggggaaggagcaaagagagatcagtaagagggaggcaagtgcgcgacagaaaagaagaaaggaagatcccacgcgaaatcnntgaataaaacaactgtntaatttatacatgaattctaataggacaaagcccgcacccgccgaccatatacattacctcagatgaaaagggaggcaaagagatcaggacagacaagcaacaatattaa

SEQ ID NO: 3577 - DNA, 1115 bp, Zea mays
cctcgaggccggccgggccggaatctgcggcctgataagctatagccatcttcttctcttctctgaattccagtccaagggccggaataccgtcagagcagagggagtgggaggaagaaaaaaaaaagatggtgaagctcgcatttggaagctttcgcgactctttgagcgccgcgtcgctcaaggcctatgtggccgagttcatcgccacgctgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccggcggccacctgaaccccgccgtcaccttcggcctcgccgtcggcggccacatcaccatcctcaccggcatcctctactgggttgcccagcttctcggcgcttccgtggcgtgctttctcctgcagtacgtcacacacggacaggctatcccgacgcacggcgtctccgggatcagcgagatcgagggcgtggtgatggagatcgtgatcaccttcgcgctggtgtacaccgtgtacgccaccgcggccgacccgaagaaggggtccctgggcaccatcgcgcccatggccatcggcttcatcgtcggcgccaacatcctggccgccggccccttcagcggcggctccatgaacccggcccgctccttcggccccgccgtggcggccggcaacttcgccggcaactgggtgtactgggtcggccccctcgtcggcggtggcctggcggggctcgtctacggcgacgtcttcatcgcctcctaccagccggtcggccagcaggagtacccatgaaagtccggagctagcccgatcgatccgtctgtgttgatttcaccatcgtcgtcgtcgtgtcatctggcgcttcgtgctgtaatcatgtttggtcctgtttgcatttcccaacgtctggttttcatttccattcaccaacggtgccaagatgccgtactgtaagcgagagaagtgttcggtctgtatctgtataaatgcaatgcacagttcggcgtttccatgaaaaaaaaaaaaaaaaaa

SEQ ID NO: 3578 - DNA, 1892 bp, Zea mays
ctcgaactgtagctccgccacgtggatcgtctcagcgcatgcatgcatggtcctggactgcatgtactcactcatggaggccagaggccagaggccacggcagaggttagagaacccatgtcgcaccaagccaaaaaaacaaaaccaaggaaaaccactacgcccttctcgatccgtctagagcgtagcgtagcgtagcgtagcgatggctttagccatgccagcttgcctgtaaatatcagagtatgctcacaggcagcacgggctccatctactgggattctcgttttaaacccctgacccccatgcatctcgcacgggcacgggcacgggcacgggcaccggcacggcacgggccacggttataaataaccacacaccctcaagggctgaaccgaaccaagcagtaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctcgccgctgcagggccgctgccccgccgtcggctgcgccatccagggccgctgctccgtgcaccaggtgcccagcggcgactgccgcaacgtccaggagatgaagatcatctactgcaacccgcacgtgtgatgcgatgcggacatggggtcgtcgcgccatctcgcgacctgtgttgtgctttctttcatgtcgccgtcgccgtcgtgtgtccaaccgccattgtcgttaggttgttgttgattagccgtttgcttcgctcagtagcctcgctctccagtgtattatcactcgcatcgcatgcatgtgatgtgagccactgcacgcgtgagtgtcacatgagtcgtcgtcctgtctcgtctcatgtgtttgaaattgtaggcagcagaggatcgagatgcgtgtctgctttgttcgtgttcactgctgtcagtctgtcaccgagttcaataatttagctttgtttcatcgggaaataaaaaaaaaaaaaaaaaaactgtagttgttggatggcttcccaataataataataataatatagtttattttaaataattaacagatggctaccgtagttttgaagcggaggcaatatagctaaatcggtctatgtgtctctgtagtaaaagttcaaacgcacacggtcatggcctcatgggggcaggcagggcagggcacatggacggtccgatttgtccgactcgaacaaaattaatgaggcccccacttgagttgtaagccctgagtctgagctttacccacggcccatcatcaaagcctagagatgcccaccttctttaaaggtctgttctttatatattacaaccagctgccagccatatcaaacaactgtttagtatttatttagcaactttattttttcaagatatttctatttttaaaggagaataaactattttctcttggaaataaaaatcccttaaaaatcaaagaagcccctacttgagatcttggcacttatgggttgtaatttgtaaggtctgggcttgagctttacccacttatggggcagagcgcg

SEQ ID NO: 3579 - DNA, 1091 bp, Zea mays
  misc_feature (25)..(27): n is a, c, g, or t
  misc_feature (648)..(648): n is a, c, g, or t
  misc_feature (746)..(746): n is a, c, g, or t
  misc_feature (1072)..(1072): n is a, c, g, or t
gccggccggtccgggtaggtaaaannnaaaaaaaaaaaataaagaaccaagcagtaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctcggccgcctgcagggccgctgccccccgccgtcggctgcgccatccagggcccgctgctccgtgcaccaggtggcccagcggcgactgccgcaacgtccagggagatgaagatcatctactgtaacccgcacgtgtgatgcgatgcnggacatggggtcgtcgcgccatctcgcgggcctgtgttgtgctttctttcatggcgcccgttcgccgtcgtgtgtccgtccaacaccgccattggcgntttaggttgttgttgattagccgtttgcttcgctcaggagccttgctctccagtgtattatcactcgcatgcatgtgatgtgagccactgcacgcgtgagtgtcacatgggtcgtcgtcctgtctcgtctcatgtgtttcaaactgtaggcagcagaggatcgagatgcgtgtctgctttgttcgtgttcactgctgtcagtctgtcaccgagttcaataatttagctttgtttcatcgggaaattgaatggatgtctgttgttgttgaatctatttttaatttttgaataataataataatatattgtttattttaaataaaaanaaaaaaaaaaaaaaaaaca

SEQ ID NO: 3580 - DNA, 1129 bp, Zea mays
cagcactcccacccccgcccgccaactgggattctcgttttaaacccctgacccccatgcatctcgcacgggcacgggccacggttataaataaccacacaccctcaagggctgaacccaaccaagcagtaacattaatcacccactctactactcttagttactaccagcagcttgcttcaacagtagaagagagcgagccgaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctcgccgctgcagggccgctgccccgccgtcggctgcgccatccagggccgctgctccgtgcaccaggtgcccagcggcgactgccgcaacgtccaggagatgaagatcatctactgtaacccgcacgtgtgatgcgatgcggacatggggtcgtcgcgccatctcgcggcctgtgttgtgctttctttcatgtcgccgtcgccgtcgtgtgtccaaccgccattgtcgttaggttgttgttgattagccgtttgcttcgctcagtagccttgctctccagtgtattatcactcgcatgcatgtgatgtgagccactgcacgcgtgagtgtcacatgagtcgtcgtcctgtctcgtctcatgtgtttcaaattgtaggcagcagaggatcgagatgcgtgtctgctttgttcgtgttcactgctgtcagtctgtcaccgagttcaataatttagctttgtttcatcgggaaattgaatggatgtctgttgttgtttaatctatttttaatttttgaataataataataatatatagtttattttaaataatt

SEQ ID NO: 3581 - DNA, 3797 bp, Zea mays
  misc_feature (3538)..(3538): n is a, c, g, or t
ggtcggttactgcttcatcaagaagaatttaatgcagccacaaatcattgtagtgtggtaggttactgggaacacatagatctggaggacgtgatgacaccagctgaagtgtacagcacattgagagacaagggctattgtatcgagtacaaaagaatacctctaaccagggaaagagaagcattagctgccgatgtagatgctatacaatcatcaattgatgagtacgtacactaattcttgttatataatctataattttgtgagttgcattgctcagttaccggatacaatactcactattgcttctccacagatctgctaggtactatctctttatttcacacactggatatggaggtgttgcttatgcgatggccattacctgcctgggactgagtgcagatgcaaagtttgtaatggaagaaacagcagaaacacactttgtatcaacatctcttgcgaaaaatgtgtccatcaaaactaaaactgacatagcacttaagcagggtgactaccgtgacatattaaacctcactagagtgttggtacatgggcccaagagcaaagaagaggttgacacagttattgacaggtattatggagttgtttttgctgcttgagatgtgcttttatatgaatgaattaaatacattcgtgaactaactgcaagtttgacgagtttcattgttgatataatcgatcttaacattgttgtacattttcttaatttcccgtttcctccttgaaggtgttctggtgctggtcatctgcgcgaagatattatgcattacaggaaagcactgcaagattgttcacatgacgacgacgacgactgtgatgaggaacactcttatctcactgatatgggcacaaaagctttgaggtgtgtttaatttgtttcaactgaagaatgtgtatttttaaatgcattatctcctctctcttattcatcacctattctgtttgttcacattagatagataattctcaagataaagtattcacattagtatcacctgatgaaaaagtggccctttaccttaaattcgtgataaaatgatttcttatctaacaatatgattcttgttatttagcacaaacacttcaacttacgcgttttcattatatgttagtcagtacctcaaggaaccatgcaatgatagtgttcaaacattttgtagtgcaatacactgacataaaatagggcctaattttgatctatacttctggaaaattagtgctttttataagtgccacagaaaacacgcaattgactgtgccaccagaaatattggtatttttcttttttttggactagagttatatccaggtacatatgacattttgatctatcaagaatcccaacaattaatgttagctagcaacattccagccacattatgctcataaccatgcgtccatgtcacacatgacgtgcttgtgttgccaagggaacaactggtcaggtagccataactaaccacgtgtgttgagtgggctggctaaactaccacgaaattcacaatgggcgtgattggaaacctgcatggaccttgggccaggttccacgcgtgcaggtggcgagatgtttggatgcctgcatctgcctttgggccaggcagcatcgatgcaaaagggggttcgggccaggctgggccagtacgtgggggttgggcgtacttggggagccaagttgagttggtgcaggcacgtaaatcaagaattttttttgttccggtttttttgttatatctcaatcgatacatctaattaataaactgattgcacctttgtgttcatgacatttttgcgaacaaaactagactgcacttgctatataacaattttagttttccatcttattttaaccgagtcaaccaaacatcgttccctcggctcatcacatacgaccaaaccaatcacatttgtctgtaccaaaccaacatagctccatatcgcagcctggccctatcgagcaagagcaaccaatcacgcctaatataacccatgtcaggccttgtttagctgcgctcatatccgcctcaatcaacatgcggagtggattaggacggatttcctgttagccacatgataacacattaacgatgttgtgttttatcttgttaactagtcacctccaatgaaaattttgcttctatattaattgaaaacagcctggggatcaggacacattttatcaggccttttattcatgtcacaacgtgcttgctctatcatggtctgcttcacaaactatgctcaaacacataagcgtgaaatgaaaataaagcacaaagtgaaaagaagacacgtgtttgtttagtccagcgtgatgtttggctagagtattgaacacgttggtggcaccatgctaggtttctaggatgttgataaggagttttttttagaatccctattttagaatccctattttatataaaaggtaattttatatgtactgtagtgacatgtttaactctggcaccatgctaggcattgtgtgttaatcaatgtcttagctacatattcccaaatgcgcaaaaaaactgcttcaatatatttatttgattttcacttggtattgattcatatcatttttttgtgtgtgtcgcaggcgttacttttttctgatcaccttcagatcctacctatacagcacgacatcatgcaaaacaacatttacatcatggatgaaggcaaggcctgaacttggccacctttgcgacaatctaaagctggacaaataggccatcttcatgtgacgtgattatgtagttgtgtcacttccttggacacattcacccagagtttcaaaaaggaaggagactaaaagaacgggtagagaggaagcagtggttatgggagttgtggacaatggaagagcagcttaggctgttggaaagtagggcattgtactatacttgtcggtgttaattgacaccagcaagcatgtatatattgtcaggcgtattatagatgaacatattagatatttctattgtagtattttctcaaattttaaaagaatcatttcatgcagttcattctcatgtatgtatctgatatgcttgctttttcagcagcgtttttttagacaaagctcttcggcagctttgatttttgacttctctgccttctgggcgtcaatatggccgcagccttttctaggagttgtattgagctaggatgaagcttgaaagaaatacgatgtcttgtttctaaagcccccttattgacttcagttgatgcatctgaagtcagtacggctcctcattgttgagtcgtgaatttttacacaaacattgtgtcaatttttaaaaacgccaatatttataatgccaaattaatatcactacatacatcacttataaatgatatttttatccataaagttgttcagatgtcaaatagtttgacttaagagaatcctcgaaattgattgattttggagcgaagaaagttttcaatagttttttttataagtgaaagtcatcaatacttcggcttgaaaatttgcaccacccaaactggacanatgacataagttcacatcagggcaagacgttggcaggccccacacgtcagcgactgaccaacgagtattgtctgcgacggcgacgcagacggtccacgtatgcacaaaatcagttagagttccagatttctagcatgatttgttagcaaaacttgtggtattaactagagaactgacttgtaatgggttcatactgaagaaaacatgtgacacctaagagagcgagggtgttgaattaggacttctaaaacttcacaaa

SEQ ID NO: 3582 - DNA, 1238 bp, Zea mays
tcggccgggtcaatgtagtgcggtaggttactgggaacacatatatctggaggacgtgatgacaccagctgaagtgtacagcacattgagagacaagggctattgtatcgagtacaaaagaatacctctaaccagggaaagagaagcattagctgccgatgtagatgctatacaatcatcaattgatgaatctgctaggtactatctctttatttcacacactggatatggaggtgttgcttatgcgatggccattacctgcctgggactgagtgcagatgcaaagtttgtaatggaagaaacagcagaaacacactttgtatcaacatctcttgcgaaaaatgtgtccatcaaaactaaaactgacatagcacttaagcagggtgactaccgtgacatattaaaccttactagagtgttggtacatgggcccaagagcaaagaagaggttgacacagttattgacaggtgttctggtgctggtcatctgcgcgaagatattatgcattacaggaaagcactgcaagattgttcacatgacgacgacgacgactgtgatgaggaacactcttatctcactgatatgggcacaaaagctttgaggcgttacttttttctgatcaccttcagatcctacctatacagcacgacatcatgcaaaacaacatttacatcatggatgaaggcaaggcctgaacttggccacctttgcgacaatctaaagctggacaaataggccatcttcatgtgacgtgattatgtagttgtgtcacttccttggacacattcacccagagtttcaaaaaggaaggagactaaaagaacgggtagagaggaagcagtggttatgggagttgtggacaatgaaagagcagcttaggctgtccgaaagtagggcattgtactatacttgtcggtgttaattgacaccagcaagcatgtatatattgtcaggcgtattatagatgaacatattagatatttctattgtagtattttctcaaattttaaaagaatcatttcatgcagttcattctcatgtatgtatctgatatgcttgctttttcagcagcgtttttttagacaaagctcttcggcagctttgatttttgaaaaaaaaaaaaaaaaaaaaaaaaaaagaaaaagaaaaaaaaaataaaaaaaaaaaatataaaaaaaaaaaaataattttataaaaaaaaaaaaattttatataaaaaaatatttataaagggggg

SEQ ID NO: 3583 - DNA, 4967 bp, Zea mays
  misc_feature (4366)..(4366): n is a, c, g, or t
cgcacaaatggaaaagtgcaccaaaattctcgcgcgccaacggattaaccagcaacctcagctcttagcacaaccgacacaaccatctgagcattcaagtgatttagttttagatggacccgatgacgtatttaataatggtatacactgaaaaattaccatgcaattaattacttcttgtatcataaatgatatcctaaacgaccttattttttagtacgaacggagtacttgttcagggacacgtgcacctatctggaacggagcgagtaggatacgtcgaacacgttgtctccacgccgaagaatcccgctctccagttctccactgcctacgtaatcctaccgccgcgtgtaccgcgcctcgaaggttcttgctcccgaaggcaccggccgacgcgtcaccgcactgcaccgcaccggctataaaaactttcccttctcgccgcccggcccgccaatcggccccatcactcttccgtcgtgtcttctcgcgctttccactcccaacgagatccatcacccccgacctctgtaagcttcccttgacgtcgtcgtcgtcatccatggagagcaaggacggcacccacgatcccgccacgacggccgcgccaccggccggcgcgccgcagcccgcgatgccttccgcggagacggcgcggtggggcacgcggcagatgggcccgccggcggcccccggggcgcacccggagaaccaggaggcggcgcggtggacggccgcgcgcggggaccaggagctgccgccgtacgtcatcatcggtgagcccgtggcggcgccgccgccgccacagcataggggcaagggggacagccccatggagcacatcctcgacttcttcaacacctggagccgcaaggccgaggagctggcctccagcatctgggtcaatcgtaagttcggatcctatgcttttgtttcggttggttggagcagaggatgctctgttttgctcgtcccctgatcagagacaagaggcactgaaatctttgctttgttgttctacgtggcactattagacgatgcatttcctaaatctaccaatatcagccgattctaagctagagttagctattatatagataacagaatatacatatagcaacttacgcaaatgtcagcagaaactcacggattaaccttgaaattgaaattcaacatttgagcatgtagtaatttaagctcttaagttggtcattattcattaggctcaatacaactcggatcgatatcgaccacaactgttagatcggtttgtccgatcgataggtaggtctacgaccatctattcagagccaaatagattggttgtctattcagagccagatagattggttacagacaaccgtattgaagaacctgttgataatgatcgactttagtggtgtcaactggctatttttttaaccattaaaaatgttaaacaatccgtaaaacaggttttttaaaaaaaactagaatataatctataaattagattttatttatggattatttattatttatttttatatttaagttatgcagttttatttatggattatgtattttttattatatttgagttatataattttaaattgttggtatataactaaatgtcggtaaaagaaatttgaaaacctggcgatgagctgaataaaaaccaatgtgtaaaagctatacacatacacttaagttttatgatagactaggaaagtgttgttacgatttttatttatgttttaagtatagaatacagaacaaatataagtattttgttggctagatgggtgtaaatttgaggtttaaagccaacaaccataatttgaatctctatttgtatatgattttagcattttttattatttaaacgtagaggagcacaacaacggtttaaaccgtagaacaagaaaactgactatttaatatagtagagatataaacggttcatttgacccttgtaactagattcatttaacaatgcagcactgtattttctatgatgatgcggaaatatgaatgctgccaagcctttttttactttcgaaaagaacacacttccatcttgtctctaaattctgcttgttgattttgaaatctaatctatgcctcctcatctagtccaccttgaaaagtagttctagggtacttgaatgctgggaagtggtaaggtcaggtcatgggctcatggcaaacctgcttactcttctactccaccttaaacagtactacagtagtagttctaaggtacttaaatgctgagaagtggtaaaacgaggtcattgctgacacactaattaaaccacatgctaataaggtcaaaagcgaatatctgtgcccatttggtgatttattttatggtgagggaattaacccagctcatttcctgtagccttaatcaaactgttgacccaggccaggtgctggggcctgggcagcacatttgacgtgtgtttgtttgttgtacatgttccagtgaaggccgcgccatccatgtcggacgccgcgatggggaagctaagcctcggcgcgaaggcgctgtcggagggcggcttcgagaagctgtacaagcagacgttctcgtccagccccgacgagcacctgaagaagacgttcgcttgctacctctccacggccacggggcccgtcgccggcacgctgtacctgaccaacctgaacgtcgccttctgcagcgaccgcccgctctccttcgccgcgccgtctggccagaccgcctggagctactacaaggtatggtatggatcggtgtcgcatgcatgggcgcgtacgtcgtcgtcaaaatgaaggagacgagtggccgtagagatcgatgagagacatatgagtcactcacgctttgcttctcgtgctgcatgcaggttatgatcccccttggcaagatcgcgacggtggagccggtgacgttgaaggagagcccgccggagaagtacgtccacgtcgtcaccgtcgactcccacgacttctggttcatgggcttcgtcagctacgacaaggccgtgcactacctcgtcgaggccgtctcccagcacggcgtcgccactgccggcggcaagtgatgaggcgacgccgctccggagactgggcgttcggcacccgtcgtcgtgtatatataatatagctgatggctctgcctgtgcattactcgtgttctgctactactagcactacgatggtgtcccggcgtgtgtttgaatgttctcagtgtgtgtgtgtgtggcacagatgcgccactgctattctatgcacttgtgagtattatgctagctttcacggactcgtcgagaaacgagagtgaagttcttcctgtctgcagcacctacatcgagctcggactgtggtagaattacgaattcactgggcagatacgaatcgatcctaaatccttgccggcgggtaatttgaatgaatcttaatttgtgtacatgcagaatggctcattttgagcactcatacttctttaaagctaaagaagcactagtttcgtttattctttacttaattgtgtccacgcacgacacgttctgttactcctcgtttctcgtcttcgtgagaaaccacgacaaataagctataaaaataaaaaataattagacttctttttaactcatattttttgtcttttagtttagataaagtgtattatttttcttatatatagactatatgtttattttaatattaaatttatttttatatgtgtcaaatataattgtgtgtaattgtgtgttatcgtaaatacatagtgagattaaccggttacgtatgagcaaccggtggttttacaatcgatcaccttagattgggtcctctatcgattatagttttgggatgttctaccacatggtgttgtagaatgaacgacaaaaattgatgtgtaattttagcatcatagtcaacaaagtcttaacggggttaatacttagactgtatctagagattatatgcttctctttcctatacattctatagtttttaacgatattccctaaagcctaccttaaatacagaaaacgctttatactctatacatagtgagatattcttgctctcttctctaccctctctatacatctctctcatctctcctttatccatttttatagtttagacaacacattataaaaaacatatatacaaaaaaagctagagcaaaatttgtatctaatacatgtccatgtatcctttaaaaaaatgctattttatgcaatttatggagcttttatttttagatttttgggaaatagaattttgcctctcttctctcacttacctataggtcccctctatcagtcgttcaacgcatgcgctacttgcgcacccatgtgcacttcccactctagctganccgccaacccacttatcgccccttctccctgtcgcactcgccctctcgtgtaggttggacaaccttgatgtgtgtgcatcaaaattgctcttatgattagacaacaaagaggacaaagcaaacagaacatgtgaagtgttagcttaggaaggaccacatctagacacaagggccaaagtggatgcactcgggttctagatctcgacttagtctagtggtcgctctcggtggacttcaacttgttgaaaagctcatccacaatgagggtctcatagttgggtgattctatgatagtcgagccttcccctcccagaccctttaatctggagaatgcaataacttgagtgctctcttatgctcatcatagggtaactacgccttgtttgtgctcatgttgtttacaattgaatagaagcgagaaagcatagaatcaatggtctatccagccaattgaacaagttctcatacttccgcgggtaggtctcaaagatacttgttttcacaagatcatgacccacactgaattcctccacggtagtacaaatctcatgagtcgtactaagatgtcccacactaccaaacatagagagcaagaggaatg

SEQ ID NO: 3584 - DNA, 1237 bp, Zea mays
  misc_feature (32)..(33): n is a, c, g, or t
ggtaccctccgaggtctcggcccgggccgggnngggagtatggtcgcaagggctcgacccccgccaatcagccccatcactcttccgtcgtgtcttctcgcgctttccactcccaacgagatccatcacccccgacctctgtaagcttcccttgacgtcgtcgtcgtcatccatggagagcaaggacggcacccacgatcccgccacgacggccgcgccaccggccggcgcgccgcagcccgcgatgccttccgcggagacggcgcggtggggcacgcggcagatgggcccgccggcggcccccggggcgcacccggagaaccaggaggcggcgcggtggacggccgcgcgcggggaccaggagctgccgccgtacgtcatcatcggtgagcccgtggcggcgccgccgccgccacagcataggggcaagggggacagccccatggagcacatcctcgacttcttcaacacctggagccgcaaggccgaggagctggcctccaacatctggttcaatctgaaggccgcgccatccatgtcggacgccgcgatggggaagctaagcctcggcgcgaaggcgctgtcggagggcggcttcgagaagctgtacaagcagacgttctcgtccagccccgacgagcacctgaagaagacgttcgcttgctacctctccacggccacggggcccgtcgccggcacgctgtacctgaccaacctgaacgtcgccttctgcagcgaccgcccgctctccttcgccgcgccgtctggccagaccgcctggagctactacaaggttatgatcccccttggcaagatcgcgacggtggagccggtgacgatgaaggagagcccgccggagaagtacgtccacgtcgtcaccgtcgactcccacgacttctggttcatgggcttcgtcagctacgacaaggccgtgcacaacctcgtcgaggccgtctcccagcacggcgtcgccactgccggcggcaagtgatgaggcgacgccgctccggagactgggtgggcgttcggcacccgtcgtcgtgtgtatatatgtagctgatggctctgcctgtgcattactcgtgttctgctactactagtactacgatggtgtcccggcgtgtgtttgaatgttctcggtgtgtgtggcacagatgcgccactgctattctatgcacttgtgagtattattatgctttcacggactcgcgtcgagaaacgagagtgaagttcttcc

SEQ ID NO: 3585 - DNA, 1043 bp, Zea mays
  misc_feature (50)..(50): n is a, c, g, or t
  misc_feature (78)..(78): n is a, c, g, or t
  misc_feature (222)..(222): n is a, c, g, or t
ttttttttttttttttgcttttttttttttccacatttgatgatttcagnctgaacaccgaatccacagcgcattctnttaaacaaagccctaaacaacacaatcgtctacgtgttgcaatggcaggatcgattcctgtcgaagtaggaaccggcagttcaccagcatctaccaactcgttcgatttccatcgcggaccactcttataaaacccacacaggncaaagcctgaaatcggcgaaaagaagaagaaaaaaggcagcggcaacagaacactacccattccgggaacttcctgacaagctaggtggtctggtcacacgtcacgtctaagcaaacccaagcagtttgaaatggcggcgagagcgagggcagcggcgccgttctggctcctggccgcggccgcggtcacgctgctggtggcggcggcgtccgcgcagtccggcggcagcagcagcgacgactgcacgtcggcgctggtgagcctgtccccgtgcatgggctacatcagcggcaacggcacgtcggcgcccagcgcgtcgtgctgctcgcagctcaaggccgtggtgcagtccaaaccgcagtgcctctgcgccgccctcggcagcgacgcctcgtcctccctcggcggcgtcaccatcgaccggtcgcgcgcgctcggcctccccgcggcttgcaacgtccagaccccacccgtcagccagtgcaacaacgggtcgtcgggcggcggatcgaaggcgacgcctttcctgccatctggtggtgcgtcgctcggggggccggcggctcttgtgctcgggctcgccgcggctgctgtttacgccgtggcagctacgtgagcgtttgtgttgtgtgattcagggatcaggatgcgttgcgtcgtgtcaactttcgcttttcagaacgggcaggggggattttgagtgctttgtgtctatggctttgtcgcatttgtgaaattggttgattcggtctacggtcgcaataaatttgccgtaatggtttcacttgaaaaaaaaaaaaaaaaaaaagggcggccgaaa

SEQ ID NO: 3586 - DNA, 1081 bp, Zea mays
tccggaattcccgggtcgacccattcggacgatttattgatcaggaaactatgagcagggggacaatgctgtagagtggtacactgacaaacttgattagttggatctaatttgttttgcattccgtttaataactgtacttgcgtttcgccttccagccacaaggaacctacgggcttatgcaataccctcctctatctcctgtgcaaaatcaagctgccttccagaatatggttcagcctgttaatcaaggaagctcgatccatggagctaattctgaagtttcgcctaatccagttcctagatcatttaattccgcgcagttgggaagcccctattcgcctttgcctggtttgcagtatcctggagtgtatcctggtggtcctattaatcatcgccccttttcaagttctcacagttcaaccaaagttcaaaactcaagtgctaattcgccgtcttcgagtcccagcagcaatcctggcccccagatagagggtcctcctggagccaatttgttcatataccacatcccgcaagaattcggtgaccatgatcttgcgagtgcattccatagtttcggtagggtactgagcgccaaagttttcgtagacaaggcaactggtgttagtaaatgctttggtttcgtaagctacgactctccagcctctgcacaggcagccatcagtgtgatgaatggataccaattaggcggcaaaaagttgaaagtacagctcaagagagacaacagcaagcacagtaaacctttctgacaaagcgacctcgttgtgtgctctcaccacgttcaggaaaaagtcggtacatatgtgtcacaattgatcattacattgtttcctccggcctctcaccattgcgttgccgccggtggtggctcttgttgtatctttgttcaattcacattcttgaaaactgtcgcattgtgtatttttcgtcgcagcgtagctgtagcgtttgtaccatcatcagatcttgtacatcagacattgatttattcaattgttttttttaaaaaaattcaaaaggaccccgtgtcgagttctctctctctctctctctctcgtgc

SEQ ID NO: 3587 - DNA, 5037 bp, Zea mays
tcctctcttcaatccacaaacgtgaaacccaaacaccaaaacatacttggtttttttttttttgaaaaaagagtaaaaacgatggacagccgtaggatggaagataaacacactcgattcttaattcctcgctaaaaaaagataaacgttgtgggaggatggaagagagagtttaacaaagactattggagcccaataccactgttatggaattaggtgcaaagctaatcgccaatcatatactgccgccttcagctatcgttccatgcatgcccgcgctctttaaattgaccatccacgaattccaggtcaaacaaagggactgtctatgtcttatgttaatgcaaagtattaagccatggcgtcctgccggttgccgcggcactagtacgtgcactactgctgcgtccaccggccgtctggtcaccagcccccactcactacccctgccccagcaccaaccaaacgtcgttgtgcccctgacatggttgacacgccggcgaaaagcctcgcgcagcaccgcggcgcacgggtcacttccgtggcgcagccagcccagcgcgcgcttactacgatccagcctccaggagaccggagaaaagcggtcagcctcgctcccacgcagcttgttaacggaaaaaaagaacgcgcacgtgaagtgaattgcggaaatcgaacacgttccctgcaccaagcgcgaaccttaatctaatcagtcaccgccgcgtcactcggcggcgcgcttaatgcgtggtgatccgatcggcgtgctagttgcgggtggcctaaccgcggctgccgggccggacaggtgaaaaggtagccagccctggcccccgggtcgtgcgtgccggccgaccggccggcggcgagggcctgtttcaaatggcctcgcgtgcgcttggaattccgatcgagtcaaacgatgattgcttgttccacatggcatcgccgctggacgtttccaaattccaatgctgctgctctgtactatcactccctgtccggaaaaccttgctccgcacaagtctctatttgtacaactactagtcgctccgttctggaagaaaaagaagaagaaaacaacaagaatcgcaggtaaaatctccggtgtcgatggatccaatcatgcaattgtcagctgttgaacgcggaagggcgttgcctgtcacgaaggcacatcacattggaccgaccagtcgcctgcactgacaagagaaaatgctattttttttaatgtcccggcagagttccgtggaacatggattttttttcacgcatgccgctcaactgcaaagatttacagcagcggagcagccaaatgaatggacccggcggaagatgttctaaaatactagatggtacggttaaagtcccagtaatacgaaagagagaaaacgatagtagtttaagaactgaagcatccttggattctcgggagcccatgctggccgtggcctggccatggtcctccactctactgccgcgactatactaggccactagggggatctcattctcgtgcactcacacccctggctgtcggccgtcaacgcgttcgcatgtttatccttgccctctcgccgctcgccgctcacccagccgccgccgtgatccaatccaatcaagccggggctgagtcatccgcgacccacccgggaaacactcatcatcccattcatccatctcgtctccatccgacggcggtggccctttatcacacgaatcaagccccttgcccccttccaatcatcttccggaaatattaaaccccgagcatcaccattaaactaagcacatgaagcgcaaccatcacagtagataagcaagcaacctcatgcgggattccacccggctctcaactaacaataacacgcctaccgcccttattaagccccctctcttcttcgccgctccgccatcgtacgccatccccactaaaaaccagccgtttctgtaggtgttagtttactaccgtttactatactgcgctgttccaatggccatgcccaatccaagatcggtgttgacctccgcgccgtcaccgcccggctgctcctcctcctcgtggtcggcggcggagtccatggcaccggcgcctgcgtcgccgtccgacggggagctgctgcgctcgctgcaccgcctcgcgcgggacctgtccgcggccgccgagacgccggccccgttcctgcgcggcgcgctcgcgtccatcaccaggcgttccaagctcctggccgccgcgttcgacgacctggtcctgtgcgccgccaccggcgatctgccgcggtccgcgtcgctgtgcctgcgcgaggtgctcttcgtgctgcagcgcttcaatgccctggccaccgactgcgccgcgcggagccggatgcggctgctgcttcactcggacgagatcgaggaggaggtgcgggagcttcaccaggacctggcaaccctgctcgacctcctccccgtcgtcgagctgggccttgccgaggacgtcatggacctgctggacctcgcgtcgcgccagtgcaggcggttcgcgccgtctgccccggcggagcaggccctcaaggccagagtgctctcgctgatacaggaaattgagcgcgagatcgtgccggatcgggagaggctgcaggagatcctggaggaggcgggcatcaacgacccgcccagctgcagcaaagagatcgagagcctcgagcgggagatcggtgaccgcgcctcggagaggtggacggacgccatgatcgcgctcgtcggtctgctacggtacgccaagtgcgtcctgttcagcgccacgccccggccttcggattccaggccggaccccgaggtcgacgaagaaggggagcccccggcgccgccgccggacttccgctgccccatcaccctcgacatcatgcgcgaccccgttgtcgtcgccagcggccagacatacgaccgggactccatctcccggtggttcgactccggcaagtcaacgtgccccaagacagggcaggttcttaccgttttggagcttgtgcccaacaaggcgctcaagaacctcatcgctaagtggtgccgggagaacggcgtcgccatggaaagcagcgcggcgagcaggagcgagccggcccaggcggtggccgcgaacaaggcggcgttggaggcggcgcgcatgacggcgtcgttcctcgtgaagaagctctccatctctttctcccctgacgcggccaaccgcgtcgtgcacgacatcaggctgctgtccaagtccggcgccgacagccgcgcgttcgtcggggaggccggagccgttccgctgctggtgcccctgctctactccgaggacgccgggctccagctgaacgccgtcacagcgctgctcaacctctccatcctcgaggccaacaagaagcgcatcatgcacgccgagggcgccgtggaggcggtcgcccacattatgagcgccggcgcgacgtggcgcgcaaaggagaatgcggcggccgccgccctcagcctggcgtccgtccatacctaccgccgccgtctcggccggatcctatccatcgtggagaagctggggcatctggtccgcaccggcccgacaagcaccaagaaagacgcgctggccgcgctgctgtcgctggccggcgagagggagaacgtcggaaagctcgtgagcgccggcgtcgcgcaggtagccctgtctgcgatcagcgaagaggagaccgccgcggcagtgctggccgcattggcgaagcgcggcggcgcggaggcgatcgtgggcatcgatggcgccgtggcgcgtctggtggccgagatgcggcgcggcacggagtgggccagggagaacgcgacggcggcgctggtgctcctgtgccggcggctgggcgcgcgggtggtaatgcaggtgatggccgtgcccggcgtggagtgggccatctgggagctgatgggcaccggaacggagcgggcgcgtcgcaaggccgcgtcgctcggcaggatatgccgccggtgggccgccgcctcggccgctgacggtgagcggggcagcgtgtgcccggccgccagcgtcgtgcctccggccatgatggcgtcataatcaagtccagccatggggcaatgccagataggataaaagctcagattaaacgattttccccctctttctcctcatgtacaaactttgcttaggctgtcacgattctttgatcagagagtgataatggtgagcggttgatcaactgtaccatcgtagtttcatctggctccttattcttcatcagcggctctaaatatacaatgaaactgggctttaccatttgactccactagtttatcaacccgtgcgctcgcatgggtgatgggtttaagtttaggagacactaaaatttgatgaaccaatttaacaatggctgaagtagataatttttagacatatataggctattggactttctgttatttgtacattgtaataacatctatcgtttatgtatctttagtaagataaatgtggataatttggatttaaatttaatatgtcattttagattatctatcataataagaaatatgtgaagatgtgtaatttagacataatttaagggattaattttagattacctatcataacataaaatgtaagtaatttaatattgtaacagtttttaggttttacatttttttaacacgtctcacgggatcaaaatggataaaccgatgaaaaatatgtatttggtctgtcttgtttatttatattctaatacaaatctttataaaggttagagggctatttgatgtttttagtgacatatgtgaggattagtgggctaacttagattatttgttaataaaatagaggtggatagtttagtcttaaatatattgtattactttaaattatttttgtagtgccaacatgcagaggagcaaaatacgtgggattagttaatgttatttttaataatggctaaggttactaatttagattatttgtttatcaaatagaggtgaatagtttagtcttagatgtattgtgttactcagtatattatgtag

SEQ ID NO: 3588 - DNA, 1217 bp, Zea mays
cgcccccttctctccctctcatgccgctggttgatctctcgtcatctcctcctccaagcacggatcctctcgtcgtctcctccaagcacggatcaggaacactgaaattctatctcaaccggttctgccgactgggtaacttgaattctaaagatgaggcatggtttggaagtcttccaagaagcagtcgtacccatgctgatatgaacagagatgaattggaagtttgttgctgcagccttaagcaagagtggtaatacttttgacacaacaaggtctatggtactcatatctgaatcagagaaagctaacctaaaggatagggcaaggaggctcctttctaagcctatcaagtttttcaatgagatgcaggagttgtttattgacagcagtgctgatggctctctagctatggatgctacaacctgcatgaatgaaactcatcctggagatgacagtgacttcaatgatgatgtgtgcagtgacttctccaactatcctcagcctgtgcatgatctaggtgatgattctgacactttaccatctcccaatcaccatccatctcaaagtgttgatcatagctcgtcaagttctggatagaagcgcccacaaggagagggtgtaccgaccaagaggaatgttaaaccaaagagtcgcacaacaaaggtagtagatgaactcagtgctactttggtagaacttcgaaatgatctgaagaagccaccacctccagcgcctatgccttttgttaaccctgatgcaatgttgtggcaaaggcttgagaatatgacaattactactgatcaaaagttgatagtaggaacatatctagcacacaaagatcaaaagggtatgcgtggtttcttatctgctgcatctgacatgacatttgagtcatgggtattgaagcatttaagtgatttggacctgtgaatcgactaggttgatccaagcaggaggtgaatgtgtgatggttggttattttgcatttcttctaggttgatgcatgacggttcatggagaaggctggtggttgtgatagctatcacacactcttttggttaataattagatctttttttgttgagcaatgtgaacctttaatggtgtttatgggtcttgtggagttgtgatggggctattatgaagatgctatggcctgttatggatgattggacatgttatgggctcctatatattaatctgttattttggtt

SEQ ID NO: 3589 - DNA, 1168 bp, Zea mays
  misc_feature (980)..(980): n is a, c, g, or t
  misc_feature (982)..(982): n is a, c, g, or t
cgagcggccgcccgggactaactttaggcagccacaaaaagtgtggcgaggttccctgagcttgccatactttttttcgccgcatctggggcgctcgttttcgatgccccagcaccgctacgcgccgcacttcgcccccttctctccctctcatgccgctggttgatctctcgtcatctcctcctccaagcacggatcttctcgtcgtctcctccaagcacggatcaggagcactgaaattctatctcaaccggttctgccgactgggtaacttgaattctaaagatgggtgtgaaggagatgtatcttcaatattacaatagttacatccagtacctacgaagaagaagggtgcttatttacattaccatttgtgtggtttttctttggtacaaactgaatagattacataggaagagtgttaaatatggtcctttgttacaacgagatttggaacgagagaggcggctcaaccggttgtataatgggacagaagccaattgtattagtgagttgcgcatgcgcaaatttgttttccataggttatgtagccatttaaggtctcgtaggttgttagaggataatgtcaatgtctctgttgaagaacaagttgctatgttcttaaagtttgttggtcatagatggacaaataggtcagttgggtttgaattcatgcggtccggagaaacagttagcaggtacttcaaccttgttttagatgctctatgtgtcatgtcacgtgacctcattaccatgagaaccacagagaaccacagggacacaaccaaaggtctcgtaggttgttagaggatgctctatttgagtcatgggtattgaagcatttaagtgatttggacctgtgaatcgactaggttgatccaagcaggaggtgaatgtgtgatggttggttattttgcatttcttctaggttgatgcatgacggttcatggagaaggctggtggttgtgatagctatcacncnctcttttggttaataattagatactctttttgttgagcaatgtgaacctttaatgatgtttatgggtcttgtggagttgtgatggggctattatgaagatgctatggcctgttatggatgattggacatgttatgggctctatatattaatctgttagtttggtttcctcaaaaaaaaaaaaaaaa

SEQ ID NO: 3590 - DNA, 779 bp, Zea mays
gccggccggtccgggaaagtagaatgccacacttctgtgggcaagtgtttggttcgtgactaactttaggcagccccggccggggtcgctcaggccgggccggccgggatactttttttcgccgcatctggggcgctcgttttcgatgccccagcaccgctacgcgccgcacttcgcccccttctctccctctcatgccgctggttgatctctcgtcatctcctcctccaagcacggatcttctcgtcgtctcctccaagcacggatcaggagcactgaaattctatctcaaccggttctgccgactggataacttgaattctaaaggttgatccaagcaggaggtgaatgtgtgatggttggttattttgcatttcttctaggttgatgcatgacggttcatggagaaggctggtggttgtgatagctatcacacactcttttggttaataattagatactctttttgttgagcaatgtgaacctttaatggtgtttatgggtcttgtggagttgtgatggggctattatgaagatgctatggcctgttatggatgattggacatgttatgggctctatatattaatctgttagtttggtttcctcaaaaaaaaaaaaaaatggggctattatgaaggttcttgcagctgctaaagtgcatctgtgatatttgtaaatgagttattggtaactgaaatgaaggaaagggatctgagattggcttccccaaaaagcggccaaaaggccctaaggcctcaaaatccagcttttgcacctt

SEQ ID NO: 3591 - DNA, 3195 bp, Zea mays
attctccctttcctcgaggtaccatcaccaaagtgcttccctttatcatatcacgcacgtgctcagaagcagagttgaatgaagttgcttcaatgtcactgttgttgctgctcttgtttctgtcagcagattctgtgcttctgatggacaaaataagacgtcccaacaagaaaaggatggcaagccccccaaagaacacacttaaggcaagcgccaagatggtcttcttgtgcctcattttcattgaggctcgaggttcttctactgagccacaatggacactgagcataggaccacatagcttgggattcccaatgtagctagaatttgtaaaggtattaaactgtcctccacttggaactggcccttctaggtcgttgttagacacattgaaccaagaaaggaagtgaagattactcagtgcagatgggagtccacctgtgagctggttatttgacaagtctagagtttgcaggtttgtgaggttgcaaatttgttgtggtatttctccagacaagctgttggtgctaaagttgaggacattgagcactttcaactgaccaatcccttggggaattatgcctgtcaagctattgttgcatagattcaatacattggggaaagcattgagcaaacggtattgccgtgattgtgtccaaaatacaggtaactcaaggaacttcgggtccaacttggcagcattcttctcagattgtagcattggcatctccatcaattcaggtgggatatcccctgtgagcctgttacttgatatgtccagaaagaagaggagttccagcctgttaatccaggatggtattgttccagtaaggtgattgtatgatagatctaatatctccagttttgtgagttttgataaccaaatagggattttcccaaccaatggacataggtctatggttagggcccggagattctcaaaaccatcaattgctacatcctgcggtatagtctcacctttgaagttgcttccaattagcagggaggtaaggttcttgcatctgttgaggttctgaagtgcatctgtgatatttgtaaacgagttgctggtaactgaaaggaaggagagggatctgagattggctattcttggtgagaactggccatgaaaattgttgtaagccaaccgcaaagcaactagattgctgcacgcatatatgctttcaggaattgttccgttgaatttgttcagagaaaaatccgcagtcctcagatccatctgggtgaagttaactctgctaagatctcccatgaagctattgtttctgagggtgatgtacttgagactcctgcagttacttagggtcgatggcagctctcctgtcatcaggttgttgtccaagtggagctcctccaatctccccagctgcccaatagaatctggcagctctcgttcgagcccattcgatccaaggtcaaggaaaacaagattgctgagtttggctaggccggaaccatcaagcaccccctgcagattattgtttggaaaagagaggtgctccagtgaggtagcattgaacagttcgtggggtagagctccggtaaggttgttgtggccagccttgagtactgtcagcttggagcaactgccaaactctgaggaaacaggcccactgaagtcatttaagcaaaggtcaattgtggcaagcgatggtgcgtggatgcagatagaagacggcaggggtcccgtaaagctgttgttgcttgcattaagagcgacgagactgttcatcgcttgcagcgttgtggacggtagctgtcctgtaaagaagttgcttgagatattcagtacctcgagagggaggccagaaactggggactgacgctcctgcagagggccggataggcggttgaagctgacatccaggacgacgatgctgccggagagcaccagttccgccggaaggtcgccgtagagtgagttgcaggacaggttgaggcgcagcagccccgtaaggttgccgagggacgccgggatcctccccctgaggcctttcgaaggcagcgagacgtccgtgaccacgccgccgccgccgccgcggcaggttattccttcccactggcagcagtccgtggcgctggcccacgacgtgttgaggccgccattgccctcccgcgagagaccgtcccggaagtcgatgagcgagctcttctctcgctctgtgcagcagctggcgaggcgcgcgcaggagaggagcacgaggacgaccgaggcagtaccaaagaaaggcgcgggtaacttggaggctgtactgctgctgcgtagcaaattcagtggctgcatgattcgctctcatgaaagatgaaacgtcctgccgctcgcagagacgctcggtttggattctgggctgccgtggctagctaaagaaccagaggttttttttttcctttccctacgacagtattgggggcaggagaagaagaagctgtttgctctctctgagtctcaggtggcgttgatctttcttcttcgtcttgttccccgagggagaatggcaaaggtatatgttgcagaaccatccaggtcagttacttacaccacgtttgcctccagcaatctctctctctctctctctctctctctctctctctctgttcaatacacgctccagagaggaaagggggagagaaaatcagaaatacttttcttgcccccgggtcacatgtttgacgttttgcttggggtcgctacaaacaactctacgtgcaaaagtccaacttccctgtacgaagccttcttagttgatatccttctctaggtcgtcaccaaactttgtaagttgccacagaatattatttttatttattttttggaggagcccaggttggtcttgaatattggaccatgctgagatagttgcacctattcgtgcatatcttctgagtcaattacgctactctagtcttaactggtaagaaaccgaaccatgcttcgttcaccaacctaatgccaaatgaaagtttcggctccgggcatggctgtgcatgtaacatgtaaaccttgagaagtcacttgactgtcaaaaaaaatatatatatatatatatttcttattgtgtttgttgttctttgacaaaaatgacaccgctccatttctttgctttgctatgttaattgcatcgttctcctggcagttgtgagccccttttccgggacggtttctgcaggcatgca

SEQ ID NO: 3592 - DNA, 2112 bp, Zea mays
gcacgagaccattacctagaacatcctaatcaaaaacattttcaaaacgtgtcacccggccaccgccacagctgctgcccagccgctcgagcaggcaagcagaccggccgccgccacagctgctgcccagccgctcgagcaggcagccgcacggccagtgcacagcagacagcaccggcaagcagccaagtagctgcttctcatccggcgccaggtccagtgcgcgcgccttatctgctgcagctgcttgtcgtcctcgttcgtcgtccctcggcaccggcaggtccagaccgacgctgcgctcagtttgaagctcctccatggcgtcggactgggactgggacagcgacagcgactgtgaagtacgcatgattaaccatccttgcgagcgtcgtgctggtgctgctactcaagcagagaaaggaaaggctatgggcgttacatgctatgatgtgagagaaattggtggtgagctagttcggtggaacgcaactaggtttggtactgtttttatttttctgcagagttttttggatagaaaagataaatttaagttgtggatggcatcagctgattgggagaactgtaagtgggctggtgaagaagatcatgaattcgcatatgattgtttgacaaaaaataaatggtggagtgacatggaaaaggttttgaaagcggtgtccccaatctaccctgtacttcgtttagcttatcaacagaagagtgtgtctatatcgtcttttcttccaaaaatgatgagtgctatggctaaaatacgatccaatttgggtgatgatcctatcaacaaaaatctgtgtgatagattaatgcaagtaatcaatagaagacttgactatatgctcaatgatactcttatgcttgcagttgctgcccttaaccctgaagcgctatatacttccaaaatggcaagaaaaccgaagttccaacatgctgtgacaatggccataaagaaactttcaagctcatcttcaaaggcttcagctgcaattgatcaatatactttcttcagaaagcaagctcggttatttggaggagaagaggctaaagattcagcacttaatggccgcgcaagtgcagctgattggtgggatcaatatggtggagactatccagaattacaagagtttacacgtcatattgtttctcaatgcatgtcctccagtggttgtgaacgtaattggagtaccttcgctttggttcataccaaattgaggaatcggttgagttatgataagttgcataaactggtttatgttcactacaacttgaagttgcgcattcaacattttgaaactgatatagaaagttttgaacaaatgaaaaactctaaagatagaaacatagatccatgtagcatcatgatagatgttgctatgtatgatgaaggcaacccgattatggaatgtttgtgcagttctaggagtgaatcagtgccgacacttgatgaaaatgatgagcctgaatcccctaacagaccaagtggattcgttttagaggagttaggaggattgaatgaagaagagatggttcttttaaattctaggattggttctggtaggaaaaatggtaggaaaaggaatgttgtagaagaagatattggagatgatttcttatcagatagtagtgagggaggaggtagcccaacctacaacgaatcaggtggtggtgatgacgaagatggtgaacctagtggtccatgttttgcagctaggacacaacctaaattagctacagaccaatataatggtcctggtcaagatgaacaagcagcgcctctccgtccaagatcaaaaaggcagaagaagctctccatcaagggcctgtacatgcttcagaagtgatctaatcttcaagcacaagcacaagaatatggcgtatacatggactgattcaatggcaagattttgaacatgtggctctattgtatcaattgtgtgctttgtttcagtttcaacacaatattgctgccatatttggttcatgtggcctaacaatatttataactgtgattgatttctatgcattatttgaactatggactaaaaaaaaaaaaaaaaaaaaaaaaaaaaaaaataaaaaaaaaaaaaaaaa

SEQ ID NO: 3593 - DNA, 876 bp, Zea mays
acattttcaaaacgcgtcacccgaccgccgccacagctgctgcccagccgctcgagcaggcaagcaggccgcccagctccggctagccgcacgagcagcaaggaggacgcccagctccggccagccgcacgagcaggcaagccctccggccagccacacgaccagtgcacagcagacagcaccagcaagcagccgagcagctgcttctcatccggcgccaggtatagtgcgcgcgtgccttatctgctgcagctgcttgccgtcctcgtccgtcgtccctcggcaccggcaggtctagccttctcagcgtcgttctccgacgctgcgctcagtttgaagctcctccatggcgtcggactgggacaacgactgtgaagtacgcatgattgaccatcctcgcaagcgtcgtgctggtagtaggaggaggtagcccaacctacaacgaatcaggtgatagtgactctaatgatggtggtggtgatgacgaagatggtgaacctagtggtccatgttttgcagctaggacacaacctaaattagctacagaccaatataatggtcttggtcaagatgaacaagcagcgcctctccgtccaagatcaaaaaggcagaagaagctctctatcaagggcatgtacatgctttagaaggttaagtacatctaaatcattttgtacggtttggtcatgtaatctgaatcagattctctaattagactaggtgttgttgttgtttgccgtttgtgcatcagaaaaaacttttgtatttctgttatgatataataaaaatggggtaatcctcttgtagaaaaaaaaaaaaaaaagattatagatgtgttgtctcactgtttcaaaaagttcatttaactaaaatatt

SEQ ID NO: 3594 - DNA, 2596 bp, Zea mays
ttatgcaccctcaaggtatatgcaccctcccctaatttactctagcttcgccactgtatataagtgtaatgatctgtggaatacaaataacggttctgtcattttgtctctctcaatctgattaccactgagtagactttaacaagcgccacggaaacagtaccggcagtccgcgcccaacccgtgacgtccgtccggttgcatcccgtcccagccgcgccgcaagcgcagccgagggccccagccaggccagcggaagcttctcaaccccatcccacgcggccacgcagccgctgacgcagcggcagcgtggcgacgcacggcacgcaccacccgccccagccccaccaccttgcggcccgttgttgcgctgccgtggccgtggggccacccggacggtcaaatctctcccaaaccaccatgtctgactctgacctgagagaccacctcggcggctcgcgcagaaacctccccgccccccgcgccccgccgggtctccacccatcccaactcccccacctcgctcgcttaaaagctcgcctcgcccccgaccgaatccaccctcccaccaccgaacccgcagccgccgccgccaaaccacaccgcgctcctctctggcggatagcggacagcgattttgatcggcggtcctcagacctcagcccagcccggcccgcgatggagaagacaaagctgccgctgccgctaccgctacccctggtgcacggcgagcgtctgtgggcgcggccgtggcggtggctgaagacggccttcttcatcgtggcgatgctggcgtcgctgctgctcgtgtgcgcgccgccgctgctggtcgtgctgctggacctgctcctgccgcccgcgctgctctccagcttcctccgcgcgcagccgccctcctccgcctccttcgccgccgcgctcgccgcccaggccaggcccttccgcttcgcctcctcgctcgccgacctccccgcgctctccgccgcgcgctccctcctcatcctctgcgcgtacgccgcggccggaggcggcggcgccgcatacaggtgggtcgccgtcgcctgcagcgccgcctccgtctgctacgtcctcgccaaggccgtcgccgtcttcggcgccgcgcccgtgtggcggggcaacggccagctcgtcgccgtcgaggccttgttcctcatgtcgctcgcgctcgccgtcgcccacctcgccatggcgtaccgcgcgtcatgccgcgagcgacgacgcctgcagctagtctacagaatcgacgtcgaagcggtaagactgaagggaggccagacgcccaaggcactgaagcaatgcatgatatgacacccatctgctcctagtatcgccgtccccgctgggtggaggtggaattggaaggaaggaacctgaagatgcacggcgcggcggtcttcgtggtgcagaccggcagtgcagtgcagtgcagggggctcatccgcgcccaagttttggctcgagaagctgtgcataccgatcgccgcgtctgtccgtccactccctctgcgtctgtgaatgtgtgccagagtgaacgtgtagtgtcatcctgtacatacgtatggaacacaacattcgtgcttcggcctcctgcagccaatgcgatccaggatgagccgtgtgccaggtgcttgcgttgcctcgtcggcccggaattgtgaatatgcctgtcacgtgcgggcggaggtggcaaatgggcatctctaaatttggtgtttatcctgctttcaagtggatttggaagccttttcctcttagctaaaacataagatcgctcttttatcttctgttaagaatttaagatcgaaaaaaaaaaaaaaaaactccaacagcattgcaaacaagctcaaatgccttaaactgctatgtgcgcggataacttaaactgcctttgaatgtgtgccaactaagcagagcgtgttcaaatttagttgtaccactcaaaccggacggctcttacaggtttcagtctgaaactttgcctcttgatatcagcattgcagactccaatccatgctgaaaaatatgtcagatgcctttggcctataccagtctatttcctttctgttcagaattattcaccagagttgcattgcactgcactgcaccatgtgtgcatgttctattgtgatgcagatggtacaacctacttgtttttagcagtaaagtggcctatctggcatgtgcagcccatgcaattgtgctaccatctatgcggacatacgcagagtaggagccgccgctaaccgcgaaccgtccatgtctctatagagagcatcaccatatagttcattctaatgtttggcatctacatcgatgccaacaaactattaatcgactttgtacatgagtagccacagcgttgccagggagaagttccgagcatcgaattgcacattgcaccgtgcggtgctcaatcaaaatatgccgacattgatgacggttggttcctcttggtactcagctcagtccaagcgtccaaccgcttggacgaggagagtgaaaaggcagctagtaatattttgttttttttcttttcctgttttgtgggtcctaggtcgatgcttatccactgcag

SEQ ID NO: 3595 - DNA, 1339 bp, Zea mays
cattgggtacctcgaggccggccggaaaaaaaacctcgctcgcttaaaagctcgcctcgcccccggccgggtccaccctcccaccaccgaacccgcagccgccgccgccaaaccacaccgcgctcctctctggcggatagcggacagcgattttgatcggcggtcctcagacctcagcccagcccggcccgcgatggagaagacaaagctgccgctgccgctaccgctacccctggtgcacggcgagcgtctgtgggcgcggccgtggcggtggctgaagacggccttcttcatcgtggcgatgctggcgtcgctgctgctcgtgtgcgcgccgccgctgctggtcgtgctgctggacctgctcctgccgcccgcgctgctctccagcttcctccgcgcgcagccgccctccttcgccgccgcgctcgccgcccaggccaggcccttccgcttcgcctcctcgctcgccgacctccccgcgctctccgccgcgcgctccctcctcatcctctgcgcgtacgccgcgggcggtggcggcggcgccgcatacaggtgggtcgccgtcgcctgcagcgccgcctccgtctgctacgtcctcgccaaggccgtcgccgtcttcggcgccgcgcccgtgtggcggggcaacggccagctcgtcgccgtcgaggccatgttcctcatgtcgctcgcgctcgccgtcgcccacctcgccatggcgtaccgcgcgtcatgccgcgagcgccgacgcctgcagctagtctacagaatcgacgtcgaagcggtaagactgaagggaggccagacgcccaaggcactgaagcaatgcatgatatgacacccatctgctccgagtatcgccgtcaccgctggcgctgggtggaggtggaattggaaggaaggaacctcaagaagatgcacggcgcggcggtcttcgtggtgcagaccggcagtgcagtgcagggggctcgctcatccgcgcccaagttttggctcgagaagctgtgcataccgatcgccgcgtctgtccgtccactccctctgcgtctgtgaatgcgtgccagagtgaacgtgtagtgtcatcctgtacatacgtatggaacacaacattcgtgcttcggcctcctgcagccaatgcgatccaggatgagccgtgtgccaggtgcttgcgttgcctcgtcggcccggaattgtgaatatgcctgtcacgtgcgggcggaggtggcaaatgggcatctctaaatttggtgtttatcctgcttttcaagtggatttggaagccttttcgtcttatcatactaaacataagatcgctcttttatctccaaaaaaaaaaaaaaaa

SEQ ID NO: 3596 - DNA, 3810 bp, Zea mays
ggcccccctctcgtgttttttttttttttttttttttttttgcatgtaattatattttattaaaaaaagaaaaggtctcatttattggtcggtgcagtacagaaaagctaagaactaaaattcctggtctgcaactactgtgggacttcaggaagccagtgtgctccgggggcagttgtcgatggagcaagcgaggatgtcccggtagtcgcgtgagattgtgaaatggtcatacacgttgccgtcgcggctcttcttgtactcgaacagcagggaggaatggttgagggccgtgagcttgacgaacccgtggtcgaagtcggtgaagtggctccactggatcttcgaggtggtgaactcagaatcgagaacgctggctcctgcgccgccgacaacgacgtgcgtcgtcgcctggaacgggccgctgtagtggtcggatccatcgacgacgcactgagactggtagaccgggcatgtcctttcgtagctgtggacgtggccatagaaggcgatgtccaccttgtacttctgccagagctcctgcagcgcttcccgccccatgggctcctcgaacgtgccctccgattcgtagtaggtgcaggaggagtagccgagaacgcggtgcgcgaggaagatgagccacggctgcttctgcctgtcgaccgacgacaggcattgctcgatgaacttgtactgctcggtccccggcctccagtcctcttccgtgtttgcgatgcagaacctgaacatgccgtagtccgtcgcgtacctgatgacgaagggattgtgttaatgttgagtcagtgtgagcagaaccaaattaaggcgctatactgactgagacactattgcggataccagaattttgcacggttctcagctggagtgtagaacacagtttgggcagggacgccgcactctccaccggagtcaaggttcccgtagaatgaaccagtgccaggccaatccctctcatggttaccgctgcaaaaaaaaaggaagaaagaaggatctcgttatcgtaaacggcggtgtgcatgaacatgggaggaacacaagggagtactgtacaggccaatcatgtatggcacccttgaagcaatcggttcgatctgtgcagtgaactgatcccactgagacaagtagccatccgcgtagcagatgtccccaatgtggaccaccatgtcgatgtcttcgaggtccctgatgatctggtaagtagtattcaacgaaccgggctggaagtcgctgaactcgttcgaaccatcagcctctgcctgtgaagagctagctcatcagaaggctcggtacaattgcgaatggaagaagaaaaaaaaaataccagtttgtttttatctcactgaaactaggtagacattttcagaaacgatgtaggtaggtaggtacctttcccatgtccccaaatacgacaactcgctgcaaagaatcttgcccagggtaaggcgacgctttgaagctgtatgacttgctccagacgcgggtcccattcatcagcctatggccaagcctgtaagtatacctgaaatttcgcaatggccatgtcgcttatggtctctgaatctgtcacggttccggaacatgttaaaacatggaaacttctgaatagatgatatgtatgcaagacagaacccatacggcgagtctggccacagatccttcaggaagctagtatggatgtaaccaggatggcgccaaccaacagttcgtgccggtgagcctgagtttgcagattaggatgaaaagattggtgacacatcacatgtaatgtaagcagtgaacttctcaaaggcctctttttttttttcttgttcatccccacagagttcggcagtatagtagcttcttaccacacatgctatttcggtcaaatgttaatgttccagctggagcaagaagtcgtcgacctcctttctcaccccactcaacaaaaggaactgcttctgtaatatcgtagccgcttgtccaggtgactgtcatctacgaaaaaaaaccattaataatatggtcgccattcttagattggtgactcctggtcgtctacagttaagttatctccacaatgcgatcttctcccgttctgatacaaagttgagttcagagcagaatactactcctacgatctttttgtcgaatggcaagaaggcttacttcattccaagacttcccttgcgccaaacgcgggtacactggtgcctttggattagcaaaggctaccttgttggagacagaaatcagcttgggctggtacaggagtgttttgttttttgttcatcagatgggaaaagcagacgagtctaaaaggtactgtcttttttttctttcagaattacctttgagagaccacctgagaaaagcgcgaatgagaaatcttccctctggttgatcaactgaagcttgaggtagccctttccagtcttgttatagccatcgttttcgaagtttgcaaactggtactgcaatgaagatacggggagagagagagagaaaaaggacattcagaggctctgaaactcggcgtgctattgtacacaaagtcaagggcactacatgccgaccttgataggtgcagtgcacagcactggggtacccgtattctcagcctcacagatcgcatcactgacaagcgcccaaacaagaacatcaaatcatatggttttgcaaatctagcatcgtgatcccccaactgattgggttgggtaattgggttgtgccactcagttcggccatggccggtacctgaaatttgcgggagagaagacgccgatccagtcgtcgtcggacgggttcgggtggaagaactccacgtccgcccactcactgttctcgccctgcaggcagcctcagagcgcctcgccaccagctccgctagagcggtggtgagagagaagcgaactggagccgagctttaccttgtgcccgagaaccagaggggacgccttgacgtacgccgcgtcgttgacggcgaggaccaccctctcgacggcgatcctggacagcggctgctctccggcgacgcctctgccgaggcgagtcacggcgctgacggacacccatgtggcggccgcccacgcccacagcagcagcagcagccgccccttcatgctgctctccctgacgatacgatttcccagcctggactggcagcaactaggtggcggcgaccggacgacgaacctgactggattggcggaaggggtgacccatggcatatatacccagtcagtcatcgaggaccgacgtcgtgttagttggggcgcgcctatcaagcacgcccgtcgccattgactctgtcagtcagtgtcagtgtgagctcgtgtccacgatgaccataggctgagagactgcaagtgtgtcgtatggaaaattggaaacagacgaagctgccatgcgtacacataaggttcgtaggagtatctgatgcccctaaactagattataaataatatatacacctattggacaacatgttagaagcatcacatagcttctttctgtgtgaacgtgtgaaggtgccatgaacctaccgaatccctctaaaattcgcagaattagaattagaattagaattttcttcccctctttaattagagagatgactgaccgtgggttggctgctagtgttcattgtttagagtgcttgatgctctcgcactcactagttttttatattgatcattctcaatagtgagcgctcttggtacattgctttgaaagattgtatccgcttgtacctggacaaaactgacccttgctattcacaaataaactaatttaaggtctgtttggttg

SEQ ID NO: 3597 - DNA, 2332 bp, Zea mays
  misc_feature (46)..(46): n is a, c, g, or t
ttattttttttattttatttttatttttagttattttttatttttntttttttttttttttttttttttttttttttttttttttttttttttttttttttttttttttttttttttttttttttttttttttggttaacccttctcatactaaaacatattttagctacgggtagaacaacatagtttcacatgcaggtaacggaggcagtaaagaaaacgcctcatttatcggcgcactaccaaaaaaagaaaaaaagaaaaaaaaaactatgtacagtaacttgaatcgctgctgccctgcaagagacccaccgcacggaccgaatcccttgtctgaaaagtgaaaaccaccgcgatcgtgaggcttcatgaggccagtgtggtccgggggcagttgtcgacggagcaagcgaggacgtcccggtagtcgcgcgagatggtgaaacggtcgtacacgttgccgtcgcggctcttcttgtactcgaacagcagcgacgagtggttgaaggcggtgagcttgacgaagccgtggtcgaagtcggtgaagtggctccactggatcttcgaggcggcgaactccgagaggctggctcccgcgccgccgaccacgacgtgcgtcgtcgcctggaacggcccgctgtagtggtccgacgcgtcgacgacgcactggctctggtagactgggcacgtcctctcgtagctgtggacgtgtccatagaaggcgaggtcgaccttgtacttctgccagagctcctgcagcgcttcccgccccatgggctcctcgaacgtgccctccgactcgtagtaggcgcaggacgagtacccaaggacgcggtgcgcgaggaagacgagccacggctgcttctgcctgtcgacggacgacaggcaccgctcgatgaacctgtactgctcggtcccgggcctccagtcctcctccgtgtgagcgacgcagaacctgaacatgccgtagtccgttgcgtaccagaactttgcgcggttctcagccggagtgtagaacacggtttgggcagggacgccgcattctccgccggagtcgaggttgccgtagaatgaaccggtgccaggccaatccctctcgtggttaccactgccaaccatgtatggcaccgtcgaagcaatcggttcgatctgtgcagtgaactgatcccactgagacaagtagccgttcgcgtagcagatgtccccgatgtggaccaccatgtcgatgttttctaagtcactcgtgatctggtacgtagtattcagtgaacctggctggaagttgttgaactcatttgaaccatctgcctctgcctttcccatgtctccaaatatgacaactcgctgcaaagaatcttgtccagggtaaggtgatgctctgaagctgtatgatttgctccagacgcgggtcccattcattagcctgtggccaagcctgtaagtgtaccgcgagtctggccacagatccttcaggtagctagtatggatgtagccaggatggcgccaaccaacagttcgcgctggtgcaccacacatgctgtttctgtcaaacgttagagttccagctggagcaagaaaccggcgtccgcctttctcgccccattcaacgaaaggaaccgcttctgtaatatcatagccacttgtccaggttactgtcatttcattccaagacttgccttgcgccaaacgtgggtacaccggcgccttcggattcgcaaatgccaccttgttggagacggcaatcagcttgggcttcaagaggcctcctgaaaaaagtgcgaacgagaaatctcccctctggttgatcagctgaagcttcaggtagccctttccggtcttgttatacccatcatttttgaaggttgcaaactggtacttgataggtgcagagcaaagcactggaggagactgcctcggattctcaggctcacagatcgcagcactgaaatccgcgggagagaagacaccgatccagtcgtcgctggatgggtcgggatggaagaactccacgtccacccattcgctgctctcgcccttgagccccagtaccaagggggacgccctgacgtgcgccgcatcgtcgacggcgaggaccgcgctctcgacggcgatcctcgacagcggctgctccccgccgccgccgccacgtctgccagggtgcgccacggcgctgacggccagccacgtggcggccgcccatagcagcagcggcgccctcatgctgccctcacgaactgccagcagagagcctaaaacaaacagcagatgcacctgaattccctgaccacttgttttttcgattaggatgttctaggtaatggtctcgtgc

SEQ ID NO: 3598 - DNA, 768 bp, Zea mays
gcttgcagaaaagtgaaagatccgtttgagatgggagcagaaacaaaaatactagaacaatgttcagtgaatgcatggaataaggctcctagcagaaagcagccactgcagctgcggcgactgcgagcgtcgccagccacgcggcgctcctggtcccgagcgccgccgcggcggcctcttcctgtgcgccggtgtccgcatggctgctggagcccttggaggtagcgttgtgcgggagcgggtggacagtgatggcgaccttcatgccttgcaggcagaagccgttgccgcagacaaagtagtagcggcgggcggcggggagtgggatgaagtccttgccggaggtccagttgccggcgaccccagccatggtgcaattgtcgtaccccgtctcgttcacctcgaacacgttatgcgtccccttctgataccggaacgagatgaggtcgccgacgtagaaggtctggttgccggaccagagggagtagttgatgttggggttccacccatggttggccccaacgatgtggtccgtgccggcggagggaccaagcgcgaagccggcaagcaccgcggcgacaaggagccacgacattgcggctgcggtgcgagcaccacgttggggagacggccgtggttatgtgagcagaagagcgaagaggaggcagagagcaagtgaactgcggcggaagtgctgtcgtacagtcagtgggcggaccggcgtagccgcgtaggaaaggagacggcccggccggctcgaggtaccca

SEQ ID NO: 3599 - DNA, 2245 bp, Zea mays
ggcctgctcgaggccggccggaccgagatctagtacactcgaagtcgcctcccatttctgcggtcgccggctcgccgctgcgtcaagcgagcgcttcccccccagatctcgacttctcgagcctgtcctccgccccccacaggctctgctggatccagaaccttctagaacccctgcactgcgcggtgcgcgccatcctcctccttccttccatccagatctcgacacccctcgccggcccagacctccggtcctgtcgtggccccggggttcgggcggctgccaaagaatcagtggccatgggatctgctatcctcaacagcattgcccccgaggagcctaaagtggtcgtgccagagtacggtgagacggctgatatccaggacaaggaagttagtatggaacagctctgctccataagcacctatgatcagtggacgccactctctgtttctggccagcttcccaaaccacgctataagcatggagctgtggtgattcagcagaagatgtatgtctttggtggaaaccacaatggccgttaccttggcgacattcaggttttggacttcaaaactttgtcatggtcaaagctggaagctaaatcacaagcagaaccatcagaatcagctggagcagttccgttttctgcatgtgctggccattcagtgattcaatggggaaataagatcctatgtcttgcaggacataccagagaacctgcagaaagtctcagtgttaaggagtttgatccacaaacctgcacttggtctaccttgcgtacttatggaaggtcacctagttcacgtggtggtcagtcagtgacccttgttggagacactctagtggtctttggcggtgaaggtcatgggagatctcttctgaatgatctgcacattcttgatcttgagaccatgacttgggatgaatttgagaccacaggcactcccccttccccaaggtcagagcatgctgctgcttgctttgcagagcggtatcttctgatatttggcgggggttctcattctacatgtttcagtgacctacacctccttgacactcagacaatggaatggtcaagaccaaagcaacaaggtgttactccagaatcaagagcaggacatgcaggtgtaactattggagaatattggtttattactggtggtggaaatagtaggaaaggtgtctcagatactcttgtactcaacctgtctacgtatgaatggtcagttctcactaatcttgaggcccgtgcaccccctgtaagtgagggctcaagtttagtaatgcacacaattaatggagaaaattttctggtgtcatttggaggatatagtggccgttatagtaatcaggcttatgcccgccccgcgtcccgaggcaagtctcaaaccaagtgtcccatctcaacaaataaatgaatcagatacaaatggcttttctcccttatctgtggcagaaaattctagcaggaaagtcatatttgaaattgaggaacttaaagatgaaaagcctggcaatagggcagataacagcaaaaccttgggacaagtagttatggttgaacaaaacgaaatagaagacagacttaatcaagagcacttgcagagtctccgcctgaagcaggaactaactggtcttgagaacagaaatgcagaacttactgaggaactccacttagttcaagatcaactttctatcgaacaaaccagggcttccaaatttgagaatgaaatttcagatattcaacaacgactacagaagatggataccctagaaaaggagattgaatcacttcgctatgaactggacagcactgtatccgaagaagaatcttcaagtggcaacgagttgcaccgcagtcggggcttttggaggtggaatgggtgaactcctcgagactcaaggagtgagtattgaagagaatactcttccaaatagttgtcattattttaatttttatgtctttcacaaaaatatatgaattcgtggatggtactagttcggaagcatatagaggatctaagcaaactgcagcaacatcaactgtgaaaagcatcttacagaaagtaaaacgagtatcatgtggcccagaatttcctatgttagaatagtttcttatctgataatgacaccgacaatgatcaccataacgaattattttttttcatacatatgtggtgggatattaactttttgtcatgtcatcatacttatgtgccggaaatttatatcatctcatgtg

SEQ ID NO: 3600 - DNA, 514 bp, Zea mays
gccggccgggccgcctctcaggctctcccgccgccgccgccgccgccgctctcaactacccttgcccctcgccagttctccacagcttttgtttccagcatttgaatttggatcggcggtgtctttgttctttgtatctttcttttttggtcgcggttttggttcggatggggatttgagctgcgcatctggctgaggacgatgaagattgtatctattggtctcgttcgtcgtaacaggcatttgattgcctttgccgaccatcctgatatatcaccacccatattccgagtccgctcccaacggtcgtcagtttctatcaactttttcattcctttttagattttgatgtttgatttattattatatttcctggcctatgattaaattttcaaaaaaagacaagcatatgtccgaatccttgtatgtggataagcctaatcttctctatgaggtcgatcacgtattatacactttattattttgttaacttgtgtttatttccattcctttg

SEQ ID NO: 3601 - DNA, 2692 bp, Zea mays
  misc_feature (97)..(97): n is a, c, g, or t
aaccgttgggggtggcaggaggtgtttggatgaggtggacataggcggtgagaggagaaatgaactgaataattgatgtgtatttttcaaacttagntatgacccaagctatactaggttataataggccctccgcacctgagtgagactgcagaaatctgtatcatgacttcatgagacactcatcggagttactattttgggcctgggcccaaattgcgggaacccgtcgtttgctcgagtgaaagttgggcctacttgacatcgacgacagactttgacggacggctgagattcgctcgacctatggagaatcgaagaaccagaggttccgccggccgccgcgaaaccctagtgcacaagggccctctatataatagcgcgccggcgatctcaagttctcaacctacgacgctgccgccacctatctcaacgaagctttttcttccctccggtgtggatccacactcttcatgcgcgggattgggttttggatctgctcctgtgttttcattatttgctggtttctctttttgatcggggatttgagatacgtatttggttgtggacgatgaagattgtatctattggtctcgttcgtcgtaactggcatctgattggattgccttgccgaccatcctgatatatcaccacccatattccgagtccgctgcctacagtcctcagtccccatcgagattttcttatctatttagcctttgttccatgatttactactattgttttctggccgatgattaaatcaaaaaaatagacaagcatatgtccgaatccatctatgtggataagcctaatcttctctatgaggtcggccacatcttctaggtttactgtttttttttcatttgatctgattttgattcatctaggggccgaagacgaaatatttggatgctatttttgtatgatatatttgattacaaaaccatttctgccttccttcagaggcccctcttcatttggatcttgttattttgtacgttgtgagtttattttgtgatctatataagtggttcatggcttcgcctaaggtcgggtgatgagtaaatgtgcatagttcagatgatcaaccctagtggttttgattaccttgaataaatagtctttcgctcctaactgacgaccttatcaacgcccaatctttcttggattagataagtttcgctttgctgtaagattttggtcgccagaaaatgataaaaatttgcttgttttgaagtgttcgcgagatttattttatttttccgcacatgcggagaaagtattgaaatgcacatgtaaagaggccccgagtttgatcctgaatactcgggctcctaaccttggtgtgcgagagtttaatctggcgattcacgcttctttgagagcgcagatgcttcccatcgtgccctcactgtgaattgtcgcacaattacttaaaagcagccatattttcgtgtaaagaattgttttcgcttcgtttgattgtcagaatttggcagcaaagaattgaatcgatgttgaataccaaatcagtttggatattgaaatgggcttcaaatcaaattcttgtttggatggacaagaatttggtatgtaaaatcatagggaattttccaattccaaaggatgggctagacaacctttgaattccaagccctgaggagtacagaactgtgaactgcacgattggaaaaaggtcagccgattccacccaaaaggagtgcacggcctctgaattgtgcgcggccatggttactaaaatgaacagtagtgtggaattggattccaatgtattgctattcagaataaaacatcagcatttgcttcagccaataccatttcctggattctgagtgccaatcatccaacggggtgttaatatgctcctgtcgctatcaagtgcttgtacagactgcagagttttgaatttgtatataaaatataaagatcgattaaacttgccgaacctttttattaggaagccatcgtaggggtcaaaacaaccgatatgtattgaaaataaatatactttttaggtactgaagaacaagtattagcatgcaaccattgaagggttgaggtgaataggagttgaataaattttcttcacaagaagctggccaaaaaaatgagaccggccgattttgtagattagccggccttctagctgattttgtagtattctttttatagcattagtgctgctatttgtaatagttaaatattattactatttttagtgataagtgatgtcggatgaatcgatttggtttgggaatatgcggatataatgcggccatcaagagcaagtattgcaacaaactatgaaagatgaagtagtgacatgtatcgtatgagacggtggtggctcctcacaaggcactgtccgtgccatatttttgtagaacacctattaggaaggagaaactggtacacaaagagccaaggatcacgtacaggcaccatctaaaacaagcgtacataggtcggacaccatgatctacaacaaagtatcggaccctcgattctatgaaagacaatgttcattttcacaatatgtgaattattcagttggtgaagtggcctgcatgcggtggatgtgctaatgagtgacctgcacgaggtggatgtgccaatgagaggagtacaaccaaatgtttgacttgttaaaagtacaaggcggatttgg

SEQ ID NO: 3602 - DNA, 2094 bp, Zea mays
cattgggctcgtcgcgccggccggggaacgacaacctccacctcgccttcaactcctccacgctcccgtcctctccacctctcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcctccccgggctgccccgcgctgtcgggagcagccggagcgctgccgcgaggctgctgctgctcccgcctctccggctgcggcgcggccggcgcgccgcctccgcgtgcgcggtgagggcgggcctgcacgggctcgactccgtcggcgggccccacctccaggccgcgctggagcgcgccgaggcggcgctctacacgctcgccgacgcagcggtagccgcggcggacgccgccgcgggcgcgggggacgacgccggccaagctgcggcggcggtccagaagaacggcggctggttcggcttcatctccgaggccctcgaggtcgttctcaaggtgctcaaggatggtctctcagcagttcatgtgccgtactcctacggatttgccatcattcttcttactatcattgttaaggctgcgacattgcctttaaccaaaaagcaggtggaatcaactatggcaatgcagaatttacagccgcagcttaaagcaatccagcagagatatgcgggcaaccaggaaaggatacagctagagactgctcggttatacaggcaagctggtgtcaaccctttagcaggatgttttccaacattggcaacaatacctgtatggattggtctttaccaggcactttcaaatgtagcaaatgaggggctattgacagaaggatttttctggattccatcactgggtggtcctacaacaattgcagctcggcaaagtggtgctgggatttcgtggctcttcccatttgtggatggccatcctccgctaggctggtatgacacgatatgctaccttgtattgcctgtgctacttgttgcttctcaatatgtctctatggagatcatgaagccacctcagagtgatgacccgtcacagaagaacacactcctcgttttgaaatttcttccatttatgattggctatttctctttgtcagtgccatcaggattgtctatttattggttcacaaacaatgtcctcagcacagcacagcaggtttggttgcggaaaatgggaggagccaagcctgtagtgagtgagggggataggaggataattacagcaggacgagcaaaacgctctaatgctcaaccagctggagaaaggtttaggcagctaaaagaagaggagagcatgagaaaagtcaacaaagcactcgctgcaggagactcaaatgcatcgtcatcaacgtatgacatggaggatgaagagtcggatgacgagaccacagaagagggagggcccgtggaggaagcatccagtactggcagtgacaagaagcctccaagttactcagggaagaagggcaaaagatccaagaggaagcgcatggtgcagtgatcgtcacagctcaatcggatgcgattttcgccacaactggttgattcagttgaccagttaggtgccgcagtggatcacggagacagttttggcggtctgctggagccctatatttggggtgcagacaaaatgaacagcttccggggtcacaggtatttgctgctaagcttatgcaaatggaggtagctgagtatatatgctaggcctgagggtgagtgatggaccggagaacaggagtcgggtacgcgtgcaagcagagagacagggtctgtagaagtagataaggtgtaatctctcgtcaagctgggttccagaatctggattgtcctcaccattcgtatgcattgcattgtatttgctttcctcttgtaacctaatgaaccactgttttggagggtatgatcgcgcaagctgacaaccatccagtcgtatacaaatgagttcgaattcgtcttgtcagaactcgttaagagaatgaacttgcgcgagattttttgcatcgc

SEQ ID NO: 3603 - DNA, 1696 bp, Zea mays
gctgaatagtaattggtcatgcagcaattatattattattgtatatcagagcctgatgatacaatgatcgataagctttcatgattgaggtatgcagatacggtaaatgcctaaaactaatgctaacatctcaaccaatttatgcaggatggccatcctccgctaggctggtatgacacgatatgctaccttgtattgcctgtgctacttgttgcttctcaatatgtctctatggagatcatgaagccacctcaggtgaatgcttccctgtatatcctttcgttggttatgatgccaattacatggtttaacttaagatctatggtctggcacagagtgatgacccgtcacagaagaacacactcctcgttttgaaatttcttccatttatgattggctatttctctttgtcagtgccatcaggattgtctatttattggtatgttcatgtcttttttttctaactacaaatatgttcatatattcttgttgcatattatgtcgctagttgcttcaaacaagatcatggccccttccctgttcagttttcactgaattttacgattaatcaaatccgcaagtttttttttgtattgactccatgttttccattaggttcacaaacaatgtcctcagcacagcacagcaggtttggttgcggaaaatgggaggagccaagcctgtagtgagtgagggggataggaggataattacagcaggacgagcaaaacgctctaatgctcaaccagctggagaaaggtgcctttgaacttcattttgaatgcttaaacttaaacctcttctgttctggatataattctcacacacaatctcacaaacaggtttaggcagctaaaagaagaggagagcatgagaaaagtcaacaaagcactcgctgcaggagactcaaatgcatcgtcatcaacgtatgacatggaggatgaagagtcggatgacgagaccacagaagaggtacactcttcacctttttttccccactattacagttgggcattgtggggatgaagaatcatatcggaaaaaaaacacttgtccctacagctcctaaagaacgtgaaattcatcccctgttacttatatgtaatcatatgcaagcagggagggcccgtggaggaagcatccagtactggcagtgacaagaagcctccaagttactcagggaagaagggcaaaagatccaagaggaagcgcatggtgcagtgatcgtcacagctcaatcggatgcgattttcgccacaactggttgattcagttgaccagttaggtgcctcagttgatcacggagacagttttggcggtctgctggagccctatatttggggtgcagacaaatgaacatcttccggggtcacaggtatttgctgctaagcttatgcaaatggaggtagctgagtatatgctaggcctggagggtgagtgatggaccggagaacaggagtcgggtacgcgtgcaatgcaagcagagagacaggatctgtagaagaagtagataaggtgtatgtaatctgtcaagctgggttccagaatctggattgtcctcaccattcacatgcattgcattgcatttgctttcctcttgtaacctaatgaaccactgtttggagggtatgatcgcgcaagctgacaaccatccagtcgtatacaaatgagttcgaattcgtctaaaaaaaaaaaa

SEQ ID NO: 3604 - DNA, 2880 bp, Zea mays
cttaaagtgaaatgctataaaatatatcattgatgaattttatttattttcttatactataaccatcatttgtttctcaccacgatactttccctttgtttcaagggtttactgaaggaggactcagatgggtctaaattttgggcatatggcggcgactttggagatactccaaatgactccaatttttgcctcaatggcattgtgtggcctgatcggacgatgcacccccctcttcatggtaacccggaaatactagggggaaatgtttgtcttggttatcaatgtgttaaactaatatctttgtctctaaagtcattggatgccaaacttggttgaccaaattgattctggttgcagaagtaaaataccttcaccagcctatcaaaatatcatcagcagataatatgcttaaggtaacctctggttgatgtttgctagtcatcgagttattttcttatgtgctttgtgcttctaatagctccattatgatcactcagattgaaaatggacacttttttgagacaacagaagctttggacttcagttgggttcttcatggagatggttgtgtcttgggctctggtccattgaatattccaactttggcaccacaaactagtcagctcatcaacatggaatcatcaccttggtttgccctttggagtgcctgtgcagcaaaagaagtatttttgtctgtgaatgtgaaacaaaggcatgaaacacgatgggctaaagctggtcatctcttggcttcagcacaactgtgtttgcctcagaaaaatggctttgtccccagcgtatgttttctcagcctgatcttgtttactactatactcctgtttggctgtttcgtcctcatcgtctaacagcttaatactattttactcctgtttcgtcctcattgtctcacagcttagtgttactttactcctgtttcttcctcgttgtcttacagcttaatatcatcttcaggtgatagcattgtccagtagccctttggtctgtgaacgcattggtgataatgtaaccatctgcaagaataatgcctggaaaattaaagtaaacagtcaggggggcccagccgacagctggaaggtatgtagaatgttcatggggagttaagaaacatggtgtccatacttgtatgtagtcaattaataaaattattaatacatgccaacagcactaacctaggaaaagtgtaaatcaagtggactgataaatctgtcatagaatgccctgtactcataggtatatctccatcgcgtcttgggtgcaagcgcgatcagcattatgttggtttaaaggtcccaatagtaattggctttacatagagaaaggaaccaaagccttaaaagttaaaactcatggttcttttgcaaacaacaggtcaacgacgttgagcttatgagcaaggggatactcccatgcttttggcgcgcaccaactgacaacgacaaaggaggtttcttcaccaagccatatgactcgcgatggagagaagccttcctcgacaatgtctcgttccacagcagccagttctctgtcaaggagttgccggacaacaccgtggagttctccaccctctactacggtgttcccgggcacctacccaagcctgacgacgaagcctccgagtccattctcttccgggtgaagatggtatgccggatccacgggtcaggcgacgtggttctcgactacgaggtaaaccccaggagcgacctccctccccttccccgggtgggcgtcgtgttcagcgccgggaggtccctgagccacgtcacgtggtacgggcgcgggcccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcactccgcgacgccggcgggctcggcctgtacgcgtcggcgcacggcggctccccgccgatgcagatgagcgcgagctactacggcgccgcggagctggacagggcaacgcacgtccacaggctggtgaagggggacgacatcgaggtggggaagctttttgtttttgcttttgagctcctggctggcatcggccgagctgctgcgaagtggtcggggaggagtgatggctctcggcttcgtgtttgtttcgcaggtgcatcttgaccacaggcacatggggctgggcggcgacgacagctggtcgccgtgcgtgcacgagcagtacctgctgccgccgacgcggtacgccttctccctgcggctctgccccctgctgccgtcgtcgtcgtgccatgacatctacaggtctcagctccccagctgatggtgccgtgtgccggagacccgtcgacgtcgagccttgggaaacaacaatgaacgcaatggcctggccagtgaatgaaagtatataatattgtaataaagcagagacgtattagctcctgcaacggcctcgcgatcgcctggatatgtctatgctgagggggtgtttagttaactaataacctaactacatatggcgccaagttactaaaacttaataaataactattactaactaataaatagtaactgaattcctaacttaataaatacttcctccgtttataaatatatgacaccgttgattttttaaaaacaacttagatcactcgtcttattaaaaaaaataatgagttaccatttattttttatggtttatttgatcacttaagatagtttgtgcttgatttaaaattttactttttttaaaaaaatattttaaataagatgagtggtcaaaattttcgaaaaaaagttaacagtgtcatatatttgtgaacggaggtagtagtaagtacc

SEQ ID NO: 3605 - DNA, 2173 bp, Zea mays
attcggctcgagctaacactttcaaattatctacacttgaacctatttgggcaaatgcaatgcttgatcgagttgttagcatggtggagagagataagaatcatgcatgcattattgtttggtctctacgaaatgaatctccctcgcgtccgaatcatgcttccatgtctggttggattcgtgaaagggatccaacaagactcctccattatgagggaggtggttccagaacatcatccacagatattgtgtgccccatgtatatgcgtgtctgggatgttggtaagatagcaaaagatccttctgaaacaaggcctctaattctttgcgaatattcacatgctatgggaaacagtaatgggaatattgatgcgtattggatggccatagacaacacttttggactccaaggaggttttatatgggactgggctgatcagggtttactgaaggaggactcagatgggtctaaattttgggcatatggcggcgactttggagatactccaaatgactccaatttttgcctcaatggcattgtgtggcctgatcggacgattcacccagctcttcatgaagtaaaataccttcaccagcctatcaaaatatcatcagcagataatatgcttaagattgaaaatggacacttttttgagacaacagaagctttggacttcagttgggttcttcatggagatggttgtgtcttgggctctggtccattgaatattccaactttggcaccacaaactagtcagctcatcaacatggaatcatcaccttggtttgccctttggagtgcctgtgcagcaaaagaagtatttttgtctgtgaatgtgaaacaaaggcatgaaacacgatgggctaaagctggtcatctcttggcttcagcacaactgtgtttgcctcagaaaaatggctttgtccccagcgtgatagcattgtccagtagccctttggtctgtgaacgcattggtgataatgtaaccatctgcaagaataatgcctggaaaattaaagtaaacagtcagttgggaacaatcgacagctggaaggtcaacgacgttgagcttatgagcaaggggatactcccatgcttttggcgcgcaccaactgacaacgacaaaggaggtttcttcaccaagccatatgactcgcgatggagagaagccttcctcgacaatgtctcgttccacagcagccagttctctgtcaaggagttgccggacaacaccgtggagttctccaccctctactacggtgttcccgggcacctacccaagcctgacgacgaagcctccgagtccattctcttccgggtgaagatggtatgccggatccacgggtcaggcgacgtggttctcgactacgaggtaaaccccaggagcgacctccctccccttccccgggtgggcgtcgtgttcagcgccgggaggtccctgagccacgtcacgtggtacgggcgcgggcccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcactccgcgacgccggcgggctcggcctgtacgcgtcggcgcacggcggctccccgccgatgcagatgagcgcgagctactacggcgccgcggagctggacagggcaacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgtcgtcgtcgtgccatgacatctacaggtctcagctccccagctgatggtgccgtgtgccggagacccgtcgacgtcgagccttgggaaacaacaatgaacgcaatggcctggccagtgaatgaaagtatataatattgtaataaagcagagacgtattagctcctgcaacggcctcgcgatcgcctggatatgtctatgctgagggggtgtttagttaactaaaaacctaactacatatggcgccaagttactaaaccttaataaataactattactaactaataaaaaaaaaaaaaaaaaa

SEQ ID NO: 3606 - DNA, 420 bp, Zea mays
  misc_feature (354)..(354): n is a, c, g, or t
atcctcatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgttatcgcaagcagggcgccggcccgctccgccccggggtcgatcaggtcgagggcaccgngaaggccgtcgtcggcccgtctacgaccgtttccacgccgtcccgctcgacctcctcaagttcatc

SEQ ID NO: 3607 - DNA, 1499 bp, Zea mays
cattgggtacctcgaggccggccgggggccgcctgctcagtgctcccacacacgtccaaccgcacccagacacccatccttatatacgcgggccgctcgacccgcccggggacgccgccagcagctcgctctcgcaccgaccgtcccagaaatatctcgtcgccggtcagttgagctgcgacaagctgcaagcaaccatcaacccaatcaaggacgacagcgcacggatcgatggccacgctctcctcctgcagccgcctgagtagcggcaccggcgccgcggctatccgccggcagccgaagccgacccgtgcaggagtcctgttcaccagccggcggggctcctccgcgagcattcacgcctccgccgctactgcggcgccggccgccgtagagcagcagaacacgggggtgtcggtgtcgctgccgacgtgggcggagttcgagctcgggcgggcgccggtgtactggaagaccagcaacggcctgccgtcctccccgggcgaggggctgaccctgttctacaacccggcggcgagcaagatggccccgaacgacgtgttcggcgtggcgttcaacggcggcttcaaccagcccatcatgtgcggcggcgagccgaggcagatgacgctgcaggtccgcgggaaagccgacccgcccatctacaccatcaggatacgcgtgccgcagcacgccacaagcttgatcttctccttcaccaacggggccgagtgggacgggccgtacaccctcaagttcagggtcccgaagccatggcagaagaagccgctgagcttcttcaacgagggcctggcggacgagctcaacagggagggcgcctgcgacctggccatctacccggacgagaacatcgccatcaccagctgcgccatggacggctacctcgacgaggggggggatcggtgcaagctggatatcgtgagcgggtgcacggaccccagctccgacatgttcgacccgctggccaccgtcgacgacggctcctgcccactcgagtctgattccgaggaatgaaggagcttcagttcgatccttttttttgtggggggcaaggaaacgtggtccatacatcttatcagtgcaagtttgtgatcatgtgatacatgaagcatatacgtgtacgtatttcaccagactacctgcaccggtgagcaagatgatctcctacttgcaccaccattagagcagtggatatgatctcatacttgcgcgttgcactagtagagttgtggatacttaggatccatcattgcaaactctgatacaaaccagtgtaagctgagctgcatggattgcagatctgtatacctacggctcatgcagctataccgtcctggattgtaccacacaatcaatattatcaaatgtaagatacgacttggagggaagcttataaagacttccccgtgaatggaagagcaatcggttcatgaatctgaaaaatttaaaattaagggttttaaaattttaccggcccc

SEQ ID NO: 3608 - DNA, 1504 bp, Zea mays
ccacgcgtccgcctgtcgttgccacctccccaccacacacgtccaaccccgcacccagtccagatacccatccactggctccgggtaccccccggccgcccgcgcgaccgccagcagccacgctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgccgggcgaggggctgaccctgttctacaacccggcggcgacgaagatggccccgaacgaggtgttcggcgtggcgttcaacggcggcttcaaccagcccatcatgtgcggcggagagccgaggcagatgacgctgcaggagcggggcaaagccgacccgcccatctacaccatcaggatacgcgtgccgcagcacgccgtaagcttgatcttctccttcaccaacggggccgagtgggacgggccgtacacgctcaagttcagggtccccaagccatggcagaacaagccgctgagcttcttcaacgagggcctggcggacgagctcaacagggagggcgcctgcgacctggccatctacccggacgagaacatcgccatcaccagctgcgccatggacggctaccctcgacggagggggggggttcgctggcaggcgctgccccgctctgctctctagtcattccaatcatgtgccattccttcgtcgtgaaaatactatagtcatggcgtcgccgcgctaatattgcagggggatcggtgcaagctggatatcgtgagcgggtgcacggaccccagctccgacatgttcgacccgctggccaccgtcgacgacggctcctgcccactcgagtctgattccgaggaatgaaggagcttcagttcgatccttttttttgtggggggcaaggaaacgtggtccatacatcttatcagtgcaagtttgtgatcatgtgatacatgaagcatatacgtgtacgtatttcaccagactacctgcaccggtgagcaagatgatctcctacttgcaccaccattagagcagtggatatgatctcatacttgcgcgttgcactagtagagttgtggatacttaggatccatcattgcaaactctgatacaaaccagtgtaagctgagctgcatggattgcagatctgtatacctacggctcatgcagctataccgtcctggattgtaccacacaatcaatattat

SEQ ID NO: 3609 - DNA, 1162 bp, Zea mays
  misc_feature (1153)..(1158): n is a, c, g, or t
  misc_feature (1161)..(1161): n is a, c, g, or t
attgggtccctcgaggcccgggccgcgggccgccggaggctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgccgggcgaggggctgaccctgttctacaacccggcggcgacgaagatggccccgaacgaggtgttcggcgtggcgttcaacggcggcttcaaccagcccatcatgtgcggcggagagccgaggcagatgacgctgcaggagcggggcaaagccgacccgcccatctacaccatcaggatacgcgtgccgcagcacgccgtaagcttgatcttctccttcaccaacggggccgagtgggacgggccgtacacgctcaagttcagggtccccaagccatggcagaacaagccgctgagcttcttcaacgagggcctggcggacgagctcaacagggagggcgcctgcgacctggccatctacccggacgagaacatcgccatcaccagctgcgccatggacggctacctcgaggaggggggggatcggtgcaagctggacattgtgagcggatgcacggaccccagctccgacatgttcgacccgctagccaccgtcgacgacggctcctgccccctcgagtctgattccgaggaatgatggtggagcttcatctcaatccgagggagggaggcagcagcagcaaacgtgatccacacatacatcatatacagatgtctgtcaagtttgtcatcatgtgatacatgaagcatacctgtatttagccagaataccacagtaaaaacgcattaatgagcaagatggtctggatacttggtatccatctttgccnnnnnnaana

SEQ ID NO: 3610 - DNA, 1039 bp, Zea mays
ggaaatgtgatctgaaaaatattaggggcgggggggggggtggtttatcaatgtgtgtggaggagcgattgcgaagactcataagtactctcatacgagtctcaaaacagagaatcgatactgaaaagaccggacatcgactagttattacttcagatgttggtcgtcaaattttacagatgaaccagagagctaaggaagaatgggataagaaacaagcagaagaagctgacaagaacaagaaacaaactgaggctgatggcagtggtgctacagaattggaaaaagaaaaagaagaaagtcgcccaaagaacgtcaagcccaacaaggaagaagatgataaaatgagggcgaatgctgcaaacgtcgctgcccggcaagcagttggaggaagtgatatgctctcaaagtggcagttgatggctgagcaagccagacagaagcgagaaggcattgatgtgtctgctgcttcacagccaggcagagggccaggttccaggcaattatccaaatttgggaaaggtcctggtgagcacccagaaggttcaaagaggagccattcgatggcattcggaactggaggcatgaaaagacccggcaggacagcgtttgctggtccacagcgattgatctccgtgaaggatgtcatttgtgcccttgagagggagcctcagatgacaaaatcaaggctaatctaccggctgcacgagcgattgcctgtagattctaccgtagattagaccggaatagtcatatactttattgtgggcatgcccaattgcccttgcatggtattgaacagcgaagaagcatacccgccactcccatttgttgtgctttggagcggcactgtatattggtgtaaaatttgtatcgcaaaggcggcgaattaccagcaaaaaagggtttctgtacaaaattccctgtaagcggggtctggcatttgccttttctgcaaccacgtctgtgaggttatttctagcagactactcatctcaatatctatatttttaagggttaattagatttttgccattac

SEQ ID NO: 3611 - DNA, 2878 bp, Zea mays
agagaggaagaggaggagcaggagctgcctcctgggggcagaggtagaggaggtgggagaggttttatgaattttggtgagaggaaagatcctcctcacaaaggagaaaaggaggtcccagagggtgcccctgactgtttatctggtctgacatttgtcataagtggtaccctcgacagtcttgaacgtgaggaagcaactgatctaattaagcgttatggtggccgtgtgactggctctattagtaaaaagacgagctacttattggccgacgaagacattggtggagtcaaatctaacaaagcaaaagatctgggtgttccattcttgactgaagatggtttatttgatttgatccgaaaatcaaagcctgcaaaggctcctgtagacaaacgtcaaaacaacaacagttctgaaaagcttcagaaatcacagacaaagagctctccagctaaagttgaaaaacgagccgaagcaagtgctgtaggcaaaagtattgcttcaaacagtaatgctgcaagtgcctccgctgacaaacaaaagcccaagattgttgaccgtggttctatgcaatggacagaaaaatatcggccaaaagttccaaatgacatagttggcaatcaatcaatggtcaaacaacttcatgattggttaaaaagttgggatgcactattccttcattctggccaaaagggtaagggaaagaaacaagctgacagtgcagccaaaaaggctgtgttgctgagtggacctcctggtatcggtaagactacaactgctaaagttgttagtcagatgcttggtttgcaggccattgaggtaaatgcgagtgatagccgtggtaaggcagactccaagatcgagaagggtgttggggggagtacatcaaattctatcaaagagcttatcaacaacgcgactctgaattatagtgacaatcggttaaaacatcccaaagctgtactagttatggatgaagttgatggtatgtctgctggagatagaggtggtgttgctgatcttattgctagcatcaagatatccaagatccctattatctgcatttgtaatgaccgttatagtcagaaattgaagagtcttgtgaattactgccttatgctcaacttcagaaagccaacaaaacaacagatgggtaaaagattgatggaaattgccaaaaaggaaggtattcaagctcaagagaatgcaatggaagagcttgctgaaagagtgcacggagatattcgcatggcactcaaccatttgcagtatatgagcctctcccagtctgtggtcaaatatgatgatataaaggagcgacttaatagcagttcaaaggatgaagatatttctccttttactgctgttgacaaactttttggtttcaatggcgggaggttaaggatggatgagagaatggattttggcatgagcgatcctgatttagttcccttgatcatccaggaaaattatatcaattatcggcctaacaccatcggcaaggatgaaagtggagttaaaagaatgaatgctttagcccgggctgctgaatctatagcggacggtgatcttgttaatgtacagataagaagatatcgacagtggcagctgtcacaagctgcttgttttgcttcatctatagtacctgccgctttgatgcatgggaacagagaaatccttgaagcaggtgagcgaaactttaataggtttggtggatggttgggtaagtactcgactactaacaaaaacagaaggctactggaagatgtccacagtcatattcttgcctcccagcaagcaaacttggacagggatgcattgaggttggattatcttactcttatcttgagagagctgactgacccactgaaaaaaatgtcaaaggatgaagctgttcaaaaggtggtagagtttatggatacatactctttaagccaggaagacttcgatacaattgttgaagtatccaaatttaagggtcatccaagtcctatggatgggattcaacctgctgttaaaagtgccttgacaaaggcatacaaacaaggaagtagttcccgtgttgttcgagcagcagatctaataaacattccaggcatgaaaaagcctttaaagaaacgagtggcggcgatcttggagccggtagaagagagcctacctgaagaaaatggactagcatcagctgaagatgatgaagatggttcttctgatgctgaaaataatgatgagcttgtgcctgctgactctacgccgaagctggacctgcaaagcgacaagaagaaaggaatccaagtgcagcttgacctgaagagcaatggggacggcccgcgcgggaagaaggcgcctgctgccaggtcaagagcaaccgggtcaggtgggaaggccgcggcgggaggaggttcggctgggaagaggaagaggtaaatgagacattcggcgcctgcccacagttggccggtggttagtttggacgcacagatcccttggtaaataaggagcaggggtggtaagcttcagagttttgctcatctaatggcacatgtaggcactaggctactgtacctgctcccatattttctcccagggcacccatgtcttgctacaagaatttgtttgcacttaggctacttccaggttgtggcaatcgagagtttggtgtggtctgtttcatttagcgaatttgtcagtactctataccaccggtcgttgcctcgttggctttgtcttcgtattctcttgtgcattttcgcgttggtagacagggttttatgtgtaaagaaaatgcagtagcgaggcatttaggcacgcaaggagaaacaaaaaagattgcttggttctggttggcgagccccatcgcttgtaatcccagcttgcatac

SEQ ID NO: 3612 - DNA, 1624 bp, Zea mays
ggcgattgggttcctcccggccggccgccagcactaaactacagctaacactgcagccccaagatcgatcgagcgtccacagccccaaggaacatagtataacatggccccagccatttccaagcctctccttaccgatctcgttgcacagatcgggaaggtcccatcgagccacatcaggcctgtcggagaccgcccggacctcgccaatgtcgacaacgagtccggcgccgggatcccgctcatcgacctcaagaagctcaacggcccggagcgccgtaaggtggtggaggccatcggcaaggcctgcgaatccgacggcttcttcatggtgacgaaccacggcatcccggcggcggtcgtggagggcatgctgcgcgtggcgcgggagttcttccacctgccggagtcggagcggctcaagtgctactccgacgaccccaacaaggcgatccggctgtccaccagcttcaacgtgcgcacggagaaggtcagcaactggcgcgacttcctgcgcctgcattgctaccccctccagagcttcgtcgaccagtggccgtcaaacccgccgtccttcaggcaagtggtgggcacctacgcgacggaggccagggcgctggcgctgaggctgctggaggccatatcggagagcctgggcctggagcggagccacatggtggcggccatggggaggcacgcgcagcacatggcggtgaactactacccgccgtgcccgcagccggagctcacctacgggctgccgggccacaaggaccccaatgccatcacgctgctgctgcaggacggcgtctccggcctccaggtgcagcgtggcagccgctgggtggccgtcaaccccgtgcccaacgcgctggtcatcaacatcggagaccagatgcaggtaacgcgcatgcacttccagtcgcaactgagattcttgctgtcgtcgtaatctgggctcgctgaacaaagtcgtcgcctattgtatccgatgcatgcatggatgcaggcactgagcaacgaccggtacaagagcgtgctccaccgcgtgatcgtcaacagcgagagcgagcggatctcggtgccgacgttctactgcccgtccccggacgcggtgatcgcgccggccgacgcgctggtggacgacggccaccctctggcctaccgccccttcacttaccaggagtactacgacgcgttctggaacatgggcctccagtcggccagctgcctcgaccggtttaggcccggaggatcgttggagtgagtgaactacgccggccacgacagggaaaaaaaatgaagacctttttgtattcttgagcatctgccaataactggatctttgaaatcctcctctggactggagtcttggattcccttcgggtcccacctaacattacgttgggtccaccctgaagatgcagacaaggtttaggttgacaaattccgatgtaaggatgattttgtccaacttattactatttccttgtgctaattacaaagtacagatgtaagcttccacaaaacattgcttttgatagatgttgatccatccattacaaattctaagttaattagacttttctgagaataaaaagtatataacttttgttatgtacct

SEQ ID NO: 3613 - DNA, 3887 bp, Zea mays
  misc_feature (459)..(459): n is a, c, g, or t
acattttagtccagaatactatagcattctcaaatattctagtatcatgttgaaactgtaaataaacctcgttaccaaacaggccttacattggaccatggcctcaacctttgagtgtggcctaaccatattgtacctaagcgtgtccgaatcctatcgtatatatattccggcgcttcatcgattccctttagagtatcagaccatctccaaccattcttaccatatttctcctcttatatgtactttctattatattttactacacttaaaaaatactccatgtacattttggacgtccccaacaattctctctatccagctccccatatacactataactaagttatttcatatttttatcattttttgaagtttaaaaattcaaagagtatttgtactaccataatacacattgttatcacggtatatagctttaaaaggattaacattgcaaanaaatgatgtagttaatgtatagagggagattagagcccccctatgtagggggtttcctctttcccccacatggggtgtgtaatggggagaaccgttggagcaacaactccccttaagtccatgtttggataccctcgtattcacattaacccacatatattcaggtggattggagtgaaacttgaactaatttacacccacccaatcgacatcaatacatgtaggttaaggtgaactagtctagaggccgacgacgactgcggcgcgagtaagggggagaggcgggaggttcttgtgtgtgaagaatgaggaagcaaatatatccaaataatattagccattggatttgaggatttgattaagtgagagtagggttatccaacgatttgaatcgttagttttgagagtgcgttatatatgtgtgcaattcgtttggtggatttgggaggtattggtgtggggtgatttgtttggatggattttggaaagttaaaagtggtagattatataggtgtatgtatagaatagatccaagagtattaaataaagtctaaagtacattgcatttagggtgggggttgttggaggtgggctcacacgacaaaatctccgtaggccatagatagcccatgccgagatgtcttctagccccggaggcccggacgccagcttggcgaacagaacggcagaggcgccagaggtgcaatggggccgggctcgatgaccggcccgttacgcccgcgttgtgctccgttcccgtcgcaaaaccccaccgccacaggggtagatccacgagcccatcggcgcccggcaatggatggtgggtccggcggagtccaggcccacgcgcatcgtgaccacggccggatcgaaatacgcaagcatcgcctaccgcttcttggtttcttgtgccagaaaggctcgccctgacctcccctgagctggtcggtttggtggccgtcaactgccaaccccacctgtcatagtcagacccaggtgcctcggccccacccgagcctcaggctcggaaagccgtttgcgcctccgagcctgccacgcagcatgaatccgagcccgaagccactaaagaattcggaagcccatcagaaaaacagaacgaagccaatggaaggactggaggaggggagtagcgtgatagtgatgccgtagtggtcgagctcgcggcggagtagagaccagagagtgagagcgagcagagcaaccaaagcgtaggcgacctcaacgcgaagcggaattgattgcgcccaccaccacgtcttctccccctccgtccgacccgtcctcaagtcaccaggccaccatcattgccgccatcgcgccgcccggccgcgggagcccagctacgcattcataactgtttctctcttggcttctcggcgaagtgttgcggttgcgggtactggagtgcggagagcagcgcggcgcgagggaggaagccaccacccaccaccacctccattaaaggcgctcacgcgccgcctccgcctccgcctccgcctccacgagagagctaggcgagaggggcgtacgagacctcagctgactcctgtcgtcaaggccatcgatctctcccctcctcacttcctcccctcacgggggcagccacgtacaaaggcaggcagctcgccaacgcccagcaccctctcgccgcgccaccccacgccgtgcgcctttaaagagagcgcacgacaagcttaaaggttcccacgccgccgctcgcgcttgtcttggcgccgcgacacagctggtcggtgcctttgatccgttccttccttttccagctgcagaggttacagagtcccgagccgtcgcgcgcgcgaaagcagaggagcggcaatggcggtggccgcgcggctcggcgccgtcttggcgtgcgtcatcttggcggccgtggcggtggcgccgcggccggtggcggggatcctcgacccggtcgacttcctcgcgctgcaggcggtgcggcggtcgctggacgacatgcccgggtccgcgttcttcgacgggtgggacttcaccgccgacccgtgcgggttccccggtgtgttctgcgacgcaccgggtggtggcgctcgcgctcggcgacccgcgggcggggtctccggggctgacggggaggctggacccagcgctgggccggctgtccgcgctcaccgagctctcgctcgtgcccgggcgcgtcgagggggagctcccggcgtcgctggcgtcgtgctcgaacctccgcttcctggccgtcagcaagaacctcctctccggccagatacctgacggcttcagcgcgctgtccaacctgcggacgctcgacgccagcttcaaccagatctccggcaccatcccgccgtccatcgccgcgctgccgtcgatcaccaacctcatcctctgccacaaccagcttaccggcggcgttccatcgttcctggactcgtccccgctcctgcggctggatctcaagcacaacgcgctctccggcggcgtgcctaccctgccggccgggctgcagtacctgtcgctgtccgcgaacaagctcaccggcacggtcgatcaggtgctgcccgggctgtcccggctcaacttcctcgacctcagcatgaaccagcttgagggcccgatcccggcgtcggtgctctcgctgccgctgtccgtgctgcagttgcagcgcaacttcttctcagggccggtgcagccgtcgaacgacgtgacgatcccggtggtggacctgagctacaacaggttctggggccagctctcgccactgctggcgggcgtcgggcagctgtaccttaacaacaaccggttcaccggcgaggtccccgcgcggctggtgcaggagctggtgggctccggcggcctgcaggtgctgtacctgcagcacaacttcctgacgggcatcgcgatatcgccgtcatcgtcgctcccctccaccgtctcgctctgcctgatgtacaactgcatggtgccgccggtgtacgcgccgtgcccgatcaaggccgggtcgcagaacacgcggccggcggaccagtgcccggagtggaggggctgagcctgatgtcggggtgagcttgatcgtgtctcagcaacgccagtgccaatgccggatcgcctccgatcaccggttgggaatagcgggaaagcagaactgaaggtcaatgattctttgattgatttgggtatagttacaggcaagtaagtgccttaataatccggatttacaggtgtgtgtttttgtttagttggtgtatgtgcgtttgtgtatctctgtgctgtatagtgagcagtactccctcccggagcttctatcgcactgccgcatgatgacgctgtttgcatctgatgatggatggtgttagtaagaggcagtgaagttattatttatcgaatcatgtcgctgaccaaaaaaaaaaaaaaaa

SEQ ID NO: 3614 - DNA, 3012 bp, Zea mays
  misc_feature (1922)..(1922): n is a, c, g, or t
  misc_feature (2921)..(2921): n is a, c, g, or t
gaaacccaggtgccctgacagtatagaatggcagtgcacaatttcattactatggatccacttcacaagtaaattagaaaaatccacgtatcaaacttccttgagtttgtccttcttgtatgtatgatccaaatttgcaataaagatagtaaagcaagatggtacatcgattgaagacttgtctcgtctatcctacaccaaacatgtcacgctatcaaactttacacatatcggccaagcattaaaaaagaaacatcagctcattgttcttttagaattttaacatatatcttatcataatatgtttattaacttcatagcaacgcacacacatttacctagtaagcgtatataatgttataaataggctagaccacgtgaagtcccgaactagctaaatgctagtaggctgccagaaatgctcgtgcatttgtatagtgggcgttcgatatgcacgcacgagcgtattgttgcttccttaataagcgtaatataataatccgaactaaatatttggccgccagaaaattcacgcaaagagagagataggaaaaggattaggccggactactagaaggaacagtttgcgtcagccagtagcaacggagacttgctatttccaacccccacctaataaactttggagtttggaatgtagtactactacgtagtttcgcatgtgttgttgaacacatgcatatgcctcgtacccgcacaggcacagccacgaatcggtctgtgctacgacaaggattggactaggactagtagcggacacacgggctagcggccaagtagcccagcatgtgcgccgtgcgcgacggaattagccggaaaccgagcagaaacccccacgcgcacgcttctttcccgcacccctcggcagccccccactactggctcggtccacgccacgcgcacggcgcgcaccgcccacgcccagcaggccagcagtccgctccaccgctcccgatcgagacctagcaccgccgccagttcgccaaccaacgcccactcccacacgcgcctgcctgcctccatgcatgatcccagaaatgaagaggaagccagccccgcccagccaagaccaccgcgcgcgcccgggtgcagagcagagacgtgccggcatctctccgcgccccgtcgcgtcacccgctcgcctttcacgtgccgcaatgctttcccctcaccgcccggtgcccgcgcaagccacgaaattagcaagggctgccctatctatctatccggccatctaccttgtctctcgacgctcgagtgtcaatcaccaccgctccagctacgcacagctataaaaccaggggcagccaaacatggtactgctataccgcatgaccgcacctcgtatcgtcgtctagctccgtttcgtttccgggaagcaaccaaccttcgttcccgggcagccgacgacccttgcgccgtcttcgtctgtcaagagtacagtttgacgcgagcagctgccggttccttctctcgtgcgcctttgctagcttgggatcgatcaaagccggtgagcgaccgagcgagcgagtgaggatcggaacatctgccatcatggcctccgagcatgcgcagctgtctgccaaggccgccgccggcagcaggttcgcggtgacgtacggcctgctgaggcagtacatgaaggagcagggcggcagcggcgccaccaggtgcctcgcgccggccgtgggcgtgggcctcatgccggaagccgacgctgctgctgcggcggcggaggcgaccgacgacaggaccaccgtgctggagctcttcccgcagcaggctggcacgctcaaacacgagcagcaaaggtgtgttaactcgccgttgccttcagtcagtgcctcaccgtgcgcgtgtgaacttctgatcgcggatctctccgtcgtccgtcgtccccttangaagaggaaggagcgtgctgacgggagagcgccgctgaccatcttctacggcggcaagatggtggtcttcgacgacttccccgccgagaaggccgaggagctgatgcagctcgccggctccggcaacgccgcccaggacgcgctgggacagcccagcctcacaggtacgaacacgaacgactcaacgcatatacgtacgctgtccagagctcacacgggcagcctgcagaggcccatgtagtagcgtccagcagccgttcatacagcggagatgataacgacagcattcatttgtcccttgcacgcgtttcttcagcccggccccgcccgaggcgggtgtcgctaaagaggttcctggagaagaggaagaaccggctcaccgcggcagatccatacccagcagcggcggcgacggcggcggcaagcgagtcgtcgactaagcctccggcagtgaaagacgagggcgcgccgtgggtcggcgtgaactcggcgctcagcctcagctgaacaatctcatcgacggcagcctgcctacctatcgctatagggaaaaactagctatttcccggccgtaaaaatatgtacgtgtttggccccccttgacatttacaccagttaaatggctgcttcagttcaggggaattattagctgggtagctaattaccatgatcggtttatttagttgtctgtttgagaattctttggccagaacgaagaagaattctttttttcttccttgctggtattcatcatatctgcgaggatacgaactgattaattagacctagtcgaactcatatatatacatagtgtgtaaattcaaataagatgatggaacaggttatatgcaattctttcgcttcattgattcagtctcgtgtcagatgaattcatggattgtttattttcaccttttttttctgtcaccgggcggtgaaactgaaatatatcgctagcactcctccgtgtatcatgtatgtccctgacaaaaaaaactnggtgtgtacgaaaccaaactgtgtgaacaattttccagacaaaacaaagaaacaactgatgaaccatatagcaacggccggccgtacgtca

SEQ ID NO: 3615 - DNA, 1211 bp, Zea mays
cccacgcgtgcgcgcacctcgtatcgtcgtctagctccgtttcgtttccgggaagcaaccaaccttcgttcccgggcagccgacgacccttgcgccgtcttcgtctgtcaagagcacagtttgacgcgagcagctgccggttccttcttctctcgtgcgcctttgctagctttgggatcgatcaaagccggtgagcgagcgagtgaggaccggaacatctgccagcatcatggcctccgagcatgcgcagctgtctgccaaggccgccggcggcagcaggttcgcggtgacgtacggcctgctgaggcagtacatgaaggagcagggcggcagcggcgccaccaggtgcctcgcgccggccgtgggcgtgggcctcatgccggaagccgacgctgctgctgctgcggcggaggcgaccgaggagaggaccaccgtgctggagctcttcccgcagcaggctggcacgctcaaagacgagcagcaaaggaagaggaaggagcgcgctgacgggagagcgccgctgaccatcttctacggcggcaagatggtggtcttcgacgacttccccgccgagaaggccgaggagctgatgcagctcgccggctccggcaacgccgcccaggacgcgctggcgggacagcccagcctcacagacatgcccctcgcgaggaaggtgtcgctaaagaggttcctggagaagaggaagaaccggctcaccgcggcagatccgtacccggcagcggcggcggcggcggcggcggcaagcgagtcgtcgactaagcctccggcagtgaaagacgagggcgcgccgtgggtcggcgtgaactcggcgctcagcctcagctgaacaatctcatcgacggcagcctgcctacctatcgctatagggaaaaactagctatttcccggccgtaaaaatatgtacgtgtttggccccccttgacatttacaccagtaaaatggctgcttcagttcaggggaattattagctgggtagctaattaccatgatcggtttatttagttgtctgtttgagaattctttggccagaacgaagaagaattctttttttcttccttgctggtattcatcatatctgcgaggatacgaactgattaattagacctagtcgaactcatatatatacatagtgtgtaaattcaaataagatgatggaacaggttatatgcaattctttcgcttcattgatc

SEQ ID NO: 3616 - DNA, 890 bp, Zea mays
attgggtacctcgaggccggccgggataccgcttgaccgcacctcgtatcgtcgtctagctccgtttcgtttccgggaagcaaccaaccttcgttcccaggcagccgacgacccttgcgccgtcttcgtctctcaagagtacacacagtttgacgcgagcagctgccggttccttctctcgtgcgcctttgctagctttgggatcgatcaaagccggtgagcgagcgagcgagtgaggaccggaacatctgccagcatcatggcctccgagcatgcgcagctgtctgccaaggccgccgccggcagcaggttcgcggtgacgtacggcctgctgaggcagtacatgaaggagcagggcggcagcggcgccaccaggtgcctcgcgccggccgtgggcgtgggcctcatgccggaagccgacgctgctgctgcggcggcggaggcgacggaggagaggaccaccgtgctggagctcttcccgcagcaggctggcacgctcaaagacgagcagcaaaggaagaggaaggagcgcgctgacgggagagcgccgctgaccatcttctacggcggcaagatggtggtcttcgacgacttccccgccgagaaggccgaggagctgatgcagctcgccggctccggcaacgccgcccaggacgcgctgggacagcccagcctcacagacatgcccctcgcgaggaaggtgtcgctaaagaggttcctggagaagaggaagaaccggctcaccgcggcagatccatacccagcagcggcggcggcaagcgagtcgtcgagcgagtcgtcgactaagcctccggcagtgaaagacgagggcgcgccgtggctcggcgtgaactcggcgctcagcctcagctgaaacatctcatcgacga

SEQ ID NO: 3617 - DNA, 4084 bp, Zea mays
gaataggagatgcagcaagaatcaggaatccatcgtggctccctccgtgtgagcatgagcatcattggacgcaatgtgctgctggctcctggagtcctggtagggcaccaagctaccataaaaaagaagaagagaaaactccgttgctggcggcaggcattcaaactcacccgttgctggcggcaggcaccgccgtcccgcgcaaaacaataatattcagctgaacgcggagacgaaacagacggcggcaggtgcacggtgcacaccggcacgccatccatcaccagccgcaagtcgtcgtcgcgttgcattgttattactatttctttcttctctccactgcaccaccaccagcgccccgcccccagatcccagcgcggccaatggcgctcgagtcaactccagggccacgaacacggccccccccgctcccgccccccctcgccgccgcccctgcctccgccacgcatcacgcctccccgcccgccgagccaatgccatgagcgcgccgccgacccacggccgcaccgatgccgacgcgtctccccctcgccgccgtcctgctcctcctcctcctcggcgccgccgccccgaccccggcgcgcggcggcagggtcgccacggagctcctcgccccgggcttcacggcgtcgtacctgctcttcatcgacacctacggcgcgttcctcgcgtcgcggagcggcgcgttccacgccgtggtctacaacccggggcagcagcaggagcggttctacctcgccgtgctccacgcgccgtccaagacctgcgtctgggtcgccaaccgcgccgcgcccatcaccgaccgcgccgccccgctgcagctcacggccagcgggatctccgccgaggaccccaacggcaccaccatctggtccacgccgccgttcggggagccagtggctgcgctccgcctcgacgaccacggcaacctctcgctgctggacgcgaggaacgccacgctgtggcagtccttcgaccggcctaccgactcgctcctgtcgtcgcagcggctccccgcgggggcgttcctcgcgtccgccgcgtccggctccgacttctccgagggggcgtaccggctcgacgtgacggcggccgacgccgtgctcacgtggatgggctccatgtactggcggctctcgaacgacgccagctcgaccgtggaacgaagcggcaccgtcgcgtacatggccgtcaacggcaccgggctgtacctgctcgcggcggacggcggggtcgtcatccgggtctcgttgcctgcagccgagctgcgagttgttaggctgggatatgacgggaagctgcagatccagagcttcgcgtcggcgaactcgtctaagtcgccgatggacggcggcttcgtggcgccgagcgatgcgtgcgctctgcccctctcctgtggcgcgctcgggctctgcacgcccaagggctgcacttgcccgcccttgttcgcggcgtcgcacgacgctggttgcacgccgtctgacggctccaccccgctgtccgtctcctcatgcggcggcggcgggaataacagctcgccggtctcgtacctcagccttggcagtggcgtcgcgtacttcgctaacaagctggcgccaccgaccgtgtccggcggcaacgtttcttcatgccaggctctctgtaccagcaactgttcctgccgcggttacttctacgacgactcgtccttgtcctgctacttggtgaagcacgagctcggctccttcatgaacgctgactccaccaaaggctccgacaagctcggctacatcaaggtgctgagctcgcagctatcgagaccatccaacagttcgtcctcaaacagcaccctcattgccatcctcctcccaacaatcgtcgtgtttgtgctcatcgtcgtcgtcagcgccaccgtgatcagggcgtggcgtaaggatgcggggcgctcgtcgcgctctagggatcagcagctccggcggcagcgctcgccgtcggattcagcgcacctggtgcgggatattgacgatcaggacgacgacatcgtcatccctggcctcccgacaaggttcacgcacgaagagatcgaggacatgaccaacagctaccgcatcaagatcggcgccggcgggttcggcgccgtgtacaagggcgagctcccgagcggctcgcaggtggccgtgaagaagatcgagggcgtcgggatgcagggcaagcgcgagttctgcaccgagatcgccgtcattggcaacatccaccacgtcaacctcgtccgcctccgcggcttctgcaccgagggccagcgccgcctcctcgtgtacgagtacatgaaccgcggctccctcgacaggtcgctgttcaggccgaccggccctctgctggagtggaaggagcggatggacgtcgccgtcggggcggcgagggggctggcgtacctccacttcggctgcgaccagagggtcatccactgcgacgtcaagccggagaacatcctgctcgcggacggcggccaggtgaagatcgccgacttcgggctcgcgaaattcctcacgccggagcagtccggcctcttcacgacgatgaggggcacccgcgggtacctcgcgccggagtggctcagcaacgcggccatcaccgaccgcaccgacgtgtacagcttcggaatggtgctcctggagctggtgcgcggccgcaagaaccgcagcgagcacgtaagcgacggcggcggcgaggcctccaattcctcgaacgggacagcgggcagctcgtcgcgcggcgcgaagagcgactatttcccgctcgccgccctggaggggcacgaggccgggcagtacgcggagctggctgaccctcggctacaggggcgggtggccgccgacgaagtggagagagtggtgaaggtggcgctgtgctgcctccacgaggacccacacctgcggccgagcatggcggtcgtggtcggcatgctggagggcaccatagcgctgtgggagccaaagatgcagtcgcttgggttcctccgactgtatggccgggggttttctgggccagcggacggcgacatgaatctgaagcatatggcgtcccccatggaccggtcagggacgacgacggcggcctccccggcggggggcgggtggccgtcgtacctgtcgtcatctcagctctccgggccgagatagcgaagaatggacacgggattctttctagcttagagtgtactccgacgaatccattcttgattttgttctggtggtagaacaaaggaaattatctttgtgtctacgtggtatctggtccaaatcaccacgattttgttgcattccttttggtggattggcttttccattggaatggatggtggagaagctgaaatccgttgatgttgtacgcaaaggtttttgcacgtccaccttttcaactcgtttcggatctgaacattcgaatctctagcgcaacttataatatgtttgaaataacccaagtttcttaaaaaacacgttgcttgcaaatagtcccttattatttcctcgcttcaacagacctcgttcggaacaaatacagtggaagggtggcttcacagttcggtaatcacgcgctgtttaagtttgaaatacgatggctcattagagacggatttcatgatcttcgatttggcaactagaaactagggatgacacattcaagaaaaaatgacagagtaaaattagatcccttcatcaatacctacggggttaggctaagaacaccgttgaacaattaaaaagtagaaatctcaacttactcatatgctttattagttggacaaaaagatgaaccggtcaactagtgctacaagatccaacaactatatgtgatacgctagaaactctccaatcgcacccaaaagatgaactgcaagatggaaatgagtgaattgtgtttctttagtcctaataggtgttctcaagtgttagaaatgaagggatactagccaaggttggacaaaagggtctatttatagcccaagtcgaaatccaaccattatctctgaagggctgaaattagagacatcaaacatgtctattgcactatcaaaacctgcacg

SEQ ID NO: 3618 - DNA, 723 bp, Zea mays
ccggccgggaacgggcaccgtgggcccgctcgacccggccattgaatacaatgaacaaacgcgtcggcccattgcgaagcctcacgtctccagcaccgggccaccggcggcgaggtcgcgcgagcgcaggcaggggtggtactgggaggggaggaggggaagaaggaggtgactgcgatgtcgagccggttctggaggtggtacgcggaccggcagttccacaagtgggagaagacggtgctgtgggacatggtggagccctaccgcccgccgcgctccttcgcgccactcgtcggcacctacgtcgccgccttctacaccggcgtcgtcggggccgccgtcaccgagcagctctacaaggagaagtactgggaggatcaccccggcgaggcggtgccgatcatgccgcccaagttctactgggggccttggagggtgatgaacggagaagttccgcgcttcattcagccgcccgacgaggccaagacggcgtaggagcttcgagcttgcttcaaaacttttcagaagaagcatgtatctggtctcgatcgaaaaaaagaaattggagccctgcttttgtgcctctcccactctcctggttgtacgcctgtacctgtctgtctggaatacacgagtaagataagatcaggagaactgaagacctcaaataaagaaaaaaatcagaaaacgttggcatggataaaaaaaaaaaaaaaagcggcc

SEQ ID NO: 3619 - DNA, 749 bp, Zea mays
tgggaccctcgaggccggccgggaaatctaccttttcactcagatcgattcaaaccacatcaacccaaaccctatctcgacggttccacttccaccgccgaccccaaccccatcaatcgtcatccaccgccggcgtgacaaacggcaatcctgccgccacaaccgcgtctgacatagatccactcttccccacaggcccctccttcctccgtccgctggcgcgctactgcttgagcgtggagggtgtgctgcgggttagccttggtcgcttcatcatcttcgtgttgtgtcctatgcccccgcttcatctgtcgtatcccccagcgcagcccctccctctctccagtctcctttctcgcatcggcaatcagcttggcatggccgaattaatggcggtctacccatggcaggtgatggcgggcttcctcaccctctccatgttcgtcatgctcgaaaaaatgatcaagcacgaccacttgtctcccatcaccgagaactgcgaggagttcttgatacaaaagaataccctgaagggcccgagatctccagatggtgacaacatgcttgctcttggaaagtagaggaatgtaaggattgttttcaagactttgtacatgttcatttattttctgggcacgtacttgaaaccacatgtagcctgcatcatttgtgtgtatttaccaacaactaaaatgtaaacacgacattttcatagttgagtacaggaataattatctcttacaagtaac

SEQ ID NO: 3620 - DNA, 2203 bp, Zea mays
gcacgagaccattacctagaacatcctaatcgaaaaattccaccgccttcctctctctctctcgcctcttcttcttcttcctcccctccccttctccccccatctgcggcggggttgattcgatttcgattcccttccccatccatcgcccacctcccctacagacagccaacgcaatccgctccccgaggcgcctccctgaccctgactccctccaccccacaacgtgcgcgctcactcgcgggcggggccgggccgggccggcaggcacactcaccgtcaccacccttattaattcctcttccgcgtccgcgcttcaaaacctcctcccgtcctccgcctcgtcccccctctaccactctccccagcaccccggcggccgcattgctcgccgcagcaccgtgtccgggtagggcccctctgggctcctgcatttcgattgcctcccctgcctgtgctttggtctgggccggttgcaaggagggggaagggagggaggatttaatttgatcggagggcgaaaatgtgggcggagcgggtggtcggggagcgacggatgcggcagatccagcgcttcgcgcggaacgccaagctcaccgtcgtatgcctcctcctcaccgtcgtcgtgctccgcggcaccgtcggcgccggccgcttcggcacgccgcagcaggacctcatcgagctacgccagcacttcgtgtcccacccgcaccgggcgctcgccgagcaccacgacgccaggtccagggcctccaccaccaccacatcgtcctcgtcctcctccgcccgccgcgacgacgaccccgacccgccgccgaggtcgctcagggacccgccctacacgctgggccccaagatcttcgactgggacgagcagcgcgccgcctggcaccgccgccacccggagacgccgcccttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggcaggcttctgggccaagctcccgctcatgcgggcgctgctcctcgcgcacccggaggtcgagttcctctggtggatggactctgacgccatgttcactgacatggcattcgagctcccgtgggagcgctacgggccgtacaacctcatcatgcacggctgggacgagatggtctacgacgacaagaattggatcgggctcaacaccggcagcttcttgctgcgcaactgccagtggtcgcttgacatgctggatacctgggcgccaatggggccaaagggccctgtccgcattgaagccggcaaggtgctgaccaagtccttgaaggatcggccagtattcgaggccgacgatcagtcggccatggtgtacatcctcgcgacgcagcgcgagaaatggggtgataaggtttaccttgagaatgggtactacctccatggctactgggggatcttggtcgacaggtacgaggagatgcttgagaattacaagccagggctcggcgatcaccggtggccactcgtcacacactttgtcgggtgcaagccgtgtggcaaatttggagactaccctgtcgagcgatgcctcaagaatatggaccgtgcattcaattttggggataaccagatcttgcagatgtatgggttcacacacaagtcactagcaagcaggagagtgaagaggatcaggaacgagaccagcaacccacttgagacaaaggatgagcttgggttgcttcatccagcattcaaggctgtgaagacttccacatgataattagagtacaattcaacttgttattttcttggttcgttctagatcctgttgggtctaaatccaaagtgttctttttgtagaatcgggtgacaaccagaagtttgggttggggttatgggatggatatctttgttgtaatgtgaggtgttaggagaattatgttatgtttatttattggcataagttatgtcttacgctcgtagaaacgagttaatggatgaactcaagttactggttgcatgatagatttcaatagagttccctgttttgctcttgcggggatttcttttataagagtgccagcagcccaagcatcaaaggaatcgttcttgc

SEQ ID NO: 3621 - DNA, 2159 bp, Zea mays
gcacgagaccattacctagaacatcctaatcgaaaaaaaacctcctccggctcgtcccccctctaaccagtccccagtcccgcggcggccgcattgcccgccgccgcaccgtgtcttgctaggactaggaccccctgtttgggctcttgcgtttcgattcctgggtcgtctgcaaggagtgtggccgacggagggggccaaaatgtgggcggagaaggtggtcggcgagcgccggatgcggcagatccagcgcttcgcgcggaacgccaagctcaccgtcgtctgcctcctcctcaccgtagttgtgctccgcggcaccgtcggcgccggccgcttcggcacgccgcagcaggacctaatcaagctccgccagcacttcgtctcccacccgcaccgggcgctcgccgagcaccacgacgccaggtccagggcctccaccaccaccacatcgtcgtcgtcgtcgtcgtcctcctcctccggccgccgcgacgagcccgacccaccgccgaggtcgctcagggacccgccctacacgctggggcccaagatctccgactgggacgagcagcgcgccgcctggcaccgccgccacccggagacgccgcctttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggccggcttctgggccaaactcccgctcatgcgggcgctgctcctcgcgcacccggaggtcgagttcctctggtggatggactctgacgccatgttcaccgacatggcgttcgagctcccgtgggagcgctacgggccatacaacctgatcatgcacggctgggacgagatggtctacgacgacaagaactggattgggctcaacaccggcagcttcttgctgcgcaactgccagtggtcgcttgatatgctggatacctgggcgccaatggggccaaagggccctgtccgcatcgaggccggcaaggtgctgaccaagtccttgaaggatcggccagtattcgaggccgatgatcagtcggccatggtgtacatcctcgcgacacagcgcgagaaatggggtgataaggtttaccttgagaatgggtactacctccacggctactgggggatcttggtcgacaggtatgaggagatgcttgagaactacaagccagggctaggtgatcaccggtggccgctcgtcacacattttgtcgggtgcaagccatgcggcaaatttggagactaccctgtcgagcgatgcctcaagaacatggaccgtgcattcaattttggggataaccagatcttgcagatgtatgggttcacacacaagtcactggcaagcaggagagtgaagaggatcaggaacgagaccagcaacccgcttgagacgaaggatgagcttgggctgcttcatccagcattcaaggctgtgaagacttccacatgataattagagtacagttccacttgtttattttgttggctcgttctagatcctgttgggtctataatccaaagtgttcttttttgtagaatcgggtgacgacagaagtttgggttggggtcatgggatggatatctttgttgtaatgtgaggtgttaggagaattatgttatgtttatttattggcataagttatgtcttacacgaaaaaaaaaattaatggatgaactcaagttattggttcaattatagatttcaatggagtttcctgtttttttattattgtggggatttatgttaggttgtctccactctccaggagaccgtgtatacttagactctactgtttatacaataggaggtgagatataaagtgctggagacggccaaagtgtgttaatagccctgtaggtgttcttaaatcaagcttggtgtgtatatataagcgatcaccaaaacgcgcaaaaggcttgctaggatgatttttgttaccatgccaggcaagcttatgttcttttagaagtactgttatgctgacttttgtattgcaatcttccattaacatcgtgacgagtttaccttaacagcacttcttacagtggaatac

SEQ ID NO: 3622 - DNA, 2983 bp, Zea mays
caaacccgagcaaattaaccgacacctctacgccgtgggtaccacgccccccgggcccaccctacatggacccctccccagaccagagggtaaacagcgatcagttcgttaattaaccgatcaattccttaattaaccaaccgtgtggagggaggcgacagcggtggatgaaagaggtgtcctggaagcatcgcatctcgtgtccgcgtcgcctcattccatgacctcctccctctctctctctcgcctcttcttcttcttcctcccctccccttctccccccatctgcggcggggttgattcgatttcgattcccttccccatccatcgcccacctcccctacagacagccaacgcaattcgctccccgaggcgcctccctgaccctgactccctccaccccacaacgtgcgcgctcactcgcgggcggggccgggcccgggccggcaggcacgctcaccgtcaccacccttattaattcctcttccgcgtccgcgcttcaaaacctcctcccgtcctccgcctcgtcccccctcccccctcccccctctaccactctccgcagcaccccggcggccgcattgcttgccgccgcaccgtgtccggctagggcctctctgggctcctgcatttcgattccctcccctgcctgtgctttggtctgggccggttgcaaggagggggaagggagggaggatttgatcggagggcgaaaatgtgggcggagcgggtggtcggggagcgacggatgcggcagatccagcgcttcgcgcggaacgccaagctcaccgtcgtctgcctcctcctcaccgtcgtcgtgctccgcggcaccgtcggcgccggccgcttccgcacgccgcagcaggacctcatcgagctacgccagcacttcgtgtcccacccgcaccgcggcgctcgccgagcaccacgacgcccaggtccaggggcctccaccaccaccacatcggcctcgtcctcgtcttcctccggccgccgcgacgagcccgacccaccgccgaggtcgctcagggacccgccctacacgctggggcccaagatctccgactgggacgagcagcgcgccgcctggcaccgccgccacccggagacgccgcctttcctcaacgacatcaagccacgggtgctgctcgtcacggggtcctcgcccaagccctgcgagaaccccgtcggggaccactacctcctcaagtccatcaagaacaagatggactactgccgcgtccacggcatcgaggtcttctacaacatggcgctgctcgacgccgagatggcaggcttctgggccaagctcccgctcatgcgggcgctgctcctcgcgcacccggaggtcgagttcctctggtggatggactctgacgccatgttcaccgacatggcgttcgagctcccgtgggagcgctacgggccatacaacctgatcatgcacggctgggacgagatggtctacgacgacaagaactggattgggctcaacaccggcagcttcttgctgcgcaactgccagtggtcgcttgatatgctggatacctgggcgccaatggggccaaagggccctgtccgcatcgaggccggcaaggtgctgaccaagtccttgaaggatcggccagtattcgaggccgatgatcagtcggccatggtgtacatcctcgcgacgcagcgcgagaaatggggtgataaggtttaccttgagaatgggtactacctccatggctactgggggatcttggtcgacaggtacgaggagatgcttgagaattacaagccagggctcggcgatcaccggtggccactcgtcacacactttgtcgggtgcaagccgtgtggcaaatttggagactaccctgtcgagcgatgcctcaagaatatggaccgtgcattcaattttggggataaccagatcttgcagatgtatgggttcacacacaagtcactagcaagcaggagagtgaagaggatcaggaacgagaccagcaacccacttgagacaaaggatgagcttgggttgcttcatccagcattcaaggctgtgaagacttccacatgataattagagtacaattcaacttgttattttcttggttcgttctagatcctgttgggtctaaatccaaagtgttctttttgtagaatcgggtgacaacaagaagtttgggttggggttatgggatggatatctttgttgtaatgtgaggtgttaggagaattatgttatgtttatttattggcataagttatgtcttacgctcgtagaaacgagttaatggatgaactcaagttactggttgcatgataaaaaaaaaaaaaattccctgtttttctcttgcggggatttctttttataagggcgccagcagcccaagcatcaaaggaattgttcttgtgatattggtgtcttcatggacaggataacatatcttgtgagccaattattttgctctcttctttgccttactattagtggctattgggttgctagatgtattttggtatatatacaagctcaaatttcaggtttccattctcatgatttgtcctttgctttaaattattaagtgggactggtgctatccaccattgagccaattatgttgtccttgttgataacatcttccattgatattgatggctaactgtggagttatgtgaacctggttcttggttgatggattctttgcaactgggttaaaggcatttttgtgttgcatgccgttctttttgcactcgatgttgatgtaaactccggtaaacatgaagaaacaaaagcttgctatgatgcattttgttatcatgctggggaagattatgttcttctagaaatgctgctattctgactattgtattgcaagcttccattaccatcatgacgagttaagcttaacagcatctctgacagtgaaatgcaacttgtagtcaatgtagagaaatggtgctgtttgatttctggaaagcactggggtccagg

SEQ ID NO: 3623 - DNA, 1809 bp, Zea mays
aattcggcacgaggcctttccgtccactcctttggtctcaaatcctcaatcatgcccggaattttgtaccagctcgtcgtcgccgccgccatctgcgccctctccagcggcagcatcgcggtcgcctcaggtttgaatgcgaccgactcgttcctcgtctgcctcatcggcgccggcgtcccgccgcgcctccttcagaccccggcgtccccgtcgtactccgcgacgctgctctcatccgtacgcaacctccgctacgtcacgtcggacattcagcggccggtcgccatcgtggccgccaccgagccagcccacgcgcaggcggccgtacgctgcggccgccgccacggcgtccgcgtccgcgcccgaagcggcgggcacgactacgagggcctatcctacgcctccctcgacccccgcgagcgcttcgccgtgctcgacctcgccgctttccgtgacgtccgcgtcgactccgcgcgcgccgaggcgtgggctggatcgggggccacgctcggcgaggtctactatgccgtcgccgccgccagccgcgtgctcgcgttccccgcggggatctgccccactgtcggcgtaggaggacacctcagcggcggcggcttcggcacgctgatgcgcaggtacggcctcgccgcggacaacgtcattgacgccgtcctcgttgacgccgacgggaggctgctgaaccggaccaccatgggggaggatctgttctgggccatccgcggtggcggcggggagagcttcggtgtcatactgtcttggaagctccgcctcgtgcgcgtgccggagacagtcaccgtgttcaccgtgcgccggtcaataaaccagtccgcctcccaactcatcaccaaatggcaggcaatcgcgccggcgctgcccagtgacctcatcctccgagtcgccgtccggagccagcccgcgcggtttgaggcactgttcctcggccgctgcagccgcctccttgagcacatgagagctcacttcccggaccttggcgtcacccaatcggactgcgaggagataagctggatccagtccaccgtgtacttcgccttctactcgagctccaagccactggagctgctcctggacaggagcggcgagacgcccagatacgtcaaggccaagtccgactacgtgcaagaacccatcccacggcacgtgtgggagagaacatggtcatggctggagaagcccgaggccgggctgctcatcctggacccctacggcggccggatgggcagcatctctccgtcagcgacgccgttcccgcaccggaaggggaacctgtacaacctccagtactactcgtattggttcgagaatggcactgcggcattggagaagcggatgagctgggtcagggggctgtacgaggagatggagccgtatgtgtccaagaacccaagaactggatatgtcaactacagggacctggatcttgggacgaacgagttggaggacaatgtgactagctacgccagggcgaggatctggggggagaagtatttcaaaggcaattttgagaggctggcagctgtgaaggccatggcggatcctgatgacttcttcaggaatgagcagagcatccctcctcttcccgctgcaaaaggatggggcttcatttgagtggtcgtttgtttcgtagctttgtggtggtggatttcttggctaacaaaaaaaaaaaaaaaaacggctgaggatttgcatgggtgaagtgtagaatgcactattgtattccggttctgttagctgagttctctttatttgtttttaaaaaaaaaaaaaaaa

SEQ ID NO: 3624 - DNA, 3815 bp, Zea mays
  misc_feature (786)..(786): n is a, c, g, or t
  misc_feature (1388)..(1388): n is a, c, g, or t
tagaaatggatataacaactttccatggatatgtactccgccttagccattaaaagtgcaatctagttttatttctttgaggaccatgatactactgacctccctagcggtgattgacatgcgcctgatgtgctctttctacccatgtagcatctcgcgtaatctgaatccgagtatccaaccaactcaaattatgaccttctggaacaccataatccaacactaggtgtacgattcgaatacatcgatatccttttcatggcttcaaaataatcttctcttggtgaggtttcaaatctagcacacacatgcatgcaattgaatctgatcttgaagtagtcaaatagagtaagcttccaatcataaaccgatacacctttaatatgatcaaccagctcaccacttgtatctagatccaaatgaccactcgtgtccactgttttatgtattgattgtgcatcttctatctcattcgtttgatccgaagtccaagtaactcaactctctttattcgtagatatattaaattctttagccatcgtctctccgaattctcacaaaaattccttatttgttgatatagaaaataataatgccatccacgtagatttttcctaccttaaatcgaatgagtaagaagttacttaacctattgtactgtgctctcttgccttgatccatgcatataacgatttcttgaaattacagaggtattttaggaataagaaaagtaaattggaagaaaaccttggttctttaatagttcgatatacaagtggagttcanattgttaatttcacttaacggccgtgaaaatgcatgtacaccggctcgatgtcactatcagattgtgaacaaggatccactctattttcttcactctatatcccagtcagacgctacgtcaacattctctctatctatatctctatcccctacaacggttcactctaaatcaacactctataccccaccagtccataccattattatatgcattccctttaactaactcaaccaccatctttttttacctttttcttttatttttgaacaggtgggcgcccaacaaaagaagcaaaaataatgatccgtgtaatttaatttaatgacgcttgtactgtttaatttttgtacatataaatctttttaatgttccttttgctcttactttaaattttgtaaatgatatatgtccggattatatgttggcggggtactgttgccgccacgaaaagcgtagagtgcgggaagcgtgaaccgttgttcatagtctcagtagcccacctctatgaaggtcccatgaacctcaggttacaaattagtagacgccccagatcgagtgccccagatcgagtaccgtgtgtgtccctgtcgccaggttgtantactagaaaattagaaccaaaaggttcactaaagtgaccagacaatccttgtggtcttgtggaggtgttgcatggtgggttggtaaaaagaaaaggaaaaaaagacactactggccggagtggcggtacactactagcagcaatgcagcgtgtcgctcccacgaatgtgaaatgcgttttgagtcgtggtggtgatcggtgatgaatgacacccacatgacatgccttgtggaattgcgagacgacgaccttaattgctagtacagcaccatgtatatgcatgggaaggatacgccacacgccttgagaggaggaaggacgctgggcatcgtgacgtcacttgcgcatcactgtgacatggccatcgatcgattggtttcttctccagactcactctagatccagattgctacgtaggatctagggtgcaaacggcggtccggccggtgtgcgtcgtcggtcggtagtagagggagacgtgtggccaagcctcccgtactcggtactccaggcaacgtccgcgtcgtcgtgaccgctctagtcacgccgtcggccggtcctaggccctgccgtgcaatcctcgaatgttatccactttttcggaaagagcacccgcccgcccgcccgtgataactggctggcaataatgaaaacctcccgccacagcagccactcttccaccactggcgctataaataaaaaattggccacggacaaaggagccacaaacaacaaatcactccgttgagccttcaccatcacctccctctctggctctctctctctctcacgcatacgaacacactctctactagtactaacctctcactaatctatatctagcagcaagcacacaccgtaacatcaaagccaacgacgacgcggggccggccgcccatggccttcacgtccttattgggcagcgacgcggagcggaaggtggcggtggcggaggtggcgctgcgggcggtgctgtgcgggctaggcgcgctggcggcggcgctggtggcgacggacacgcagacgcgcaccttcttctccctgcagaagaaggcgacctacacggacatgaaggccatggtgctcctggtggccgccgcggccacggccgccggctacagcctgctgcaggcggcgcgctgctgctgctgcgtcgccctgctgcgcacgtccatccgcccccgcgcccgcctgctgctggcctggtgcgtcttcgcgtgcgaccaggcgctggcgtacgcgctgctggccgccgtcgccgccgcgctgcaggcctccgtcgtcgccaagcaaggcctgccccagctgcagtggatggccatctgcgccctctacggcgccttctgcaggcaggcaggcgccggcgtcgcctgcgccgtcgccgccgccgtcgacgccgccctgctcgccttcctttccgccttcaacctcttcaggctctacggcgccaaggcctagcgcccagcccaccaccacgacgtagctttgttgcattaattagcacagcagaggtgccttccatctgaccatcctctcttgcaaacaccgtaacaccgcgtagtagagtagagattatggagagacaattaataaggtgcgttcaagctttattaacatatataaacgcattactcatcaataaattctaaaaaaaaaaaaaaaaaaaaaacgggccacgcgtcgctgtgggggaacaagtcccttcaagtgcggtgcgagtgcgatgtctcgtttttttttctttcatcaaggtaagtatagtccacaggcgtgcagcaactccactacggattacggaacatcatacatcagtttggtgcaacagaatcaaacgctttcttcctctttgattgatgattgatttcgaacgcacgcacccagctttgcatgattgcgcgtgctatgcatgcattggcggtggcggggacacgtggttggttttgccttctatttcatgatttcaggcccagcgctatatatatgcactttgagctagcctctaacgggacaatctacttctaaaaggtgcttacaagaagctctgctactatgctgggaatcgaggacagggccaggaattcaccacccactaatagtatccctacgcacgcgcgctgtgcaaatactttagtcgagtctggttgacgactaaaacaattcagggatgtttgaatgcactagagataatagttagtgactaaatttagctagagacattcaaacatcttagctaatagttcagctattagatattttttgggccatattctttgcgttgttttttgtttctatccatgtctgctatttggaaataagaaaatctacatattgacaaatctattggattaggcacgttattttatttttgtccaaataaaaaataatcaccctcagtccctcactgctttgtgcggttgtgccttggct

SEQ ID NO: 3625 - DNA, 3232 bp, Zea mays
attctcgttatgttagttgcacgcagctataactatttggcatcatatatatatgtcgaatattagttatttggttgtgaaaaaaaggttggtatatatccctgtagattttgaatatacccagggccaggccacagcactaaaatctccaagctatacggtgcccggcttgctaacgttccggttatttattaaatcatgcatcatcagagccatgatcagtgactgattgggtagagtcagtaggtagctagcatatgcatgcatatgagcgatctcatcaactcgacctggctgcatttggagttggcgttgggaccaatgcagcatttgcctttgttccccctttaaaccaacaacacaacacatcacatgcccatgcatctggtagctatagctaaaaaaaacctggattacattttcctactacgcacccaacacatcaatggaccatgcagcatatgcagtccagatgaatgattgaacacgatttaattattttttttaaaaaaaatccccgtttgattatatttttggtgtgtgacaataatattgcaacaagaagtattggatgttacgagagttgcactaatccctttcttcattaattatattacgtgcacaatttaagaggtgtagacttgtttgcgttttgttccctttcttcagactcaacagataatgatctgatgatggcagctatgtatcctagctaattcatcatttatatatgtttggatccggctaatatataggtgcatatatatatatataatatccctaagcaatgaactttagccaattgtgtttggttaattgactaacaactagacaagagttcagttcagtagatagatgaaccaatataaaacacagccatgcatgacgactaattagttactgatagccggttgctgttggctcatggctgtcacggacactgctgctaatgaagaaatctgtacgacatagaagctatataagcagtgaccgtcttccccacaagcacaacaagcagaagcagaagcagaagctagcagctagtagacgagcgacgagtagctagctagctagctatctagagagctcatcatatcgctgctcgctctcatccaccattatagagaagagcagatcgagctgcagctggcagaggccgagttgttgctagctagctcctgcttgctaaatttgcatcgtatccgatccattccatgaagaagtcgtcgatgatggcgcccatgacgatcatggcgagagttgccgctgtgctcgtcctctcgtcggctgccatggcttccgccgcaggagcagctgggctggacatgaatttctacggcagcacgtgcccgcgcgtggaggccatcgtcaaggaggagatggtggcgatcctcaaggcggcgccgacgctggccggcccgctgctccgcctccatttccacgactgcttcgtcagggtatatatataactatatacatatattgttgctgcattgattagttgcattgcattgcacgttagctaactcatcccctgcattattattaattattaattgctgccagggctgcgacgcctccgtgctcctggactcgactcccaccagcacggcggagaaggacgccaccccgaacctcaccctccggggcttcggctccgtgcagcgcgtcaaggaccggctggaggaggcgtgcccgggcaccgtctcctgcgccgacgtcctggcgctcatggcgcgcgacgccgtcgtgctggccaacggcccctcctggcccgtcgcgctgggccgccgcgacggccgcgtctccctcgccaacgagaccaaccagctgcccccgcccaccgccaacttcacccgcctcgtcagcatgttcgccgccaagggcctctccgtcagggacctcgtcgtgctctccggcggccacaccctcggcaccgcgcactgcaacctcttcagcgaccgcctctacaacttcaccggcgccaacagcctcgccgacgtcgacccggcgctcgacgccgcctacctcgcccgcctcaggtccaggtgccggagcctcgccgacaacaccacgctcaacgagatggaccccggcagcttcctcagcttcgactccagctactacagcctggtggccaggcgccgggggctcttccactccgacgccgcgctgctcaccgacccggccaccagggcgtacgtccagcgccaggccacggggctcttcaccgccgagttcttccgcgacttcgccgactccatggtcaagatgtccaccatcgacgtgctcaccggccagcagcagggcgagatcagaaagaaatgcaacctcgtcaacgggctctggagacgcacattaattgctgctggttttgacgatgcctttcacttacgttcatccacttaattcatgcatccatgttggttgggttcattcaattattatattcgttgcttacctttacttttgcttggttaatcttaattaaatcgtgtgagttttcttttcttttcttgagtatatatatgtatgtacgtagagcgtgatgagtgccttttcaagtttattgtttttttactttttcctctcgtgcatatggttcaaatccatgatgatgatgtaatgcgcatgtaattaataatgacaatcaagtcaataaacacacatgcaatttatatatgatatgttcaacatatataattagctactgtttttttacatgtatatggtttcttcatcttggtgtgacgtacgttacattgttgctcattctttacgcttggtggatgtagactgccgcaatgcactatatatatataaatgcatgtacttgcaaggcactacatattttagttacgatgtttcctctgaagcacaccaaccaacaaaatatctaattaaaggacggccattaagagatttggcgtgatttttattatacgagacaaatgaaaagatattagcgtaatgattttggattagcaagttgttcaggcactgtatatattagtctgagttgatcagttttccgttctgaaatcaaaaattaaaccaacaacaatagtccattattaattgtcaagttctcaaaacaagacaagctatacctccgtgacaatggcatccatattttgtaaaaggtaataaaaatgcataaacgacatttgaacctgacggttgttttcctcttgcagtttctgtatactgcaggtcgcatgtagactataca

SEQ ID NO: 3626 - DNA, 1604 bp, Zea mays
gccggcagacaacaagcagaagcagaagcagaagctagcagctagtagacgagcgacgagtagctagctagctagctatctagagagctcatcatatcgctgctcgctctcatccaccattatagagaagagcagatcgagctgcagctggcagaggccgagttgttgctagctagctcctgcttgctaaatttgcatcgtatccgatccattccatgaagaagtcgtcgatgatggcgcccatgacgatcatggcgagagttgccgctgtgctcgtcctctcgtcggctgccatggcttccgccgcaggagcagctgggctggacatgaatttctacggcagcacgtgcccgcgcgtggaggccatcgtcaaggaggagatggtggcgatcctcaaggcggcgccgacgctggccggcccgctgctccgcctccatttccacgactgcttcgtcaggggctgcgacgcctccgtgctcctggactcgactcccaccagcacggcggagaaggacgccaccccgaacctcaccctccggggcttcggctccgtgcagcgcgtcaaggaccggctggaggaggcgtgcccgggcaccgtctcctgcgccgacgtcctggcgctcatggcgcgcgacgccgtcgtgctggccaacggcccctcctggcccgtcgcgctgggccgccgcgacggccgcgtctccctcgccaacgagaccaaccagctgcccccgcccaccgccaacttcacccgcctcgtcagcatgttcgccgccaagggcctctccgtcagggacctcgtcgtgctctccggcggccacaccctcggcaccgcgcactgcaacctcttcagcgaccgcctctacaacttcaccggcgccaacagcctcgccgacgtcgacccggcgctcgacgccgcctacctcgcccgcctcaggtccaggtgccggagcctcgccgacaacaccacgctcaacgagatggaccccggcagcttcctcagcttcgactccagctactacagcctggtggccaggcgccgggggctcttccactccgacgccgcgctgctcaccgacccggccaccagggcgtacgtccagcgccaggccacggggctcttcaccgccgagttcttccgcgacttcgccgactccatggtcaagatgtccaccatcgacgtgctcaccggccagcagcagggcgagatcagaaagaaatgcaacctcgtcaactgacaaataatacgtacattaattgctgctggttttgacgatgcctttcacttacgttcatccacttaattcatgcatccatgttggttgggttcattcaattattatattcgttgcttacctttacttttgcttggttaatcttaattaaatcgtgtgagttttcttttcttttcttgagtatatatatgtatgtacgtagagcgtgatgagtgtcttttcaagtttattgtttttttttactttttcctctcgtgcatatggttcaaatccatgatgatgatgtaatgcatgtaattaataatgacaatcaagtcaataaacacacatgcaatttatatatgatatgttcatcataaaaaaaaaaaaaaa

SEQ ID NO: 3627 - DNA, 985 bp, Zea mays
  misc_feature (984)..(984): n is a, c, g, or t
gcaaatacaacacgacgcgagcaccctgagtaatgcttgagatcgatcagcacgtagtatttccatgcatgcatggcagcaccgcaagatgccgtgtctacccctatatattagctagatacacatgcacgtacgtattatacatctaatacgcacacgcactcgataatgttttccacgacatcgacaccgcaccgggtatcgctagttagactattattagctactgatcacctcttccaggagcttgtacctccggaccttcggcctgccacgcgcgacgccgggcgacggcggcgcgttgtggtcggtaggaacgcggctgccaaggtccgacgccgaccgccgcagcaggatccgctgcgcatgctgcttcttgacaggcttgctcaggttggaagacgcaaagtcgccacgagcggcaaccttgggcgatcttccgctgccgatcgtgtcaccaccgtgagatggcggccgggcagccgctttgccagcggatctcggcgagttagaagtagaagccacgcgcccatccgccctgaggcaccagttgcaggtgccgtacgactccgccttcgggtacctatccgtgcagtatgtgtgctgggagcggacggagcaggcggagcagcggaagagctcggacaggacgccgcggtcgccgcacatgcagcagacgacggcgccgcccggcggcggggcgctcccgccggcagcggcgcctggcggggacgatgccttgccgctccccatggagcaaccgagatctcagaagacggatgcgtggggcatccgtaggtgccgcatgcgatcgatcggccggatcgagcccagcagcgtggctatctaccgacgatggggttggttgtttagctggctgcttgattcctcgtcgctcctcctgggtgatgagactgggggtggatgtcctgtggggagggcgtggctggacgttgcaggaattgatgaaggtgggtggttttnt

SEQ ID NO: 3628 - DNA, 1572 bp, Zea mays
  misc_feature (1550)..(1550): n is a, c, g, or t
ggccgtcaaataatgagtttcgaaagcgatcccacgcgcccgcccacgcccccccgcacgcccaggaggtggacctaccaatcatcactgtccctgttctcttccagcggcgcgggggatagctcgccggagtccggagtcgccgctgccggtccacagccccaccgtctgcttcacctcgcccgtcatgtctgctgccgcagcagctgcagctgccgctcggtgcgtccctctccgggtgtcctcgccggagaccgcgaagtccgccgcttccattcccacctcctcggccgcctctgcgtctgctcccctccgcgccgccgtcgccgcgggacccggccgccggcttccggcgccgccgttccggtgctcctcatcgtcgccggagaactctgccccgcgcgatcttggattgcttctggaggtggaaggagttcttgcagatgtctaccgttttggcaatcgccaagctttcaatgtagcatttcgaagcctcggactagattgtgcaaattggacagagccaatatatgctgatttggtgaggaaagcttgtggtgatgaggaaaggatgctggcattattctttgacaggattggctggcctacatctttgccaactagtgagaaaggatcatttataaaaagtgttcttcgtgagaagctgaaagccttggaagaattctcagcttctgatagcttaccactacggcctggagtggaaaagttcattgacgatgcacttggtgaagctgttcctttggccatattggctgcatatgggagaaatggagaaaagatttcaagatctatagctatgaagttaggccccgaaagaatctcaaaaataaagattgttggaaacgttgaggttgaagaaagcttttatgggcaacttgttcttggtaaaggagccacgtccggtttggatgagcaacttgtcagggaagcccagaaggctgcttctgcagagaagcagaggattgcagaaaaggttgcatcgatcctaaaacttagtgttgacatcacagcatccgaaagctctgacaaggtaatagctgccctccgagctggttcagaatacgttgggtgcgacgtgcaaaactgcatccttgttgcgggcagccaatctggtgtccttgcagccgaacgcattggcatgccatgcatagttgttcgaagcagctttaccgcaagagccgaatttcactccgcgaaggccgttatggatgggttcggcgacacagacttgaccgtttcgaaactgctgagcaaaaagtggttttgattgtctgtcacctgtggaaacgaagggttggattggaggctgttgtgatttatgaacctgtaaatgattcagtgctaaccggagcaaacctttgtataaacaagaggtgttgctgatgaaagttaatgagtgacaaactgaaagaataacttcaggtggcgccatcgtgtgcttctggttatcagtaatctgcctctatcaagtgtcatgcatgtttgatgtggaggcaatgaataaataggtaaacagttcctctacacantaatatggagcttttgcttccc

SEQ ID NO: 3629 - DNA, 1482 bp, Zea mays
ggtaaccactgaagagcggctcgccacgcgggcacgcggccgacacaggatcagagccgtcttggccgcgtcgcctccgtggcgaacgggcgcgtgtggcgccacgccacgccataccgctgccacccaccgcaatccaagcaagcagccccgctatgtcggtcgctgtgctgcgagtgcgagccatggagctactggcacgacccgcagcggcagcgtcgtcctcctgcgcgcgaccctcgctacagctccccgccccgggcacatcccgtccccgtcggcccgggttccctactctccgcgcagctgcggcggcagcggcggcgatcgccgcggagccgcaatcgaacgagcagcagaatatcattatggaaactgaggtgtttgcctgccctgtctgctacgagccattgatgagaaaagggccaccaggcataaacttgccagcaatttataggtcgggattcaagtgttcaaagtgcaacaagtcatttaccagcaaagacatcttcctggacctcactgtaactgcagggacaaaagaatatagcgaacagaagcccgctagaactgagctgttcaggagtccacttgtctcatttctttatgagagagggtggcgacaaaactttaatcggagtggtttccctggtcttgacgaagagtttcaaatggctcaagactattttcaacccattgctggtggtatccttcttgatgtcagctgtggcagtggcttgtttactaggaagtttgcaaagtctgggacatactcagctgtgatcgctttggacttctctgagaatatgctccgccaatgctatgaattcattaagcaagatgattctctcctcaatgcgaatctcgcactcgtgagagcagatatttcgaggctcccttttgcttcttgttcagtagatgccattcatgctggagcggctatccattgttggccctcaccctctaatgcggtagctgaaataagccgcgtcctgaggcctggtggagtgtttgtgggaaccaccttcttatcctctcccaggaacaacccattctctgttgaagcactaaggccacttagacagattgttggaccagttaacaccagctacaactattttactgaaggagagctagaagacttgtgcaaatcctgtggccttgtcaactacagcagcaatgttcagaggtcatttatcatgttctccgggcaaaagccgtactgaagaatcctgtcaaatccaagctctgttgtttcttcaggattccttgcaaaacacgtttacaagtatttgcatatatttgtgccatactgtgcataggttccttaatttctgtactattcctgaatgtattcagtacaacaacaaaaaatgcatgctgcagactctcagaaaagccctacgtttctgtgaatcagcacactgtttgttgtgcttcgttgggctacaagcctaaaagcctagaataatgcttgaattc

SEQ ID NO: 3630 - DNA, 760 bp, Zea mays
  misc_feature (33)..(34): n is a, c, g, or t
cctcgaggccggccgggtctcggcaggtaggtnncggtcgttcggtttgtgtacaagtgcacagtgccaatgcaaaaaattagctaagcttgtggtatgcggtagagctgcaagttccgtatccagtccagtccagtgaggggaattgctttggatggtgcagggcagatggaggggctgacgtccagtgagatcgccggattcgtggtgggtgccctgctgctcggcgccaccatcgctgcccccaaggtcgacggcttcatcgcctcctcccagagaaggtcactagggatgtgtaagaggtgcggtgaccttcggattgtagcatgctcgcagtgcaagggaacaggatcagctcggagcggagggatgctcagtttgggcgtgctggatgacctctacgagtctcttggagccgaagccaagactgagaatctggttccctgcacaaagtgcaggtcgagaggccgtctcatgtgtccagaatgctccaaggtcgcatgaccctggcctggagccgtgtactcggtcagaacacatgtacggctctgacaaacacaaatcactgctgtcactgtttgtgtttgaacattattatgtgcatggaattcctgacccgactactggtggttagggatggtccactgtctcaatgcagttgttttcagtgctttaaaaaaaaaaaaaaagcgcttgttcttttttattctctcgtctaataaaaattatggtaaatccattgttaaaaaaaaaaaaaaaa

SEQ ID NO: 3631 - DNA, 726 bp, Zea mays
gccggccgggtccggactcggcaggtaggtctgcggcgctcggggtgtactcgtgcacagtgccaatgcaaaaaattagcattgctttggatggtatgcggtagagctgcaagttccgtatccagtccagtccagtgaggggaattgctttggatggtgcagggcagatggaggggctgacgtccagtgagatcgccggattcgtggtgggtgccctgctgctcggcgccaccatcgctgcccccaaggtcgacggcttcatcgcctcctcccagagaaggtcactagggatgtgtaagaggtgcggtgaccttcggattgtagcatgctcgcagtgcaaaggaacaggatcagctcggagcggagggatgctcagtttgggaatgctggatgacctctacgagtctcttggagccgaagccaagactgagaatctggttccctgcacaaagtgcaggtcgagaggccgtctcctgtgtccagaatgctccaaggtcgcatgaccctggaaccaaggccgtctcctgtgtccagaatactctcaatgcagttgttctcagtgcttttggttgggctggttgggtgttttgtatcttgttcttttttattctctcgtctaataaaaattatggtaaatatattgtcatccttccccaaaaagtaaagtatcccaatgcaatctcacctcaacttgcaactcgcgcccctacagatgatagaacaaaa

SEQ ID NO: 3632 - DNA, 1753 bp, Zea mays
  misc_feature (816)..(816): n is a, c, g, or t
cattgggaccctcgaggccggccgggactaaccatcgccatccgctgtctgttcaactacattacgccagcggcagcgggaagggcaggaccagcggcagcgtcgacctggtggtggtgcgcttcgggttcggcgaagggcgacatggagagcacgctcaaggggatacgcggcagcgatgcgccgtgcgttctggacctgggcgacgcggccaccgtggcgggcggcgtcgaggacacctacggcgaggatcgcgccaccgaggagcagctcgtcacgccctggaccgtctccgtcgccagcggttacaatctgcttagggatccccggtgcaacaggggacttgcgttcacagagagggaacgtgagacgcactacctccgtggccttctgccaccagctattgtatcccaggagctccaggagagaaagatcatgaataatattcgacaataccagttgcctttgcagcgctacatggcactcatggatctccaggaagggaacgagaggcttttctacaagttgctcattgacaacgtcgaggagttacttccaatcgtgtacactccaaccgttggcgaggcctgccaaaagggaaagatccttgaggtgttgaagaactggccagagaggcgctttctggttatagtcgttactgatggtgaacggattggggggcttggagatctcggatgccaggggatggggattcctgttggtaaactttccctttacactgccctgggaggagttcgtccatctgctggcttgccgatcacattgcacgttggtacaaataacgaggaactgctntaatggacgaattttacattggcttgagacatgagcataaaccactcagcaacctcttagatgctgttaatgctatcaaaccaacagtgttgattggcacatccgggaaggggcaaactttcccaaaagacgttggtgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgatgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatacaactcggttcagtctttcatactgtaataccctaagctctctagcaaaagctgtttcacgtcctcttctgcccctacatattccgcagtgtttatctcttgcgatgtcatgtaaatcagctccggttaggcttttggatgctagtcagtcatggtgctgctgccgtccttccggacaaggataaatttggaataaagtttgagtcgacgattcctcccaaaaaaaaagcggccaaaagcggcc

SEQ ID NO: 3633 - DNA, 2334 bp, Zea mays
  misc_feature (2321)..(2324): n is a, c, g, or t
caatcgcgcgggcgcagacagtcggcttccaccaaccacgttgccagcaggcagcggcagcctccacttgctccatgtctccatccaaccctcttccgccgccgggcgagacgcgcgtcggctgctcgttgccctcaccagtcacccctctaggccggccgcccagtgcgccggggcccgccgggccggcactaaccacgccatcacttctgttaactacattcgcagcggcagcgggagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttagggatccccgttacaacaagggacttgcgttcacagagagggaacgtgagacgcactacctccgtggccttctgccaccagctattgtatcccaggagctccaggagagaaagatcatgaataatattcgacaataccagttgcctttgcagcgctacatggcactcatggatctccaggaagggaacgagaggcttttctacaagttgctcattgacaacgtcgaggagttacttccaatcgtgtacactccaaccgttggcgaggcctgccaaaagtatggatccatatttagtcgccctcagggtctttatattagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttctgcaagaatttatgactgctgtgaaacaaaactatggggagaaagttcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatagctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgacgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctcggccaaaggacctggtgaaatatgcagagagttgcatgtacagccccatctaccgcaactaccgttgaattcggatcaactccagttatgtgcaaatcagcagcagctattccgcagcgtttatctcttgcgatgtcatgtaaatcagctccggttagccttttggatgctagtcagtcatggtgctggtgccgtccttccggacaaggataaatttggaataaagtttgagtcgacgattcctccctaaaaaaaaaaaaaaaaaaactcggggggggggccgggcccccattccgcctatgagggnnnntaaacacaca

SEQ ID NO: 3634 - DNA, 2533 bp, Zea mays
agaagatggaatcttctagagaatggtgaaaaatggaatttagaggtatataaagagaatccctccggttaatcattgatcacccaagccagtggagccttggcctcgaacagaatagaaccaaccaatcgcgcgggcgcacacagtcggcttccaccaaccacgttgccagcaggcagcggcagcctccacttgctccatgtctccatccaaccctcttccgccgccgggcgagacgcgcgtcggctgctcgttgccctcaccagtcacccctcaggccatgggcgggggccccgctcgtcatgtggccatgcgcgcccttcgcgctcgcttcctctcgcggcagcgggagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttagggatccccgttacaacaagggacttgcgttcacagagagggaacgtgagacgcactacctccgtggccttctgccaccagctattgtatcccaggagctccaggaaagaaagatcatgaataatattcgacaataccagttgcctttgcagcgctacatggcactcatggatctccaggaagggaacgagaggcttttctacaagttgctcattgacaacgtcgaggagttacttccaatcgtgtacactccaaccgttggcgaggcctgccaaaagtatggatccatatttagtcgccctcagggtctttatatcagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttctgcaagaatttatgagtgctgtgaaacaaaactatggggagaaagtgcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgatgacatgcttctggcagcatcggaggctctggcccagcaggtcacagaagaaaattttgagaaggggctgatttatcctcccttctcaaacataaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatataactcgtttcagtctttcatactgtaataccctaagccctctagcaatagctgtttcacgtccttttctgcccctacatattccgcagcgtttatctcttgcgatgtcatgtaaatcagctccggttaggcttttggatgctagtcagtcatggtgctgctgccgtccttccggttccggacaaggataaatttggaataaagtttgagtcgacgattcctcctcaaaaaaaaaaaaaaaaaaaaaacaaaaaaaagcaaagctaccc

SEQ ID NO: 3635 - DNA, 2860 bp, Zea mays
atttccggtccaccatcagcagacttgcgtcgtcgcggagggctcgcgtcggggtccatctgaacatccgccagaccgccgccaccatgccgcaacctaccgccgattcgagcaccatggtcgccggcgagcatcagcaacaacagcaacctgccaccgcgcggatctcctcctcctcaaccagctccggaaggctcgtcactccgttctggaaagtatgagagggacgcgaggaggtactgggacatcttctacaggcgccacgaggacaagttcttcaaggatcgacactacctggataaagaatgggggaaatactttaagggacgagatggagaaaagaaggtggttctagaggttggttgtggagctgggaacacaatctatccattgctttctacatacccagatatttttgtccacgcctgcgatttttctccacgagctgtcaatttggtcaagaaacacaaggacttcaaagctgaccggataaatgcatttgtttgtgatattgcatcagaacaactaaccgagaatgtggaaccttcttctgctgacattgtaacgatgatctttatgctctctgcagttgcaccagataaaatgcctatagttctggagaatgttagaagtgtcttaaaacatggtggccgtgttctttttcgggactatgcctttggtgatcctgcacaggaaagactgatgtcaaagggccaacaaataagtgagaacttctatgtcagaggtgatggtacccgggcatattacttttcaaatgaatatctggtagatttattttcaaaatgtggacttactcttgaggagatatgtgtgcacaacaagcaagttgaaaaccgttcactggagctggtgatgaacaggaattggatccaagctactttcaccctaaattcagctagtcctcaaggtccaaatggtcaacacgatctccttgcttacgaaggagaggatgataaggtagttactgacacatctaagaagaaaagcagcggtgaagaaatcgatctttctgaagatttttgcaacatgtttgggacatcacacagccttgatgaggtacaaatcattggggtgaaagcaaaaggccacgacttcaaaataagaatgctcaggaaggaataccagcacacctgcagatcaactggcttaatgctctgggaatctgctcaattcatgtgctgtcttttagcagagaacccttcgatcgttgcaagcaaaagggtcctggagttgggctgtggctcagctggcatctgctcgatggttgctgcaagtttcactcccgtttgttttagctacagatggggatgaagaatcactggacctccttagacaaaatatctcctcgaacatggagcctaatttgctgagcagaatcatggttaggaagttattctggggcaacgaagatgatatgaaggcagtccgagagcttcatggtaacggcgcgggttttgattgcataataggcaccgacgtgacatacaatcctgatgctatactccctctcttcaagactgctaggggagtgatttctgagaaagctaacgaggactcggtccctgctctcattctttgctacatccagcgacgagttgatgaggactccatcctttctaatgcaacgtcccagggtttcaggcttgtggacaaatggataaatggagttcacgagagtaacggtaccatcagttcttggttctctggtaatgatgtctgcagtgctttccggcatacagtactttcagtattgtacttcgagctgtgaatgctgctatgcatgtgcaaggttactgtgtaacctgaaggatttttgtagcagctgtatcaagcaacggcaaaccaactttgaatctttaggccttgtttggtgatttcaattttatgtgtatcggactgtactggaatggattgagatggattttgacttctatggatttaaattgacttagtgccatccaatccatatggattaacggtgaaacgaataagcccttactgtgtttttttatatttgtggttgctgggcaatgtacattagctaaatttactaatttagctactctttaaagtagatttcataaaaaaagagtagactagtccaatagacttgtagttttagaactctgccagtaaaacagtctacctaaaaataagtggaggtgtagccgtgtaggggatggaggagcactaagtttggagagccatttacaaagtctcctaataatagccaaatttaccttcacaaaatgatttggtagtcttttgaagtccctcttagggtctttttgatacatgagttaaactgttaaagtgttgagcaccaaaagtggtggacggtccggcccttgggcccggacagtccgtgtgccccgcgattagattaactcgggtgattatccttatctcgtgcgtggttatccatctaatcacgtcgaagttgttggctatctcctaggaataggtccagacctcctcccctataaatataaagggatacgaccgattgagaacccctgaacatatttcaatcgaaccaattactttatttactttttcttcatcatatctgtcatagaaataagtgtagcctagccttagttgtatctttccgcatcacctccacccatattcgactttacgtcgtctagctccatcttgggtgtcttgccgaccccaagacgaatgatcttacctcctaggggcaagatctagttgtccattcaagatacggtatctcgactgtctcttaattcataggcgactccacattatctggggacgcccgggtgacctgtggactcgtagcactctaagatctctccacaggaggcgcaag

SEQ ID NO: 3636 - DNA, 880 bp, Zea mays
aagcaagatggctgatttgaagagtggaagagataaagattgatttatttttcttcgtcttctgattttcacaatagcccaggttcaactgacggcttgaaccgtggtcgcattgcattgcagatagtacagcctgccgctgccaagtacagttatgcattccaagtccccagagaagcaatcacttctggacgagggatcgaggagaaacccagcaaataatgggagtacggaggatgaaaagggagacggcgggatcccatggctgacatttctggggttcgtgttcctgaccttcaactcgggcatggcgatctaccgctcggaccgcgaccccgggtcaatagcgttcgtgtcgggctcgtacgtcgacctgctgctgctcttcctctgccttcgcctgttcgagcggacgccgcctgactcgccgcgccgggggtggatcaaggcctgcgtctgggggctgaccacgctgctcaccgtcatgttctcgcagaaggtggccgccatcatgccgccgctgctggcgctcgtcgtgtgggcgatggcgttcgccaccatcggcggtggcttctacgcgttcttcatccacaaggacaaggccgcccttgtggaggcggagaacccgtagatgtctctgccgctgccatgcgctcgtggctgtttcagactatctccagccccggtcctatgattttgaggcctctagtcgaactgatcatggtggaccctctagactataaaaaaaattctatattatacaatagagcatattaatacttcgtaaataaatgatcatgtatattgaaattggttttttaaaaatctaagaagctagataatatacatcggtacaaaaaaaaaaaaaaaaaaaaaaaaa

SEQ ID NO: 3637 - DNA, 890 bp, Zea mays
ctgggccagagtctcgaagtctatctactctgttataagatgtcacaccaccgccgggccggccggggtgccgcagaacggaccaccaggttggcgttgctggaagagaaggagctgtcggcggtgcttaaaacctgtgctctacctactggcgtagccaggaagatagtacagcctgccgctgccaagtacagttatgcattccaagtccccagagaagcaatcacttctgggatcgaggagaaacccagcaaataatgggagtacggaggatgaaaagggagacggcgggatcccatggctgacatttctggggttcgtgttcctgaccttcaactcgggcatggcgatctaccgctcggaccgcgaccccgggtcaatagcgttcgtgtcgggctcgtacgtcgacctgctgctgctcttcctctgccttcgcctgttcgagcggacgccgcctgactcgccgcgccgggggtggatcaaggcctgcgtctgggggctgaccacgctgctcaccgtcatgttctcgcagaaggtggccgccatcatgccgccgctgctggcgctcgtcgtgtgggcgatggcgttcgccaccatcggcggtggcttctacgcgttcttcatccacaaggacaaggccgcccttgtggaggcggagaacccgtagatgtctctgccgctgccatgcgctcgtggctgtttcagactatctccagccccggtcctatgattttgaggcctctagtcgaactgatcatggtggaccctctagactataaaaaaaattctatattatacaatagagcatattaatacttcgtaaataaatgatcatgtatattgaaattggttttttaaaattcgcggccgctagtttttttttttttttt

SEQ ID NO: 3638 - DNA, 857 bp, Zea mays
  misc_feature (716)..(716): n is a, c, g, or t
  misc_feature (741)..(741): n is a, c, g, or t
  misc_feature (808)..(808): n is a, c, g, or t
actcctatgggcgattgggttcctcgtgcccggccgggagagtcgcgaagtctatctactctgttataagatgtcacaagatgtgcgcgcaccgcgttgtgccgcagaacggaccaccaggttggcgttgctggaagagaaggagctgtcggcggtgcttaaaacctgtgctctacctactggcgtagccaggaagatagtacagcctgccgctgccaagtacagttatgcattccaagtccccagagaagcaatcacttctggacgagggatcgaggagaaacccagcaaataatgggagtacggaggatgaaaagggagacggcgggatcccatggctgacatttctggggttcgtgttcctgaccttcaactcgggcatggcgatctaccgctcggaccgcgaccccgggtcaatagcgttcgtgtcgggctcgtacgtcgacctgctgctgctcttcctctgccttcgcctgttcgagcggacgccgcctgactcgccgcgccgggggtggatcaaggcctgcgtctgggggctgaccacgctgctcaccgtcatgttctcgcagaaggtggccgccatcatgccgccgctgctggcgctcgtcgtgtgggcgatggcgttcgccaccatcggcggtggcttctacgcgttcttcatccacaaggacaaggccgcccccttgtggaggcggagaaaaccccgtagatgtctnctgccgctgccatgcggctcgtggnctggttcagactatctccagcccgggtcctatgattttgaggcctctagtcgacctgatcatggtgnacctctagactataaaaaaatctatattatacatagagcatattatact

SEQ ID NO: 3639 - DNA, 840 bp, Zea mays
ccggccggggagagtctcgaagtctatctattgtcctcgaggccgcccggggtgcgcccccgcgttgtgccgcagaacggaccaccaggttggcgttgcaggaagagaaggagctgtcggcggtgcttaagacctgtgctctacctactggcgtagccaggaagatagtacagcctgccgctgccaagtacagttatgcattccaagtccccagagaagcaatcacttctggacgaggagggatcgaggagaaacccagcaaataatgggagtacggaggatgaaaagggagacggcgggatcccatggctgacatttctggggttcgtgttcctgaccttcaactcgggcatggcgatctaccgctcggaccgcgaccccgggtcgatagcgttcgtgtcgggctcgtacgtcgacctgctgctgctcttcctctgccttcgcctgttcgagcggacgccgcctgactcgccgcgccgggggtggatcaaggcctgcgtctgggggctgaccacgctgctcaccgtcatgttctcgcagaaggtggccgccatcatgccgccgctgctggcgctcgtcgtgtgggcgatggcgttcgccaccatcggcggcggcttctacgcgttcttcatccacaaggacaaggccgcccttgtggaggcggagaacccgtagatgtctctgccgctgccatgcgctcgtggctgtttcagactatctccagccccggtcctatgattttgaggcctctagtcgaactgatcatggtgggccctctagactataaaaaaaagtctatgttataccatagagccttttaaatacttcgtaaaagcgggc

SEQ ID NO: 3640 - DNA, 2327 bp, Zea mays
ccgcccgcccccgctggccgctgctctcttcctccctcctcctcggtccactccaaccccaggcctgccgcggccacagacgggccgcgccgccgccgcagcttccgattccgcttccgccggccgttctgccgcgcgcgcgcctgtggcgcttgagcgggcggatttgttcggcccgttctttggccgccgccgttgcgctgcgccgtgttggcttccaggtgcgcaatccggtcccgtgctctgttcgtgagctgaggatttgggtagtccgccaccctggatcctgatggggccgttcctgtgcagttcccatccaggcgtcttgagattccccggccggagatctgcttaattcgtacctctctctggttctgaggcccctccgaggtggaggaggagctcgtgggtcgacgaaagaacaatcgtttctttgcccactcctgcggctgcttctccgtcccaggctttccagccatggaggaggtggaggtggccaacatggccgcggtggagagctgccaccgggtgctggctctgctctcgcagcagcaggacccagccctgctcaagagcgtagcttcagagacggctgaagcctgcgccaagttcaggaaggtagcggccctcctcggcagtgccagtggcggaggtggctgtggccatgctagaggcaggttctccagacgagtccggcctctggggctcgtcaaccagaagagccccttggggatcgccaccggcagcggcaacccgctggagatgatgcccagcacagctgctgctgctgggtctccatctccacctcagtcgactagctatgcgcaaatgcgcgctcggcttagcagtgcgccagagtcctcacgagggctggatttggcctgctccagcagcaggtgtagccctcatccatttggagcccccaagctggtccagccactgtctgtgcagttccagattgggagtgttgcgcataggtacccgttccaccagcagcagtcgaggcagaagctgcaggccgagatgttcaggaggagcaacagtgggatcagcctcaagttcgatagccctagccccagcggtggtgctgctggcaccatgtcgtctgcgagatcattcatgtcgtcgttgagtatagacaggagcatggcgagcttggatgggaagcggccgttccatttggtaggcaccccggtggcgagcgacccagcagatgcgcaccgtgcgcccaaacggcgatgcacgggtagaggggaggatggaagaggcaagtgtgccaccactggcagatgccattgctcaaagagaaggaaactgcggattaagaggtccattagagtgccagccattagcaacaaaatcgctgatatccctcctgatgagtactcgtggcgcaagtacgggcagaagccaattacggctcgcccacacccgaggggttactacaaatgcagcagcgtcaggggctgcccagcaaggaagcacgtcgagcgatgtgtagacgacccggcgatgctaatcgtgacatacgaaggcgagcacagccacacccagctgccagcacagcctgcccagacctagaagatcagtaaatcgtcgctccattctggaagcgcggggagcatgcctttgcacctagatggtcatgtagaatctcaggccttcgattttcgattgcagcagcagcaatgaccatggagagaatcttatgagctgcttggcccccctcctgagtcactctgttacagatgcaagagtggggactgctgccaagttgttcatctttcttgtgagctgtggcatgtatgtataattgaaagatggtgcaggaaggaaggaaaatgcagcgtccgacagcgaccggtgagctttgccggtgagcctgaagggttgaaagcaaagactgacaagaggaagtgaacaaccgcgcattgttgtgagggtggattaggatgggaagatttggcttttagcgtgcacaagttcacttgccatggactagcctctgtatgttgcttttgctttttctgaaatatcgcatcacctcttttgttgacaaaataaaaaagggtggggttgcatcccagtatcaaaggagggagctccgtactgaccccgctgcaagttaggaccatctgggttttccaggtgtaagcattccagaagggaaggtgcaaagctgttgttggtgtgatttgccacccccagtactgttgctcttgtgtaaagcattctgtgtaattaatgatttgtgccatctgcaatcttgaggatgaatggatgctctaactgaaacataaaaaaaaggctaaagattatttattttg

SEQ ID NO: 3641 - DNA, 1651 bp, Zea mays
agttaggactacctccacaaattgagcatcggttaccccattgcatcgtcctcttcggcggcgctggcgcccacaccaccgaaccctcttccagcttccttccacccgagcacgccggtcacccatcatcgccgaagccctccccctcctgcttcagctgtgctggtattagattagatcaaagtggaccgcgtcgggttgggtccagtcctttcgctgcggtgcggaaggcaatggtggggttgggatggagagtcggctcaaaggtgcagagatggggccggagctgcctccggggtttctcttctgctgcagttccgtctcagctggagaatgtcggattcatcggacttgggaacatgggttcccatatggcaaggaacttatcacggctggatataaagtgactgttcatgatataaatgaaaattctatgaagaaattctcagaggatggaatccctacaaaacagtctccacttgaagtatcagaatcgagtgatgtcataattaccatgcttccttcatctactcatgttttagaagtatacaatggacccaatggcttgctttgtcggggcgaacgcttgggcccatggttatacatagattcatcaacagttgatccacaaacatcaagaaagatatcgacagccatctcaagatgccttttaaaagaaaagaaaggttacgctgaaagccctaagattctggatgctccggtgtctggaggtgttcctgctgcagaagctggcaagctaactttcatggtgggtggtcttgaggaagcgtatttagcagccaagcccttacttcaagcaatgggggaaaaaacaatctactgtggtggtgctggaaatggctcggctgcaaagatatgtaacaacatggcaatggcaatcagcatgcttggggtctccgaggcctttgctcttggccagaaccttgggatcaaagcaactactctcacagacattttcaactgttcaagcgctcgctgctggagtagcgatacatataatccagttcctggagttatggaaggtgtaccatcatcaaggaactatagtggtggtttcacttccaaattaatggccaaagatttggatttggccatggcttctgcatctggagttggcttcaaatgccccatgagttccaatgcacttgaaatttaccgaaaactatgcgaggatggttgtgaactcaaagacttctcgtgtgcattccgacattactattctggcaagaatgaagagtgatcttggatacgctgcaaaatttcctcctttcgaaatcaataaaacagcaaataaagttaggacctgattatgtcccatgaattgaaacattgaaaccaatatctagaaagtgtgtttccttgtttcattattagattactttctaattggtctaaattcctggaaccgaacaggaccttattggaaagtttacagtataagctgtgtagcattgtaccagagtccagagacatggtggttgtttgttgaccagtggtgatgatctgatcatctggttaaaactgttattggttttgcttctaggcaatcaagtgatactgttcttggacagattcaaagaaaaaaaaaaaaaaaaaaaaaaaaactcgagcccggaggaattaaaaactc

SEQ ID NO: 3642 - DNA, 1831 bp, Zea mays
  misc_feature (11)..(11): n is a, c, g, or t
  misc_feature (39)..(39): n is a, c, g, or t
cctcgaggccnggccggaaaaaaaaattttccaaaaaanaaaaaaaaaaaaaaaatgcttcctgattgcgtgtgttagtgcgccacggatgctgaaagcctgaaactgctcaagtagcgcgcaacgacaagagcaacgaggaacatcagttaggactacctccacaaattgagcatcggttaccccattccatcgtcctcttcggcggcgctggcgcccacaccaccgaaccctcttccagcttccttccacccgagcacgccggtcacccatcatcgccgaagccctccccctcctgcttcagctgtgctggtattagattagatcaaagtggaccgcgtcgggttgggtccagtcctttcgctgattgcggttgcagattcctctcctgcgaggcacgagctgagtcctatccctatccgcccttgttgcagcggtgcggaaggcaatggtggggttgggatggagagtcggctcaaaggtgcagagatggggccggagctgcctccggggtttctcttctgctgcagttccgtctcagctggagaatgtcggattcatcggacttgggaacatgggttcccatatggcaaggaacttgatcacggctggatataaagtgactgttcatgatataaatgaaaattctatgaagaaattctcagaggatggaatccctacaaaacagtctccacttgaagtatcagaatcgagtgatgttataattaccatgcttccttcatctactcatgttttagaagtatacaatggacccaatggcttgctttgtcggggcgaacgcttgggcccatggttatacatagattcatcaacagttgatccacaaacatcaagaaagatatcgacagccatctcaagatgccttttaaaagaaaagaaaggttacgctgaaagccctaagattctggatgctccggtgtctggaggtgttcctgctgcagaagctggcaagctaactttcatggtgggtggtcttgaggaagcgtatttagcagccaagcccttacttcaagcaatgggggaaaaaaagacaattctactgtggtggtgctggaaatggctcggctgcaaagatatgtaccaacatggcaatggcaatcagcatgcttggggtctccgaggcctttgttcttggccagaaccttgggatcaaagcaaccactctcacagacattttcaactgttcaagcgctcgctgctggagtagcgatacatataatccagttcctggagttatggaaggtgtaccatcatcaaggaactatagtggtggtttcacttccaaactaatggccaaagatttggatttggccatggcttctgcatctggagttggcttcaaatgccctatgggttccaatgcacttgaaatttaccgaaaactatgcgaggatggttgtgaactcaaagacttctcgtgcgcattccgacattactattctggcaagaatgaagagtgatcttggagttacgctgcaaaatttcctcctttcgaaatcaataaaacaacaaataaagttaggacctgtttatatcccatgaattgaaaccaatatctagaaagtgtgtttccttgtttcattattagattactttctaattggtctaaattcctggaatcgaacaggaccttggaaagtttacagtgtaagctgtgtagcattgtaccagagacatggtggttgtttgttgaccagtggtgctgatctgatcatctgtttaaaactgttaaaaaaaaaaaaaaaaaaaaaaaaaaaaaaaaaaaaaaaaaaaaaaaaaaaaaaaaaaaaaaggggcgggccgttttaaa

SEQ ID NO: 3643 - DNA, 777 bp, Zea mays
ctcgaggccggccgggatgccttccccaccgcgaggccagccgcggaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcgcggtcggggtcggggacgttgagcatgctagctgcttttggaaattgcattgcgtgcatctgcagtgtaatctacattcctatcaattgtacgaagtatgcctttgattatgcaaccatgtatcaattgtttttttttgccgtggatttatgttgatgaggttaccatgtgatcatatgttctttccctagaacttttaagaacaattaaatactatctttaagacttctctagacaaaaaaaaaaaaaagcgtgcggcccactttagatatacaacgtacaattatgtatctatttagatatacattatatattgatgcagagtaccaaaaaaaaaaaaaaaaagcggcc

SEQ ID NO: 3644 - DNA, 1501 bp, Zea mays
agtcgacgcttcaccgccaactttcagtccctctccaacaaacccgcacaaccagaggacctcaaatccatcaagcgccggggggacaaaactcttcggttgtacctcaaaaggttccagaccatgagaaatcgtatccccgaggtcacggaggcggccgtgatcgaggacttctacagaggatccaacgactcggctttcgtccgagccatattacagaaggcaccgactacctccgagcaactgttccgggaagccgacctctacatcaccgccgacgagcgagctcaggacctcatcggaggagcgaagcctgcaccagctgcaccgcgacgcgatacgaaccagcagcccgacaaacgctgggagaagaggcctcgcgaagaagttcacgccgccggaccacccgcctctcgcgcccgggggggacctcgtggaggcgaacgcacgctggacgacatcctcgacgcccagggcccccgccacaaggacatgcgccacacccttcggaactgcagagacttcaagcactccgtcggacaaggccggcccttccaacctctacctcctcctccgccgcggggaggaccaggagaaccgcaacaacctcagcaacaggaggagggaggaggtggagccttcccgtgcgttgacagagaggtcaacatcatcttcggcggacacggatcgcaggagaacagaagacaacaaaagctcaaagatcgccagatattggtggcgaccaccggtcctcccgctctgtaccgatggtcggagcacctgatcaccttcactcgggcagatcaatggctcaacttcgaccacccaggcaaatacccgctcctcgtcgatccggtgatttgagagagcagggtgaagaaggtattagtggacggggggagcagcatcaacgtcaccttcccccggacactccaaggcttgggagttcacctcaaagagctccacgagtcagacactcctttcttcggcatcgtgccgactgaaggagaatacccgctgggccacatctacatgccggtcaccttcggaactccggagaactacagaaccgagttcctgaggttcgaagtggcaaacttcgactgcgggtacaacgccatcatcgggaggcctggattggcgaaattcatggccattccgcattacacatacatgatattgaagatgccagggccgcaagggatcataactgtgcgcgctgacttccaaggcgccgcagaatgtttccgagtggccatccaggcggccctcaccaccaaaccatcggcgacttcttctgtacaggcaaactctaagcctgaggaagacctcgcggcgcctgcgcgacgaagctcaagccgcaacctctatgcggccgactgaagaaaccaaaaggatcaaccttgggttcgctgatgaacgcaagactgccatcatcagctccagcctggatgacaaatgggaaggcgcgctcgtccagtttctgcaagataaccaagac

SEQ ID NO: 3645 - DNA, 1237 bp, Zea mays
attggcaaaattcatggccattctgcattacacgtacatgatattgaagatgccagggccgcaaggaatcataactgtgcgcgctgacttccaaggcgccgcagaatgtttccgagtggccatccaggcggccctctccaccaaaccatcggcaacttcttcggtacaggcaaactctaagcctgaggaagaccttgcagtacctgcaaatgaagctcaagccgcgacctctatgcggccgactgaagaaaccaaaaggatcaacctcgggttcgctgatgaacgcaagaccgccatcatcagttccagcctggatgacaaataggaaagcgcgctcgtccagttcctgcaagataaccgagacgtattcgcatggcaacctgcggatatgccgggagtcccgagagaactggccgagcacaaattgaaagtctatccccaggcgaggccgattcggcaaaaattacgtcgtttcacgcccgacaagagagaggccattcgcgctgagctggctcgcttggtcgcggctggatttattagagaggtgttacatcccgagtggttagccaaccctgttcttgtactcaaaaagaataaagtggattggcgcatgtgcgtcgactatacggatctcaacaaacactgtccaaaggatcccttcgggctccctaggatagatcaggtggtagattccaccgctggatgttctgtgctgtctttcttggattgctactccgggtatcatcagattagcttggcaaaagaagacgaggaaaaaacagcgttcatcactccattcggtgctttctgctatacctccatgccgttcggcctcaaaaacgctggagcgacttatcagagagccattcaaacatgcttagccgatcactggggcaagcgtgtggaagcttatgtggatgatgtggtaatcaaaacagaaatttcagaaaatttcattgaagatctacagctggttttcaacagtctacggcgatatcgatggaagcttaatcccgaaaaatgtgtcttcagggtaccggcaggaaagttactcgggtttattgtcagccaccgggggattgaagctaatccagataagatcgaagctatcatgaaaatggaggcgccgcgatcacaaaagaaagttcaaagacttaccggatgtatggcagccctaagcagattcatatccaggctgggaagaaaaggcttaccagtttataagctactccagaag

SEQ ID NO: 3646 - DNA, 2301 bp, Zea mays
cgtaccgggccccccctcgagtagctaatcaccttctgcccatcgctcatcccccgagcaacctacaccacgccatcaacagccgacgagacgcgcggagctccatcaatgcttcgcgcgaccgacggcacgaaagcgagataaggcgccgggaggagtatgaccgggatcatggtgtcccagcttgaagttgcgccacccgagttgagtcggctgcggcctcgaccagtggcccgacccggggacggtcgagacgacacaccaccagctcccctccccgggaccgacctcacgaacgccgacaggaagacacatgcggggtctctgcgcttactccgcgtctccgggccatccagtggccccccaacttcaaagtctcaaacgtcgacaagtacgagcccaagcagcacccagggggctagttggccgtctacacgaccgccgcttcgggtcgctggggcgacggaagacgtaatgacagcgtatttgcccatcgtcctagggcaagacgcactgcagtggcttcgacatctgccacgacactgcatcgacggttggggcgactttagtcggcgtttcatcgccaacttccagtccctctctgacaagccgccgcagcccatggtacctcaaatccatcaggcgccagggcgatgaaacactctggtcatacctccagaggtttcagaccatgaggaaccgcatccccgaagtcgtcaaggcagcgatgattgaagatttctaccgggggatccaatgactccgccttcgtcggagccatactacagaaagcgtccgccacctccgagcaacggtttcgagaggcagacctctacatcaccatagatgagcgggcccaggacctcatcggaggtactaaacccgcaccacccgcaccacgacgcgatacgaaccagcaacctgacaggcgctgggagaagaggcctcgcgaggaggtgcacaccgccggaccacccgtggctcgagcccgaggtgcgccctgcggaggggtacgaacactagataaaatcctcgacgcccagtgcccgtaccacaaggacatgcgccacaccctacggaactgcagggacttcaagcattctgccgggcatggccgaccgttctagcctctaccacctcccccaccgcgaggagggcctggtgaagccaggcagccccagcagcaagaagggggagggggcagagctttcccacgcgttgacagggaggtcaacgtcatcttcggaggacacggagcacaggagaaccagaggcagcaaaaactcaacgaccggcaggtcctgatggccaccaccagtgcccagctccttaccggtagtcggagcatgcaataacctttagccgagctgatcaatggctcaactttgatcatcccggcaagtacccgctcctcgttgatccggtgatccgagagagctgggtgaagaaagtattagtggacgggggaagcagcatcaacatcaccttcccctggactctccaggccctggggttgaactcaaagacctcaccgagtcagatactcccttctttggcatcgtgccgactgaaggggagtaaccgctcgggcacatctacatgtccgtcaccttcgggaccccagagaattacagaactgagttcctgaggttcgaggtggcgcgcttcgactgcgggtacaacgccatcatcggaagaccgggactggcaaagttcatggctattccgcattacccgtacatgatactaaaaatgccaggacctcaaggaatcatcactgtgcgcgctgatttccaaggcgccgcagagtgctttcggggagccattcagacagctctcactgcggggccctcgatagctccccccacacaggcgaacaccaggtcggaggaggagggtctcataatacccactaatgaagttcaagccgtgacctctatacggccgactaaagagactaagaggatcattctgggatttgctgatgagcgcaagaccgccatcatcagttccagccttgatgacaaataggaaagcgcgctcgtccggttcctgcaagataaccgagacgtattcgcatggcaacctgtggatatgctgggggtcccgagagaactgaccgagcacaaattgaaggtatatcctcaagcaagtccgattcgacagaagctgcgtcgtttcacgtccgacaaaagagaagcaattcgcgtcgagttagctcgcttagtgtctgtagggtttattagggaagtactgcaccccgagtggctagcgaatcctgttcttgtactcaaaaagaat

SEQ ID NO: 3647 - DNA, 1840 bp, Zea mays
gcgcgaagctctatcaatgcttcacgcgagcggcggcatgaaaacgaaattcgccgtcgggaggagtacgaccgagatcacggcttcccgactcaaagccaggccaccaggactgagtcggcaacagcttcgactggcggtaccacccggggatggtcgaggaaccaccaccaccactcccctccccgggacaggcgtcgtccccgacgacaggaggacacgtgcggagtatccgctcttaccccgcgcctcagggccatccagtggcctcccaacttcaaggtatccaatgtcgacaaatatgaacctaagcaggatccagggggttggctagccgtctacaccaccgctgctcgggctgccggggcatccgaagacgtcatgaccgcgtatctgcccatcgtccttgggcaagacgcgctgcagtggctacgacatctaccccgacactgcatcgacgactggggagacttcagtcgacgtttcaccgccaacttccagtccctctccgacaagccagcgcaaccatgggacctcaaatccatcaagcgccggggggacgagactctccggtcgtacctcaaaaggttccagaccatgagaaaccgcatccccgaggtcacggaggcggccgtgatcgaggacttctacagaggatccaatgactcggctttcgtccgagccatactacaaaaggcaccgactacctccgaggagctgttccgggaagccgacctctacatcaccgccgacgagcgggcccaggatctcattggaggagcaaagcctgcaccggcagcaccgcgacgtgacgcgaaccagccacccgacaaacgctgggagaagaggcctcgtgaagaagtacacgccgccggaccacccgcctctcgcgcccgaggaggacctcgtggaggcgagcgcacgctggacgacatcctcgacgcccagtgcccgtaccacaaggacatgcgccacactcttcgtaactgccgggacttcaagcactccgtcgggcacggccgacccttccaacctctaccgcctcctccgccgaggggaggaccagatgaaccacgacagccccatcagcaggaggaggggggaggaggagctttcccgcgcgttgacagggaggtcaacgtcatcttcggcggacatgggtcgcaggagaacaaaagacaacaaaagctcaacgaccgccagatactggtggcgaccaccggtcctcccgccccataccggtggtcggagcacccgatcactttcactcgggaggatcaatggctcaacttcgaccatccaggcaaatacccgctcctcgtcgatccggtgatccgagagagccgggtaaagaaggtgctagtggacggggggagcagcatcaacgtcaccttcccccggacactccaaggcttgggagttcacctcaaagagctccacgagtcggacactcctttcttcggcatcgtgccgacggaaggggaatacccgctgggccacatctacatgccggtcaccttcggaactccggagaactacagaaccgagttcctgaggttcgaagtggcgaacttcgactgcgggtaccacgccatcgctcccgaggccgggactggccaaattcatggccattccccactacacatacatgatactgaagatgccaggaccgcagggaatcataactgtgtgcgccgacttccaaggcgccgcagaatgtttccgagtggccatccaagcagccctcaccgccaagccgtcgacagttccttctacactggcgaactctaagcctgaggaggaccttgcagtaccggcaaacgaagctcagaacgcgacc

SEQ ID NO: 3648 - DNA, 3793 bp, Zea mays
ccggagcagcctgtctcgcgagacgaggtctcagagataggagaaactccggaagaacgcgtcttcagggaacgaaggaactcccgacgacgtgatcgccgtcggactcaggagcaagccgagcaagatgcaaggcaacgacgcgagaatccgctcttcgggcgcaacttgaaccctgacttcgcccgagctatgaacacgccgagcgaagtcggaggcgttctagcccggatagctgacggacttcctcggacccccgacgccgagggataccggcgcctgttcactcaggcagccaaccatcttctaccgctcgctcacccgccgaacgatctgcgacacgccatcaacagtcgccgagacgcgcgaagctctatcaatgcttcgcgcgaacggcggcacgagaacgaaattcgccgtcgggaggagtatgatcgagatcatggcttcccgactcaaagccaggccacccgaactgagtcggcaacagcttcaactggtggaaccacccggggacggtcgaggaaccaccaccgccactcccctccccgggacagacgacatcctcgacgacaggaggacacgtgcggagtatccgcccttactccgcgccttagggccatccaatggcctcccaacttcaaggtatccaatgtcgacaaatatgaacctaagcaggatccagggggctggttagccgtctacaccaccgctgctcgggctgccggggcatccgaggacgtcatgactgcgtatctgcccatcgtcctcgggcaagacgcgctgcagtggctacgacatctaccccgacactgcatcgacgactggggagacttcagtcgacgtttcaccgccaacttccaatctctctccgacaagccagcgcaaccatgggacctcaaatccatcaagcgccggggggatgagactctccggtcataccttaaaaggttccagaccatgagaaaccgcatccccgaggtcacggaggcggccgtgatcgaggacttctacagaggatctaacgactcggctttcgtccgagccatactgcaaaaggcgccgactacctccgaggagctgttccgggaagccgacctctacatcaccgctgacgagcgggcccaggacctcatcggaggagcaaagcccgcaccggcggcaccacgacgcgacgcgaaccagccgcccgacaagcgctgggagaagaggcctcgcgaagaggtacacgccgccggaccacccgcctctcgcgcccgaggaggacctcgtggaggcgaacgcacgctggacgacatcctcgacgcccagtgcccgtaccacaaggatatgcgccacactctccgcaactgccgggacttcaagcactccgtcgggcatggccgacccttccaacctctaccacctcctccgccgaggggaggaccagatgaaccacgacagccccatcagccggaggaggggggaggaggagctttcccgcgcgttgacagggaggtcaacgtcatcttcggcggacatgggtcgcaggagaacaagagacaacaaaagctcaacgaccgccagatactggtggcgaccaccggccctcccgccccgtaccggtggtcggagcacccaatcacgttcactcgggaggatcaatggctcaacttcgaccacccaggcaaatacccgctcctcgtcgatccggtgatccgagagagccgggtgaagaaggtgctagtggacggggggagcagcatcaacgtcaccttcccccgtacgctccaaggcttgggagttcacctcaaagagctccacgagtcagacactcctttcttcggcatcgtgccgacggaaggggaatacccgctgggccacatctacatgccggtcaccttcgggactccggataactacagaaccgagttcctgaggttcgaggtggcgaacttcgactgcgggtacaacgccatcatcgggaggccggggctggccaaattcatggccatcccgcactatacatacatgatactgaagatgccaggaccgcaaggaatcataactgtgcgcgccgacttccaaggcgccgcagaatgtttccgagtggccatccaagcagccctcaccaccaagccgtcaacggttccttctacaccggcgaactctaagcctgaggaagacctcgccgtgccggcaaacgaagctcaggccgcgacctctatgcggccgactgaagaaaccaagcggatcaacctggggttcgctgatgagcgcaagacggccatcatcagctccagtttgaatgacaaataggaaagcgcgctcgtccagttcctgcaagataaccgagacgtattcgcatggcaacctgcggatatgccgggagtcccaagagaactggccgagcacaaattgaaggtctatccccaggcgaggccgatccggcaaaagctgcgtcgtttcacgcccgacaagagagaggccattcgtgccgagttagctcgcttggtcgcggccggatttattagagaagtattacaccccgagtggttagccaaccctgttcttgtactcaaaaagaataaagtggattggcgcatgtgcgtcgactatactgatctcaacaaacactgtccgaaggatcccttcgggctcccgaggatagatcaggtggtggattccaccgctggatgttctgtgctgtctttcttagattgctattccgggtatcatcagattagtttggcaaaagaagacgaggaaaaaacggcgttcatcaccccgtttggtgctttctgttatacctccatgccgttcggcctcaaaaacgctggagcgacttatcagagagccattcaaacatgcttagccgatcactggggcaagcgtgtggaggcttacgtagatgacgtggtgatcaaaacagagaatccggaaaacttcatcgaagatttacagctggttttcaacagcctgagaagatatagatggaagctcaatcctgaaaaatgcgttttcggggtaccagcaggaaagttgctcggatttatcgtcagccaccggggaattgaagctaatccagataagattgaagctatcatgaagatggaagctcctcggtcacaaaagaaggttcagcgactcactggatgtatggcagccctgagcagattcatatccaggctgggagaaaaaggtttgccattttacaaactactcaagaaggtggataagtttcaatggacttcagaagcacaagaagctctagacgcactgaagaaattcttgacaacaccaccagtattgaaaccgccccggcgagctacgccgactcaaccggctgaagatttgctgttgtatatctcttgcacgactcacgtggtaagcactgcgttggtagtcgagcgagtggaagaagggcatgcctacccggtacaacatcctgtttacttcatcagtgaagttctaggtccctcgaagaagaagtatcctcaggttcagaagctattatatgcagtacttctaactgcccgcaagctgcgtcactactttgacgaccacaaagtcatagtagtcactggttttccaataggagatatccttcacaacaaggaagccattggccgaatagccaagtgggcatgcgagttgggatcccatgatatcgagttccgacctcgcacagccgtcaaaactcaagcactggttgatttcgtatcagagtggacagaacagcaagtaccggataatccagaaaccgcagaagtatggcaaatgtattttgatggctcgctgaaactgcaaggag

SEQ ID NO: 3649 - DNA, 6158 bp, Zea mays
atgaagatgacaaagagaagatcaataagtatcaagcaaagtccaagaaacgaagaaaagtgttaccacggacggactgtccggtcgaggacactggactgtccggtgcaacagggaagtgtagcccaatggctagttactggtgaaactggtggagagatgtcaccggactgtccgttgtgacacccgaactgtctggtgtgaaagcctgtagcgccaacggtcacctgctgtgggggacagatatcccccgggtccaccagaaggacaagatgcctcgcgaggggcccgtgggcccaataatccgcaaggtcatcccttcgtgggcctagggaggaacgcccaataaagcggatcgatgcaagcccagacggcccgatgaattcgagcggtgatcacaacagtgacccgaccttcccgtgcagaggccacgtacgtcggaactgagcgaggatgggtcggctgaattataggaagatagactcagtcagttcactattatctaggcacccgttgttatcatatccacatgtaatgcctcacgatcgagtatataaggcctagggggcaccccttcaagacgatcgacctcatattacttagccatccacaccggctctctacgtttctagaactagagaacctccttgtaacccaccacataaagtactcacaccaggacgtagggtgttacgcatctcaaagcggcccgaacctgtacacgactgtccactgtttctcgtgcatccagcacgaaccatagagctacagtcggtaacaccgtcctactccaaaaagcaccttgaggggcaaccccgggtgcacggtcggacccaaaacaccgacagctagcgcgccaggtgtggggtgtgtcgtcgatccaagctagctcaatggtcgtcaccttccagcataagatcatccttcgtcccgggtccgtgttctgctttgggactatctcatctatagcagatgaggaaggaactctgcatcgcatcgcggatccaccggagagaaagtcatcctcaaagatcttcgagaaaatcggagcaaagcagggaaaagctcaacctccagcgcttcgagaaaagatcaccttcagcaagctaggagctgagggtccgtctacccggtgaaccccgctgtccacctctccgacagaaaaatggacacagatcacagaaggaaagaaacgaatgaagccaagggtcgtcaagctgctctttctgtgcctctgtcctcaaaggaggacagaaagaagatcatcgtgacaggtgctacattctaccccgacgtcctcttcatcgggggaagagtggaatcgaatcctatctccgacgatgaaccaaccgcaccaggagaggaacctcttcatcgggagtctcgccgatggaggaaccaatgccgaaatattcggcggcatcacgaagccggagaacgggatccagcgcagcccgtatcacgagacgaggtctcataagtaggagaaactctagaagaacgggtcctcagagaaagaatgaactcttgacgacgtgaccgtcggcaggctcaaggataggccgagcaggaaatgaggcaacatcgagaaaatccactctttggacgcaacctgaaccccgacttcgcctgagccatgaacacgctgagtgaagtcggtggagtgttggctcggatagctgatggcctccctcggactcccgacgccgagggctaccgacgactgttcacccaggcagccaaccatcttctaccgctcgctcacccaccgaacgatctacgacacgccatcaacagtcgccgagacgcgcgaagctccatcaatgcttcgcgtgaacggcggcatgtgaacgagatccgccgccgggaggagtacgacagggatcatggcatcccagctcggagccaggccaccagaactgagtcggcaacggcctcaactggcggtactacccggggacggtcgaggaaccacaacaactactcccctccccgggacaggcatcatccccgacgacaggaggacacctgcggagtgtctgctcttactccgcgccttagggccatccaatggcctcccaacttcaaggtatccaatgtcgacaaatatgaacctaagcaggatccagggggttggctagccgtctacaccaccgctgctcgagctgccggggcgtccgaagacgtgatgaccgcgtatttacccattgtccttgggcaagacgcgctgcaatggctgcgacatctaccccgacactgcatcgacgactggggcgacttcagtcgacgcttcaccgccaatttccagtccctctccgacaaaccggcgcaaccatgggacctcaaatccatcaagcgccggggggacgaaactctccggtcgtacctcaaaaggttccagaccatgagaaatcgtatccccgaggtcacggaggcggccgtgatcgaggacttctacagaggatccaatgactcggctttcgtccgagccatactacagaaggcgccgactacctccgaggagctgttccgggaagccgacctctacatcaccgccgacgagcgggcccaggacctcatcggaggagcaaagcccgcaccggcagcaccacgacgcgacgcgaaccagcaacccgacaaacgctgggagaagaggcctcgcgaagaagtacacgccgccggaccacctgcctctcgcgcccgaggaggacctcgcggaggcgagcgcacgctggacgacatcctcgacgcccagtgcccgtaccacaaggacatgcgccacactcttcgtaactgccgggacttcaagcactccgtcgggcacggccgacccttccaacctctacctcctcctccgccgaggggaggaccagatgaaccacgacaaccccatcagcaggaggagggaggaggaggagctttcccgcgcgttgacagggaggtcaacgtcatcttcggcggacatgggtcgcaggagaacaaaagacaacaaaagctcaacgaccgccagatactggtggcgaccaccggtcctcccgccccataccggtggtcggagcacccgatcactttcactcgggaggatcaatggctcaacttcgaccatccaggcaaatacccgctcctcgtcgatccggtgatccgagagagccgggtgaagaaggtgctagtggacggggggagcagcatcaacgtcaccttcccccggacactccaaggcttgggagttcacctcaaagagctccacgagtcggacactcctttcttcggcatcgtgccgacggaaggggaatacccgctgggccacatctacatgcctgtcaccttcggaactccggagaactacagaaccgagttcctgaggtttgaagtggcgaacttcgactgcgggtacaacgccatcatcgggaggccgggattggccaaattcatggccattccgcattacacgtacatgatactgaagatgccaggaccgcaaggaatcataactgtgcgcgccgacttccaaggcgccgcagagtgtttccgagtggccatccaagcagccctcaccaccaagccatcgacggtctcttcaacacaggcgaattctaagcctgaggaggaccttgcggtaacggcaaatgaagcttaggccgcgacctctatgcggccgactgaagaaactaagaggatcaacctggggttcgctgatgaacgcaagaccgccatcatcagctccagcctaggcgacaaataggaaagcgcgctcgtccagtttctacaagataaccgagacgtattcgcatggcaacctgcggatatgccgggagtcccaagagaactggccgagcacaaattgaaggtctatccccaggcgaggccgatccggcaaaaactacgtcgtttcacgcccgacaagagagaggccattcgtgccgagttagcccgcttggtcgcggctggattcattagagaagtgttacatcccgagtggttagccaaccctgttcttgtactcaaaaagaataaagtggattggcgcatgtgcgtcgactatactgatctcaacaaacactgtccgaaggatcccttcgggctcccgaggatagatcaggtggtggactccaccgctggatgttctgtgctgtctttcttggattgctattccggataccatcagattagtttggcgaaggaagacgaggaaaaaacagcgttcatcactccgtttggtgctttctgttatacctccatgtcgttcggcctcaaaaacgctggagcgacttatcagagagccattcaaacatgcttagccgatcactggggcaagcgtgtggaggcctacgtagatgacgtggtaatcaaaacggagaactcggaaaacttcatcgaagacttacagcttgttttcaacagtctgagacggtatagatggaagcttaatcccgaaaaatgtgtttttggggtaccagcaggaaagttactcgggtttatcgtcagccaccgaggaattgaggctaatccggataagattgaagctatcatgaagatggaagcgcctcgatcacaaaagaaggttcagcgacttactggatgtatggcagctctgagcagatttatatccaggctgggggaaaaaggtttgccgttttacaagctactcaagaaggtggataagtttcagtggacttcagaagcacaggaagctctagatgcactgaagaaattcttgacaacaccaccagtactgaagccaccacgacgagctacatcaactcaaccagctgaagatctgcgctgaagatctattactgtatatctcttgcacgactcacgtggtaagcaccgtgttggtagtcgagcgagcagaagaaggacatgcctacccagtgcaacatcccgtttacttcatcagtgaagttctgggcccctcgaagaaaaagtatcctcaagttcagaagctattatatgcagtacttctaactgcccgcaagctacatcactactttgacgaccacaaagtcatagtagttactggttttccaataggggatattcttcacaacaaggaagccattggccgaatagccaagtgggcctgtgagctgagatctcatgacatcgaatgtattttgactcaagcattggttgacttcgtatcagagtggactgaacaacaagtaccagataacccaaagaccgcagaagtatggcgaatgtattttgatggctcgctgaagctgcagggagcaggagcaggaattctcttcaccgcacctggaggcgagcacctcaaatatgccctccggttgctgtttccagcctccaacaatgcagccgagtatgaagctctgatccatggattgaacatcgccatatcattaggcatcaagagactgatggtgtacggagactctctggtagtcataagccagataaacaaagaatgagattgttcaagcgattcaatgggaaagtactgcactgccgtccgaaaactggaagataaatttgagggtctagaatttcatcatgtagaaagagatcggaacacggcagccgatgtattgtccaagctaggatccagtcgaacttaggtcccacctggagtctttatgcaagaaatactacagccgagcatctcaatagatcaagcagaagagtgcaatatcgtgaatcaaccagagtcagaccctgatgactggagaaggccaatcatcaggtacataaagaatgaagaggagccaaatgacaaaaatgcagccgagcgtatcgccagacagtcggctcactacacactcattggggagacattatacagaaggggtgcatcaggcgtcctcatgaaatgcattctctcatctactgggaagcgacttctggatgagatccatgttgggcaatgtggaatacacgccgcatccaagacaatagttgggaaggtcttcaggtcaggattctattggccaacagcgaagaatgacgtagccgagttagttcagaggtgcgaagcttgccagtacttgttgaagcaacaacatctaccggcacagcaactgcagaccataccagtgacttggcccttcgcatgctggggactcgatatgattggacctttcaagaaagctcaaggaggatacactcatgtactggtagcaatcgacaaatcacca

SEQ ID NO: 3650 - DNA, 1265 bp, Zea mays
agagaaagtcttcctcaaaaatctctgggaaagtcggagcgaaacagaaaaagcacaacctctagcgctcagagcaaagaccaccttcagcaagctaggagccgaggccccccccacccggagaactccattgtccacttctctgatgaaaaaaatggacatggatcccaaggaaaaaggaagtgaccaaggtaaaggattgtcaaactgctctttcggtgcctccgtcctcaaaggagaacggaaagaagctcgtcacaatggcagttccattctaccctgacgtcctcttcatcggaagagtggagtcgcccccccgtcttcgacgatgaaccaactgcgcccggggaagaacctcctcagcgggaatcccgccgacgaaggaaccgatgccgaaatattcggcgacattacgaggccggagagtgggacccggtgcagcccgtatcacgagacaaggtctcggagataggagaaactccagaagaacgggtcttcaaggaaaggaggaattcccgacgacgtgactgtcggcaagctcaagagcaggctgagcaggaagcaaggcaatgtcgagaaaatccactttggggggggggggggggggactagtgcgcctgcagcccggggcaccccgtgcggagtgggcggccgactgcctcggatagccgatggcctcccctggactccatacaccgagggctatcggcggctgttcactcgggcggccaactaccttctacctctcgctcatccgccgagcgatctatgacacgccatcaacagtcggcgagacgcacggagctccatcaatgcctcgcacgaacgacgacacgagaacgagatccggtgctgggaagaatatgactgggatcacggcatccctgcgcggagtcaggccaccagaattgagtcggcaatggcttcgactggtggcacgacccggggacgatcgaggcaccacgacaacaactcctctccccgggacaggcatcatcatcgacgataggaggacacatgtggagtatcggcactcactctgcaccttagggccattcaatggccccctaacttcaaagtctccaacgtcgacaagtacgagcctaagcaggatccgggaggctggctggccgtctacaccaccgccgcccgagccgctagggcaaccaaagacgtgatgactgcatacttgcctatcgttcttgggcaggatgcactgcaatggctgcgacacctaccccgacactgcatcgacgactggagcg

SEQ ID NO: 3651 - DNA, 4329 bp, Zea mays
  misc_feature (1745)..(1745): n is a, c, g, or t
cgccccaaccagacgccccgatgtcgctcaccaccgcctccttcgcgatgtgcgacgtcgtctgaccccaacacttcctgacgcccctcaccccgctcgtcgttgtcgcgatgcagccccacccagcaagtctgatcttgttcgtcgcaacgatgtgacacatctttggcggtcgacaaacttagtgaactagtgagttctgcctctctaccggagaggccgtctgacactgtcctctttttggtggcccccgcactagatcgacatttgaaaaggcacacatgacttggattctgctaccaagaacatagcgacatgtttgcttcttttgtttatatagttttcttctttggacttgtatctattgatatgaaacttaaattctacgcaacactagtttttacggtattacttgattttgtcacgtggtttttggacccctcgtgaattttcgtcctacgttcggcactgatgctgaatgcaacaaaggctaggacacattatctctctgcctaaaagtaggtttgctatggcttgacagatactcgtacagctgcatggaaagtcacttgagcttgcaagtccagcatcagtgtactgtctggacgacgactggcctgctgccggactggtctttataccagactagagctggagtagagcccccatgccttcgagtgattacgctaatgaatccatcattatgctgcttggtttaattaagctggcaagaattaattgcctatgtttttatgtagtacatctcctttgtattccttctttattcgaaacaagtaatatcggtggacgttcgatccatatatataaatacaataattctaaatatacatgaacaaattaaagcgtcctttattttgcgcagcgtgctgtactgtcacactgttgcttgttgactcgaacagtagtatgtgctagctctgatctatcggtactgtatggagcagccggcatggccatggagacgatggaggttactacagtggaatgcctgcctcctagcgatagcgcagtactagcaacacatggcacgcaaccatgtctatgtatgcttcaattcgccgcatttacgtggctggctggctggttcgatcggagcagtgtgcttcaattcgattcggatcgggtcgggtgatccttttgcaacaacgcattgaagcgacagggttggcatgaactgtgcgcgcgcgcgcgcgcggtgtggtttcactgatcgcccggccggccgctctgacacgcaggaaatgaagaaaggaatcccccccggccgccccgttgcattgcatgccctccgctgtctccaattactcgggcatttattctgggtttcaaggcgagttaatcggcaatagtctccccggcctcaaccctgatgagctaaccaccgatatgaccaggcttgctgctgctggatgcatcttccctaccagcaacagccgccgcagccggtttgctgtccgcttgcattgcatgcattatgcatcatcagttcatcacccaccagatcgcctctccagtctccatgctgcgtgctctctagcccatctcgtcgtcgcccgggcggcaaaagatctgcaaagcaacaaccctaaacaccagtagctcagttgcatgtcacatgcacggctgcacccacaccaaaccaaatgcctgtttcactttcgacgagccgttcgacgacgcacctatataaattcatcagaacacttcccttccgatccgtatanatagtacgtgtgttcatactagatgctttcacagttgcattagtgaggctgaggcgcgcgatagataaatcgatgagctcatagcagccgtctcttccgttgtttcaatggcgatgaaattgcgcgcctgcagttctgctgcacccaccgcttgctgctgtgtatttacgccacgccaagacgagaacagtgaagagtcttcccaaaactcaatctctaaacatttactagcattattctgtgtgctaacgctacaatctcgaataggagtcgacgatgatggcagcacgagtgaaggagaggaggaggtgctgagaacagggggagggggcgctcacggcgacgggtcacgggtgagagatgagtgatagatgatataaataatattattcattgacttaagtgagtaagagagaatgttatctagcaatttgaatcgttgattttgatggtatgttaagtctggttgcaatttatttggtaaatttagtgcatgttatgaatgtggattgatttagttaggtgagttttacaaagtttaaattggtaaattatatagtggtatagatttgaagctagtattaaaaatcgttttccatatttttttttcaatctacaatattttttctatttttatttacgctctagagagcgattattagtttttatctttattagccataaaccaagaatagaaagtatatttgataactattccatccgttattttttattttttcgcgggtttcgtttaaaaaatattcacgccaaatgttcgataacgaagatattattttttaaaaaactattagatgtcatctttttactaaaacatgtattcatagctattagaaaggatacatagagttacttagatttattttaaacagtttttttaaataattatcttctatttcgaaattttctccaccaaatataaaaaaacgagaataactttctatagtgcaaataagataaaaaatttgttagagtgaaaatatatgtataaaaataacaataaacaagtatcccaataataatttagagagttaaatttataaaaactcttaataatgctttcgataaaacctgcgagacaaaatcttaatccttatcagtactacagaccacacaacccacatgacaccaaccgacgcacgtcctctacactccgcagaggcgcagacatgacacacacagacagaaaggtagagagcgagggacgcagaattattacctagacccgttccattggcacccctgatgtccaacatacctaggagcttttagcttctcatcatatggctggcccatggaagaacgggtctacgcaataattcctttctgatcaactcgaactcgaacacacacggacacaaggagcacccacgtacgtaatggacacgacggacggcagttgctagccatgcaagggcatgcgcctgccggcgacgctagctctcccgtcagcctcgcttgccgcccttgcccttggcgccggcgtggcgcggatcggcgggggcgtcgttgaagtcgaggagcacggtgctgtagcacttggggcaccgggggtcctcccgcgacagcatcacgtacatcatgcagcgggggcaccccgccaggatcatgggcgcgccggcgccgcctgcccccgcctcggggctgccctccgacgacacgcacgagctcggcggagaagcggtcgaggacgacgacgacgagagcctcctgggcgagcccccgccgccgccgtggtggtgggtcgtcgcccccgacgagccccccgcgcccccgcgcgaccgcgacaggctcagccgcagctcctgcagcttggacccgaccttgccgttgttcctgctcatcttccaacaaagtaaaattaaccactgatcactgccgcacggcgcacggaaccgagatcagtactagcttagctagctagctagctcgtgtatgcatgcactgtggatgtggagctacggggaggagaccgcggccactcttgcgcgcatgtgcttgtggtggttcctgtggtgctgctggactggaatggagccaggccacctcgacggtgtgcctgcctgggtatttgtggtgcggtggtgcaactcccgtttgcgttatataatgatgatgatgtcttgtggaggttgccgatgatgctcgttgaggtgaagaggaggtgatggttttcattactgccatgaacagcagcatttaaatccctgttgcttcctagctagctccaccctgcctctcttctgaattctcatgccggctaggctagctaagcgcgcgctctcgttctctctcatgtggttggggatttaatggactcacgccttcattcaaaattagttgacgttttaagtttggacgccagaatttagaagaaataaagagatgatggttaactactattttgagacggggaaaatattattatgggcgattgagaaatcggatgctacgagaattaaggatttcctgatgggcattgtgggtgactgaatgggagtggatcggagggatatattatatagcgccagtatttatcttggaaatacagtattaacaactggag

SEQ ID NO: 3652 - DNA, 2353 bp, Zea mays
  misc_feature (334)..(334): n is a, c, g, or t
gtacacttcttttttcaccaaatggattcattccgtctatacccaaagcaaatcttacatttctggtttctttggcaacaaatcgatacgagaagaaatgcgtgaatgaggcacaatttagttgcaaaaggcacgatgagcatggcgtctcgacccaccgcaacatgtgcgtggcacgcagtatgcggtactagcacagtacttggctggtaccaaaacgttggacggaaccgagtcacatgaaggagcagcagggggggggggggggcacgcgtgcatcccacggtcagcagtctccgccatgtctgttatctgtagcgcccgatgacatcanaagcggaacgaaccatatctgcactgcactggactgcactgcaactaaacggctcgcacagttgtatcatgtacgtacgcccttcaccacccccctgacatgatgcccaacaacttcttctttgcaaattcattcactgcaccctccgcaacgcaacaaaacaaggggatacaggcgtacagctagcgagacagccatacatctcccatgtggggggccgttggccgtacgctgccatcgtttacgtacgtgcgtgcgcgcgtgctctgcttgcgttacgcgtagacttcaaacatgcacgctcttcttcaccctttgtttgttgtttgggggaaacaataaaaaggtaaagtggttaattatatataccatgttgccaataaggataccacacttcacagtggacgtaataataaatttctttactgttaactgatgaggaaaccaggcgatagctgtaaaagttccaggatcacgctgtcgcgtcgcgtggcaacctttctttttgctgcctttttttttacctttctttctactggtttctacttcgttccgcgaataaaactcgtcggcgtcgacagagatcgatcgacgcattcgttctacatgtacgcttgcaaagttagtgatgatcctgcgtgctgcgtagtgcgacgtcgcattcaaatgcaacaaaatatactccctacccgtcaccaagtgttcaaagccgatcgcgctagtcgctcgatcgtctccgcttttgccttttctttttatctttttttccctggctttattacatatacacacacatctcagtctctcacctcgtgtgtgtgcgtgcgcgtgcgtgcgtgcgggtatatatatatcgcgcagggtcggagctgagttcggacacccagagcgcgggcgcggcggccatggaggagcaccagtcggcagctgcgctgtccagccaggagggccccgagacgccgcggaggcggtaccgcggggtgcgccagcggccgtggggcaagtgggccgccgagatccgggacccgcacaaggcggcgcgcgtctggctcggcacgttcgagaccgccgaggccgcggcgcgcgcctacgacgaggccgcgctccgcttccgcggcagccgcgccaagctcaacttccccgaggacgcgcgcctctacccggcgtccacggcgggcgcggcggcgcctctcgccgcggcggcctcgacctccccacctgtctactccggtggcgtccagggctcgtcggactacctgaggtaccaccagatgcttctgcaagcgtccacgggcagccagggcaccctgctcccgttctatggcggcggcatgagcaatccctacggcggcggtgccgccatgaccggttcctacggtggagccggcggcggcaacacgagtggttccttgggctcctactactcgttcccggcctcctctgtttctgtcgccaccgtgccgtcctctacttcctctgcttcggggtactactactcgtcgccgcacgactcgcaacacagcgaggcgtccgcggcggcggactggaactgggagagcgcgctggcctggcccgactcgagccagtacccgccgccacctcacactcagtagcagcagccagtagcggtcttcttcttttctctgtaacaataagtaaggtgagtacggttgcgcggagggagacgcgcggcaacgcaaagcaaaacaaagcagatcaacaagaggaggatgctttcatttctttcgtgttatgatgatgacacccgagtggtctttgtttgttgatttttagttttggtcgacgatgtggctggcggctatccccattgtttccatttaatcttggctgcgaatttaagagatgaaagctccaccccgttccccttctccaagactccatcggtgtatatatttctccgaattctttccaggaatttctgatttagctgatctctcaaaaacaaatctaaacctgtcacatcatctagcctttttcggatcatcacgcagccttcct

SEQ ID NO: 3653 - DNA, 767 bp, Zea mays
ccagttactaagttaaccctcgctcttcctttcccctcggttctcgttgtctgacaggcaaagcggctatgacgacaacggccgccgggtacggctgctgctgggcggggattccgcccttcgcgttgttgccgcggattctctcgacccgccgggagactcctcctcctcctcctcctcgcgcttcccttgtcgcctcctcctcgaagctcagggcgctggcaccacggctgagagtttcgaaccgtccaaggaggctcattgtctccgcttcctcctccggcgaggccaattcggacgcggcgccgtcgccaacggaagccgctattgatataaagcttcctagaagaagcttgcttgttcaatttacatgcaacgcatgtggcgaaaggaccaagcgcttgataaacagagtagcctatgaaagaggcacagtttttcttcagtgtgcagggtgccaggtgtaccataagtttgttgataatcttgggctagttgttgagtatgatctacgagaagaaaacgagctacaaggagaaaatgcggtggacaccagttctgaagattgatctgctgtgagaagcggtgttggtatgcaaaacgccctgtactctgtaggtttttgacaacattggttatttgtatatcataaaaatggcactttttaaagttgttgcacatactcatctgaaattctgaatacagcggggcctacattgttacttcttacaaaaaaaaaaaaaaaagggcggcggctcgcgatctag

SEQ ID NO: 3654 - DNA, 716 bp, Zea mays
aagcccagttactaagttcaccctcgctcttcctttcccctcggttctcgttgtctgacaggcaaagcggctatgacgacgacggccgccgggtacggctgctgctgggcggggattccgcccttcgcgttgttgccacggattctctcgacccgccgggagactcctcgcgcttcccttgtcgcctcctcctcgaagctcagggcgctggcaccacggctgagagtttcgaaccgtccaaggaggctcattgtctccgcttcctcctccggcgaggccaattcggacgcggtgccgtcgccagcggaagccgctattgatataaagcttcctagaagaagcttgcttgttcaatttacatgcaacgcatgtggcgaaaggaccaagcgcttgataaacagagtagcctatgaaagaggcacagtttttcttcagtgtgcagggtgccaggtgtaccataagtttgttgataatcttgggctagttgttgagtatgatctacgagaagaaaacgagctacaaggagaaaatgcggtggacaccagttctgaagattgatctgctatgagaagcggtgttggtatgcaaaacgccctgtactctgtaggtttttgacaacattggttatttgtatatcataaaaatggcactttttaaagttgttgcacatactcatctgaaattctgaatacagcggggcctacattgttacttct

SEQ ID NO: 3655 - DNA, 762 bp, Zea mays
gcttcatgtgggctatgctctgtgctcttggcttgtccaatcttcgtcacagtgctactggaagctccagaaacagtattatagttgggctggctttattcttgtccctatcagttccttcttacttccagcagtacggtgtacatcctagcgcaaactcatcagtgccaacttactttcaaccatacgttgttgcatctcatggacctgttcacactggatcgggcggggtgaactatgtcctcaacacgatactttcactcaacatggccattgcgtttctggttgctctggtacttgacaacacagtccctggtggtcgtcaagagcggggattgtatgtatggtcagaagcagaggcagcgatgagagaatcgactttcatgaaagactatgaacttcctttcaagatcggacgcccgttcaggtgggtgaagtgtgttggtctataacacaattttgggtagtttgtagctgtggcaaactttgaagatctcaagctttcatgaatcatgactgatcgtttctcgacaaggctggtgtataggttatttagcatgtcttgattctgatgtatctaattttcagatacgtttgagactgctgtatatcatcgctgacggtcctattatttagatggttttagggatatcaatttgtacaggtccagttaaaaaaaaactgagctaccacacctgaactcatatctggtttgaagtcaatagttatcccgaaaccgcactttcataaaaaaaaaaaaaa

SEQ ID NO: 3656 - DNA, 1428 bp, Zea mays
ctctcttccccaccctgtttctgcacacatcgccacttgtttatgccgctggcttacgaggaaggcaaaccacctaagcttgttcctgtgctgaaattgtcgaccagcacccaggtggccaggtggcatcgataagaatagagtatcatagataatagattgttgaaggggtctgactacataatgtccagctataaacaacccatttgaatgttataaaatagtgcagcaaaattaaactttgggaggctttattgctgcacaaatggaatagttttgggattctattgttcaacttaaaaaagggacggtgaaaagaagatagcatacgaacacactagaagggtttatacgcttgccagtttaagcttgttcttcaactgaaattagtcaagtatgatagttgtagtaggtaaaaaatctgatgcttgatgtgctaaagtacatgtttggttgtttaggcttgaaggatagcgacttttattgctgtccattttgagcatggatcttcagctccttgggtcaagtggtttcaatgatattcttctttttatttgccctttttccttttagttccaactcctgacaatgtcacgctagagaagcaaaaataaatataacattgtcttgatttttatgattattccttgagacccgaatgcctaaattgttgaattttactatcaatccaacctatttgagggcttaggacactattataccttacattttcgtaagaaaagagttataatcagtcgatcctacagagggcatgtaacgccctgtcataatgtaattttgacacccttggttatatccaagcatttcattgcaatttcgttatctgcttgcatttcaggtgaactatgtcctcaacacgatactttcactcaacatggccattgcatttctggttgctctggtacttgacaacacagtccctggtggtcgtcaagagcggggattgtatgtatggtcagaagcagaggcagcgatgagagaatcgactttcatgaaagactatgaacttcctttcaagatcggacgcccgttcaggtgggtgaagtgtgttggcctataacacaattttgggtagtttgtagctgtggcaaactttgaagatctcaagctttcatgaatcatgactgatcgtttctcgacaaggctggtgtataggttatttagcatgtcctgatcctgatgtatctaattttcagatacgtttgagactgctgtatatcatcgctgacggtcctattatttagatggttttagggatatcaatttgtacaggtccagttaaaaaaaaactgagctaccacacctgaactcatatctggtttgaagtcaatagttatcccgaaaccgcactttcataaagtacagccgtgcagaatttgcatctcatacagccgtgcagaattttca

SEQ ID NO: 3657 - DNA, 1007 bp, Zea mays
gcgctccccttttctcccctcaccctttctctttctcccccccccgccccggatctgtctcgccgcgccggcgcgcagctgagccgccgaagcgaggaggcaatcgaggcggacgaagcgccgcaccaaattcgacgggggatcgagcaccagaggcgtagcgcaaaatgttcaagttcctcaaggaggtggtcgcgggatccggatcgggactcaaggacttcccctacaccatcggtgagccctacgcatcggcttggggctcatggaaacaccaccgcggtacctccaaggatgatgggtcgcctgtgtcaattttttctctatcagggagcaaccctcaggacagacacatggttgctggtcgcaatggtgttaagagattacgaacagtgcggcatccaaatatcttatcctttttacacagcactgaagcagaagctgcggatggacctgccatgaaatacacaatttatattgtaacagagcctgttatgccactttctgaaaagctcaaggaactgaatcttggtggtacacagagagatgagtactttgcatgggggcttcatcagatatccaaagctgtgagctttctcaataatgactgcaaacttgttcatggtaatgtatgcttgaccagtgttgttgttacacaaaccctggattggaagcttcatgcttttgatgttctgtcagaatttgatgctaataatgaagcctctggtagccccatgttgcaatttgaatggttagttggaacacagtacaagccaatggagctgtcaaagtcagattgggcttcaattagaaaatcacccccgtgggccattgattcttggggactagggtgtttaatttatgaactattttctggtgcaaagctggctagaacagaggaccttcgaaatactgcttcaatcccaaagtctctacttccagattaccaaaggctcttgaattccacaccttctcgtagactaaatccttcaaaacttattgacaac

SEQ ID NO: 3658 - DNA, 2848 bp, Zea mays
agaacaagttagtagagaccatccagttcatggaaattcttaatttgaaagacacctttgagaaagacagtttttttcgtaaactccccaatatagctgaacagcttcctcgtgaaatagttctgaaaaagctgctccctgtattggcttcttctcttgaatttggttcagctgccgctccagccttaactgttttgttaaagatgggttcctggcttcctgctgaccaatttagtatcaaggtcttgccaactattgtcaagctttttgcctccaatgaccgagctatccgagcatgtcttttgcatcacataaatcagtttggggaatcaatgtcagctcaaattgttgacgaacaagtttttcctcatgtagccactggcttctctgatactgatggtactattcgtgaactgacattgaagtcgatgctcgtattagcaccaaaattatctcagcgtacaatctcaggatctctcttaaaatatctctctaagctacaggtggacgaagaacctggtatcaggacaaacacgacaattcttcttggcaatattgcaggctacatgaacgatgggacaaggaagagagtgctgatcaatgcattcacagttcgtgcattacgtgataccttccctccggccagagcagctggaatcatggcactgagtgtcactagttcatactatgaaatgacagagattgcaactcgcatcctgcctaacattgttgtgctcacatttgacccaaatagtgatgtccgaaccaaggcttttcaggctaccgatcagttcttgcaaatagcaaaacaacaccatgaaaagcttaatacgggagacaacagtgtggctgaaagtactggtgttaagttaaagcctggaaatgcaggtttacttgggtgggccatgagttctgttacacaaaagggtaaaccttctgaccatgccccaatatctactgcaaatgccaataattctcaagcatcaacaacctcgactgccactccagacactcaggcttccacactagcgtatgcaccatccacatccacctcgcttgatcaagctgcatcagcatcagcaaggtcgtcagtagatgggtggggtgagcttgaggatggtaatatccatgaggagaatagtagcgataaagatggatgggatgatgtagacccatttgaggacaagccatccccatctcttctatccaacatacaggctgctcagaaacgtccagtggtgcaaccaaagcaaccggttgcaaactcatctaaaccaaacccactgaaagcgccaaagtcagaagacgatcctttgtggggtcctatagctgctgcaccacctaaaagtgcagtaaaatctgcagacatcaagccatcaacatcacataatgatgaggatgacctctggggttcaatagcggcacctccaaaatcatctgggaagcctttgaagccagctgtagcgaatagtgacgacttatggggtgccatcgcagcacctccaccagcaaccaaagccagacccttagcctcgtcaggtaggggccgaggaacaaagccagcgcaaccaaaacttggtgctcaaagaataggaagaacatcttcaactggaatgtgacgtcttatgatatcaagtgttgtacaagaatgcaaagttttcctttttttcccctgccttgcgttgagtctgtccaggatgacattctttgtaaactagtaaaaagatttatgtatatgagcacagttttgaccaatgtattagtattattttaccattgtgtattaaaatagatccagaagatttttgtacatcacagctgcagtcatcttgtgtccatattattaatatattgctatgtcttattttggcctgataagagcaacttaatgccttgtttgggtagtgtcgtattcaccttaatccaaggtagattgagatgtaatttaaactaatttacacctcaatatacatggagaggtgaatataagagtatctaaaataaattttctatacccttcctatccacaaacagttttgattgactatgatggagaattaagttgactatcttgagcgcatgagatatcctctaaccaacttacatgctctaaccaacttacatgctgtttggtttctagggactaatttttagtccctacattttatttaattttattccaaaattgtcaaatacagaaactaaaactctattttagtttctatatttgacaatttatagactaaaatgaaataaaataaagagactaaaccttaatctatagaaaccaaacacccccttaatcttgtacacatcttcgagaggagccctccattttggctttgtggatgatacagtaagaagtttgcacacacgggttgcctctctctatgcctgaaaatggaagaaaacatcattaaacacttcttgcgccaatttcctcctttcaccagaaataatcttattacatgcagaccaccaacaccataaaaataaaatcattttgcattggcaatcattatcaaattttcagattatatgcaacaccaccaaggagaattctctcccattaagggctagtttggaaatcccattttccaaatggatttccattttctcaaaagaaattagttcatttttctctgagaaaatatgaatctcttaaaaaaatagagtttccaaactagctctaaaaggattcttttgccctccatatttagcagttgccagccgtgccttccctccttgcatttgaaaaatagatgatccggtacttcattaaaccttgagcacactgggcaaagagtgtccagatcccctcccattcttactatatttccccgcttca

SEQ ID NO: 3659 - DNA, 1659 bp, Zea mays
tagcgtggtcgcggccgaggtacaatctcaggatctctcttgaaatatctctctaaactacaggtggatgaagaacctggaatcaggacgaacactacaattcttcttggcaatattgcaagctacatgaatgatgggactaggaagagagtgctgatcaatgcattcacagttcgtgcattacgtgataccttccctccggccagagcagctggaatcatggcactaagtgtcactagttcatactatgaaatgacagagattgcaactcgcatcctgcctaacattgttgtgctcacatttgacccaaatagtgatgtccgaaccaaggcttttcaggctaccgatcagttcttgcaaatagcaaagcaacaccatgaaaagcttaatacgggagacaacagtgtggctgaaagtactggtgttaagttaaagcctggaaatgcaggtttacttgggtgggccatgagttctgttacacaaaagggtaaaccttttgaccatgccccagtttcggctccacatgccaataattctcaagcatcaacagccttgactgccgctccagagactcaggcttccacaccagcgtatgcacaatccacatccagctcccttgatcaagctgcaccagcatcagcaaggtcttcagaagatgggtggggtgagcttgaggatgacaatatccatgaggagaatagtgataaagatggatgggatgatgtagacccgtttgaggacaagccatcaccatctcttctatccaacatacaggctgcacagaaacgtccagtggcgcaaccaaagcaagctgttgcaaactcatctaaatccaacccactaaaagcgccaaaatcagaagacgatcctctatggggtcctatagctgctgcaccacccaaaagcgcagcaaaacctgcagacatcaagccatcaacatcacataacgatgaggatgacctgtggggttcaatagcggcacctcctccaaaatcatctggaaagcctttgaagccagctgcagcgaatagtgacgacctatggggtgccattgcagcacctccaccaggaaccaaagccaggcccttagcctcatcaggtaagggccgaggaacaaagcctgcgcaaccaaaacttggtgctcaaagaataggaagaacatcctcaactggaatgtgatggcttatgatatcaaatgttgtacaagagtgcgaagttttcctttttgtcccccatgctttgagtctgaccaggatgtcattctttgtaaactagcaaaaggtatcaatatatggacacaattttgacaaatgtattaatattgtttcaccattgtgtattaaaatagacacatacgtttttttttgtttttgtattttttgtacatcacagctgtttcgagtaaatattattaatatatttgcccctgccttattttggcttgaaaaaaaaaaaaaaaccttttggcggcgcggccgcgtgtccgggtagcgctgtatagaacttacatgtttgctcctttgtaatgagcttcaggcttcagcctcttctatataatataacacccaatccctggattagggttagagttttcattcttccacttggtactagatctaaggtttaggtttatctctcttcctcccaccccatagccct

SEQ ID NO: 3660 - DNA, 4009 bp, Zea mays
  misc_feature (22)..(22): n is a, c, g, or t
  misc_feature (111)..(111): n is a, c, g, or t
  misc_feature (178)..(178): n is a, c, g, or t
  misc_feature (235)..(235): n is a, c, g, or t
  misc_feature (285)..(285): n is a, c, g, or t
  misc_feature (290)..(290): n is a, c, g, or t
  misc_feature (308)..(308): n is a, c, g, or t
  misc_feature (310)..(313): n is a, c, g, or t
  misc_feature (341)..(341): n is a, c, g, or t
  misc_feature (362)..(364): n is a, c, g, or t
  misc_feature (408)..(408): n is a, c, g, or t
aaaaaaaaaaaagaaggacggnaaaaaaaaaaaaaaaaaaaaaagaaagagaagaaaaaaaataaaaaaagacaggaaaaaagaaaaaaaaaaaaaaaagaagggaaaaanaaaaaaaaaaaggggaaaagaagaaaagaaaaaaaaaaaagagaaaaaaaaaagaggaaaaaaaaanaaaaaaaaaaaaaataaaaaattaaaaagaaaaagaaggaaaaaaaaaaaaagaaanaaaaaaaaaaaaaaaaaaaaggaaaaaaagaaaaaagaaaaaaaaaaaanaaaanaaagaagaaaaaaaaaanannnnaaaaaaaggagaaaaaaaaaaaaaaagnaaaagaaaaaaaaaaaaaaannngaagggaagaaaaaaaaaaaaaggaaaaaaataagggaaagaanaaaaggaacagaaacttcgtctttacaaaaacaggcgtctagtcattcaaacctctcaatcaataggtgatgccccatatggggaccattttactgtagagggcatctgggatgttgaacaagatagcctagatgagaactgttgtgacctcaggatatacatcaatgtagccttctcaaagaaaacaatatttagagggaaaatagagcagtcaacaaaagatgaatgccgggaagttttcagtctctggattaagctcggtcatgatcttttgaagcaggagtatgatcgatcaaaaggcgcctccagcacacctgattctggtgttcaaccaggggctacaacaaacgaggaaagtgccgtggaagtagcagttccagtggtgagttcctcacatgatgaatctggtgcgagaagcctcattcctcctactcaagatcaccagcagaggacaggaagagatccttccatcacgtccacttcacaagaattgtggggttctctatcgtcatacatgaggtcaaggcaacttggtccagtactagcaatgtcactggtagctctcattatcctaatgcaggtgaccatcatagttctactaacaagacccccccaggtccaaatggatcctcatgggatctggacgggcagttcagggtacagcaaagaaagcatagagtgggtgcagaagcgcctcagcttactaagcgaggagatgcagctcgcggaggcacacatggagacgatgaggcgcgagtttgcctggctcaggtcttacctggagagactgcagaggacgcggggcagcacatgacggcggcgcgtgtacatggcacaggggcacgagttcgctacgcgaattcggaggtgtatacaaatacaatacaatacaacccggaggtggtgttcagtgtttcttctgttgttacagatggtacagatgcaaacagagagaggtggattgttgtttgcagaggtatttgccgtaaggcagaactgcaagatcccggtatagcgttcgatgtaaatagctggagcttccccattgcgctggggtgatgtacaatgtcagggacgagtcactgcgatcacgctacggcggtgacgcgttatgttatttataaatttctgactgaattttaacttctaaaagctacccggtccgtccgcggtccgtccaaaaatgataaacagtactacctccgtttcacaataatgttctttttacctcttatttttgtgtctatatttaaatagaagacaataaatctggacacacacacacacatatatatatatatatatatatatatatatatatatgtaagttctctttctctgtagagcaccaacgatatgaaggtcacgaaaaaaaattcagattgctagcttagcaagtgatgcatgttctgccactcctaaagctggtgtccatggactaaaatctgctggtgatttggtacttactttagggatctcctaccccaggactgtcgtgcccgcctggaaatgcaaagcagagcgtcagcaaacctgcggacgagcaggttgggacttgggcgggagggatggatgcgtagcaggacctcctcctccgtcgcactctccggcggcggatctgcttccatggtggtgtccgggccggcggcgcagcagaaggggtggcagcgccggtggttctacctccggaatgacggcgagttgctcccgccgttctcccagcgagtagtcaccgccgccaccgacacttggcgccacgggaccccgcacgaaagacaaaagaacctcgaaccccttctcaaggccttggaggtgtcgcggaaagggggactcaccgctgcgggagtggttgccgccatccaccgtcggagggtgcttcccttggcggagcgactactgtcgctctgggagatgacactggaggctaacttggagggctcacggatgtcctctgatccccttccctttgatgtcccaaccgacatgtgggcccaacttattacaatcatgaacacgtgtcctcacaggttactgatagtcgcctagaggggggtgaatagggcgaaactgaaatttacaaatataaacacaactacaagtcgggttagcgttaaaaataaaaaccgagtccgcgagagagggtgcaaaacaaatctcaagcaaataaggagtgtgacacaaggatttgttttaccgaggttcggttcttgcaaacatactccccgttgaggtggtcacaaagaccgggtctctttcaaccctttccctctctcaaacggtccctccgaccgagtgagcttctcttctcaaatcaaaaccgggaacaaaacttctccgcaagggccaccacacaattggtgcctcttgccttgattacaatggagttttgatcacaagaacaagtgagaaagaaaagaagcaatccaagcgcaagagctcaaaagaacacgacaaatctctctcgctaatcactaaagccttgtgtggaattggagaggatttgatctcttttgtgtgtctagaattgaatgcttagctcttgtaagtagttggaaggtggaaaacttggatgacttgaatgtggggtggttgggggtatttatagccccaaccaccaaactagccgtttggtggaggctgctgtcgcatggcgcaccggacagtacagtgcgccaccagacaatgtccggtgcgccagccacgtcacctggccgttgggttccgaccgttggagctctaacttgtgggcccgcctggctgtccggtggtgcaccggacaagtcctgtagactgtccggtgtgccacccgcgcgtgcactgctcctctgctcgcgctggcgcgcatttaatgtgttgcagacgaccgttgcgcgcgaagtagtcgttgctccactgtctcaccgcacagtccggtgtgcaccggacatgtccggtgaattatagctgacccctagtagcgaggctgctgccaccttttttttatcatgagtgaatttatttagtgagggccatcagtgaagcaaagctgcttgtaataaacaaagatgcgtgcttggccaattcattcggtttatgtggtgaatctgaagagtgaagatgcatcacaacataggagaagacaacaataggatataatgatagatattcatgaaaagattgatgacatataaatctaatcttcaattcagctttcctggtctcaaatgaatggctgagtttttttcctctctgaagtttggtaaagaggtgataaagaagaaggcaaggagaggtcctttcttcaacttttgcatcattccgaaggtaatctcggttattttgcatcattcagatatataattatcatcgaaaaaaatataaaaatattattatcagtatatcatggatatatgctcacgaagataaggtacatgtatatctatggcattccctcttctcttaaaacagttctaagttttgaacaaaagttatgtatttatttgctttctaattttagtaagattgcatctacctgagagatggacaaggtgtggctgatggtttcggctgcaaacataggtatgcctcatttaattaggtatggcttcgttacagggggat

SEQ ID NO: 3661 - DNA, 2054 bp, Zea mays
gcacgagaccattacctagaacatcctaatcgaaaattttcaaaattgtttgagttaaattacacacttatctttttatcttttaaggaaataagtgtaatcttaaatttagcattcttaatggatttcatactaaaatgtgttatcttgcaggggcatatgtatttatttcttcaccatatatgcttctactctaacatatttggatatgagactaagaaaacaatacctttgcaagaggtaacagatgttcgtaaagcaaagacggctgccattttttctaatgccattgaaattgttgctggtagtagaaggcacttctttggatctttcttgtcacgtgatgaagcctatcaaattatagtagatggctgggaacaacatgttagtaatgcaagattgctccttgaacgtcaggagacaaagtcagctagtagcagtgaagaaaatggttatgttttattggaaggagcaaaggaacctaaacaagatgaagattcatcaccgctggacaggtctgtcaatagtacggctgtctccagtggtagtgctgatggtggtgattcgaacatcaacatttccagaaggttttcaaatgttgaggagaatggactcgaagacaacatcatcacactaaacccattcaatttggagccagttgatgatactcctagtgtacctgaatcttacactacggtcacggagtcaaagtttcaggtgcctgtggaggttctttttaatttgttattgtctgatggtgcttttggctttttggatgatttccacaaaaattgtggtgacaaagaatttagttgctccaaatggcgtacagatgaacaagggggacttgtaagggatgtctcatttttgcacccaataaaaatttatcttggtgcaaaatttgggacttgtcaagaggtccagaaacttcgtctttacaaaaacaggcgtctagtgattcaaacctctcagtcaataggtgatgccccatatggggaccatttcactgtagagggcatctgggatgttgaacaagatagcctagatgagaactgttgttacctcaggatatatattaatgtagccttctcaaagaaaacaatatttagagggaaaatagagcagtcaacaaaagatgaatgccgagaagttttcagtctctggattaagctcggccatgatcttttgaagcaggagtgtgatcgatcaaaaggcacttccagcacaactgattctggtgctcaatcaggggctataacgaacgaggaaaataccggggaagtagcagtacccatggtgagtacctcacaggatgtatctggtgcgaggagcctcattcctccttttcaagatccccagcagagaacaggaagagattcttccatcgggtccacttcacaagaactgtggggttcactaacgtcacacatgagatcaagccaacttggtccagtactagcagtggcgctggtggctatcattgtcctattgcaggtaaccatcatagttctgctaactaggtccccccaggtccagatggctcctcacgggatctcgacgggcagtttcgggtacagcaaagaaagcatggagtgggcgcagaagcgcctcagcctactcagggaggagatgcaggtggctgaggcgcacatggagaggatgaggcacgagtttgcctggctcagatcttacctggagggactggagaggctgaggcgccgcacatgaccgcagcgcgtgtacacgacaggggcacgattccgcgatgcggattcgttggtatacagtacgaactcggagacgttgttcaggtttcttcttcttctgtgttgctacagaccgtacagatgcaaacggagagctggtgccgtggtggtggtgttgcagaggtattgccgtaaggcagaactgccagatcccggtacagcattcaatgtaaatagctgggggacgtgtcattgccatgacgatacagcggcgtgatgttagaaacctcgcactacttttttttttcagaaagtaaaaaactttttgtggttaaaaaaaaaaaaaaa

SEQ ID NO: 3662 - DNA, 2166 bp, Zea mays
  misc_feature (25)..(25): n is a, c, g, or t
  misc_feature (30)..(31): n is a, c, g, or t
  misc_feature (38)..(38): n is a, c, g, or t
ctctaaaactaatggtcccccccgnctgcnngaattcngcacgagctcactagtccccccccccccccccgaacgtcaggagacaaagtcagctagtagcagtgaagaaaatggttatgttgtattggaaggaacaaaggaatctaaacaagatggagatttatcactgccggacaggtctgtcaacagtacagctgtctcaagtagcaatgctgatggtggtgattcgaacatcaacatttccaaaaggttttcagaagttgaggagaacggacttgaagacaacatcgtcgcgctaaacccattcaatttggagccagttgatgctcctcctagtggtttgttgccatcttcatcattcctattcatttgtatatcattaattgtttgctagccactcgttacatgatttgtttttactaagtttccatcatgccttttctcacagtacctgaatcttacactatgatctcggagtcgaagtttcaggtgcctgtggaggttctctttaatttcttgttgtctgatggggcttttggctttgtggatgatttccacacaaaatgtggtgaacaaagatgcctgtggtgcttctctttaatttcttgttgtctgatggtgcttttggctttgtggatgatttccacacaaaatgtggtgacaaaggttgatgccaatatataatttcattactcatgaatatcttttggtctttagaagtattttgagttttgacctggatgacctgcagaatttagttgctccaaatggcgtacagatgagcaagggggacttgtaagggatgtctcatttttgcatccaataaaaatttatcttggtaagtcaagtgctttcagttaactgaagaaattggttggcattgaatatgacatgggctatgacttgctttacattttcttatattccattttgattacactaaattttctttaggtgcaaaatttgggacttgtcaagaggttcagaaacttcgtctttacaaaaacaggttagtctaagatccactgtctgccagttaagttgcgtctttactgagcttttggtcattggggaataaagaatctgtttggtttgctgcctcagttgccatagtttgccacgtctaaggttaggcaggtttgaccggcttgcgtgtgtgtttggtttgtagccacacttgtggcaagttttttctcttgcgtaagtctcactcgtcaatgacttgtaaaagtgtgatatgaatcctttaggcatatgccaagatgtggcgaagaatttgagcgcctaaccttaggcaagtgtggcagaaaatatgtggtattttttggcatcttaagtatacaaccaaacatgctatttttttgagacgtagaactagcaattattttagtgtcctctttttgtcgttttaatcaaacttagttctgtacctgaacaaaattcatgccttaattccttatatttggattttggcccaattaggttgccttcttggcagttgatggctatgtgcatgtcttagctttctaacatgatgtcctgtgccatcttctgtgttaagatattatccatttggcgtccagagatgatcatgctaacagtgatctgttgctagtcctgttcattctgctgcatgcttgtttattgtagtaatgtttcccttccgaagaataattgatgttacagctccctgcaattaacttctttcacttgtttgtaggcgtctagtcattcaaacctctcaatcaataggtgatgccccatatggggaccattttactgtagaggtgagtaatccacagtgctgtttataatgttgatttttatctagcttggacaagcagacctggtgcagtgatgtctcattgagtcagcaagtcatgggctcgaagcagcctctccacatttgcgggggaaaggcttgcctcggtctatccattccccatatctgggagcctgcggcactggatcagcccttttttgaacttctgttgttatatcccatattaacattgatttgcccttagtcttactcttgtttgatcttattttaccttcagggcatctgggatgttgaacaagatagcctagatgagaactgttgtgacctcaggatatacatcaatgtagccttctcaaagaaaacaatatttagaggtaatttac

SEQ ID NO: 3663 - DNA, 2114 bp, Zea mays
ctcgagccgccggaaaatccagcaccctgcaccctcttcctccatcgcaccctatcctcctcctccccggtccggcggtccccaccggtccaccacggcaccaccgtctccccgccccccgcgtccgatcaccgcaccggcgaactcggcgagccgctcgtcgctgcacgctaagctgggaatggccgctgcgctcgccagctcaccgcttgttcacctatccacctcccgcctccgcctccccaggccccgggcctccgcctccagttccgctccaggctgctcgatcggcgtgtgcttgggatggaggctgaaggtcgggtggagggctctgaggcggtgcgaccggcttcgatgcttctccaccgacggcgacggcgtggaggagggggagaagcgtggcgaggaggaggcctcggcgacggcggccccggccccggacccagccccagcggagacacaggtgggcgctgcggaggagctggcgtctgagcggagccgatcagggagcttttcgtcctcatcctcgtccgggaatcctggtgtatcaagcgagccaccactgttgagttttagtgttgataatatcgatacagttaaactattggaacttctaggcccggaaaaggttgacccagttgatgtcatggcaattaaggaaaaactctttggttatacgacattctggttgacaaaagaagagccttttggtgatctcggtgaaggagtccttttcattgggaatctccgtgggaagagggaggaaatctttgcaaaacttcaaaggcaactacgcgaacttgctggtgaaaaatacaatctttttatggtggaggaacccaattcagaaggggatgacccacgtgggggaccacgtgttagttttggtttgcttaggaaggaagtttctgagcctggacctactaccctatggcagtatgtcatttctctgtcacttttccttctcactatgttctcctgtgttgagctaggaattgcatcaaagattagcagtcttccaccagaaattgtttcatatttcactgatccaaattctactggaccccctcctgatatgcaacttctgctcccatttgtggaatcggctttgccagtggcttacggtgtcttggctatccaattatttcatgaaattggacactttttggcagcatttccaaaaatgtgaaactaggcattcctttctttattccgaacttcacccttggaacttttggtgcaattactcagttcaagtccattcttccggatcgaaagacaatgtttgacatatcaatggctggtcctgtggctggagctgcactttccttttcaatgttctttgtaggcttattactctcttcaaatcctgttggggcaagtgatttagtagaagtacctagccagctgttccagggttcattattgcttggactcattagtagagcaacacttggatacagagctatgcatgctgctacagtttcgatccaccctctagtgattgcaggctggtgtggtttaactactactgcatttaatatgcttcctgttggatgtcttgatggtggaagagcattacagggtgcttttggcaaggatgctttgtttggatttggcctcacaacatactcgttgcttggactaggagtgcttggaggaccactgtctcttccttggggtttgtacgtgctaatttgccagagaacaccggagaaaccatgcttgaacgacgtaagcgatattggaggttggaggaggacggccttgatagcttcagtgtttcttgttgttttgactctcatcccgttgtgggatgaactcgcggaggaactaggtgtagggcttgttacttcgttctgagatacggtccttaccgatagaattaggccgtgatgtagctcaattttgtattgaaatgtagcgtcccatagcgggactgctgtaaaggcatgtgcagtttcctgattaggtgagcaatgatatcacctatgcgagtgtcatgaaattgtgccaagacgctgacgattattatcaattacatacatgtacgcacattttgaccatacgagtacagatacacacaacctacccttctaaaaaaaaaaaaaaaa

SEQ ID NO: 3664 - DNA, 2143 bp, Zea mays
tggaaagcatcgccggctcgccgccaaactcgctgccacgtcggtccgagccaaatccagcacctctctcccctcccccttcctcccgtcccccgtcgacagtcgcatcgcaccctatcctccccagtccccaccactccaccaccctctccccgcctcccgctgcgaccaccgcacccgcgaacttggcgggccgctcggcgctgcacaccaagccggggatggccgccgcgcttgcgagctcgccgcttgttcacctaactacctcccgcctccgcctccccaggccccaggcctccgcttccagttcgggtccagtctgctcgatcggcgtgtgcttgggatggaggctcaaggtcgggtggagagccctgaggcggcgcgaccggcttcgatgcttctccaccgacgggggcggcggggaggagggggaaaagcgtggcgaggaggaggcatcggcaacggcggcggcatccccggcctcggttccagcggagacacaggtgggcgctggggaggagctggcgtccgagcggagtcggtcagggagcttttcttcctcatcctcgtcgtccgggactcctggtgtatcaagcgagccaccgctgttgagttttagtgttgataatatcgatacagttaaactgttggaacttctaggcccagaaaaggttgatccagttgatgtcaaggcaattaaggaaaaactctttggttatacgacattctggttgacaaaagaagaaccttttggtgatcttggtgaaggagttcttttcattgggaacctccgtgggaagagagaggaaatctttgcaaaacttcaacggcaagtacgtgaacttaccggtgataaatacaatctttttatggtggaggaacccaattcagaaggggatgacccacgtgggggaccacgtgttagttttggtttgcttaggaaggaagtttctgagccaggacctactacgctatggcagtatgtcatttctctgttacttttccttctcactatgttctcctgcattgagctaggaattgcgtcaaagattagcagtcttccaccagaaattgtttcatatttcactgatccaaatgctactggaccccctcctgacatgcaacttctgctcccatttgtggagtcggctttgccagtggcttacggtgtcttgtctatccaactatttcatgaaattgggcactttttggcagcatttccaaaaaatgttaaactgggaattcctttctttattccgaacttcacccttggaacttttggtgcaattactcagttcaagtccattcttccggatcgaaagacaatgtttgacatatcaatggctggtcctgtggctggagctgcactttccttttcaatgttctttgttggcttattactctcttcaaatcctgttggggcaagtgatttggtggaagtacctagtcagctgttccagggttcattgttgcttggactaattagtagagcaacgcttggatacagagctatgcatgctgctacagtttcgatccaccctcttgtgattgcaggctggtgcggtttaactactagtgcatttaatatgcttcctgttggttgtcttgatggtggaagagcattacagggtgcttttggcaaggatgctttgtttggatttggcctcacaacatattcgttgcttggactaggagtgcttggagggccactgtctcttccttggggtttgtacgtgctaatatgtcagagaacacccgagaaaccatgcttgaacgacgtgagcgatgttggaagttggaggagagcggccttgatagcttcagtatttcttgttgttttgacgctcattccgttgtgggatgaacttgcggaggaactaggtgtagggcttgtttcttcgttctgagatgcggtgcttaccgatagaattaggccgtgatgtagttcagttttgtgttgaaatgtagcttcccacggtggaattgttgtaaaggtatgtggaatttccggattaggtgagcaatgatatcgcttatgcgagtgtaatgaaattgtgccaactgccaagtatagactttaacgattaccaattacatacatgtatgctcccttacccataaaaaaataaaaaaaaaaaaaaaa

SEQ ID NO: 3665 - DNA, 995 bp, Zea mays
atcttacatttcagactctcaactccaaggttccttttttttctcgatactggaagtgccgtcatgagcaatcatggacgtgagcggagcaaactgaggaactgcgaagaatggactacggcccgaccttaatggcgttagtccaatcgaacacatttcctgtttacgaaacaaactgaaaagacaatgaagtgaaaagtttatagaaacaaattgaaaagatagttgtttagcagtacaaaattcttatcataagctctgaaaattcttatcataagatagttgtttagcaatacaaaataaagatctactcagcctaatgtacaataaagaccaagcaaatttttattgtgctaaaacaacagctgaaagttcaaaggacatgggcaaaagagaatgataccggaggcaaggatgctccatattctgtatcttcctcgagttagtttaaaaagacaaagatcagatgattcatttaactctatatggtgtgataagtttgacatgctaatctgcattgaaagatgatggtccaaagctaccctcttccgccgaagttctcgccacattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaacttatatgtgaacttagatctctgtgttgaactgattgtgtgaacttgtctttgtgaaacttttgtgtgcgaacttgatggctatgtgaaactgttgtgtgcgaacttggtggctttatgaaactgctatgtgaagatttgatgtctttgtagaacttttatgtgcgaattcgatgactttgtgaaactgttatgtgtgacttgcctttgtggaactgttatttgtgagcttaatagtttctgatagttgtaaattgttcatgcttattttttagcag

SEQ ID NO: 3666 - DNA, 4244 bp, Zea mays
  misc_feature (940)..(940): n is a, c, g, or t
  misc_feature (1071)..(1071): n is a, c, g, or t
gaaataaggaagcaaaaggatataaacataaggttgtgaagttttaggatctactcagcctagtgtacagcaaatggtcaggcaaatggagagggtgctaaaacagcagctgaaagttcaaaggaaatggcaaaagagaatgataccggaggcaaggatgctccatattctgtatcttcctcgagtagtttaaaaagacaaagatcagatgattcatttaactctatgtggtgtgataagtttgacatgcttacatctgcattgaaagatgacggtccaaagctaccctcttccgccgaagttctcgccgcattacaagaggttgagggacttgatgaagacacagaacttgagctttatgacatcctcacctctaatgcacgcaagtttgagtcgatgatggcactcccaatggaaaggaggaagaggtggcttatgatgcagctaaggaagtgaaacaacttatatgtgaacttagatctctgtgttgaactgattgtgtgaacttgtctttgtgaaacttttgtgtgtgaacttgatggctatgtgaaactgttgtgtgcgaacttgatggctttatgaaactgctatgtgaagatttgatgtctttgtagaacttttatgtgcgaacgcggccgcctccgctcgatgactttgtgaaactgttatttgtgaacttaatagtttcttatgatgatagttgtaaattgttcatgctcatttttaagcatatgcaaagtcaagagatccttgtttgtattcaaattccgtgtgcaaagtatccaaacaacatctagaatttaattctaggaattcaattgattgtacaaccaaacaaaaataatggaattcaatcactttctagtcgattgaattctatataattcatttcttggaatttatttcttggaaaaggtttcatttctaggcatccaaacgngctataggaatctaatatctagaatgttattcgtggaatgagtttcatttccaaggaaacaaacgagccataaaggaaaatttactacgtgagactttggaacagagtattcaatcccatcaattcctttnaaattcctatggattgctttcctccatacaagttttgtaggaaaataacaagaagtccaacctcttggaaaatatcctatagctcttatcactctactcaaattcctgcatagcatccaaggactaaggcttctttagagcgcaaaattttacaacaatagtataggaattttacagaaattagtttaaaaacacaggaaaaatacatgattcaaaaaataatccttcgatctaaaggagccctaaatgagaatttttcctataggattgcaaatcataaccaaccctaatatgtgtttgggccttacttcaatttgtattacttttctagaatttgtatgaacccatattttgttttactaattctgttttacgaattcatgttagttgtacttgtgacacgttgtactatgagaaactagtatgttccaaaatttaatagctgattaagggcatgtttggttccattaatcttaggactaaagtgtagtctctaccctacttggttatagagactaaatagattctaaatacattaactacaacacataaagaccaaaatactccttttcttgtttgacaccagttttctaggcaagggtaattagagtaaatgttgtcctttagcccattttagcacccatgtgagggactagagactaaaactaattagtccctaatctagtttagtccttccgtttgacaaaataaagactaaaggggactaaaaccaggtactaaaaccaaatgggacctaactagctttaggagaacgttccaatcactgttagctggctttcttttgtctgaagttccaaaccgtctcttatattgaatatcaactaaacagacacatcatcgcacacatcaaaacaccacaaatgaaggaacgtcgcacaactgttttgttgtcttgttcacctttcttatcgttcaactaggaagctaataataaacttgacagctcctcgtccgtcagcaccgagggggcaactttcacttgctgtactacaaagccggcctcctggcatcccttgcggagacgctccacctgcgaatccccatctgggcacagcgccaccactgcgcctccgctgccagtgaacttggacgctgcgcccacgctgcgtgccacatccaccatctttatgttcaatgcaccaagtacatcatctccaaacatctccctacaaccacataaccgataaccacgtatgaatattgtgctaccttgccattccatgcatgtgttggggcaggcacattgatcttaccttcgcagatcaaaattcttattcataaatctcgctagctcagtataatccttctgcagcaaagccttgtggccatcgagcgctagctgcgctacttccttcatacgtgatgttataaaatcatcacctgacagccatctttgtctaacagtgctgtggacctacgttaaagaaccatagatagctgttaattagcaggactcaaacatctctcaatattattccgtgccatgtgacaagattaaagattggattgcagtttatatatagatttaattcggcgagaaccttgccagagtcactggggttatcggcatagatgaggtatagaggaggaagcagattgacatccaatggcatgtatatgccatgacccagcttgtccatatgaccctggctaaaatcctgagtgatacaaacaaaaacgttagcaaacagagttcaaactagctagcaatacttatgcaactattacatgcttgtattagttcacactatctagaagtatgtttgcaagaactatactgccaataatgaatgcttttatcacataccatataaactagtccaccataaacctgtgccactcggtcctgaagtccagcaacaatcccaagctctttctcagcattgagaatcagattaggtctcatttcaacttttattagatgtctgacattatagaagtcaagaaggcagcttagagcagcacaaacaatcgcgctcgaaccagacagcccagactacagaacaaaagaatcaagataatatccattcaatctccaacccatcagcatatcaagaaaatgctatagcaaggattaatctacagctgccaatatgtgatgcgagtaaaagggtgaaacaaatggagtggattctgactagttacctgccgaggaatattagtatcgtatgataaggtgaaattttcagcttttaaactgatgttattttgaacacaatagttgtagaaaactttacagatagccatcagcagccggacgcctccataatatccttcactttgcaaacggctcacctaaaaggtaaaaaaattaataccaacataggctatttgttcaaataatggtaggtagtgatagttaaaaggattgaacttggcatatttcagtgtaatgttcatgccggcaatctccttccatagttcctcttaaaaatagtgaaatgtgttgatgtttcagcaagattgtttgcctctgaacatatttcttcctaaccaaacacaacctgattcagtgttttgctcttgtatttagactatgttgctaattttgtattgaaaactgttcaagaagaatttgccttgcaccaaaaattttagaaagaccctattcactgtattgtaagctatgattactttcttctttggcatacaaggggtgggtgtcctgaattcataattagatacatcggtgtgcaacttgttcctttttggctcttatggattccacatattgaaaatgtgcacataagagagatgcacaaatacattgtatgattgggtttgctcaacagaattgcagtgcttgctgtgatgcatgatggtcatcttgtttgatttggacatttggtgggaagaggatgttacactcacacatatactggatacaatactcagagtagattcagagtaaggaggaagaaggcaggaagcagagagcacaatgtcttggagaggaagatgagttctgattattcgctaccctccccagcgtacatatcgctctcacgcgcactcgctcagcccattaacccaaaccggcccaaacgtcttcacgcttctcttccttagctttcctgtacgcctcggcccgtctgcgactagcccctccggcacgatcccccctcccgctgattgcccccaaacaaaaggat

SEQ ID NO: 3667 - DNA, 1468 bp, Zea mays
ttttttttttttttttgttagctggctaactattatctgaagttccaaaccgtctcttatattgaatatcaactaaacagacacatcatcgcacacatcaaaacaccacaaatgaaggaacgtcgcacaactgttttgttgtcttgttcacctttcttatcgttcaactaggaagctaataataaacttgacagctcctcgtccgtcagcaccgagggggcaactttcacttgctgtactacaaagccggcctcctggcatcccttgcggagacgctccacctgcgaatccccatctgggcacagcgccaccactgcgcctccgctgccagtgaacttggacgctgcgcccacgctgcgtgccacatccaccatctttatgttcaatgcaccaagtacatcatctccaaacatctcccttcgcagatcaaaattcttattcataaatctcgctagctcagtataatccttctgcagcaaagccttgtggccatcgagcgctagctgcgctacttccttcatacgtgatgttataaaatcatcacctgacagccatctttgtctaacagtgctgtggaccttgccagagtcactggggttatcggcatagatgaggtatagaggaggaagcagattgacatccaatggcatgtatatgccatgacccagcttgtccatatgaccctggctaaaatccatataaactagtccaccataaacctgtgccactcggtcctgaagtccagcaacaatcccaagctctttctcagcattgagaatcagattaggtctcatttcaacttttattagatgtctgacattatagaagtcaagaaggcagcttagagcagcacaaacaatcgcgctcgaaccagacagcccagactacagaacaaaagaatcaagataatatccattcaatctccaacccatcagcatatcaagaaaatgctatagcaaggattaatctacagctgccaatatgtgatgcgagtaaaagggtgaaacaaatggagtggattctgactagttacctgccgaggaatattagtatcgtatgataaggtgaaattttcagcttttaaactgatgttattttgaacacaatagttgtagaaaactttacagatagccatcagcagccggacgcctccataatatccttcactttgcaaacggctcacgagttgagggagagaggggaaggcgacgaggtcgtggtgcggatgcggctggatgagcagctcgggcgaagggcggaggtggacggtggcggaaaagtcggcgatggcgaaggacagggccctgccgccgtacacgtcgctggggttgccgaggagccccaccccgcgcgtacgcccgccgctccaacaccatctctgccgccgcttccgccgtcacggccatgtcttcccttctcttcagtcttctctcctcttccacagatgagacgagaatactcgaactct

SEQ ID NO: 3668 - DNA, 1334 bp, Zea mays
gaagttccaaaccgtctcttatattgaatatcaactaaacagacacatcatcgcacacatcaaaacaccacaaatgaaggaacgtcgcacaactgttttgttgtcttgttcacctttcttatcgttcaactaggaagctaataataaacttgacagctcctcgtccgtcagcaccgaggggggaactttcacttgctgtactacaaagccggcctcctggcatcccttgcggagacgctccacctgcgaatccccatctgggcacagcgccaccactgcgcctccgctgccagtgaacttggacgctgcgcccacgctgcgtgccacatccaccatctttatgttcaatgcaccaagtacatcatctccaaacatctcccttcgcagatcaaaattcttattcataaatctcgctagctcagtataatccttctgcagcaaagccttgtggccatcgagcgctagctgcgctacttccttcatacgtgatgttataaaatcatcacctgacagccatctttgtctaacagtgctgtggaccttgccagagtcactggggttatcggcatagatgaggtatagaggaggaagcagattgacatccaatggcatgtatatgccatgacccagcttgtccatatgaccctggctaaaatccatataaactagtccaccataaacctgtgccactcggtcctgaagtccagcaacaatcccaagctctttctcagcattgagaatcagattaggtctcatttcaacttttattagatgtctgacattatagaagtcaagaaggcagcttagagcagcacaaacaatcgcgctcgaaccagacagcccagactgccgaggaatattagtatcgtatgataaggtgaaattttcagcttttaaactgatgttattttgaacacaatagttgtagaaaactttacagatagccatcagcagccggacgcctccataatatccttcactttgcaaacggctcacgagttgagggagagaggggaaggcgacgaggtcgtggtgcggatgcggctggatgagcagctcgggcgaagggcggaggtggacggtggcggaaaagtcggcgatggcgaaggacagggccctgccgccgtacacgtcgctggggttgccgaggagccccaccccgcgcgtacgcccgccgctccaacaccatctctgccgccgcttccgccgtcacggccatgtcttcccttctcttcagtcttctctcctcttccacagatgagacgagaatactcgaactctagtcgttaaggtcgtagttatcagtttattacacaacggaccgggccgggctt

SEQ ID NO: 3669 - DNA, 1082 bp, Zea mays
cgcccaggagccttatcctccatctgtcgacatgctcatcttctctccttcgtccgttcagccggcgcaagattttcctgtgtcttagttgttctcatcctctccttagccgccgtacctcactgcgtgatatttttgccgccgcccctgttcgctttatatgcgcgctatgcgtgctcgtgcggcagattgctcggctgtttcgggcagatgctggggcactcgattccctagcgcccagacttccttcttctccctgaagctcgcctaagctcggccgtcctccaagtttcgcccagcccagtcgttcctcctatgctcggcgccggatttctgctcgcccggctctgctccttcgcggcggcagcttgggccaggatgtcagtattcctgtaggcgacctggagttgggggacgacaggagagcaggaactgatgaagtgatgggccggcgaacaaggaagcccaatagcaaatggtccggtgccgagtggatccgttgaagggtgggccggcgcttaatagctggttgtaataaatagtagcacttgtactgagaaagacagctttgggaataaaaatacagaactcacctctccttcttggttgtcttctccctctcgtttcctctctgcaacgagcagcgttcgccatcaggtggaggacgctgacaattggtatcagagatctggttccggccctggcgacgaccttccactacaccaggagggctaagatgtcgggcgcagcagaccccggcgttgcggcggcaatagccgcgcagtccaagtccattgaggcccaatcgaagacgctggcgacgcaatcaaggctcctgcagcagatgtgcgatcggctggagtctactgaggagcgctggaagcaattggagtctaccgtggggaagaactccgagaatattgcatcattgtctgccaaatttgacggggtggaaggtgttctgccccgagcggacctggggcgcgacttacgggcgcatctcgacggccagatggcggagatgcaggcggtggcgatggaccgtctcgacgcgctggcggcggatgcatcgggacgtgtcg

SEQ ID NO: 3670 - DNA, 2234 bp, Zea mays
  misc_feature (598)..(598): n is a, c, g, or t
tgtttccccccttttaatacaaatgactgccaaatacatatagatgaaagaatactcccctaggaacacctatttacagagttaactttgacttcaattccttgtggatcttgtgtctattcaaaccagctagagcaatatagagtttaagattggcaatttgtcatttgagtgaatcaacatattttttttccaatgaaatgcaacttttatccgttccaaacaggcatgccaatgagcgtgttgattctctaagattttgaattggctaagattacatgcactgttcaagcgatctactgtttgttcagcttcattgccttctatttcacgtcaattctgttccttctgggagagctctcctgccaagtttgatattaagatgtatgaatcacaacaatggaagatggcctcttgtatgagtccttcgtttcagaatttattacttgtttatgttgttgggctgttgataaaattatatggtctgatcttttcctgcatatctctctcccatggtcccaccaactaatttcctgagttcagttaataaactaatgagttattaaatgtggagagtatctttcaagtagcactactnatttattttgctaaccggatcatctaacatgtctcatgcctaatgctgggccttataaggcctaagaataaaaatagctgttgctatatgattttctattgagaaatcaccagtgccaaaatctagattctgtttttcattttccccctttactgaagcagaaactgcaggcaagtccccacgtttagttttcagtcttatttacagtgctgtaagccgtgtttaacagatgggtactgcttgtttcctcagcttgagtgccctgcgccgctgctgctgctgctgccgccgccgccgcagccaccaattctgcttctgccaccaaagagctgctgcgctggctgttgtgttgctaaggtgccatagagcatggaagccgtagaaggtgctacgtaggcatggaataaaagatactatcgtcctgttatattcagatggttgcttgaacttgcttgactcaatgcttgagtggtacctcttcactatggggtctctctctccccctgtgtgtggttatgtatttgttgtcataaagatgattttgactccagctaatctggtgtctgcgctattggcttccctttagcgccacacgtttgttgtatggatacttttttttgagccaatgtttcgccacgctttgccgctgtttcaaacaggcaccacctgaagacattctgatgtgcttgtgatgcttaactaggaatacagtgccaggtaccaagctgattgaaacggcaaggtatctgaaaggttgggtgatgatgaggccttatgccaagcgtgccattctgttgctgctcgaatgcgtgcggtctacaggtaagcgattttaagggcatgtacaacggccatgtacaattggttttctatgtacaagagacatttaagaaactgtatcatacagtggagagttcttaaaatcagtcatatcagacagactctttgcgaagaacacatctcttatattttttatatttaatcctctagagactcctcaagaaacaaggtattaaatggaggttgtatgcccatgagctctgtggacacacattcagacatgccgcagcggttttatgggtagcctgcttgacgcccagttgcgccgcctaagcatttgacgattggggcacgttctgggaaatgctatgcttggatttgtgatagtaaactagattagcatgccgtttctctgtgactgagcttcgtttgcagctactggatttcaataatgattatgagattgtattgctgtagtaatattgcagcgccaattttataacttgttcggttattcccaatacacatggattggatgagattagaaaaaaattaaaaagaagtttgatttatttgggattcaaagccatctaatctcactcaatccacatggattgagagctaactgaacaagccctaacttggttatcactagctgcagcagtagatttggtcacaggagacaacaagcacggtcagggccatttgacttcgcctttgttttttctgtctcagcaaagagcaggaaggatgagctcggaatgctctgctcctctagcgcgggacatatcttggataaagcatatgtatagcactaacataataacaattaacatcaaagttttagattggacag

SEQ ID NO: 3671 - DNA, 2331 bp, Zea mays
gtaccatatatacgcacatcatcgacctatatatatacagcgataccatgcatcacgccgcttctgtggcggtctttttttgacgacacatacaaatacacaaaagagttcattcttatatacgtagtacgtacacatccacacacacatgcaaacgacgtctagcatttccgtgtatgttacatcatacagacacgagtacacgacagtagtggcatccacaactcatgggcggctagcatgcatgcatgcatggccaaacggcgatgcgtggtgcagctgggcgtgcagagcacacgtacgagcgatgtcgtactgccacgctacctgacacgcgcacactgtagccatgcatgcgcgcgtccgtccgcccgtccgatcagaacgcgaggtttcgcggcttcactgcggccagcagcggccgatccatcaccaccgtgaactccaccttgtccttgaagtccagctgcggctgcgacgggtgcgcgcgccactcgaacgcctgcaccatccgcgccaccatcagggcgatgtgcgtcgtccccatggcaagcccagggcagatcctccgccccgcgccgaacgggatcatccggatccccgccgaccccgtcatgtccgccgtctcgccgccggacacgaacctgtccgggtcgaactccgtcggccggtcccacagctttgggtcctcggagatggtcgggaggaagatgtccaggttcgcgtccacgggcacgtcgtagccggcgagcttgcatcccggctgcacagcggcgtgggtgagcgagaagtacgtgggcgggtgcttccggagcagctccttcacgaaggcctggaggtacggcatggcgtcggtgtccttgtcgtcgaccggccgcgcgtcgccgacctgctgcatgacctcctcgtggagccgtgcctggatggacgggctgtccacgatgcgcgccatgccccactcgatcgcggtggccgtggtgtcggtgccgccattcaacagctccgcgcagagcgtcaccagctcgtcgtcggtgagcgcgccgtcgtcgcggccctcgatgcggaggtcgagcacggagtcgaggtacgagaagggcgctgcgacgctggggtcgggcggcggcgatgagctctgcctctgctgcatgtcgcgaagcattgcgcgccgcctgttgatgagcgggagcagggtgtcgatctgctcgcggcggacggcgagggcacggcgctggtgccgccagaagaacgggcggaggaacgggaggtagtcgtccatgcgcacgccgacggcgagcagcacgcgcttcatgacggcgtcgatgcgcacgatgtgctcctcgcggaggtccagcaggccgaaggtcatgtccagcaggatgcagaacacggcgaagcgcgcgttgcggagcacccagacggacgcgccgtcgggcgacgccgcggcctcggcgcgcatccgcgacacgaaccggtccatggcgcgcctccgggcgtgccggaactccctgagccgcgacgtgctcagcatcccggacaccatgttccggcgcagcgaccgccactcgggcccgtacaccgcggagttcacggtgagcttgttggacgagaagatgttgcgcgtggtgttctcccggggccggctcgcgaactcccgccctttctccaccagcgcctcgtgcgcgagctcggcgctgctgatgatcacgagcgtgcgctcccccatgcgcagcgtcaggatggggccgtactccttgcggagctcgcggatgtagtggatgaagagcttgccggagaacgccacctggaagaggttgccgacgacgggccacccgggcgggcccggaggcagcctcaggcccatgtatctccggttgtacctcgtgacggtcaccgcgacgcccagcgccgcgatcgccgcgaccgccgtgaaggcgagctgcagtgacgagagcgacaatgacgcttccatcgcggcgtgaagctgggtggcggcgctcgtcggctcttgcatggacatggacggcacgataaatgcgaagccccgacgaggtggtctgtcgagcatgagttggttcccggcccggccgccccgcagccgccctagatatagcgctccggtgacggggggcggagtaaatgcgaggtggaaaatgtgggtgggacattcaatggcgatctccggaaccggggcagctagctgaccgaccacactctccatactcctacgtctacgtgtgcagcaccggcgccctttgccttcccgaactagagacggcgatggtcatcgatccccaaatccgcacggtgaatttctctattagaaaaacgagg

SEQ ID NO: 3672 - DNA, 2476 bp, Zea mays
cgccgcatgacgataccttcgagttgcacccacggccacaggtcgtcgactcgtcgtatggcccgagcaaggggggaaaagatgacgggccacaagaacagggacaaggatagtagaagccctccagcctccaggagtaaagcgcgtggatctgatctgccgccgttgacgcaattcaattagatatataaattataagattggattaactaaaaatggatacattattggtcaaactttattagtcctattttgatcgatagtcaaaatcatagatgacgtacgtattcaattgatatatactcctatatatataatagataatgccttatggacgtaacgtacgtgtgacatttgagaacacgaagccacgacccatgtaccatatatacgcacatcatcgacctatatatatacagcgataccatgcatcacgaatgttctgtggcggtcaactgatttttttttttttttttgcacaaaagagttcattcttatatacgtagtacgtacacatccacacacatatgcaaacgtctagcatttccgtgtatgttacatcatacagacacgagtacacgacagtagtggcgtccacaactcatgggcggctagcatgcatgcatgcatagccaaacggcgatgcgtggtgcagctgggcgtgcagagcacacgtacgacggtacgagcgatgtcgtactgccacgctagctgacacgcgcacactgtagccatgcatgcgcgcgtccgtccgcccgtccgatcagaacgcgaggtttcgcggcttcactgcggccagcagcggccgatccatcaccaccgtgaactccaccttgtccttgaagtccagctgcggctgcgacgggtgcgcgcgccactcgaacgcctgcaccatccgcgccaccatcagggcgatgtgcgtcgtccccatggcaagcccagggcagatcctccgccccgcgccgaacgggatcatccggatccccgctgaccccgtcatgtccgccgtctcgccgccggacacgaacctgtccgggtcgaactccgtcggccggtcccacagctttgggtcctcggagatggtcgggaggaagatgtccaggttcgcgtccacgggcacgtcgtagccggcgagcttgcatcccggctgcacagcggcgtgggtgagcgagaagtacgtgggcgggtgcttccggagcagctccttcacgaaggcctggaggtacggcatggcgtcggtgtccttgtcgtcgaccggccgcgcgtcgccgacctgctgcatgacctcctcgtggagccgtgcctggatggacgggctgtccacgatgcgcgccatgccccactcgatcgcggtggccgtggtgtcggtgccgccattcaacagctccgcgcagagcgtcaccagctcgtcgtcggtgagcgcgccgtcgtcgcggccctcgatgcggaggtcgagcacggagtcgaggtacgagaagggcgctgcgacgctggggtcgggcagcggcgatgagctctgcctctgctgcatgtcgcgaagcattgcgcgccgcctgttgatgagcgggagcagggtgtcgatctgctcgcggcggacggcgagggcacggcgctggtgccgccagaagaacgggcggaggaacgggaggtagtcgtccatgcgcacgccgacggcgagcagcacgcgcttcatgacggcgtcgatgcgcacgatgtgctcctcgcggaggtccagcaggccgaaggtcatgtcgagcaggatgcagaacacggcgaaccgcgcgttgcggagcacccagacggacgcgccgtcgggcgacgccgcggcctcggcgcgcatccgcgacacgaaccggtccatggcgcgcctccgggcgtgccggaactccctgagccgcgacgtgctcagcatcccggacaccatgttccggcgagcgaccgccactcgggcccgtacaccgcggagttcacggtgagcttgttggacgagaagatgttgcgcgtggtgttctcccggggccggctcgcgaactcccgccctttctccaccagcgcctcgtgcgcgagctcggcgctgctgatgatcacgagcgtgcgctcccccatgcgcagcgtcaggatggggccgtactccttgcggagctcgcggatgtagtggatgaagagcttgccggagaacgccacctggaagaggttgccgacgacgggccacccgggcgggcccggaggcagcctcaggcccatgtatctccggttgtacctcgtgacggccaccgcgacggccagcgccgcgatcgccgcgaccgccgtgaaggcgagctgcagtgacgagagcgacaatggcgcttccatcgcggcgtgaagttggcttgcggcgttcgtcggctgttgcatggacatggacggcacgataaatgcgaagctccgacgaggtggtccgtcgagcatgagttggttcggcccggccggcctcgag

SEQ ID NO: 3673 - DNA, 1858 bp, Zea mays
tttttttttatttttttgagaggaaaaattccgtatataagttaaagccatgtcaaacagacaaacatccccttagaagcttttttgcgtctttgttttcttgtgtgatctcgaatgttgtctgaatcaaggtctagttaaacggctgaagcattactacaatgttgacactgctacctgtctgtaccatctaaagactaaacaattgtataagttacagaatgcgtgattgcaagataaacccccttccgtgcatttgtttcgatagatacaacttgtcatcagaccccaaaaaatgccagtttgactccattgtccttgtgtgtatggtaaccctggactgatctccactttttttttctgtaataaagcattcttgtgagactacaaaatgctcctgaactcaatcacgatgaggcgtactgcacgcttgaacaaagtcttcgacttccccttgcagtattccccccaatgtcttctttcagcaataatctccacaagatggcagatgcaaaaagtatataacttcatccaaactcaatccctaactgaacttcttgaataggatttagggataaactgttatcatctttcatctcaatgatgatagtatcagagttgatgatcactctacatggtccaagataccctccattaacaaggtcgcagttttcatagagaccttcagctggtggcatgttcagcatgcaagaattagggagtacaatgcttttcttttcatgaaggcagtgttggttaaccattagcaaaagacggtgtttcctccctagtaattcagagacgtattccatgtcacccatagccaatgcatggcggacacggctggaagaaacctgtcctttatcactcgaatttatagcgcctgaaaatccattaagagatctttttgctgtgtccatgacagagcgtacaatgaatgcacttaaaccaaattcctcacatagtttcactaactcagttgcgtcaccagatgctttgtaaccaaacctgtaattttcacctgccacgacaccttttattctaagatcctttgataacctttcaacaaattgtcgtggagacagggacctgacctttgaaaattcaacttgatattcaagtggtaccacattcctacagtatggagcccaagatgaaaggacccgcttgcgatcacaatgagcaactataggtggcctatatgtccagccaagtacttcggccattcccacaaaagaaagaagaaaaggagtccctgctttagaagcatgcattgccaattcccgatgaccaatgtggagagcatcaaactttcccagggcaactatgccaccgagcacacaatcttgatcctctccacaatctattaggagcctgtcgttgacgagaccttcgttgtttagtctaacccccgagtgtccagatgagctgaaggtcttcggtgagttcctactatgtcccttcttcatgtctaggggcctgaaacgccgcgcgggcggcaggagggagcggggaggcccgggcgggccgcgccgtgggcagcggtggagcggcggccaccggggagccggggacgcggagggggaaggggagcggagggcgcagccgagcgccgcggcggccgtggcggcgcccctctccataccactcccaccacgcgccgactaggcgacgacgcgggccctcctgtttcttttggcaggggagcttggcgggccacgtcgtcttcttcgacgcgagctggctgcctggctgtggccggtggctggtggcggcagcggacacggccgctgcgctgcggcctgcgggatcaaatccgtcgactaggctacagtcggacgatttttaccgtccgctc

SEQ ID NO: 3674 - DNA, 1502 bp, Zea mays
gggtaccccccgggcagctcctggactgactgcccgctcgtctgtttgaaacgaaggaggaggtacgcacgccgctactgcaagctagcaagaagaggccgctagcagggggttttgcttgatttctggcggacgacatgagcacggccacgggcgtgcggccggggcggcggttcacggtggggcggagcgaggacgccacgcacccggacaccatccgcgccgccatctctgagttcatcgccaccgccatcttcgtcttcgccgccgagggatccgtcctctcgctcgggaagatgtaccacgaccacagcacgatcagcacggcgggcgggctggtggcagtggcgctggcgcacgcgctgggtctggccgtggcggtggcggtggccgtcaacgtctcgggcgggcacgtgaacccggccgtcaccttcggcgcgctcgtcggcggccgcgtctccctcgtccgcgcggtcctctactgggccgcgcagctgctgggcgccgtcgccgcgacgctcctgctgcggctcgccacggggggcgcgcgcccgccggggttcgcgctcgcgtccggggtcggcgacgggcacgccgtgctgctggaggccgtcatgacgttcggcctcgtgtacgcctactacgccacggtggtcgacccgaagcggggccacctgggcaccatcgcgccgctggccgtgggtttcctgctcggcgccaacgtgctggcgggcgggcccttcgacggcgccgggatgaacccggcgcgggtcttcggcccggcgctcgtcgggtggcggtggaggcaccactgggtttactggctgggccccttcctcggcgcggggctcgcagggctggtgtacgagtacctgcttatcccgcccgccgacgccgtgccgcacacgcaccagccgctcgcgccagaggactactagctagtcggccggcgccggcgccggcgcggcggcgtctccttagttgggccgtgtcctgttgtcaaatttttttatgcatgtgttggaaattatattgtggtgtcttgtgatggttaataatgaggggcatagggtacgtacttgttgatcgccccagcgttggacacggttaatcaggtgatatgcgtctctactaattactatgtgtatgtaataaattccaggtacaaaatgcaggatttgtctcgtatgagtcgtatcatagtagagaccaaaaaaaaaaagggggggggaacgaaatgttccgtctttaataaaaacgactctctaaagaccagccaacctgaaacactaacattaaagcagctcctacaaatgaaagaaaatgcagaataggctcctgggccggaacccccctagggggaatttttggaaatttccgtaaaagtgggggccgctggaccttgcttttaaagggcccattccgccctatagggggtcgttttacattgaatgggccggcgtttaacaacgtgggggggggaaaaaccttggggttcccca

SEQ ID NO: 3675 - DNA, 1129 bp, Zea mays
accacctgactactgcacactcgtctccgcagtttgaaacgaagcccgcggctactgcaagctactccgtctccgtagctaaaggagaggtaggtttttatttggcgacgacatgagcacgggcgtgcgaccggggcggcggttcacggtggggcggagcgaggacgccacgcacccggacaccatccgcgccgccatctccgagttcatcgccaccgccatcttcgtcttcgccgccgagggatccgtcctctcgctcgggaagatgtaccacgacatgagcacggcgggcggcctggtggctgtggcgctggcgcacgcgctggccctggccgtggccgtggcagtggccgtcaacatctcgggcgggcacgtgaacccggcggtcaccttcggcgcgctcgtcggcggccgcgtctccctcgtccgcgcggtcttgtactgggtcgcgcagctgctgggcgccgtcgccgccacgctgctcctgcggctcgccacggggggcatgcggccgccggggttcgcgctcgcgtccggggtcggggactggcacgccgtgctgctggaggccgtcatgacgttcggcctcatgtacgcctactacgccacggtgatcgacccgaagcgggggcacgtgggcaccatcgcgccgctggccgtgggcttcctgctcggcgccaacgtgctggcgggagggcccttcgacggcgcagggatgaacccggcgcgggtcttcggcccggcgctcgtcgggtggcggtggaggcaccactgggtgtactggctgggccctttcctcggcgccgggcttgcagggctggtgtacgagtacctggttatcccgtccgccgacgccgccgtgccccacgcgcaccagccgctcgcgccagaggactactagcttgaaaattgtattgtggggtcgtgtaagtggttaataaggggggcataggtacgtacttgtctgtcgccccagcgtgtgttggagacggtgaatcaggtgatgtgtacatgctgcttcactgtagtgtatgtgtatgtgtatgtagtaaataattccaggtatataaggcacgacttgtgtagtaaaaaaaaaaaaaaaagggcggcgctcgcgatctagaaccga

SEQ ID NO: 3676 - DNA, 744 bp, Zea mays
gctgcctgtttgtctgaaagtttttttttttttttttggaatctgattgcatcatttcaacggtgggaacacctacagctacagctacagcgttgtttcctcagccagaatatataataatatgtttcccggataagctcaagtgttggcaaaagaatctgcattgtggcatatggatggaaatcattgggtagtagaaatgtgataggccgattttactttcttttccaagagggcaacatgcttgtcgagcatggacaccactgcctcaaactcagtcacctgttgatctatcgcatcaatctgcgacacgtaatcgtcgaagcctcggtttttctcattcagctgctctacaaatactcgcagaccagcggcgatgtcaccgtagttgctgtattcctgtgatacgcgatcattcatcttctcaagcagagcaagctgattgttagtcccctggagctcgccgcggaccatgagggagacgttggtgaagagctcagccagcgactccgacagctcgtcccgccgccccgccgcctccgcctctgcctccgccaccgcggggtttacactcgccatcgccggcgctgggcttcctccgaacaactgaacctggagctcgcctgccgtcttggatcgcaacgacgccgctctttggtttcatggcgtggcaaaggaccagccaacgacattaggcccgtaaggcctactacgtggttggtggttaactactgatgggccgat

SEQ ID NO: 3677 - DNA, 3391 bp, Zea mays
  misc_feature (264)..(264): n is a, c, g, or t
  misc_feature (2546)..(2546): n is a, c, g, or t
ttcgccggctagttttatttttgaactaaaacatgccaaataaaaaagaacggaggggatagttattaattcatttgctaggtttaataaactctagctacataaattttaatgtttatgtttaatttgttgaatgcctacagcttttgttaatacattctcattctcaatttatttcatggcataattgaggtgagtgttctttttgcagagggatgtacatatcatgaatgccgccttggagcagcatttgtaccagagttngaagggaaatttttggcgacagaaaacttttaccatacttcaaaggtccaattctttctctaccgttgggggctttcagaaaggggattaaatttgaacatactgcatgcataatgataggagtcttctcttcggatcaagattgtccattttcttttatgttcagtattctacaatctttagtacatgttcatttgatatttgattgcttaacagttctttggtctgagttcgaagcccttcctttctgatctgatggtggctggggagaaattttgccatggggattggtcgaagattaaaaataagtacagttcttttgatgacggacaactgcttcttttttgcttttcctcagcatatattattgctctactgcatgatacgcttaaaatgccactgggtcataaaaggtgaagccttttctttaagttctattctttgttgaaacctggatatttatgagttttttctcaggattgatgttgtaaaccaaatccatggcgtgcctgttgactgggcattgggtgctttcattgtgcagacgacgatgaacagaacagagtactcagattcatcagtttcatatctaaacagctatgactctcctggcttggttccgcttctgttcattattgtggttgtatttacagcattgtccattctaaggtggagaaaacctcgtctgaagacgatctacgatatggagaaaggcaggtacatcataacaagggtcagccgatgagtcgcgcacatcagcgttgggagtgggtggactttctgcagcggagcactattgaccatgtatgtagattttcctaaattgatttcttacttagtggccaactacctccagcatgttgccttgcggagtcaacttgttgagtttgagcagcaacccctgtatatgatagaaggatgcgggttgccgtggcatttgtgcatgttcagtgttgtatgtaatgttgctaaactgttgttgatgtaattagaattttgtgcatgggcatccatccgatgatgtaatcctgagataaccatgtgtctaatgatcaatagaagttctctgccatggatcatggatggcagggcagttgtatctttgtttcatgtcaaatcactgatgttatgtaatcctaagatattatttctaatggtcgtgtatattctcttgcattaaacaccacatgtctgttgataccacaatcacatagcattagtttaggctatgtgatattattgcactcattcctggcataagtaaacttttgaactttatctattttgaggcaactctaatatatatggagtttgactttgggtcttaactaggtggggtgtatcccacggtttaatttctcgatgtgagatcacctgagtttcgcttttttttcgaaaaacgaatttcggtctgatttcaaatagattttgattcaaaatacaaaactcaaattttggtcaacaaaatgaaatccggatcattccaaaccaaattgtgaaccctgatgtatcatgagtggagagctggaaggagagacaagataagctatctgtcagtctacatccatctgatgcttgagaacctaaaatttttatatgcacgagaaccaataatatctgatgagctcaagtaggctatgtgtgagccaattacattactatacgagtggattgataaataggatgagtatacactattagcgttcctttttttactccagccacgtcactggcatccccgagcgcaggcctggacgcctggtagcatggccatcacgaccgtctctttattttcttttctttaaatccctgcagtcgctcgtccctttctttttatgtttcaggatgcacacgcacgcgcacaggtcgagcaccttgtccttggcacgaagcagaatgaacttggactaggctgacccggtccaattaccagcactaagtcgtatgcatctgcctgctcttcggcgcctggactgctctttgcgactatagctatccttattctctaaatataaatgcttgctataacagtctggttatagtatgaatatatataatttagctgctactagttattacagtccgatttagctcgcgattagtggtgtaagaagggtgatcagccgcgagcggtactgtttagatgactgtatatgagcagtgctgaggatatgggccgacttttcgggccagcacgagcacgatccaaaaataggagtccaaagcatggctcggcatgaaataatatagccaggctagcacgatccgaaggtgggcttagntcgggccttaatttccggcctattggagccccggcatggcccgcatagatgggccaggcttgagcgggcacggcccaattaagcttaatctatttgatttctttaatctagtaagatatcgattttatattgttgttatatttagagtttatgtgatcaaatgatgctagaattgtttaatatctttaatttagtaagctattaactttatatgattgtaatattttgattttatatggtatattggccgagcttggttggcacggtccaacaaatgcaagaagtcatttaagatagagtgggtcactgtttttacacttcgatctgttacgatatgacttaattttttttttagcattatttatctaaacccatttgataccaagtatgataggcttgggtcagagccgagtgtgactcggcccaattcccagtttgggccgggagcacgaggtcaagtcgacgggtttcccggtgcaaacggaggtcaaatctgcctgtgctcctgagacgtctcggaaagcaaagactgccagattttggacgaagtcgtgtagtttgaaaacccatccgaactataaaaaataagcataatccgaaacagcttctgttatctctatgaattacaactttaatctaaaacaatttatactgtttttacattatatttattttgtagattacaactacagcggtacgacgaacggaagtaatggaagaagaaactgcatgggatattccgcagaaagagaaggatgtgtaattcatcccacgtggtacaagagcatgaaccgaagatcaacacaaaacctgcaattggtagtcagtacaggtagcactgcggc

SEQ ID NO: 3678 - DNA, 3758 bp, Zea mays
gaagacgacgcccgcgacaacctctcccgtctcccgtgctgccacctgtccgctccgctgtacccatgcggaccggaacggtcaattatccctccactgcccgccacaccctatcccccacactcaccctccgcaccggatcccgtcatcacctccgagcggcgcgccgggccggcatccaactcgccgccgacgcgccgcgccccagaacgagccgccggaacgatctccctgacccccgatgcgccgtcctattgcccgcggcgagcccaaggtacaaaccctagctctaggtcctccctccgcagccgcccccaccaagatgggcgcccataggcgacaacccagctcccaccgccgcgttgccggcgccctcacgctcctcgccgcgtccgcgctcgcgcttcttctcctagcatcccgccgggttcccccgacctacggcgtcatcatcgacgccggcagcacggggagccgcgtccacgtcctcgcctaccgctccacggcgggactcccgcagctggactgggcacgcatggcctcgatgaaggctaccccagggctatcgtccttcgcggcggacccacgcggcgcggggctgtctctggcgccgctattggagtttgccaggcgccgtgtgccgcgggagagctggggggaaaccgaggtgcggctcatggccactgccgggctgcggctgctcgattccgcagtggccgagtccatcctgcagtcttgcagggaagtgcttcgggggtcggggttccaatttcaggacgaatgggccaccgtgatctcaggcatgtaacatagtaaaactgtgtgacttattttccgttttgatgacttgctttggaaatgtgtggatctggagctcttgcatttgatgtgatgctggaagtactattttgaaattgggagcttacatttcagtacatctggatagagttttgttgaattttggcagttttctgtgtatcttagcatgtttgattgaactgaattcaatttctttgtttagatgatcatgcaagtacgttgaaatactgtgtaggggctgaggaagggatatacgcatgggttgcagcaaattatgctttggggactcttgggggtgatccaaacgacaccactgggattattgaacttggtggggcttctattcaggttccgtgtcttgcatcacactaaggaatcaatccttctgcaaaacttgggtagttgggttcttactgttttgctatttttgatcaaacaggtgacacttgttactggtgaacctgtgccaccgaagttctctcatatgcttaagtttggtgatgtctcatataacctgtacagccacagttttttgcatcttggtctggtgagttgtgggcataaatattagttgtccttgtccattcaaacattatcgattgtccatgttctcctaaattgccttatcacaagaaaagtatgttgccacgcctgcaccttagcaatgatccactttatggttaattaagtgctcctttgctataatcttctatgtgctgactgttctatctcattttgtgtgcagaatgtagcatatgaatcactccatgacttgctcagctcacctggccttagatcaagtaagtcaattggttcattgcatttgtagtttataaagtaagataatcagataacataggaacacatctaccaccctctgtcccaaactataggtcgttttggcttttctagatacatagcttttgctatgcacctagatatacgatatgtctagatatataataaaagttgtgtatcttgaaaagccaaaacgtcttataaactggaatggagggagtatgatttaaaattgattacacttggggaacacttttagtacaattgtgatatttctttttcgcgtatccaacttctgtggatatctatgatttgttttaaagctaacataactccagcatgtttcatgaatcttcatgtctgatctgactatgcttatgcagtggccacacatttgatttctcaagctaagtacaaagatccttgcactccaaggggatttacacgcatagcaggatcagctaaacttcctgttggtgttcttgagccgaaggttgaatacagaccttttgctcattctgcggggaacttctctgagtgtagatctgcagcactaacactactgcaaaaaggaaatgagggatgtacatatcatgaatgccgccttggagcagcatttgtaccagagttggaagggaaatttttggcgacagaaaacttttaccatacttcaaagttctttggtctgagttcgaagcccttcctttctgatctgatggtggctggggagaaattttgccatggggattggtcgaagattaaaaataagtacagttcttttgatgacggacaactgcttcttttttgcttttcctcagcatatattattgctctactgcatgatacgcttaaaatgccactgggtcataaaaggattgatgttgtaaaccaaatccatggcgtgcctgttgactgggcattgggtgctttcattgtgcagacgacgatgaacagaacagacattgtccattctaaggtggagaaaacctcgtctgaagacgatctacgatatggagaaaggcaggtacatcataacaagggtcagccgatgagtcgcgcacatcagcgttgggagtgggtggactttctgcagcggagcactattgaccatgtatgtagattttcctaaattgatttcttacttagtggccagctacctccagcatgttgccttgcggagtcaacttgttgagtttgagcagcaacccctgtatatgatagaaggatgcgggttgccgtggcatttgtgcatgttcagtgttgtatgtaatgttgctaaactgttgttgatgtaattagaattttgtgcatgggcatccatccgatgatgtaatcctgagataaccatgtgtctaatgatcaatagaagttctctgccatggatcatggatggcagggcagttgtatctttgtttcatgtcaaatcactgatgttatgtaatcctaagatattatgtctaatggtcgtgtatattctcttgcattaaacaccacatgtctgttgataccacaatcacagcattagtttaggctatgtgatattgttgcactcattcctggcataagtaaacttttgaactttatctattttgaggcaactctaatatatatggagtttgactttgggtcttaactaggtggggtgtatcccacggtttaatttctagatgtgagatcacctgagtttcgcttttttcgaaaaacgaatttcggtctgatttcaaatagattttgattcaaaatacaaaaatacaaaactcaaattttggtcaacaaaatgaaatctggatcattccaaaccaaattgtgaaccctgatgtatcctgagtggagagctggaaggagagacaagataagctatctgtcagtctacatccatctgatgcttgagaacctagaatttttatatgcacgagaaccaataatatctgatgagctcaagtaggctatgtgtgagccaattacattactatacgagtggattgataaataggatgagtatacactattagcgttcctttttttttttactccagccacgtcactggcatccccgagcgcaggcctggacgcctggtagcatggccatcacgaccgtctctttattttcttttctttaaatccctgcaggtcgactctag

SEQ ID NO: 3679 - DNA, 4706 bp, Zea mays
  misc_feature (4079)..(4079): n is a, c, g, or t
cagcagatgaccgcaaaagtgaagccctttgggcgttgcaagagacgagaagacggacgtggataacaccagagctaatctcgtgagattaaagattacgatttacaactggtgcgatgcggcgccggtgccgttctgagccccgcgtagcacaatatgctttggaaaaattgacaggtcagggcacacgatgcggtgcggtgcggcgcgtcctctaatcaatcagtttattcaggggagggggagtgaagtgcgtatcttctttgttaaacgcccttcaaaaaaggactgtttgggcaggtcaggtgcggattctgttggagttattagaatctccaaacccatgattttgtatcccagcttttaatctggcgaatctccggtaacagctacgtacgagtatttggcttggctatactgtatgtatgccacacggcacgttttcccaatcacagttaaccacacggcacgtccaatccataggagtccggaggccgtaccaaagttgcgaatcaaaatataccgataaactcgaattcatctcttaacacacgcaaatcgttatcctaagaactgacgagatttctgtggcattggcgttcggctgctccaaccaccaaacgcctccaccactcctgtaccggtgcgcccggacaagaactcgcgccggccggatcgacgactccaaacgattctaaaccactggaaacgcgtgccgatgccgaccgacgaaaccacacgaacctacccacctctggctgcgtcgcggcctcgtggggcgcctgcacgacgcgtccgccgctccccgccttcttttgacccgcgcacgccacgccaaaccaagccgcacccgatccccgaccccgagtccgcacgagttcccctttccttccccgtctcgactctcgagagacgccgtcgcgggcctggccgcccataaaacccacccccctgcccccatccaacaacggacgcgtggggccgaaacacacgaaccgacgtgaccagatcaaaagcaaggagggaggcagcaactgccaacggcgatgatggggcaggacggcgtcggcggaggggtgatcggggccctgctctacgccgcgctggcggtgctggcgctgcgtctggtgctgtcgtacaagtcggcggcgcacgcggtgcggcgggcgtggcggtgggcggacgagtgggcgcaggcgtaccagtactacgaggtgccgcgcctcgccgtcgacggcgcggagaacccgctgttccggaaggcggcggcgtacgtggcgtcgctgccgtcgctcgaggacgcggacgccgcctgcgtgctgtcgtcggcggccaagagcaacgacttcgcgctgcagctggggccgggccacaccgcgcgggacgcgttcctcggcgcgcgcctcgcgtggaccaacgccggcggcgacggccgcctcgtgctccgcgtgcgccgccacgaccgcacccgcgtgctgcggccctacctgcagcacctcgagtccgtcgccgacgagatggaggcgcgccgccgcgagctgcgggtccacgccaacgccggcggtggcgcgccgcggtgggcgtccgcgcccttcacgcacccggccacgctcgacacggtggccatggaccccgacctcaaggcccgcgtccgcgccgacctggagagcttcctcaagggccgcgcgtactaccaccgcctcggccgcgtctggcgcaggagctacctgctgtacggcgctcccggcacgggcaagtccacgttcgccgccgcgatggcgaggttcctggggtacgacgtctacgacgtggacctgtcccgcggcggctgcgacgacctccgcgccctgctcctggacaccgcgccgcggtcgctcatcctcgtggaggacctcgaccgctacctgcgcggcggggacggcgagacggcggcggcgaggaccgcgcgcgtgctcggcttcatggacgggctctcctcgtcatgcggcgaggagcgcgtgatggtgttcaccatgagcgggggcaaggacggcgtggacccggccgtgctgcggcccggccggctcgacgtgcacatccacttcaccatgtgcgacttcgagggattcaaggctctggcgagcaactacctggggctcaaggaccacaagctgtacccgcaggtggaggaggggttccacgccggcgcccgcctcagccccgccgagctcggcgagatcatgctcgccaaccgcgggtccgcgagccgcgcgctccgcaccgtcatcagcgcgctgcagcacgtggccccgtcaccgcctccgcagcggaccgtcaccgcggcgcggccgccgaggctgacatcgagatggtccgggcacctcgacgaggccagcgtcgcgaccgcgacgtccgaggccagcgcggcggggcagtcgccgcggggcgggggaggtttcgccaaggacgcgccgatcagggagatcaagaagctctacggtctgatcaagtacaggagccgcaaggacgccggcgtcgtgccggtggatgacagcgcggcatcgccggacgggcgggacagcgacgttagccccgagaaggaccggtgattagttatctgtgttttctttttttttttcgttttcacttttgataatgggttctaaagtagtagtacaaattactgtttattcgaaacgtgggtggatgtacattctgcactgtaaatctttgtagcactagaggctttctcattactcgagaaaaaaacgtgttcatctgaaaggcatccattgtgcggcagtgaacaaagcttagacaaagttcaatggtaaccgcttcttcgcagtttggcacgcaaaatcgcggtcaatgagcccaattgacattctggtgacaccttatgcgaaatactcaggtgcaatagaatagcaaattctcaacaacgactaacaaccaggactctgtatgtttgttagtttgaagttgaagtagtcaaagatcttattcttgtttgccaaaagaacagaaatctgacattagtttccaaacaccgtgatttgcgcgctttgtaccaatctctgtcaccgagctagcactgccactaatcctgtcctggaccaccgtcgctggtccgtcctagtcccctcgcgggagccggcggcttggggacaatcgtcgccgattcctttgcccaccatactgcgatttgatgaagcgccgggctggctgcggttgccacatcgccataacaccgctttcaggtgttagctcgcgtctgtttcggctctgccttgcgcttaactgtcttttcgtttggttcctatagtatttttgtccttataaattacagctgcagcaatcaaacagcccactttaattcgaaacaaacaaccgacttttaaatagtattgtacaatatatacttcatctgtcctataatataatgtataaccatttttatttttgtcctataatataagacatgttatctttaaacacacgtacatcgatgcaatagcatagataaaattaaatatatttattggcttttgaactagagtagagttagttacgtcttatacagtgagagggagtaatatatactgtatagtacatatactgtacagtagcaaaggacacgcgtggttacgaggtgctagacaatgagatgaagcaaagacgcccattattattgcacttagaggctggcgatgatgattaggggcatggttctgcgagctaatgatgtgcctgctgcaagctaatgatgtgcctgccagccactgctagccctgcagtcttaattttgcgcgcgcgcgcgcacacacacagactcctctacagcctatctgtgccgtttggcgcttagcagagcacagctagttccaaggtgtggaacagccgccgccgccgcgcaggcacaggcacagccgcacagcaaagatgtccatgtcctatcgctgttccagccttgcaagatgaactggaggacagtggacgcggttctctgcttcacaggatgggcgcctcgtcgtccttcatcggtgcggtgcggccgcattactcctaccaatccgaactcacaccagattttattnaatatttaaagtatattatatgctaaataatattatagtaaaaattattaataattataaatttctaaataagatgagcctgtcaaatttaagactaaaaagtcgaataaattataaattagaacggagagaatatacgtgaatataaaaaaagtatacaaacatgataggaatacatacacaaaacaagagtgaaaacataaaaaaagttatcgaaatatgtgttttgaccggttacacgaaattgtccatgtagttttttctactgaactgaagataaagaagagtttcttttgtattcagtcaacggattctttttttcccctgatgcaacgatgatgcaccaaaggtcccaccggcatcttcaagagactctttattttttactttttatttgactatctatttattttttttataaaaattacactacatacgtagcatctcacttcaacaaactatttattagtttgacactcaaggtggctagccaaatttggctagtgaaggagccaatttgaagattcgaatagtttggcgagtcagacagctaatctgttagagagttattttaatgttgagtagctaaaatttggcttgacgagccatttgcctaatctcttggag

SEQ ID NO: 3680 - DNA, 2886 bp, Zea mays
tgcagactactcctcctgtccctctactctactacctgatggccgatgccaaaagccgtagtagcatttcataatcaaatcgacggacggattcatccagcagtaatgtaaattcatgtacagtggagtacgcattgtactccatgaccttccctcgcgatcgatccgatcggcagctccagtgccacggcgatatgccataaattcatgattcatccatcagtctctctctctctctctctaccatgtacaacagtccatacaatcatgtgatttgtcaagtattttttcttcaagaacacaacgtcacatatccggtggctaaggtttacgagcaagatctattcagcctaacacaccctctaagcatgcaaaaaaaatttaaaaaaagatgaagaccggaacgtgacgtaagccttgtattgactaacaatgtatgtatacttttccattctcaaatggagcgagtaggttttaaccacacggcaaatatacctcaatggtttcaaataaaacacacacggcatgactcatgagcttgaatgtcaggccacgtggcggcgtccgatgactagatacacccatcacaaccactctgcaatgcatcagggcgacgtttctatacagtagactttcaccgtgaatttgtcgccgataaagaaaaaacagtgcatcttttcgtcaggtttcaagtctagcaaacggcacgaaatttttaaatcagttttttttttcttcttccagttgttccattttgggccgattccgtcgttcatggaactgggaatctgaaacgccgggcccaatggttctcagaagtcaaacgcaggctgcgcctgattgcctgcggccaagcttttctatccaccttctttgaccgccattgctctcgtcaaagagcatttcagcaaccacctccctcctctacaaacgataataaagccctacctctcacatcggcaacaggacgaggccagggcatccacgaccacgacacggacacagggagccgcccgccatgccaccgcacggcggcatgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggcccagtgcgggtgcgacggcgcagagaacccgctgttccgcaaggtcgccgcgtacgtggcggcgctgccgtcgctggaggacgccgacgctgcgtgcgtggtgtcgtcggcgtcaaggaccaacggcgggctgtccctgcagctcggcccgggccacaccgcgagggacacgtaccttggcgcgcgcctcgcgtggaccagcgcgggcggcgagcgcctggtgctgcgcgtgcgccgccacgaccgctcccgcgtgctgcgaccttacctgcagcacgtggagtccgtggcagaggagatggagcagcgccgccgcgagctgcgcctcttcgccaacaccgccgtggacgcgaccacgggcgcgccgcgctgggcgtcggcgcccttcacccacccggccacgctcgacgccgtggccatggacccggacctcaaggcccgcgtccgcgccgacctcgagagcttcctcaagggccgcgcctactaccaccgcctcggccgcgtctggcgccggagctacctcctctacggcccgccgggcaccggcaagtccacgttcgcggcggccatggccaggttcctgggctacgacgtctacgacgtcgacctgtctcgcgccgacgccgccggcgacgacctccgcgcgctgctcctgcacaccaccccgcgctcgctcgtcctcgtcgaggacctggaccggtacctgcagggcggcggcggggacgcggaggcgcgcgcggccagggtgctgagcttcatggacggcatcgcgtcgtgctgcggcgaggagcgtgtcatggtgttcaccatgcgcgggggcaaggacgccgtggacgccgcggtggtgcgcccgggccggctggacgtgcacatccagttcacgctctgcgacttcgaggccttcaaggcgctggccagcaactacctggggctcaaggaccacaagctgtacccgcaggtggaggaggggttccacgccgccggcgcccgcctcagcccggccgagcttggcgagatcatgctggccaaccgcgcgtccccgagccgcgcgctccgcagcgtgatcaccaagctccagcgcgtcgcgtccggaggcgccgcgccgccgcggaacccggcgcacaggcggaacacgagctggtccggcgcctggaccggacagcagtgggaggaccaggcccagccggcgcgagccagcgcggtctccgtggaggtcgacgagacggccgccggggcaccggcgacgtgcggcggggtgttcggaaaggaggcgcccatgagggagttcaagaagctgtacgggctgatcaaggtcaggagccggagggagggcgccggcgccgtgccactggaaggcgacgcgcacgggccgccgacgccgggcaaccatgacagggagcggtgatcgccgtggatggtagaattgtagtggtgtgcaaaaagaaagcatttttatttctttctctttttttttcttgttattgttacagtttatcacactactctactaatgtgtcagtgactgcaagtaggaatggcaatagatgaattggatggatcaaaaaaaaaaaaaaaatcaacctggccacggtctcaactgcgagtgtaattttaaacccacagtcgaacccgtcgagtttcaggtcacctcaggtttttacttagtgtgcacttttaaacaatataagcaattaaaacaat

SEQ ID NO: 3681 - DNA, 2317 bp, Zea mays
aaaagggtgcacccatcgcggtgcgcagtgcccgcgcctcgacgttccattggcactgtggccgatttatacccttgatgggatcccgcctccgtgtgccctcacatggcagacggctgggaggaggagctgtggcgccggccttgcaagagccaatgtgtcggtggagaggagatggcgcccaccggagctacattgtctgcctgctcgacgccgcaagtggtggccagctccactgctctcaccgctagccgtctgcaggtaatctaaactgcattgttgttgctaaaaaagaagcaaatccagatgagcaaacactgttttaccatggcctgttttcgtcacggagtccaggaatatgagccgtacacttgcgatggctctgttgacatcaacggcgacccagcgtcgaaaaagcacactgggaaatggagagcctgctactcgattcttggtggtgagttctgcgtctctttggcgtactacggtgtggggacgaacctggtgagctacctaaccaaggcgcggaagcagagcaatgtcgctgcggcgagcaacgtcgcctcatggcagggaacctgctacctgactcccctactcggcgcattcctggcggattcgtattggggaaggcaacggacgatcgtcatttccctcgccatctttaccatggttgttagctcagctccactccactcttggccgccgccgcaggccttcactttctttgtcaaattaatctgcatccgcatgttcagttccactttcttttgtctgcaggggatgcttgtactgacacttgcggcagcaagcattcatgcactggacatctctccccagggccagggccaggacgccctgccttcccttggccttttcctggccgccctaggcctgggtggcgtgtggccatgcgtgcccacgtttggggccgaccagttcgacgacaccgacggagcggagaaggcgcagaaggagcggtactacaactggtactacttcgccgtcaatggcggctccctcgcgagcacgctcctcgtgtacgttcaggacagctggggctggggctgggggttcgggatccctgcgctgttttcggtggttggaatagctgggtttcttgccagcaccaagctttacaggtaccagaaaccgggagggagcgcactcaccagggtttgccaggttgtggttgccgccgtccggaaggcccatgtggacgtgccgagcgacagctctctcctgtatgaagtgccaggcaaggaggcggcggcggtcgtagggagcaggaagctggtgcacactcaagggctaaggtatggtacttgtagtggttttgagagcttcctaatttttattttgtctactgaatgggaaaacaaaacaaaatgaccgcatttagtaggttctttgatcgggctgccaccttttcctccgtcgacgaagcatcgtctgctgctgctgctatgcctagtccatggaagctgtgcacggtgacgcaggtggaggagctgaaggtcctggcgaggatgttgcctgtgctgctagctggcgtagtcttcaacatggctgaagccttcttcccgcttttcgtcgaacaaggagaagtcatggacaagaacatacgtgggttctcagttcctccagcctctctgacgaccttcaactgcctctgcatcctcatcctgctggccccctgttacagcagggttgtcaagccagtgctgagcatggccactggtggcctcaaaggaggcggcctgtccgagctgcagcgagtcggcgtgggtctggctttcgctacgctctcgttggcttcggccgcgctggttgagacgacgcgcctcaggatcgtcgacgaacgaggcctagcgcaccgcgacgctgccgtccccatgagcatcctgtggcaggcaccgcagtacgtgttcgttggcgtagcgaaagtgttcgccgctgtcggtttcaccgagttcgcatacgagcagtcgccccatgccatgcgaagttcgtgccaggcctgctcgctcgtcatggtcacccttggaaactaccttgtctctgtgatgttgaagctcatggattcggcgacactggtgggaagagggcggcacggctggatccctgataacctcaatgagggtcgtcttgatcgtctgttctggttaatggcaggattgcagcttctcaaccttctcgctttcgcatgttgtgccaccaggtacaagcgcaaacaggctactacttgactttggttgcgtcacatgctatatatgtcctcgttcgtccgcagaagttttgacacacccttgtaaca

SEQ ID NO: 3682 - DNA, 2601 bp, Zea mays
gcatgggaggagatggccaacgtgctggatgctgtgctggaaactatgaaggttttaagccctgttgctacaaagaaagttgctgaaactacaaaaacgcaggccaaaaccaaaactaggcaagcagaaactgaagctgcgctagctcaaactgaagtcgaatttgggccttcagtgcccaccgagatggagcctgctgatcctaaggaagaaacaacagaacagattgcatctaaaaagatcgaagctcctgctcccgaagcttcgaacaaaagcattgactacattattcatcatgcttcgggaaaagaactatcccaagaagaaatgctagaagcacgacactacgcccaaaaattgaaatatccgaagggggcgttagtgttcaatggtagtgacgaagaagattttatgtactgtctctcggataacaaagaaatatccatttgtcgggagataggtaaaagcatcggattcccgaagctggaagacggccttttgattttatcgaaggatgaacttgctgacagcctagcatacaatagcataaatgtaacaccccaggtgtttatattccgctcgacaacgagtatggatttaagcacgtaatatcagtgggtaaacagacgctaaattttaatcatcttcgtctatcgcaattttaataccgcatctgtttcatccatcgcgagtgcgacgtcgtttttatttttatccatccggactcttcctaaattttgtgatgttcggaacatagctgttctgaaaatcggtgcgtccgatgattaactaaaattcatcgccgcgcgaatacgaattcgaaagcccgaaccacttggacgattttatcccgaacaagttaatttgaactcaacgcctaaaatgtgtggggtaaaataattcgaatcgcgcgaaatcttgcgcaagtctatgatccaatttatccttcaacccacactgtaggataatcaactcaactgtgtttagataacggatgaatttttatccgatttcaaagtatctgcgatttttgaaacaaaaaaaaagaaaatcaaaagaaaatatcctcgaatcctatctaatcccaccgctctcccacagatctttttccacccgcgcgtgacgtttcctccttatcttctcctgacgcgcgcttcttatcctcttctcccacaggcacgctcagatttttctccatcccgtgccagccttcatcttccagccgctcaccgcttgtgaagatcacagccgtcgttcttatcttcttgcgccgctcctctgttgatatttcatcgctggcttcttcttattcctgtacgcgagctcagcttctcccgtatcctccggcgccttccctccatttcgtccttccaaccatggccgcgtgcctcccggctccagtccgcccactcctcacggtgcccttcctctatctcctccctgctcctctgccccagttcgagctgctcccatggcgccgttggccggatctccctggccgtgtgcccctgcgctcggtcgcctctcctgcagctcgctctctcctccctccatctctctcaagcgctagccgccgtggttccctcccctgggctctgctcgccggagcttcctgctcggccacgcccatgcccaacgcctagccgagcggcctcactgcacgttcctcctttctccaagttgagctccatctccctgcgcgcggtactctctccggcgtccagttttctccgcgccgaagttccctccatgtgttgcccagcaccagttcctctgtggccacgcgcatgaatccctgctagccagcatgctctggattcagccatggagcatctcctgcgtctctctctattcgctggccgagatccctgcctgcgcgctctgtttcttcttgccgagcgccactcgcccagccaaagccacccagccgaagtcccatggcgcttcttcggctgaatttcctgctcgcagccgcgaagtcccctgctcggccttcttcctcggtgtcgcgcgcccggttccagctcgcccctgacgcgcgcgcttctcagctcgtctctctctctgcacgccgagcggctcgcacaggtccttctctctgccccggctcgcggatctcccatgtgccacgcgcgccctcggccatgaaggacgccgcgcgccgctcagccttgtcatttccttgtcatgctcgcccagctctgttgccgcgccctgccttcgtggccgctgcgcacttgcctctgctcggcaccgagtctgtttgccgcggacgcgggtcgccgcgctgcgcaggctgctctctctagtcagactgtctccagcagcgtcccctaaatttcgtcccctaaaggaatattctttgttctttacagaacactctaaaagattttgtcctctatatattctccgtctccagcagcgtcctctaaattccgtcccctaaagctacagtgttaacagattcacattttccatttctttttcatttttctttgttttcttctcatttgacactatataaatgatacgaaaaaattgtatttattaattttgaaagtaataaattcgaaatatcaataataattacattgcttgttc

SEQ ID NO: 3683 - DNA, 883 bp, Zea mays
  misc_feature (5)..(5): n is a, c, g, or t
  misc_feature (7)..(8): n is a, c, g, or t
  misc_feature (10)..(10): n is a, c, g, or t
  misc_feature (17)..(17): n is a, c, g, or t
  misc_feature (20)..(21): n is a, c, g, or t
  misc_feature (23)..(23): n is a, c, g, or t
  misc_feature (26)..(27): n is a, c, g, or t
  misc_feature (29)..(29): n is a, c, g, or t
  misc_feature (34)..(34): n is a, c, g, or t
  misc_feature (44)..(44): n is a, c, g, or t
  misc_feature (53)..(54): n is a, c, g, or t
caaantnnanctccccncgnngnggnncnctctntttctaatgnatccccccnnctgcaggaattcgccgagaggctcactagtcccccccccccccccatgatacagaagtttgtttgggccatctgaagcggtatgctttcaaggagctccgtgcagctactaataattttaactcaaagaacatcttaggtgaaggtggatatggcatagtatacaagggttatttacgcgatggctccgttgttgctgtcaaaaggctgaaggattataatgccgtcggtggggaagttcaattccaaactgaagttgaagtcataagcttggctgttcatcggaatctcctacgtcttattggattctgcactacagagagtgagaggttacttgtttatccatacatgccaaatggaagcgttgcttctcaattgcggggttagtcgctcttcttgctcttgacttccatgtccatatgctgttgcaagctggaccaattttgaaagtacactggtccagaaaatgcattttttgtcacaagaggggggaaagtggctataaaaaagcaattataaaaatgtccactcagaaaacctttgagtggtaaaacggctatcaaagcctgatgaaaattttgaatttaaaaatgtgttaacacttctgcatatctgttaaataagtttcttgtatctaacacaaaatagttaccctatttctggatgcatcatagttgatgtgaaacgtgttggttttcgaacttttgcttagtgcttctgcatagtgcgttgagtagtactaaatttagttttgtgtggtatagaacaaatgattatgctttgaacaaacaagcaagctaccatgatttctattggtgtgctgcaggtcg

SEQ ID NO: 3684 - DNA, 1917 bp, Zea mays
  misc_feature (739)..(739): n is a, c, g, or t
attgggtgtccggactccggactggacagggaccgtcggaaagacagggtccttcttcttggctgctgatttcgcgagcgctgccgctgccgctgccgccgccgcttcttcttcttcctccctgctgctgcggcggcggaattgtgcgttggagggctgtgggctggcgactggtctctgccccctccctcttctccggcttgttcgccgaattgaatctgcgggggttgcgttgcagcgatgcgggcgcgggagccccggatgtggatggggtggtgctgggtggcgctcgctgctgtgctcgccttcatcctgccgccgtccaacgccacgctctcccctgccggcatcaactacgaagtggtggctctgatggccatcaagaccgagctggaggacccctacaacgtgctcgacaactgggacatcaactccgtcgacccctgcagctggaggatggtcacgtgctcctccgacggctacgtctccgccttaggactgcctagccagagcttgtccgggaagttatcacccggcatcggtaacctcaccaggctgcaatctgtgctgttgcagaacaacgtgatttctggacctattcccagtacgataggaaggctggggatgctaaagactcttgacatgtcagataaccagctcacggggagtatcccaggctcgcttggaaatctgaagaacctcaattatttgaagttgaacaataatagcttgtctggangtctgcctgattcaattgccagcattgatggttctgttatagagatctttcgttaacaatctcagtggcccattacccaagatttctgcaagaacctttatcatagctggaaatccaatgatttgtggtaataaatctggagatagctgctcttctgtgtcacttgacccactctcttacccaccagatgatctgaaaactcagccacaacaaggtattggaaggagccatcatattgctacaatatgtggagcaactgttggttcggtagcttttgtcactgttgtagttggtatgcttctttggtggcgtcataggcgaaatcagcagatcttttttgatgttaacgatcaatatgatccagaagtttgtttgggtcatctaaagcggtatgctttcaaggagctccgtgcagctactaataattttaactcaaagaacatcttaggtgaaggtggatatggcatagtatacaagggttatttgcgtgatggctccgttgttgctgttaaaaggctgaaggattataatgccgtcggtggggaagtccaattccaaactgaagttgaagtcataagcttggctgtgcatcggaatctcctccgtcttattgggttctgcacttcggagagcgagaggttacttgtttatccatatatgccaaatggaagtgttgcttctcaattgcgggaacatataaacggcaagccagctctagactggccaaggagaaagaggatagcgctaggcacggcacggggcctgctctaccttcacgagcaatgcgacccgaagataatccaccgggacgtaaaggcttccaacgtgcttctcgacgagtacttcgaagcgatcgtgggagacttcgggctggcgaaactcctggaccacagggagtcccacgtcacgaccgcggtgcgcgggaccgtcgggcacatcgcgccggagtacctgtcgacgggccagtcgtcggagaagaccgacgtgtttgggttcggggttctgttagtcgagctgatcactgggcacaaggcgctggatttcggaagggtggcgaaccagaagggtggagtgctcgactgggtaagcatgcacgcatgcagcttgtgtttactttacttgtccgatttcaggtttgctttgaaacttcaaaatgaagaacgtctgtctgtctgtct

SEQ ID NO: 3685 - DNA, 587 bp, Zea mays
  misc_feature (2)..(2): n is a, c, g, or t
  misc_feature (36)..(36): n is a, c, g, or t
  misc_feature (107)..(107): n is a, c, g, or t
antcgtcgaaacggagcttcgcccatcttgcaagtngtaacggatctcctgcgctctctgtcaacggctcttcttccagaataaaaaggggtcccgactccgcaagnttccgttccccagagttcttgtagtcttctcggcctcccgctaaccgccatccaccacaccgagccccaagccccccaactcccgagccctcggacctccatccctgtttcccatggctgtgcctcggcggtgggcgaacctcgacatcgacctggtgacggaaatcatgaaccgcgccccgtgcgtaatcgaccgcgcgcgaatggccgccgtctgccaggcgtggctcgaggcggtcgcgcgggcagagcctctgacatttcagctcccgtcgctcctcctcccgcccgcggacgtgactggcgtctactgctacctcagcggcttccgcgaccacaacatgtttcccgggccccgctacttcggctcgtacgacggcggctggttcttcctcgcctacggccagactcgcgggcaccggctgttcaacatccgcaccggagaatcctacgagctacccgacggcctcgcggatatct

SEQ ID NO: 3686 - DNA, 662 bp, Zea mays
  misc_feature (608)..(608): n is a, c, g, or t
  misc_feature (627)..(627): n is a, c, g, or t
gttccccagagttcttgtagtcttctcggcctcccgctaaccgccatccaccacaccgagccccaaggcccccaactcccgagccctcggacctccatccctgttcccatggctgtgcctccccggtgggcgaacctcgacatcgacctggtgacggaaatcatgaaccgcgccccgtgcgtaatcgaccgcgcgcgaatggccgccgtctgccaggcgtggctcgaggctgtcgcgcgggcagagcctctgacatttcagctcccgtcgctcctcctcccgcccgcggacgtgactggcgtctactgctacctcagcggcttccgcgaccacaacatgtttcccgggccccgctacttcggctcgtacgacggcggctggttcttcctcgcctacggccagactcgcgggcaccggctgttcaacatccgcaccggagaatcctacgagctacccgacgggctcgcggatatcttcactaacgatatccacagcatggtcgtcctcgccgccaccctctcgttcccgcctcatcacccgggatgcggccgccgcgggcatcgtcacctaccagccgggacctcgacgcgccgcgccaacgccacttnccccgctggcgcccagggnataggatggccgtctgcgacgttgtgcccgccgtg

SEQ ID NO: 3687 - DNA, 1823 bp, Zea mays
cgcagtcacgccctccgcaaaactcccccactccacgcccggccgcacctctcctatcttgctccaagtagcaagttccaactcgagtagattcacttcgccactccgttgccctctcctccgccgcccgatcctttccccgtctgagatggcatctccggcatcggcgtcgcttaaggaagccgtgggcagcctcgaccgcgacggctttgttggtctcctctccaacctcatcggcgagaccgcacacctgcagaacgacccgccgacctacaggcctcaggaggagcgcgtggcgcagcacgtagtcgacgtgctccgcccggtgtccgcggacaccgggggcggccccctccttgtgcggaagataagctacgccgagggcaggagcaacgtcatcgttgaataccccggcaccgtcccaggccgcgttgtctccttcgtcggcatgcacatggacgtcgtccctgccaacggcagcgagtgggactttgatcctttctcactaacctttgatagcgaggataaggacaaacttcggggacgtgggacaaccgactgtcttggacatgtcgcactggtggctcagctaatgcggcggcttggtgaggtcaagccacccctgaaacattctgtcattgctgtgttcattgccaatgaggagaactcatctgtcactggcattggtgttgatggcctcgtgaaggatggattacttgacaagctcaaaacaggacccttgttttggatagatacagctgataagcagccatgcattggcactggtggaatgattccatggcatctcaaggcaacagggaagctgttccacagtggccttgcacataaggccataaatgcaatggagatgaacatggaagcactaaaggtaatccaaaaacggttttacactgacttccctccacatgagaaagagaaggtctataaatttgctactccatctacaatgaagccaactaaatggagctatcctggcggggggcttaatcaaattccgggagaatgcacaatttcaggggatgtaaggttgactcctttctatagcacttcgcatgtcatggagaagttgaaggaatatgtagaggacatcaatgagagatttgaaacagtacttgatactcgtggtcctgtgtccaaatatattcttcctgatgaaaatctacaaggaaggcttgaaatcacttttgatggagatgtgatgaatggggtggcttgcaatctggagtctcgaggctatcatgcattatgcaaagcaaccaaggaaatagttggccacgtggagccatattccatcaccgggagtctacctctaatccgggaattacaggacgagggatttgatgttcaaacagctggatatggcttactgaagacgtaccatgcgaagaacgagtactgtctgttttcagacatggcccagggctttcaggtgtttctgagcatcatttcacagctggaagaagaggtctgagccttcttgatgggatagaccaatactccctccgtttcgttttagttgtcgctggatagtgcaaaattgaactatccagcgacaactaaaaagaaacggagggagtacctccaatttacattactcgttgctcagtgatctgtttaatacctccaatttacatcactggttgctcagttgtctgtttacaactcttttcaagattccgggacacggacatctaacaagccttcgaggttgtctgtcacccgttgaaaacggagccatttcaccgcagtgttctcgtgggcatacaacctttgtgctacaacttggcataaaatctttgcgc

SEQ ID NO: 3688 - DNA, 2712 bp, Zea mays
aattcggcacgaggcccaaaaccccccccccccccccccgccccccaacccctccgctgccgagtcccgagtcccgactagtattctattgcatcccctccggggagggctgaaccaattcaacacgctgtgcctgtgcgtgcgcttgtgtcgggcggggtcgcagcagccagccaggatataatccccgcgcgcgccgctcgtaaacagaggagggcgagggggagggcgagctgagccagtcctccgatcacgcgcccgcacacacgcacgcagcgcggcagggagaggaagagcttacaaggccacagcaggcagggcacggagaggctattcaccaccgctgccgcacatgcgagcgggcgcagcagcgcgcggggactctcctcgtgcaatgagcgccgccgcgacgccgcgccaccggctcggggtcgcgctgctgctcctgctgctcctcggtggcgccgacgcgaaggcgcacaactacgaggacgcgctgcggaagagcctgctctacttcgaggcgcagcgctcgggccggctcccgcacagccagcgcgtcacctggcgccaccactccggcctcaccgacggcctggagcaaggggtggacttggtcggcggatactacgacgccggggatcacgtcaagttcgggctccccatggcgttcaccgtcaccatgctgtcgtggagcctgatcgagtacggcgccgacgtcgcggcggccggcgagctcggccacgcgctcgaggccgtcaagtggggaaccgactacttcgtcaaggcgcacaccaggcccgatgagctgtgggctgaggtgggcgacggcgacacggaccactactgctggcagcggccggaggacatgacgacgtcgcggcaggcgtacaaggtcgaccgggaccacccgggctccgacgtcgccggcgagaccgcggcggccatggcggccgcgtccatcgtcttccgcgactccaacccgcactacgcgcacctcctcctgcaccacgcccagcagctgttcgagttcgccgacaagtacaggggcaaatacgacagcagcatcgctgaggtgaagagctactacgcgtccgtgagcgggtacaaggacgagctcctgtgggccgccctgtggctccaccgcgccaccggcagggctgactacctcgactacgtcgtcgacaatgccgacagcttcggcggcaccggctgggccatcaacgagttcagctgggacgtcaagtacgccggcgtccagatcctagcagcaaggttgctgctgagaggggagcacgcgacgcgccaccggagcacgctggagcggtacagggccaaggcggagcgctacgtgtgcgcgtgcctgggccggaacacggaaggcggcgcggacgccaacgtggagcgcagccccggcgggatgctctacgtccggcagtggaacaacatgcagtacgtgaccagcgccgcgttcctgctctccgcctactccgactacctggccgaggccggcgtccggaccgtgtcgtgcgcgggcggcgagaccgtggcggcccgggaggtggccgcgctcgccagggcgcaggtggactacgtgctcggcaccaaccccaggggcgtcagctacctcgtcggctacggccccaagtaccccagccgggtgcaccaccgcgccgcgtccatcgtgccgtacaagcacagcaaggagttcatcggctgcacgcagggcttcgaccactggttcggccgccggagctccaaccccaacgtgctcgtcggcgccatcgtcggcgggccggaccggcgggacaggttcagggacaaccgggagaactacatgcagacggaggcctgcacgtacaacacggccccgatggtcggcatgttcgccaagctgcaccggttggcgcggcaggagcgggaacaggggccgacgccggcgccggcgccggcgcccgtcacgtctgcagcggccgatgtgtaaatagataggaatgtagagggggggctgtacaattttccccattctttggttcattttttgttgggctctgaatttcattttacacagatccaggttattgtatacaaaagaaaaggtagaggcatcgacatgtgcaaatgtaaatccactaccagtacatacgagggaaagaaatggcattcttaacttattggtcgtcaaaaaaaaaaaaaaaacgtcggagattcttcattcgtgcagtccagcttgacaaagagcacgttatcttcggctaaccgggcgctgccgagttttcaatgccaatctggcaccataaggtcactagaccagctgcataacacgaagcacaggcataaaacacatggttagacctcaaaagaatggaaataatgatgctttcacatgattgctgtcctttctctaagagcagcaacataaaacaacaaatcttggtccgcctttgatacagctttcttaatcatatatatagtaaactaggaaacagtgaagcgagatcacctgctcttgcgtccgaagaatcgcaatcgaagctacacaaaatattatgccacagttcagatgccccattacccacatagagcccaatatgaacatgtgggccgtatcaacaagcatgtgtgtactccagcccaataatgaattgtacaatataatcatacagcagtatggcacaaccactgaacatgtggttcagtctaaaagaatgg

SEQ ID NO: 3689 - DNA, 2083 bp, Zea mays
  misc_feature (1)..(1): n is a, c, g, or t
naaaaaacacgctgtgcctgtgcgtgcgcttgtgtcgggcggggtcgcagcagccagccaggatataatccccgcgcgcgccgctcgtaaacagaggagggcgagagggagggcgagctgagccagtcctccgatcacgcgcccgcacacacgcacggagcgcggcagccggcagggaggaagagcttacagggccacagcaggcaggcaggcagggcacggagaggctattgaccaccgctgccgcacatgcgagcgggcgcagaggcgcgcggggactctcctcgtgcaatgagcgccgccgcgacgccgcgccaccgggctcgggggtcgcgctgcttctcctgctgctcctcggtggcgccggacgcgaaggcgcacagctacgaggacgcgctgcggaagagcctgctctacttcgaggcgcagcgctcgggccggctcccgcacagccagcgcgtcacctggcgccaccactccggcctcaccgacggtctcgagcaaggggtggacttggtcggcggatactacgacgccggggatcacgtcaagttcgggctccccatggcgttcaccgtcaccatgctgtcgtggagcctgatcgagtacggcgccgacgtcgcggcggccggcgagctcggccacgcgctcgaggccgtcaagtggggaaccgactacttcgtcaaggcgcacaccaggcccgatgagctgtgggctgaggtgggcgacggcgacacggaccactactgctggcagcggccggaggacatgacgacgtcgcggcaggcgtacaaggtcgaccgggaccacccgggctccgacgtcgccggcgagaccgcggcggccatggcggccgcgtccatcgtcttccgcgactccaacccgcactacgcgcacctcctcctgcaccacgcccagcagctgttcgagttcgccgacaagtacaggggcaaatacgacagcagcatcgctgaggtgaagagctactacgcgtccgtgagcgggtacaaggacgagctcctgtgggccgccctgtggctccaccgcgccaccggcagggctgactacctcgactacgtcgtcgacaatgccgacagcttcggcggcaccggctgggccatcaacgagttcagctgggacgtcaagtacgccggcgtccagatcctagcagcaaggttgctgctgagaggggagcacgcgacgcgccaccggagcacgctggagcggtacagggccaaggcggagcgctacgtgtgcgcgtgcctgggccggaacacggaaggcggcgcggacgccaacgtggagcgcagccccggcgggatgctctacgtccggcagtggaacaacatgcagtacgtgaccagcgccgcgttcctgctctccgcctactccgactacctggccgaggccggcgtccggaccgtgtcgtgcgcgggcggcgagaccgtggcggcccgggaggtggccgcgctcgccagggcgcaggtggactacgtgctcggcaccaaccccaggggcgtcagctacctcgtcggctacggccccaagtaccccagccgggtgcaccaccgcgccgcgtccatcgtgccgtacaagcacagcaaggagttcatcggctgcacgcagggcttcgaccactggttcggccgccggagctccaaccccaacgtgctcgtcggcgccatcgtcggcgggccggaccggcgggacaggttcagggacaaccgggagaactacatgcagacggaggcctgcacgtacaacacggccccgatggtcggcatgttcgccaagctgcaccggttggcgcggcaggagcgggaacaggggccgacgccggcgccggcgccggcgcccgtcacgtctgcagcggccgatgtgtaaatagataggaatgtagagggggggctgtacaattttccccattctttggttcattttttgttgggctctgaatttcattttacacagatccaggttattgtatacaaaagaaaaggtagaggcatcgacatgtgcaaatgtaaatccactaccagtacatacgagggaaagaaatggcattcttaacttattggtcgtc

SEQ ID NO: 3690 - DNA, 4572 bp, Zea mays
  misc_feature (1627)..(1627): n is a, c, g, or t
  misc_feature (1696)..(1696): n is a, c, g, or t
  misc_feature (1706)..(1706): n is a, c, g, or t
  misc_feature (1709)..(1709): n is a, c, g, or t
  misc_feature (1712)..(1712): n is a, c, g, or t
cgcttacatataagggctgcgcgcacgacgtcccccagggccgcggactggacagcccaccacactcttccactcccctcccccgccccgccaccgatccccaccgccgaacaaccgacgggtgctgctgctcctgctcctgccgccacctgctacgtagcatacgcggacggacgtaccaccaaacccccaccgaactagctgccggtccatcgcgctacgccgctacctacgacgatcgggcaagcgaagcgcgcgagttcgacgtcgtcgtcctctggcatcatctctatccgccgtcctgtggtatcgtcagcagcaccggtgtcgtcgtcgtcgatcgtttccggttgtgaggagaggcggcgatgaagaggaccacgagcaggagcggcgcgtcgcccgccgccggcctgtggctccggccgggccggctcggtgaggttctcgccgtcgcgactctgctggcctcggcgttgctgccgtcggcggcggctgcgaccgacgcgccgccgccggcgtcgtcgccgcggcacgactacgaggacgcgctgcgcaagagcctgctctacttcgaggcgcagcggtcggggcggctgccgcacggccagcgcgtcacctggcgcgaccactcgggcctcaccgacggcctcgagcaaggggtacgttcgttcgtacagtacgtacgcgggcgaggggcgacctgacggcggtgctttgttgggttggaacttggaacttggatcccgattttgatcgactgccggcctgtttcaggtggacctggtgggcgggtactacgacgccggcgaccacgtcaagttcggcttgcccatggccttcaccgtcaccatgctctcctggagcctgctggagtacggcgccgacgtcgccgacgccggcgagctcgcccacgcgctcgagtccatcaagtggggcaccgactacttcatcaaggcgcacaccaggcccgacgagctctgggcagaggtatacgagcaattcaccatttacagtaacaaattaaattagtaccactcacagtcactgcacctacctaatcacatgatcgtgggctagaaaactgtgtcttaattggtttggtaataaacaagcaagataataccccagtcatagccagagcgaccaacaaacatgcatccacacagcagtcatggttgcagagtttttttttttttgaagattcgaaaggggggggtgggggtgggggggggggggggaagagaacatttgttaggtggtgctactgctaggggacaaccaagctgcggttcggaacgcgcaaatctcacacgctccatgattgtgcttccacatgggggattattagctagctgcggcgagctgttttttttatttgtatattccggctccttttaacttttataatttcggaggcgggcgggctggctctgactctgaactaagctacgtacctagctcatgtgctcatggacgacgaccgacgcaatgattgaccgcggtatatgctatgcctggctgccaggtcggcgacggcgacacggaccactactgctggcagcggccggaggacatgacgacgtcgcggcaggcgtacaaggtggaccgcgaccggccagggtcngacgtcgccggcgagaccgcggccgccatggccgccgcgtccatggtgttccgggagcacaacccgcantacgccagcntcntcntcctccacgcgctgcaggtgggtgtactgccttactttactcatcatgatgtgacagactgaaacgtaccttaattaatcactgctaatgatggaggagattagttaccgcaccgcacggtcagcgtcccccccgattccgattgggtcagaactaccttacttttttttttgtcgtgcggcgtgccggtcggtcggagccgccgccgcacgattttctttcgccctcctcctggttcacactcctggttagctctgtgcagcagccggttcggcgcacgtggcaacttgtcaccgtgcgtgacgacgtctggtcaagggcgggttgaactttgaaccgtgtctgcgtgcgcgcgcgtgtgaaaacttgctgtcctgtcggtccacacgtggggccccacgccgcggacatagcatatgctactctctaccagtaccagggttaggttaggtgggtactactgattaagctcctcagcgtaaccaccacattcggtcacgttgtgatgggatcgaccgatagatagctactccagcatcgatctcctgcaaagctagccagccatgtattacaacgatgcactgatgatgatggatcatcgatccatcgatcatgcatggcaggcagagctaggccatgccactactggaataatattagctgggttggttagtacgtactcattagtagtacctgggggtgtggagatgaacagtcactagctagtagtctagtactactgatcccccagctaagctagctaaagctactagctttgaacaataatgatcgaaccatccatggacaaaaactgatcccacgcacctgccgcgctgtacttacagctgttcgagttcgccgacaagtaccggggcaagtacgacagcagcatcgcggaggtgaagagctactacgcctccgtcagcggctaccacgacgagctcctctgggccgcgctctggctccaccgcgccaccggacgcgccgagtacctggactacgtcgtcgacaacgccgacgacttcggcggcaccggctgggccatcaccgagttcagctgggacgtcaagtacgccggcgtccagatcctcgccgcaagggtacgcgtgctagctgcgtatatgctactgttttttttcctttctttctttctttctaccctgaatatataatatatattaaaaggacgtacatacaatacaagtgcttacgtgtcgtcgcgcgcgtggtttcatttcagctgctgctcagcggggagcactcgccgcggcacagggagacgctggagcagtacagggcgaaggcggagcactacgtgtgcgcgtgcctgggcaggaacgccgcggacggcaacgtggagcgcagccccggcgggatgctgtacgtgcggcagtggaacaacatgcagtacgtgacgagcgccgcgttcctgctgtccgcctactcgggctacctctcctcgtcgtcgtcgtcgtcgtccgtgacgtgcgcggcgggcggcggctcatcggcggccgccagcgccggcgaggtgttcgcgctggcccgggcgcaggtggactacgtgctgggcagcaacccgcgcgggatgagctacctggtgggctacggcgcccggttccccgccagggtgcaccaccgcgccgcctccatcgtgccgtacaagcacagcaaggagttcatcggctgcgcgcagggcttcgacgactggttcgtccgcaagggcgccaaccccaacgtcgtcgtcggcgccatcgtcggcgggcccgaccgccgggaccgcttcagggaccacagggagaactacatgcagaccgaggcgtgcacgtacaacacggcgcccatggtcggcatgttcgccatgctcaacaggctggcccgggacgaggcgggtgtaaatagatagccatatatatacagcgggggcttgtacaatttttatttggccctattcttttgttcattcttctctacggaggaaagtagaagtgaagtgaaggcactctcttcacaggaaattatttgtatacgattaaaaaaaagataggaggagggatttggcaaagcaaatgtaaattccctccccgtaaatatcagagagagagagagagaatacgaagaatgtcttatatagttccatataaatcaaatcacctcttgcctcccaaatcatcactgatgctcatgcccgcaatgatcacagaatcttgtaaagaaatttcagcatggcgaggcacctataatcaagtatgttgttctgaagaagtgaagagtacccgatatataaagaaagtctgatattctttttatttaattagaagaaagcctgatattctgcagacagagtactgaacgaatatttgtatcgtccagaaagatctcgagtgcggtcgtctttttcacgctggcgacgatgcaaaggagaactctttcagctgcaaagtttgcaggggtaaatggcgtgttgtgtataccggaagtggccgttcttggaccattgttgtttatgacgagcatttcaaatttttttcatttcaatcattcttttgatatcagaagagattcgcatcacgtatcagtaaatactagcacgtctaaatcgacatacgattttgaactcaatgaaaaaccgatcgacctaataaccgactaaaccaatattgttctatttatattagggacccggacgcgaaacacagactagtgcatcagaaatgtaaataaccaaactaccaaagtatagtcattaatcattataaacatatatattttcttgttgtattacaaattagaaagtattacgtctacctaatcatatgatctctcatccataaaatcggttgtgtaactcattcatctt

SEQ ID NO: 3691 - DNA, 921 bp, Zea mays
  misc_feature (908)..(908): n is a, c, g, or t
atgatcagacagctcaccagctagctatattgaagtaggtcctgtcagcccgctgtggtgcgtgttgtaggaaccataacagcgcgctgtattgaatatactgctggtggtatacatgagaaagaatcagccgagatagtttatcaacatggagatagggaccaagcaaagccctctcttcctcagctcattgctctcatacagcagcgccttctcgctattacttgaactgttgatggcttgttgatcccccacgccagtcacctgctgttttgaacccacagcttccacgtacttggccatgagctgcaggtggtggggcatgttggattctttcgcgccatccatggctgccatttgcttcaagccgaaactctccatggtagccatcttttggccagctgcagaagagcaggcggtgtcctgtagggactcgtcgtcgtcgccgccgcacatgagctgagacgtgataaaggaggaggcgtcgccaaaggaatcgaaggaagaagagaagctgccgccgccgccagagaccgccgcttgcggatcatccgtcgttgcgatgtcgtcttgcggcatggaggccaggaagttcgcgatgtgcacggcccagctgctctcgccgccggctgatgacatggtggacgtggccgccgggctgatgacgcacgaggaggaggctgatttgttctccattgttctgaccggtagtgcccggccggaagaaacagtaggagttgcagcggcagctcttgctatcgatctgttgtgctggtgctgctttgttttccggatgggaatatgggatgggagtgccgaccccgcccgcgaggcccccggtatatatacaggtcctattactcctatagtggatgaaccgactagtcggtagccccggccggcccgcnagggtacccaaaa

SEQ ID NO: 3692 - DNA, 1649 bp, Zea mays
cattgggtacctcgaggccggccgggacttctcgtgcgaagaagaaagtgttctcttgcttgatccgccattcagaagccggccactaatccgagctaggcacgctcccatccgacgtcgtcccagctagcacagccatttctgtttcgtttcttccactgcagtcagaacccagaagcagaggccgccgttgcaagcatgccgccgatggaggccgccgaggacgtcgtcatcgtcggcgccggacttgccggactcgcggtggctctcggactgcacaggaaaggggtgaggagcctggtgctggagtcgtcgccgtcgctgcgcgcgtcggggttcgccttcaccacgtggacgaacgccttccgggcgctggacgccctcggggtgggcgacaagatcaggaggcagcaccagcaggcgcaggcgctacgcgtcatggcttcttccaccggagaaatcgtacaggaagtggacctcacgcagcaggggaaacgagggcccaacgagatccgttgcgttcggcgggacctgctgctgcaggccttggaggaggagctaccgagaggcgccatccgctactcgtccaggatcgtgtccatcgaggaggaggacggcaacggcgacaaggtcctgcaactaaccgatggttcagtcatcagagcaaaggtgctcgtcgggtgcgacggggtcaactccgtggtggccaaatggctcggcctcgccacgccgtcctactcggggcgctcggcggcgagaggcttcgcgcgttacccggacggccacggcttcgagccaagttcctgcagttcgtcggccacggcttccgctccggcatgctgccgtgcaacgacaccgacatctactggttcttcacctggactccttccgagaacgacaagggcgtcgacgagagcgcggccaagatgaagcagttcgtgctggccaagctccggggctccaataaggtgcccgcggaggcgctggcggcgatcgacaggagcgagatgagcgacgtgctcgccgcgccgctgcggttccggtcgccgctgtcgctggccaccgcgagcatcgccaggggcagcgcgtgcgtggccggcgacgcgctgcacccgatgacgccggacctcggccagggcgcctgctcggcgctggaggacggcgtcgtcctggcccgctgcctcggcgacgccctgctgccgccgccagctggcagtggcagtggcaggggcaaggaggaccgggtccaggcggccttgcgcgagtacgcctggatcaggcggtggaggagcgtcgagctcgtcgccacctcctacaccgttggcttcgtccagcagagtgacagcgcggtcgtcagcttcctgcgggacaggctcctgtcgggagtgctcgctcgaaggcttctgaaaatggcggactacgactgcggcacgctcgaaagctactagcccccttgtactgtttcctgtgtgtacatcagtacacgtgttgtgttgtgcctgctgctggaataatatgcctactgttatgtgttattagtagaaaattgtactgcaatatcatcacctctgttgcacattttttttctacccttgtttatgcatagcataggaaccgtcacatcgatgtaacttttgatttctctgctt

SEQ ID NO: 3693 - DNA, 1441 bp, Zea mays
  misc_feature (1334)..(1334): n is a, c, g, or t
  misc_feature (1394)..(1394): n is a, c, g, or t
gccggccggctggactacgcggactacgcaaacagagcaaagcatcggtgtctacctcattattttcggagtccgagtggcgaaacccgccgcagcttccactgggcagtgctccacaggctcatatccgattccgatccctaagacctcagccgctgcggcatccacggccaactcaagcgctggcaactggcaagggcagatgatctgtgtatagcactcgctaccttctcttgatttcccccctgaggtcgctgaccaagggtcctgtccgccatggatgcggagcgaagctctgcacgcagcgccacgccttttggtccgccgtccgatcgccaccgctagacgccacgcctgcgttgccttcccggctgaatcgccgattcccttggcggtctagtgcctgcggtcggcgccagacgccggcgaggtagccgcgagacacaggtacgggtgccgaacgggaacggctgctgcccgccgagccgtcgactgcctgcctggagccttgactgcgcaagcgcagctgccgtgtgttgagtgctgagtcgccgactccaccaggtggccagcgattgctttgctgctccaggaaagaagccaaaaaaaaaaaaaaaaaatccctataaacatcgattgaaagggaaaagacaatgccaagcctgaactgagaggcgcacactggatttcgcatcagttcatgtcgttccttacaccgtcaatttgacgaatcacctcgccacgccgccttgattttgttttgtcctccgcttctggccgggctcagttcagctgtatggtattggtatcgccatgtcaagcgacctctccacacgctcctcgccttcctcctccaccgcgtcgccttccgacgactcgcggcggcaggagcaaggccaggcggcgggtaacgccagcgggagccggcggtggcggtggcgcctcgggctgggcgcggcgtgggcgctggacccgcgggcgaggtgggtccgggactggaaccgcgcctacctcctggcctgcgcggccgggctcatggtcgacccgctcttcctctacgccgtgtccctgagcggcccgctcatgtgcatattcgtcgacggctggctcgccgccgccgtcaccgcgctgcgctgcggggtggacgccatgcacgtgtggaacgtcgccacgcagctccgcaccgccaaggcgccgccgggtaagcgcgtggccggcgacgaggagcagcagcagaccgtcgccgaggccgcgcgcaagctctccgaggacgcggcgtccaggagggggctgttgctggacttcttcgtcatccttcccgtgatgcaggtggntggtgtgggttgcggcgccggcgatgatccgcgcggggctgacgacgccggtgatgacgntgctgctggtgtcgttcctgctggagtactgccccagatctaccacg

SEQ ID NO: 3694 - DNA, 3144 bp, Zea mays
  misc_feature (1213)..(1213): n is a, c, g, or t
  misc_feature (1407)..(1407): n is a, c, g, or t
  misc_feature (1981)..(1981): n is a, c, g, or t
  misc_feature (2115)..(2115): n is a, c, g, or t
cctgctttcctcccctgctttcctgctttcctcccctgctttcctcccctgctgaaactgctttcctcccctgtgcagtgtacaagtgaaagaaatcaaaggattaaggtttaaggatgtcatcagaaactgcagctgcaccttctgaaactgaagcagctagagcgaatctcctaaaaagaaattcagatgatgttggatgggaatatggtgttcttgttgatgctaacaacaaagacaaggtgaagtgtaagttctgtgacaaggagatgagtggagggatttataggttgaaggagcatcttgcccaggttggaaagaatgtgaagaaatgcacgtatgcaacaccgcaggctctagaggctaaagagaagtgcaagaaagcaatagaaattggagtgaaacaccaagctccttacaaaagatggaactgaaacaccagctttacaaaagatggctacaaggatattatctttgacatcaagctcttctggttgtgaaagaaattggagggggtttgaaggggtcagtacctatctattaatcatttcagcagtactatgattaaatttcagaactgaaaatgcttttgtttctaatttatagatacacactaagaagagaaataggctgactacaacccgcctcaacaagttggtctatattcagttcaataacaggctgatgaataacagagaaaagattaagtcaaagaaaatcactgatgttctcttgtctagtgatacaactgaagctcaaggttttctccaagagggtggagatgattgtgcacaagttgtctttagagatgaggaagatgagatggaaggtacagggataccttggtctgttattggagaggcagtgggagcagaagaacagcttgagcctcgtagaagtgcaagagtgagagagctctatgaaggagaagagtttgagtctgaagaagaagagtatgaagatgaagatttgtgctacagtgaagatgaaatatgatctggaccatctccatctagtagtgaagccttttgtgatgccctggtcttatgaactgcagctgtgtcactttgtgtctgtgtgtcttcttttgtgtgagacctgaactaagaactatgtgcttgtgttgtcctttatttataaattgtgttctgcacttgtattactgtcatatccatttgtgttgtaattaccagctgctgatatggtgtgctcnactgctcatgaatgggaggttgttgaaatcatccagataagtcacaatttagtgttttctatttttttgatgaacaactagttgtgtattgactaatttactaactactagctgtcaaaatgtgttgcagccttgcaggagctaggaacatgcaagagtaagctcagctaggaatcagatatgtctactagccntctttttatacttactgtgactcatatatagtagttatatatgtatatatagttatatacataatatatatatatatatatataatttatggctatattgccaaaacgcctagaaaagcgcctagaagcgcctaagaccgagtactcccgactaggcgctaggcaatgggacaccgcctagattccgcctagcgcctagctgaactttggatatcactgatgcagaaaacgacgatatcgacaaaggaaacatagaggtacaatcttctttgtttcactaatctaccatatttattttttttcctaaatttaactcattccatccttcacatgctcggttattccatatgaacatttcatacaacagataatactggcacaattaaatgcaacaaaaaaaataaaactccataatattatttaataaattataataaaatccattcttatgcttagcagtaacacatactaggacctacacaactgctactccaggcaatcctgaatgcataatgaacattctattcaaacttaatagcttaatgaaacattataatttcctttcttcctaccnatttttcctattttgtttctattcaatttgaactaaattcaatctagtcataatttttttaaaccgacaagagaattgcctgttatattaaaaagaagatgagcgcctgcaagggatggactatacaagtccancacactaggaaaggagacactaattatagtggcacaaatgtcctaaaccaaatgaaatcgaaattagcatttcagcagaacaccattcttcctatttttaagatcacacaacacaataatatatcatcaactacaatcttttccgtttaattaacctaccacaatactttcatgtaattaaactagattactatgatcgttcacacaaacacttgctctatatatacacagtctaatgctctgaaaacactccattctacgcacatcatttactccatatgcacaattcatatgtaacagataatattagtaagatgagattgaagaaaattacaacaacatgctactccataacagattgtaacataaattattcttatcatgaatgatagcattcattaaatctaaactatcttctcttcatattcaaacacttcatattcaaacactttattaaaattcgattgtccaacaaaatatattgcttccttttctagctatccatctttcgatacctataactaatagacagttatagataatactgcttcacactttcatttacacttaacaaataccatcaccttcttgccacttctttataaataatttttacatatacagcatgatgtaatacttgacgacaagggaaaaggtccaacagctacaattgaatctccacccaaaaaattatactttgctatacaatatcctacatgtattattttctatctattataaaagcgtcatttcatttttgtttggtaattattgcaactacaaaagtgaacttatccaaaactatatttctttcacacatttttccccatatttaacttatccaaaatttaataccacatatacatgtaaatagaaactagaaattaattgtgataaccatttatgctgaacaattctgtccctttctcttctgcttccataaacgaagacattaaaattatttgtttctcaactatacaggttcaaacatgggacctctgtgcatcaaagaaaagccggacaccatat

SEQ ID NO: 3695 - DNA, 3016 bp, Zea mays
  misc_feature (319)..(319): n is a, c, g, or t
  misc_feature (1899)..(1899): n is a, c, g, or t
cgctcgacttgctgatcccaatggcgtcgtcctatcgtgtctatgtgcagctcgacggggcgatcgtggcgccgagcgaccccgacacgtggccggtcaacagcaagcgcaactggctgctgttctaccaggcccacggcatgtcgctgcagggcgccggcctcatcgacggcaggggccagaagtggtgggagctcccctgcaagtctcacaagggccagggtggatcaagcggccacggtgcatcctgcgacagcccagtggtaagtggctctcaactaattaacgacttttaggccttgttcgtttccgttggatngcacccggaatcgttccagctaatcaaagtttatataaattagagaaacaatccggtcaggaatcgttccaactcatcaatccggcagaaacgaacaaggccttaaccgcactataattaaccgccacttggtgtactactggtcccatgctcatggcaacatccatcatcgtcaggcgctgaggtttttcatgaccaacaacgtgacggtacaaggcctcaaggtgcagaacagccccgagttccacatccggttcgacagctgccgcggcgtggtcgccagcggcctgtccatcagctccccggcgctgagccccaacacggacggcatccacgtcgagaacaccgaggacgtcctcatcaccaacaccgccgtctccaacggcgacgactgcgtctccatcggcgccggcacccgcaacatgcacgtcgagaacgtcacctgcgggcccggcggccacggcatcagcatcgggagcctgggcaagcagggctcgcgggcgtgcgtggccaacgtcacggtgcgcaacgcggtcatccgccactcggacaacggcgtccggatcaagacgtggcagggcggctccggcgccgtctcctccgtctccttcgagaacgtgcgcatggacgccgtgcgcaaccccatcatcatcgaccagtactactgcctctccaagagctgcgacaacgccacctccgccgtcttcgtctccggcgtctcctacgccggcatccggggcacctacgacccgcgcaccacgcccatccacttcggatgcagcgacgccgtgccgtgcaccaacatcacgctctccgacgtcgagcttctccccgcgtccggcgacagtaccatcgacaaccccttctgctggaacgtgtacggcagcaccgccacgcccacggtgccgcccgtgccatgcctcatagaaggcgtgcccaggagagtcgacgataacagcaccctcaaatgctactagatagcagctagtgatcgatgaacgtcctatacatatgcatccggcctgctactacttgtttattagaaggagatgaggccgacgaaaacagacaaaagtaattaagattagtgcagataaaaggagttcaacgcgtaattgcttatgtatgtagagaaaaagatggaaatgtaatagtagtactaacaagtcatttgtgtaagaactatacatatagtgttaccggaatatatacaatgttttcaactttggtattcgaattttttgaagtcacactctcgaaattactaagttcatgtacttttggccaaatttcgtcggattttgtttggaagcttcaacaaaaagtatggttttattaaatttttagatctagaaaaaaggtattggcacgatttatgattatacatgacaaataggcttcatagggaaaattccagcgctaattgatctgaatcgaactggtttcattaaagggaagtcagctgaaacatttgtctatgcttaattaggttcttaggaaaaacaatagcattcaaccctagcatcgtttgtctagctagcgatagaggctcatggaaaactcctatacctgccactacngaggggtgcacgtccttaaagactttttaagcctggaaggtgcaacacttcattcttggagatcttgctgataaaagtttccctttacttgaagaacgtgatgcctagaactaagagtttcaagaagggagtgaacatgaaaactcgttttaacaatagagagcattagataaatttaaaatgaaaaagggaggaagaaggtcgaggaggtgaagtgtttttaaaatattgtaaaattataaccttaacaacgactatttatatcaacgaatctagtggcctccacaggcatagatcgagaagaccatgagtctagacttcgccaccgtgctcatcagcgtacacccatacacttcctttagttgagaaatattatgtaaagcaagtacttttggtattcaacaagtatggaaaagatgtcatgtaggttgatcaggaaaggctaaacttggttctttgctaaaaaagcttttatttgaaattcatttatttccactcataattttcttgtaaataaggataatcataccaaacccataatcaccaacaaatacatatctcatctaattgtgtgggggtccatgccgctcttaactgtgagtatggctgtcacgacaattttcactctgtagaggttgtacactttttcgacgagaagtgacttcattccccatcctcgggggatgaatatctccatctggtcttccttggtgtatgaccagaagaccactacaagacttttcgttaactttctctaggatgtacgtacccactaaggtttcaaccaataggaaagtacccttcctaactcccacacatcacttttctgacgaatttggcgtaccccgtcatcctcgtaccactgtttggcacacacaaaactggtttccgctaattactatgtcaggttgtgcccatacttagctcgtggttgtacaatctcatgggtgctcgctccataaaccgaccataagattcatttaatttgggtgataaaacaaataaggaaaactactgataccctcgaacataaataggtaaaaaacctaaaattatgtataaataaggatttaaaccatggtcgttggcttaaaacccacattcccacccacctaac

SEQ ID NO: 3696 - DNA, 977 bp, Zea mays
gctagttgtttcttgaaccttgaactgctgacctggccaaaggagagaatatatggaaaccaaggagcgaagactcttcaagcctcattacctcatatctatttaactataccccccaagaccgcccgggaacaaagaatccatggtggtggaatttcggatcaatataagtggcggagttgggattggttcttggtgcaaaagcaagagcaaaagatcatctctatccgtatcctagctttggtggtccgcagaacaggtggttaagaatagggagaaacaagggttaggtggcagaggaggcagtgaaatccggccaaatctcgacgcaacttttcttgccgattgttggtgcgtagtaagatcctagttgaatccgtaggacgggcgctaatcggaggaacttgcatcgattcttgcgtgctgacggtaccggcaaggcggcaagataagagttggtgcctgccgattgcagggacagggacggtgtttgtggaattgcctccttggaggaggctggtgagagggagaaaggatgacgatgccatggggtctcgcggcctgcatcgtggacatggtgtgggcggtgctcgccggctgggtgtccacctgcctggtcatcgccaacgaggtcgcccgcggcatgcgcagtggcgagatcggtccgttcgttgtcggctgagttattcgaccggctttaggtggctcagttgttcctgcattctcgatagtgtatttttcgtaccggtatatttcatacacatcgttatgctgtacagacggcgttgaggactggagaggatgacttttgtttctaggatttttgagttgttgagtgtttgtgcaatcacacaagaacaaacatgtgaatatgtgatgtacttccagtggtatataaacgggatggtcctgtaaaataattctaaattgaattcaatatctaatccttttatgttcttgtaaaaaaaaaaaaaaaa

SEQ ID NO: 3697 - DNA, 978 bp, Zea mays
ccggagggtccctgggccccccggggccggcccgggaaccttgtactgctgacctggccaaaggagagaatatatggaaaccaaggagcgaagactcttcaagcctcattacctcatatctatttaactatagtgaaaaaaaatccgaacaaagaatccatggtggtggaatttcggatcaatataagtggcggagttgggattggttcttggtgcaaaagcaagagcaaaagatcatctctatccgtatcctagctttggtggtccgcagaacaggtggttaagaatagggagaaacaagggttaggtggcagaggaggcagtgaaatccggccaaatctcgacgcaatttttcttgccgattgctggtgcgtagtaagatcgtagctgaatccgtaggacgggcgctaatcggaggaacttgcatcgattcttgcgtgctgacggtaccggcaaggcggcaagataagagggacagggacggtgtttgtggaattgcctccttggaggaggctggtgagagggagaaaggatgacgatgccatggggtctcgcggcctgcatcgtggacatggtgtgggcggtgctcgccggctgggtgtccacctgcctggtcatcgccaacgaggtcgcccgcggcatgcgcagtggcgagatcggtccgttcgttgtcggctgagttattcgatcggctttaggtggctcagttgttcctgcattctcgatagtgtatttttcgtaccggtacatttcatacacatcgctatgctgtacagacggcgttgaggactggaggatgacttttgtttctaggattttgagttgtagtgagtgtttgtgcaatcacacaagaacaaacatgtgaatatgtgatgtactttcagtggtatataaacgggatggtcctgtaaaataattctaaattgaattcaatatctaatccttttatgttccaaaaaaaaaaaaaaaaagccccta

SEQ ID NO: 3698 - DNA, 1050 bp, Zea mays
cctcgaggccgcccggcactccttatcccttctctatccgccagagggaaatacccattgatctcatctcatgccctgttgccgcgcctgctcctccttccccatccgcgcccaccgccgcccctccggcagccccgccacgagcccacccgcaagcttcccgcacggccaccgctgcctggtatcaatcaaaccagtcgtccgtcctcctttccttcaaatcaagtccatttccactccctgtctaccctctccctcgtctctggtgggcggtggcctcgcctccctttccccgtcgccctgatggctccctccgcagctctcgctccggtggccttccgctccgccttctcgactccgctcgcgtcgaaccctacccgtaatagaataaacatagaaggcgctttctgtttgccgtgttccgcaaggaagagagctagttatagatctttccgagtgtacagtttatttggagggaagaaggataaagatgagaatggcgatgaagcgccatcgaaagcagggatttttggaaacatgcaaaatctctatgaaactgttaagaaggcccaaatggttgtccaagttgaggctgttcgggtgcagaaggagcttgcagcgactgagattgatggttattgtgaaggtgaactaatcaaggttacactttctggaaaccagcaacctattagagttgaaatcacagaagctgcaatggagttgggtgctgaaaaactttcggagctggtcaatgatgcttacaaggatgcgcatcaacggagtgtccaggccatgaaagagaggatgtctgacttggcacagagcttaggaatgcctgcgggccttggtgatggtctcaagtgatgctgcgattcgggaagcctttctaataatttttttttggtccctcaattttgtatacgaagtcacgtagtaagaagtgtactcgtgaccagctgtttcgttcagcgttagctgtgattttgttttgtacaagcagatatatttgcactaaatcgtggtaacgtcgtcctctggagcttggatgtc

SEQ ID NO: 3699 - DNA, 1086 bp, Zea mays
cggccgggactccttatcccttctctatccgccaaagggaaatacccattgatctcatctcatgccctgttgccgcgcctgctcctccttccccatccgcacccaccgccgcccacccgcaagcttcccgcacggccaccgctgcccggtatcaatcgaaccagtcgtccgtcctcctttccttcaaatcaagtccatttccactccctgtctaccctctccctcgtctctggtgggcggtggcctcgcctccctttccccgtcgccctgatggctccctccgcagctctcgctccggtggccttccgctccgccttctcgactccgctcgcgtcgaaccctacccgtaatagaataaacatagaaggcgctttctgtttgccgtgttccgcaaggaagagagctagttatagatctttccgagtgtacagtttatttggagggaagaaggataaagatgagaatggcgatgaagcgccatcgaaagcagggatttttggaaacatgcaaaatctctatgaaactgttaagaaggcccaaatggttgtccaagttgaggctgtccgggtgcagaaggagcttgcagcgactgagattgatggttattgtgaaggtgaactaatcaaggttacactttctggaaaccagcaacctattagagttgaaatcacagaagctgcaatggagttgggtgctgaaaaactttcggagctggtcaatgatgcttacaaggatgcgcatcaacggagcgtccaggccatgaaagagaggatgtctgacttggcacagagcttaggaatgcctgcgggccttggtgatggtctcaagtgatgctgcctgccattcgggaagcctttctaataattttttttgtccctcaattttgtatacgagccgtgtgggcaccttctcgtagtcacgtagtaagaagtgtactcgtgaccagctgtttcgttcagcgttagctgtgattttgttttgtacaagcagatattttgcactaaaaaaaaaaaaaaaaaaactatggaactcggatatcacatgtggtatgctaatctgcaagatataggggatatgcaccgaaat

SEQ ID NO: 3700 - DNA, 1115 bp, Zea mays
cattgggtaccccggcccccccggccgggactcccgtcactccttatcccttcccatcgatcccatgccctgttgccgcgcccgcacctccttccccatccgcgcccgccgcggctcctccggcagctccgccacgcgcccaaccgcaacctgcccgcacggccaccgctgcctggtagtatctatcaaatcagccacctgtcctctttttcttcaaatcaagtccgtttccctttcctttctaccctctccctcgtctccggcgggcggtggcctcacctccctctccccgtcgccctgatggctccctccacagctctcgctccggtggccttccgctccgccttctcgacgccgctcgcgtcgaaacctacccgtaatagaatgaacatagagggcgctttctgtttgccgtgttccacaaggaagagagcaagttatagacctttccgagtgtacagtttatttggagggaagaaggataaagatgagaatggtgatgaggcgccatcgaaagcaggaatttttggaaatatgcaaaatctctatgaaactgttaagaaggcccaaatggttgtccaagttgaggctgtccgggtgcaaaaggagcttgcagcgactgagattgatggttattgtgaaggcgaactaatcaaggttacactttctggaaaccagcaacctattagagttgaaatcacagaagctgcgatggagttgggtgctgaaaaactttccgggttggtcaacgatgcttacaaggatgcacaccaacggagcgtccaggccatgaaagagaggatggctgacttggcgcagagcctgggaatgcctgcgggcctcggcgatggtctcaagtgatgccgcaattcgggaaagctttccaataatcctttttcctcaattttgtatgctagccgtgtgagtagtaagcataacccctccgcgacctctcataagaagtgtacttgtgagcacttgttttctttcagctttagctgccatttgctgttctgcgcacgcagatatttgcacattaacttcacgtctggtctacaaagttgcaagatgcgggccatgatcttttgggcatttttccaacaagttgttgggct

SEQ ID NO: 3701 - DNA, 4853 bp, Zea mays
tgagcctctggagttcgtcttggtactaaaaagtcagaaccggtcctagttaattttaacgttcttaataaaaaaaaggtgaacgtaggaatgcacgtcctgaaatcggagtttggcgtaggaggctagcgcatctagcgaatgagaaatgtgcatctcggctgagtctcgggagggctacgacgtttggcgtaggaggctggcttgcctggctgaggcagagcttcttcgtgcggtcagcttagccgtggcatgactcggaagcccgacagtgcacgcgcggaaataacagcacgccgcaggggcatttccgtcaagggccgcccataagagtccacacgcttgcgctgccctgccccgccctcccccgcagccgccccgcccttggcctcgcctttccttgcttccttctcgagcagagcaacagagcaggtgaggcagtcagcacgctcagccacacccacagagacgcggcacgcctccactcctcctccgactccgaggccagcacgccgcacgctccgcctcgcagtcgcagcccctagcctctcgcgcgtgcttcttcttcctcctcgctccgggggctcgatctggtgagtgccctggcctgctcgtgtgggttttggaggagggttcctgagtgccatgtcgtcgggggtactgatacgataggatagattcggggctaaatttgtgggcgccgtctctaaggatgatttggtgatttgggcattgggttccgtctgcgctccttcctcccaattttgggttccctctgaactctgaattctccatacatggccgcatcgatctattacgcagttggtagaatcggcctttccagttctcagtactcatatttgggctcatcccatctggggagcgtcgcgccaccatttcgtgctacatctccgtgtaccatgtacaatgatgagcctgtttggatcccgtggcactaagtactagtttttatttatgctgcgtccaacgggactacgggaggaaataagcttgctagagccgcgtcatttctttctgcgtgcctttccaggagctgtcccggtgtaaattttgctcatggttaatgcttactcgttgtgctattagaagcttatgcaatcatattccgctgtatcttggagctgcctaccgatttggctctgaatgggttgcacattgttgcttagaatccggttaattagcctcgttttttttcctcagatgtctcacatatgcagtagattagtagacaatagtagtctaacagattgccgagcatacatctgataccagcacacatttgtttcgtttcgtatatatgaaagtattgctgtgtccttctgtttaaggaaactcacccgggttttccaatttccattcgtgcaggtaactctggtgggggacaatcaagaactgaacactcgacactggcacagagctctggcagcatgcggtggctcggtctatctgtcgatgtgttccgcagggggatctccttgaacctttactgccgtgtgattctgtaaatcgtctccgtggctaccggcttttccttcgcacgcctcctgattcatgagaggcttgtgaaggcactttacatcttccccacccagtcattaattggcgtcgctgttaggctgttgtggttgtttggccaaggcttttgaggagaacgtacggactggagtactgatggtgtggaaagcagccgctcagacgagattccgcgtgtttaagcatgagaacggaatcacagtgagggctattgcttgcttccagccgctgcaaaattgccaggtagtgaggcaaaagggcaaacatttgttaaggattttcctttcttcacttgatggttctgacatttgcttcggtatatctgctgtaggccgagtacttccgccatctcctcaagcccgtgacgtagctcccctctgctctccacctgctgctgaataaacttacagccttagttttttctccatagcaactgaagtgggagaacatcccagtcgttcatcgggactttctgctggtaagaacatcatcctttcattcatgttgctgctacctgtctctatttgatattgatatatactgacgctcagttccttcttggtaatctcaggtagttctgtccggtggttgttttaatttattcatcatgggggacaaggtgaatccctggtgccattggcctaatcctcaatggaaattcaacactgagagttctgccggcaatctgcacccacctgatgtcgggcttgctaatgccgattcggtggcattgcctgcataccaccttaacgcagcacctatgccatttttcgcagcatcgtcgattgctgagagacctcttccaataatgggcccgagacacgtcacgacgttggcaccaagtttcgaatcgcctgcaccgtgtccctcgcgtaagagaccttcagtcctctaccagaaggaaactcatggtcccaccgcagctcctttgcggaggagcaaggggccactggatcctgtgccggagctccaaggtagcaacgagaccaacgtaaccgacgttggagcagaagaaaccgagggtgttcacgaggacacagacgagatcgatgccctcctggactcctccgactcggacgaagggccgcacgaactcgacagggccaggaggcagcctgctgcagagaacgagacctcgagcgtcgagtcggtggccagtgccgcaggttctgcgccgccggccaagaagaggaggctcagctcttgcacggacaggtccgtcgtcgacaccgccagttcggcgaggccggaccattccgtcgagcagaagcctctcgcgagcgactgcgacgcgcagtcgtgctgcgtcggcgaggtggtggaaagcggccgccttaggttctctccgggggagggggagggggaggtggaggcagcagaaggcgacagccccgacgaccagaggcggaggagagagaggatccaagagaccgtggctgcgctgagaaacatcgtcccggggggcaccgccaaggacgccacggccgttctcgacgaagccatctgctacctgcagtatctgaagctgaaggtcaagacgctgggagctgcctccctctagcctcctggacagggagtcatctggctttctgctgttctacataagtatggagtgcaggcaggcattgggtaataaggtgaaagatgccggagaccatatcagaatttggcggtgcttcaggacacgcaccacaccaggggtgaaaacaacggggagaagggggaaaaaaaggtccaatggtgcttgctttgctgcttccccgcccgtgtaccacccccaccacaaggctctcgaacgatgctgtgggcaacgactggcgtgcagcattgcgaagagcgtcttcaaccgaagcgaggcgggtatgttttccgtcgtccatttgtggcggagcaacatggaggccaaaagatccatccaccagtcaccaccacctaatatgctgctctccagtgacagtgagctgctagtgtaagcaccatctttctgtctgggagcatggatcttccaccctaagagctgtcggtgcctgcctgtatcactcgccgtcctcaaaaaggccctcacggcacgggttggtgcaacgtatgcgctatgcaaagctagaagacatcttttgctgaccgtgatccaaagcaaagagcggcactgaccaccaaaggcaaggaaagggggggagatgggctggagcctggagtccaacaaagtgctgtgtgcctgacgtggatgagctcaaactctgagccacaccaattgcgcgggcgggcgcctttcatcatctcacgctgctttgctttctctcaaatcccgctgcatgtgccaccacactagcgtacatacgtatgtatgcttgtgtaatcgctttgacacgcctttgtacgcggtgtaatcatgtatagtcctagctttaggacggtttctctgctggatccggatgaatgagccttgctcgtcaagtgtgcgtgcgtgcgtgcgtctatagtcctgttctgttggcaatgattgtttggaggctgcatcgtcgtcgtcccgttgttgcccctcgactagaaggggattaaatcctcttctggattggtataaccgaagccgaagagtgctgctgcggcgctgccactgccggattgggaaccgctttggtccctgtagggaacggatggcgggagggattccgagtgggggcacgcgtggggagcggagcgtgcagcgaccgtcgcggcggaatgagtggcgaggcagatggagtggagccgtcgaggccgcctgctttccttcggttcgttgcgccgaggtgaggtggggccggccccaatgccaaagcggaagatggagaggactgcactgcacaggcatcatcgcactcgcatgcgcatgcgacggaacggagtgcgggccgtagtatccgccccccctcaactccctgtagcaaagcctttatagacgtgcaaaccaggtcacctggcggtggtcatacattgaaggagtcttcgaaaccattgctttacttctgtaacaccctgttttaaaggaacaaagctgggtgcatctcatacatgcgccaagaagacaacatatataataacagagtatatagagttaaatgtcacaaaacatcagagtatttattacatagcggaagtcttattacaaaataaagataaatataaaacgaactaaggatcgtcggcgccaatgtcgactgagaaacaccacctagatcaagtcgaatgcctcagtgttaggcagctcctctccgaccacctgttcttctcctgtgggggggggtgtgagacagcaagag

SEQ ID NO: 3702 - DNA, 1677 bp, Zea mays
  misc_feature (1646)..(1646): n is a, c, g, or t
  misc_feature (1651)..(1651): n is a, c, g, or t
  misc_feature (1657)..(1657): n is a, c, g, or t
  misc_feature (1673)..(1673): n is a, c, g, or t
ccacgcgtccgaccacttcgatgtttcctgcgacagcaacgagcacgagaccattacctagaacatcctaatcgaaaaatcagccctcacgcatgtggcacgcgatgggccggatctgaggttgagtgtgcgatcccgttggcatatcgacaaagtttggtgggtcccaccgcagatcccggcccggtaggtactagttccgccgtcccccctccctagtctccggggaggaccgtctcggccgcgagagtgcgctcgtcgactccactcagctctctcgctccctctcctcccccaaggtcccagagacaggcagccggcgaggcgcgccgccgcgaagcaatggatttcaaggggttctgggagtccagattcgggggcaagaaggaacccgagccggagcagaacgggcacgccaacggggtccagaaccagaagaggacctccgatctggcggtctacgagcagttcgagcagcaggccaggcagacccaggtccgagccgccgcgattcgcgacggagacgctgatgtcatccagaagccccttctaccttcatttgagtcagctgaaatgcgtaatctcgcagagacattgttgagggatattattcgcgggagcccagatgtgaaatgggagagcatcaaaggactggaaaatgcaaaacgccttctaaaagaggctgttgtcatgcccataaagtacccaaaatacttcactggtctcctttctccatggaaaggcatcttactttttggccccccagggacaggaaagacaatgctggcaaaagcggtcgctactgagtgcaaaaccaccttcttcaacatttcagcatcatcaattgtcagcaaatggcgtggagattcagagaagcttgtcaaagttctgtttgagcttgctaggcatcatgcaccatccacaatattccttgatgaaatagatgctatcatcagccagcgtggtgaagctcgcagtgagcatgaagctagtcgtcgcttgaagactgagctacttattcagatggatggtttgacaaagacaaacgacttggtatttgtacttgcagctacaaatcttccctgggaattggatgcagccatgctccgccggcttgagaagcggattcttgtaccgcttcctgaaggtgaagcaaggcaagcgatgtttgaggaacttctgccagcaactacctcaaagttagaaatcccgtacgacatactagttgaaaagactgaaggttactctggttcagatattcgtctcgtgtgcaaagaagctgccatgcaaccactgagacgtctcatgtcagttcttgaagccagtgacgagttggttccggaggaagaactgcctgaggttggccctctgaaacctgatgatattgaacttgcattaaggaacactaggccgtcagcacatctccatgcgcatcgctatgagaagttcaaccaggactacggtagccatgtcgtttgttcagagctagcatgatcttattatcgggtaaggctttcaagcctgacgaaatctgcccaacatattgcagtttccctctggccgcagtacctcgcccgcggcctcgctttaaagtgcgaagtgcaagttcttgctgctcaaatctaatttggcatttgctttgttcntgcantctganatttccccaatccttnaatc

SEQ ID NO: 3703 - DNA, 1706 bp, Zea mays
  misc_feature (534)..(534): n is a, c, g, or t
tcgaggccggccgggtctctgtgcggcctgctgactcccgtctccgcgttcgttctcccaggatttcaaggggttctgggagtccagattcggtggcaagaaggaacccgagccggggcagaacgggcacgccaacggggtccagaaccagaagaggacctccgatctggcggtctacgagcagttcgagcagcaggccaggcagacccaggtccgagccgccgcgattcgcgacggagacgctgatgtcataagccccttctaccttcatttgagtcagctgaaatgcgtaatctcgcagagacattgttgagggatattattcgcgggagcccagatgtgaaatgggagagcatcaaaggactggaaaatgcaaaacgccttctaaaagaggctgttgtcatgcccataaagtacccaaaatacttcactggtctcctttctccatggaaaggcatcttactttttccccccccgccggctgctttggacaatgctggcaaaagcggtcgctactgagtgcaaaaccacctntcttcaacatttcagcatcatcaattgccagcaaatggcgtggagattcagagaagcttgtcaaagttctgtttgagcttgctaggcatcatgcaccatccacagtattccttgatgaaatagatgctatcatcagccagcgtggtgaagctcgcagtgagcatgaggctagtcgtcgcttgaagactgagctacttattcagatggatggtttgacaaagacaaacgacttggtatttgtacttgcagctacaaatcttccctgggaattggatgcagccatgctccgccggcttgagaagcggattcttgtaccacttcctgaaggtgaagcaaggcaagcgatgtttgaggaacttctgccagcaactacctcaaagttagaaatcccgtacgacatactagttgaaaagactgaaggttactctggttcagatattcgtctcgtgtgcaaagaagctgccatgcaaccactgagacgtctcatgtcagttcttgaagccagtgacgagttggttccggaggaagaactgcctgaggttggccctctgaaacctgatgatattgaacttgcattaaggaacactaggccgtcagcacatctccatgcgcatcgctatgagaagttcaaccaggactacggtagccatgtcgtttgttcagagctagcatgatcttattatcgggttgatgtttcgttcaatcatggaaccagagcagagctaatatatgtcctgctccggcgcatcagtttgttggcatgttgatgggggtcgcgtgttgtcaaaacggttgctgcgctggtaacgcgactcccaacatattgcagtttccctctggccgcagtaccttgcattttgcatgggttaaagtgcgaggtgcaggtgcttgctgctcagatctatgtgggcatgtggctttgttcatgcaatctgagattttcccgaatccttgaactcagaaaaaaaagattcgttctctagttacgtgtctaataaatgttagttaccctgcagaaaagtacactctggtttatatttaaaggaaaacgagccagagagcttgtataagtttcttctgattgttggtgtaattacccagctcgttaaaccaagctttaacaacaaattcttgcatgttgtggtcaaccgcgagccggggcccggtaccca

SEQ ID NO: 3704 - DNA, 2642 bp, Zea mays
attcattggctcgcgctcggcagtcggcacgacggtacttggacttggctattcccaacgccaccccgcaaccgcaacgtctctctagcgtctagcctctgcctgcgctcccacaccagaacaccacaccgctccgcgtgcgtcgcccgcactcctcgcctctgcccgtctgcctaccgtgccgtgccgtgccgtgctccccacccgatgcagccgccgacgcgggccgtgccgagccacagccggagatgagctccaggaaccgttccgccgccgcctcgtccgctgccccggctctccggacaccgcgccgcctgaagcggcggccagttaaggcgtcggcgccggggccgggcagcgggcggcggagcgggcccgcgacgccgctgctgaaatgggacgtcggtggcggcggcgggcgcggtgaggggaggaaggctggcgccgacgaagcgggggacgccgcgcgggcgcgggagaccaaggcgaaggcgacggaggtgtcggtgcggaggctcgcggccggggtttggcggctgcgcccgccggaggccgtggccggcggcgggagcggggtccgcgtgggcgtcgagcatatcccaaggcatctacaagtccagcttctgaagcagaacacttcaggtcatcaccagagttcgaagaatgaggtttcaagccccatatctgttttggagcggaagagtggagagctccacaagggacaacttcatgctacttctgctatgctgcctgtcgctaccatggagaaggcaacgaaatgggagcctggggacataaagggaatggaatcgcatgatgcgtatctgatagccagccagctgaatcttcttgatgaacacagagacaccgcgtatgttgctgacctccagatggagcttcagcaagcacgtgacccgataagtgcgatggaaactgagcgacggtcagctaagaagaggcttgaccacttgttcaagaaacttgcggaggagaaagcggcttggaggaacagagagcatgaaaaggtgcgtgctatcctcgaagatatgaaggcagaccttgaccacgaggggaaaaaccggaggcggctggagatgattaacatgaaactcgtcaacgagctgaaggaggccaagatgtcagcaaaacagctgttacaagagtatgagacagagaggaaagcacgtgagctcactgaggaggtgtgcaacgagctagcaagagaggtggatgaagacaaagctgagatcgaggccctgaaacgggactcccagaggttgcgagaggaggtagacgaggagcggaagatgctgcagatggcggaggtgtggcgtgaagaacgggtgcagatgaagcttgttgatgcaaaacttactctcgacgcaaaatacacacagctgagcaaactgcaacaggatgttgaggcgtttattgctgcatgcagtactgctaatggagacgtcacggtagtagagcaagcagagagcataatacaggcaatcaagtcagtcagagcccaagatgctgagttcaggtacgagccaccggccgcatcagaagacatattttccatttttgaagagctgcgtccaagtgaggagcctgtcatcaaggagatcgagccatgttacaagaatagctctgccaaatgtgaaccagaaattcaagaggttagcccaatgaccgatatattcctcgaaaagaaagccaaggcaaactcgaacaaaagccctaaagatgaaagcgacactgaagatggcagcagctgggagacaataagccacgaagatgtccagggttcaagcggttcacctgatggaagcgagccttcggtcagcaacaaggtctgcgacggaagcattccttggaagagcagaaatggtttcgagcgtatggagagtgagaagctgaaggatgagtcagctgatgcctgcctgacaaacatgaaccagcccaagaagaaagaatcggccatttcaaagctctggaagtcgtcccgcccaaagaacagcgagatatgcaagaaagacgcagttgaaacggtaaatgcaagatcgtcaaacgtgcggctctcagtcgggacctattccactgttgaaagtggcatccaagaaatagggctcagtccaccgtgtgttgagcagtggagctcaccagactcgatgaacgtccaattcaaccggggattcaagggctgtatagagtacccgcggatgtcccagaagcacagcttgaaggcgaagctcatggaggcacggttggagagccataaggtccagctccgccaggtgctcaagcagaagatctagtgcaggccagaaccagaaggcgaaacattgtaaacctagcattcaatccaaggaataatgtaaaggagtacctagatgcttcgtttttcatgttttagagtaacctgtattgcatgtacaacaaggactagaaaaaaaaaggacagggctggtctttgaggtctatctggagcctttcctgcttctgtatctcactttagttttggtgttattgtttgatctgataggctatggtgagatccatcatgatgtataatacagacataaacaagtagcaacgttgagacaaattgcatacctttgtatgcagtttccctaaaaaaaaaaaaaaaa

SEQ ID NO: 3705 - DNA, 1051 bp, Zea mays
tgcagggacaacttcatgctacttctgctatactgcctgtcgctaccatggagaaggcaacgaaatgggagcctggggacgtaaagggaatggaatcgcatgatgcgtatctgatagccagccagctgaatcttcttgatgaacacagagacacggcgtatgttgctgacctccagatggagctccagcaagcacgtgataggataagtgcgatggaaactgagcgacggtcagctaagaagaggcttgaccacttgttcaagaaacttgcggaggagaaagcggcttggaggaacagagagcatgaaaaagtgcgtgctactctcgaagatatgaaggcggaccttgaccatgagaagaaaaaccggaggcggctggagatgatcaacttgaaactcgtcaacgagctgaaggaggccaagatgtcagcaaaacagctgttacaagattatgagacagagaggaaggcgcgtgagctcaccgaggaggtatgcaacgagctagcaagagaggtgggggaagacaaagctgagattgaggccttgaaacgggactccctgaggttgcgagaggagctagacgaggaacggaagatgctccagatggctgaggtgtggcgtgaagaacgggtgcagatgaagctcgtcgatgcaaaacttactcttgacgccaaatacacacagctgagcagactgcaacaggttgttgaggcgtttattgccgcacgcagtactgcaaacggagacataacagtagtagaggaagcagagaacatcattcaggcaatcaagtcagtcagagcccaaggcgctgaattcagatatgaaccaccagcggcatccgaagacatattttccatctttgaagagctgcgtccaagtgaggagcctgtcattaaggagattgagccatgctacacgaatagctctgccaaatgtgaatcagaaattcaacaggttagcccaatgaccgatatattcctcgaaacgaaagccaaagtttactcaaacaaaggccccaaagatgaaaccgacgctgaagatggcagcag

SEQ ID NO: 3706 - DNA, 2528 bp, Zea mays
  misc_feature (1140)..(1140): n is a, c, g, or t
ctcccatagtcccatgtgtcctaggccctagacccctagtttacttctcccccacttggctagctcgcgctcccatttctttcccaacgtctctctgtccagcctccgcctctcccctgtgccctccccagtccccagtccccaccctgccctgcctgcgctttccacaccgctccgcgtgcgccgcacgtagcccgcacctccgcctgccgtgccgtgccgtgctctgctcctcacccgatgctgccgccggcgcggtccgtcccgagccacaggcggagatgagctccaggaaccgctccgccgcctcgtgcgctgccccggctgcagcaccatctctccggacgccgcgccgcctcaggcggcgaccggttaaggcggcagcaccggggccgggcggcggcgggcggcggagcgggcccgcgacgccgctgctgaaatgggacgtgggcggccggcgtggtgagggcacgaaggctgccgacgaagcgggggacgccgcgcgggcgcgggagaccaaggcgagggaggtgtcagtgcggaggctcgcggccggagtctggcggctgcgcccgccggaggccgtggccggcgccggcgccggcggcgagaacagggtccgtgtgggtgtcgaggtatgtcatgctgcgctgcttcagcacctgcttcccagctacatcagcctctcctagcggcattttttttattgatacacaggtgctgaggtgcgtcgtttttttggtgtttattgagtaagaatgtgcactcaaaagagttctccgtgatttttttcgctgctgtttatatgctttttaacaacaactgttgagagttgagacttgtagtccaaactccaaaccaaacgtgctacgttgccctaggacatagatctctcgcactgttttgggctgacaccatcattaccctttgcatgtttgctaatttgagttgcttaattcgcctaaactcgattagcttagtcaaaactcgattagcttaggtgcgttttaaccttttgcagttgatttggctggcctccaggcttcattggcctggccatctgaacagcggagtttgaaatttggatcgtgaaaggtttgggccttctgaatcgggcaaaacggctctcagctcccgtgncgtgccgtgcagcaccagacactgggttcagacgcaaaatggtcctgtttagttgctttgcttgtctcatgctattgcatattggagcccacatcccagtgcaacttccaggaaatatttttgaattctgaagcttttagcccttacgtaggctgggaacaaaatgctagccaacaaacgtgacgatattaccgatgctatagatgtaggttctctgtatatgactcggtttgataggggtctccacgtgatgattgtttgggcccctatagattctttgagaatgtctaccggaaattcacccctttttgtttaacatgtctgtgaatctgtgttgttcctttcaaatcacggtacgaaatagtaacacgaacatgcacagatctagtgctgctctctgtatacatatgtttaatcatcaaacgttcattcatgcaagtagattttagtacagaactttcgtgtcttgttttctttttttgttctttaagaaattgtgtagcttatgccgaactgtgcctatatgacagcatatcccaaggcatctacaagtccagcttctgaagcagaacacttcaggtcatcaccagagtttgaagaatgaggtttcaagccccatatctgttctggagcggaagagtggagagctccacaaggtgagggaaagaagcaacaagacatccattaactgcgtatcagcctgtaatgtaaggccattgacatgacacattctgcaggtacagcttcacgctacctctgccatgcttcctgtcgctaccatggagaaggcaacgaaatgggagcctggggacataaaggggatggagtcacatgatgcgtatctgatagccagccagctaaatcttcttgatgaacagcaagacacagtgtatgttgctggcctccagatggagctccagcaagcacgtgataggataagtgagctggaagtggagcggcggtcggctaggaagaagcttgatcacttgttcaagaaacttgcagaggagaaagcagcttggagaaacagagagcatgaaaaggtgcgtgctatcctcgaagatatgaaggcagaccttgaccatgagaagaaaaacaggaggcggctggagatgattaacttgaaactcgtcaatgagctgaaggaggccaagatgtcagcaaaacagctgttacaagagtatgagacagagaggaaggcgcgtgagctcaccgaggaggtatgcaacgagctagcaagagaggtgggggaagacaaagctgagattgaggccttgaaacgtgactccctgaggttgcgagaggaggtagacgaggaacggaagatgctccagatggctgaggtgtggccgtgaaacttttaatcaaatcagttcactcttttgcct

SEQ ID NO: 3707 - DNA, 1936 bp, Zea mays
cattgggtccctcgcggccggctggctgaccagaacacttgagcagactagcaaggccttcagaccgggagggctccctgtcctgtcccccgcgccgccgcggatggccggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcaggcaagtcagcaaactgaattttgatgtgtctttgaactcttaggctatctcctgtagcttcttactcgtacccgtttcttattattttaaaagttattatgtaaacagtataatttatagtgcaaaacagtgtcttgcatggccatatgcttgtggcttcatatgcagagtttactgatctgctgtgcacattgtgattgctaagactaggatggctgagcagctgaggcctattggccattcatatgcttctgcttgctcaagtgtttactctcgaagtaattatgggcatgtttggttcggattattattctcttttccacggagaaacaccagaatcgacggatagtccgccaaatgtcatgctttttccgcttttcctcaccgcggcttcggtagcaagcgtggggttgaacaaaaaggccagaatcgtaagacgccaatagaatcatgattctccccaccgtcgattgtttcggacgcgctcccgtgaaaagcgagtacaaacatgccctatgtgtaaagaaacttatatactactcccttcattcttttttatttgtcgcggattcgaaaacagaggtagtatttgattgcactggcactgcacacaaatagatctttgcaactgtcacttggcagtccttcaaataatgcaaattaggatacagtagaatagaatccatgaaacgggaagagaagtgctggtttgtccaagagccggatgcttaggatcaggaatttattttcaaataatgcaaattatgctggcagattggtttcttttttttatttttattttcgcaaggatatagatttgcttgtggtctgtttattcatcatgtagtttcgtttgctttggtgagtagtggcaatattggccggctcattggacaacgtgggagagtatcgactctgctgcttctagtgttcgtcatgcttcttttatgaactaaacccgaagacgctgcaatttgaggaggggatgtcagttgtcacagaggagagagtcatttttagggctagtttggaaatctcatttttttcaagagatttttattttcctaaaggaaattagtttatttttctttgagaaaatagaattcccttgggaaattagagtttctaaacgagcccttaatttcgtaaaattatgtccggagtccatatttcctatcggagcaccatggtccttgaacttgcaaaactatatggtgcaaaccaaatattgttttttcatccgtgttgacgtcttgtgtggcatacttt

SEQ ID NO: 3708 - DNA, 3874 bp, Zea mays
  misc_feature (3191)..(3191): n is a, c, g, or t
cgctgaagctggcaattccattggcgcgcgagcgatattggcgcggctcaatcaccagcttcccccgctcgggaagccgttcctccgctccgcctcctacctcaaggaggccctcctcgcgctcgccgaaggccatcacggcggctgccacctcaaatcaccgctcgacgttgccctcaagctcgcggcgtacaagactttctctgaccactcgcccgtgctccagttcaccaacttcaccgcaacgcaggcacttcttgacgaaattggtggcagcacgtcgtcctgtatccatgtcatcgattttgatcttggcgttggaggccagtgggcttctttcttgcaggaacttgcacactgccgtggcgcaggtggcgcagctctgccgttcgttaagctcactgcctttgtatcagctgcttcccaccatccactggagctgtgtcttgcgcgtgacaacattgcacagtttgctgctgaccttggaattccctttgagttcagtgctatcagtgctgatatgatcaaccctgcagaattcatttctgccactgatgatgaagatgtagttgttgtcctcccgactggttgctctgctcgtgcaccaccactgccagcgatccttgggttggtgaaacagctagctcctaagattgtgatagccatagaccatggcgctgatcgcgctgatcttcccttctcacagtacttcttaaactgctttcagtcttgcatgttcctccttgattcgcttgatgctgctggcattgatgctgattctgcctgcaagattgagaagttcctgattcagccaagaattgaggattcggtgcttgggcggggcaaggtggacaatccaattgcatggagaagtgcatttgcagctgctaggttcgtgcctgttccacccagcaattgggcagaggcagaggccgattgcctcctgaaacgggtgcaggtccacggtttccatgtggagaaatgtggggtcgggctcacactatactggcagcatggcgagcttgtcactgtatcagcatggcggtgctgatcagcaatccacgcctgtgggcaccaatatttcaccaccatttgctagcagcttcaactccagtaacgtgtatttcgtcttgcaatttagtgttgcaaaggtaacaaatatattggtgttgaacccttcatgttgattatctttgcaacttattagctagaagtagaactagcggatttttagcaatgttggtgtcaatgtctctagtgtaatgatgttgctctaggtttttaccctgcttgctctcgggtcactagacattctaatgtgacttgaaacactgcttgtgaggagagggtataattaacctatcaaatgtctgtggtacagtataatacgtgtttcatgttcttttatatcagttcttcttcttatggtatttcattgtgcagtttcaattgttatggatcaaactttaatatgtcctgttaccttatctgcaatccgcctcagattgtggatgccatccatcactatactaccaaattttgggtctggctttcattagactcaagcattcaaaattagtactgttgcgggcaattatttcaaaagcttagcatgctggtcgtgcttagggattgaaccaggggtatcggaaatagtgtaactaaggttttgctttaagaagataattagagattgttcagaagtttactgattcacatagtgcgcttctatttgagctgtactcgtaatggtccattcctaatgtgaaattcatagggtttatctgaggaatatggtatgtgttccttgtccaaactatcttggaatttagttcgctatagttaaaggaatttcttgttccagttgggtttcatgtgaactataacaccggacttgggaaataatgagtcctggcatacatgatttcagtaagctagtcacaaatggtaaatatggtactgattactcaagatgtccctcacaataggaaacaccagaagaaaactaggcatttgcaaggatgtaaattgctgtttttctgttgatgtgccaagcatagacatcaagcaacacaaccaattcacacttgacagactaatctgttatatttccacaatacacttgatgccagtggcggatggcaatcacaaaggcacatccattttgttcatgggctatatgcttattgggagtaagattggcaatcacaaaggcacatccagtttcgtgcttgagtcagcttcctttttcaaaatgtgggtcagcttgttggcgccttgactgccactcttggcatctcttctttgccacgcagatttggggttgtgaaatgtgttgattgctcttaaaccgaatcacatgtatatgtagtacaagtttgctagtgtcttatcgtttgctgggcccaatgacataattttggcttttggggcccttcgagatctctctccctccctctgtttaattccaatctgcttgcatgatatactaaactctgtaccagcaccatcaatccatagtgatatgtcctacctctgattagaaaatattttaaaactgttttattttacctgctactggtcgattagagaaaaaaaaaactctggaagacccgacaagaaaactggcaagattatttctagggccagtttcatcccctgctcatggctcacatggttgtgtcccctcccggttcccccctcctgttgtacattcttgcctccatgatcacccacctgcccctgcatcacattggcttccgcccacttaccgtataaaaagcttgtcatctgtactgattgccctaacctgagttagaagatgttttttttctctcgaacaaatctaggatttgaaagcttaggactacatgttacaggtgtgacagcggagtagatgggcagcttacattttttttctcatggcaagatcatttgcactgaagaaagtccactgcttgcatgagtgggcccataggacgaatacatggttttttcttttcattgcatagaaaaaagcatttcaaagtaatcaatgtcgattgaactttacatttgaatagagaaaatctttaaaatacaatgctaaaagaggggaaaaaactgaatgccatgagagttatacaactttaatttaggcctatttaacccggcttcttcgactttagctcctgcttcatgctagagtaccntcctggcttctcacggcttggccatattagcttgagagcctggtctacgtggctccatgtatattactccgtcggaaatgatacacgtccgactgcgcttgatcaacggctacgcgcagctcacgcctcatccctgtatgtcgagacgatggatggtcggggtcgtccgatgtgaatcggacgctggtccctcataccaaaatagtattcgtatgagctcttgatttgtacataccaaaatagtatttgtatgagctcttgatttgtacatgtatattcaaataggtgattatgaatctaaacacatatacaaaaaatatgcatcaattattatatgaatctattaaaacgctaaaacaaattttaatttgggtgggctgtatgttagagctttagcttcattaaaaatagttacacttatagcttctctggagaaacattttttctagctccaactatactagttagaaaaatgtcatcgactattgattcttaaaaacctaattttagttgtgagttgtgagaaaactgttgcgagctgtggttgtagaaaagctaaaatatgtttggttgaaacaactatcaaatatagattttgtaagaacattatagcttactagcacggaaggcgggaatataaacaaattaggatattaggtaactctaagttaaaatataaattc

SEQ ID NO: 3709 - DNA, 3411 bp, Zea mays
  misc_feature (830)..(830): n is a, c, g, or t
atggtggtcgtttttttaaccggtaaaaatagttaacccgtcgtttttttaaccggcgaacccgacggtttcctgcgaacctagcgatggtggtcgtctcgtctgcatccagcagtgcagcactacagttgtgcagcatgcgtccacggaccatccatgggtggcgtgtgtgcctgcctgctgtgggtgggccccgctggctctcgctgccactggtggtccacgcttgtacagtatacggagtacgcctaggcctagctatgaattttggtggagctgacgtcagcgctgtcttcttaatttttaaattttatgttatttttataccagctccaaattagaaaaagctagtgctagatgaaaatgatggcgagagggacactttttaaaacctttttatgttgcacgcatccggaggcaatggcagtagagagagaagaggccaccgagcaagcagagagagagagagagaggagggaggcctggagccctggagggagcgcatgagctgacagaagagagcacagaggcacttggagttggcacgcggtgctctgcttgcccccgcctcctccctgttctatactctcgcaggcccaggccaagcccctcccccgccctcagacgcaccgcggcaagaaatcctccactccatcccggtttccccggagagattatgtgggattaggtagatgagggcggcgctgttcggtgccgagcggaacggggctgcggacctcgtcggagacgggaagacgctgttctggccggaggggaaggcgaaggggctgttggagccgaggtccgtgctggactgcacgcggagcctnagccccaacaaccccacatcgacgttgtcgtcgtccgtgggtggcggcgctgcggactcgaccggcatggcggtggcttcggacagcagcgccgccgccgaagccaccaaatggggagcccccggcgagcacggcggcgagcgggaaggaggactgggctggcggctgtgagctgccaccgattcccaccggcctcgacatgggggtcggcggcggcgacagcggggccgccatgctcggcaatgccgctgcggcggggcaggaccagacgttcttgaactggatcattggggccgccggcgacctggatcagccagggccgccgcttcccgtgcaccagcagccgctccttgacaatgtgggcttcgggttcccggcagcggacccccttggtttcacgctcgatccacacctctgcggccttgcctgtgacatgtcgtcccctggtgcggtgtcgcacactaccaacagtagcggcggtggcaacaaggcgtcctcggccttcggcctcttctcaccggagtctgcttccctccagccgccgccgcccccggtgctgttccacgaaggtatcgacacaaagcccccgcctcttggggtccccctgcccggcctcctccaccagtaccagcaccagccgacccccggcacaaccttcttcatgcccatcccctccttccccgaccccaatcagcgctcgccactcatccaaccaccgcccaaacgtcctcaatccataggggatgacctctatctcgcccgaaaccggcttctgccgccgccggcggggcaaggtcatgcctttccaccattaaatggcccttctccgttccagctccagccttcgccaccgctgtcccacggggcgatgaagacaacggctgcggaggcggcgcagcagcagttgctggacgagctggcggcggcggcaaaggccgccgaagctggcaattccattggcgcgcgagagatattggcgcggctcaatcaccagcttcccttgctcgggaagccgttcctccgctccgcctcctacctcaaggaggccctcctcctcgcgctcgccgaaggccaccacggcggctgccacctcacgtcgcccctcgacgttgccctcaagctcgcggcgtacaagactttctctgaccactcgcccgtgctccagttcaccaacttcaccgcgacacaggcacttatcgacgaaattgcccgcagcacatcgtcctgcatccatgtcatcgattttgatcttggtgttggaggccagtgggcttctttcttgcaggagctcgcacaccgccgtggcgcaggcggtgcggctctgccgtccgtgaagctcactgcctttgtatcagctgcttcccaccatccactggagctgcgtctcacgcgtgacaacattgcacagtttgctgcagaccttgggattccctttcagttcagtgctatcagcgctgatacgatcaaccctgcagagctcgtttctgccaccgctgatgaagttgtagctgttgtcctcccggttggttgctctgctcgtgcaccaccgctgccagcgatccttcggttggtgaaacagctggctcctaagattgtgatagccatagaccatggcgctgatcgtgctgaccttcccttctcgcagcacttcttgaattgcttccagtcctgcatgttcctccttgattcgcttgatgctgctggcattgatgctgattctacctgcaagattgagaagttcctgattcagccaagaattgaggatgcggtgcttgggcggggcaaggtggacaagccaattgcatggagaagtgcatttgcagctgctgggttcgcacctgttccacccagcaatttggcggaggcacaggccgactgcctcctgaagcgggtgcaggtccgcggtttccacgtggagaaatgcggggtcgggctcacactatactggcagtgtggcgagcttgtcactgtatcagcatggcggtgctgatcagcgatccacgcctgtgcgcaccatgttccaccaacatttgctggcatcttcaacccgagtaatgtgtattttgtcttgcaattaaatgctactaaggaaactgatatattgctgttgaaccctccatgttcatcatctttgcaacttacgagctagaactagtggatttttagcaatgttggtgccaatatctctagtgtaatgatgttggcctaagattttaccctgcttgctctcagctcactagacattcccatgtcatttggaacactgcttgtgaggagagggtataattaacctatcaaatgtctgtggtatagtactgatatgtgtttcatgtttctttatatcagtcattgttcttatggtattttcattgtgcagttcaattgttttgggtcaaacatcaatatgtcttgttaccttatctgcaatttgcttcagattgatggtgccatactgccatccatcatcacagtaccagatttgggtctggctctaattagactggaacatttaaaatcagtactgttgtggtcagttatttcaaaacgttagcgtgctggtcgtgcttagagttagaaccag

SEQ ID NO: 3710 - DNA, 946 bp, Zea mays
cccctgggtggaaaaggcaaaacaaacagaatcatcagtgttacgtaataatccttggattttgcgctgtttaccatggtgttcccaaaaggcccctggcctttcttaccgcccaagctgtaccccgcggccgcctctcatctctctcgggactttccccaatccactccactccaatccccttcccccctctgtcaaccctagccgcgccgccggcagtctgctcgggtggcgcatacatgacccacccttcctcgccgtcgtcctccgcgccgccaccgccgcccgccgcggcggcggcagcggcggcggccgaggccacttccctcgcgccgggtttccgcttccaccccaccgacgaggagctcgtctcgtactacctcaagcgcaaggttctcggccgcccgctcaaggtcgacgccatcgccgaggtcgacctgtacaagctcgagccctgggacctgcccccgcgctcccgcctccgctcccgcgactcccagtggtacttcttcagccgcctcgaccgcaagcacgccaaccgcgcccgcaccaaccgcgccacgtcgggagggtactggaagaccaccggcaaggacagggaggtgcgccatgggcccagggtcgtcgggatgaagaagacgctcgtattccacgccggacgcgcccccaagggcgagcgcaccaactgggtcatgcacgagtaccgcctcgagggcgacgccgccgtggagataccgcaggactcgtttgtggtgtgccggatattccagaaagctggcccaggtcctcagaatggggcacagtatggagcgccgttcgttgaggaggaatgggaggaggacgatgcagatgtcggtttgcttccagtggagggtgatgctgctgtcgaccctgaggttccccctggccctgggggagatccctggtgctttggagagaggctatc

SEQ ID NO: 3711 - DNA, 1141 bp, Zea mays
gggttccatgacaaattcagttctgcctgaggacgattatttgatgttctatgatgcacccttcgattccctatgtgtgatgggtatggacagaatggaattcttggctccgcagcagccaatctatctggcattggcatgatggaggatggtatggcatactttgatgcaatggatgataattcatttaatgatactctgggctccatacagcagtcagctggtagcagttcccatgcttttaatggcccagtccttacccaagaggtcaacaatactatgtgtacatatagtccaactcaaaaggttttagaacctaattttctagttggtgccccgtcatctgctaggttacctgaagctggtagtcagttaaattgtgttgttttaccagatggtcaggctaagagtagtactattggaaagggatttgtaaagattttggactcaatctccgctcccccagcttttgctggagaattcccagctatccaccgcaaatctttggctcatatttctggggggcgccccaacacactccatgtttctgctgaagtgatccgcgtaggaagtttagctgttccttctggcgcagataagtgggcgctgcaaaaggatcaaggcatggagctggtcttttctgcagattttgagcctgatacccgtcttcactgtggctgcaacaccattaccgcggtgctgcgtggtggcttctgccttttctttgtttcggcaataatgctcttagtgagctatgaggtgggcatgtgcatctatggcaagtagcaggctggtattggattaagataaatctcatgacattagattaatccagtgttctgaggcagactcaactggggcctcctgctagcttttaaatgtattgcgttgcatggcgtggacctgtggggtgttcagcactagcagtaccattttgcttgcagctcgagagctaatggtgtatgtatgaattccgtgttatttagtaggggtatgcgaattgccccattggtgtgtgatgatgccatttgccatggaaatcctgtatatatataattcagatctgccatggaaatcatgatgcttttgccaaaaaaaaaaaaaaaaaaaaaaaaaaaaaaaaaaaaaaaaaaaaaaaaaa

SEQ ID NO: 3712 - DNA, 2624 bp, Zea mays
gggaactggccctccggccgggccccggcctttcttatcgcccaggccactcccttcttcctcctctcacctctctcgaaactttccccaatcccatctcctgcccccctctcccaaccctatccacgccgccgccagccctgctcgggtggtgcgcatacatgaaccatccgtcctcgtcgtcgtcctccgcccagccgccgccagccccggcggcggcggccgaggccacctccctcgcgccgggcttccgcttccaccccaccgacgaggagctcgtctcctactacctcaagcgcaaggtcctcggccgcccgctcaaggttgatgccatcgccgatgtggacctttacaagctcgagccctgggacctgcccgcccgctcccgcctccgctcccgcgactcccagtggtacttcttcagccgcctcgaccgcaagcacgccaaccgcgcccgcaccaaccgcgccacgtcgggagggtactggaagaccaccgggaaggacagggaggtgcgccatgggcccaggcttgtcgggatgaagaagacgctcgtcttccacgcgggacgcgcccccaagggcgaacgcaccaactgggtcatgcacgaataccgcctcgagggcgacgacgccgcagggataccgcaggactcatttgttgtgtgccggatcttccagaaagctggaccaggtcctcagaatggcgcacagtatggagcacctttcgttgaggaggaatgggaggaggatgacacagatgatggtttgcttccagtggagggtgttgctgctgctgaccctgaggttccccttgcttctgtggagatccctggtgctttggatagaggctatcttcaaatgagtgatctcattcagggtttggatgatcaaaatggaaatggtacacctagtttgccagtttctgatacttcaaataatagcaaccattctgaagacgtagatggaaattctggggacattttaagtgacccaaaccttggctctaattttcttcagtatgctgaacctggggagcaaaatagcttaatgcttaatggaactatcatatcaaatgcaaatgctggagatttttttgataattccagccacagtgatgggtttctagagctgaaggattttggagatgctgcaaatctggatttccctttgggcaatggatcatccatctggcctttggattgttgggcatggaaaacacctgactcagcggaatctttaaatggaactaatgatgagattcctccacttcctgatgaccagactttccagccagatgagctggaacaactgttacagtcaatacaagaagattcccatttaggctcaagtatcattgaccccccacattcttctatgacaaattcagttctgcctgatgaggattgtttgatgttctatgatgcaccgttcgattccaccatgtgtgatgatgggtttgcacagaatgggatccttggctctgcagcaaccaatctatctggtattggcatggtggacgatggtatgccatactttgatgcaatggatggtaatttatttaatgacattctgggctccatacagcagccagatggtagcagttcccatgcttttaatggcccagtccttacccaagaggtcaacaataccatgtttacatatagtccaactcaaaaggttttagaacctaatattgtagttggcgcaccatcgtctgctaggttacctgaagctggtagtcagttaaattgtgttgttttaccagatggtcaggctaagagtagtactattggaaagggatttgtaaggattttggattcgatctctgctcccccagcttttgcaggagagttcccatctaaccaccgcaaatccttggctcgtatttctggagcgcgccccaacacactccatgtttctgctgaagtgatccatataggaagtttagctgttccttctggcgcagataagtgggcgctgcaaaaggatcaaggcatggagctgctcttctctgcagattttgaacctgatgcccgtatacattgtggctgcaacaccattaccgcggtgctgcgtggtggcttctgccttttcttcgtttcagcaataatgctcttagtgagctacgaggtgggcatgtgcatctatggcaagtagcaacctggtactggtctaagataaatctcacagcatttaggttaatcctatgttttgaggcagactcaactggggtctggggcctcctgctagcttttaagtgtgccgcattgcatggcatggacctgtggggtgtttagcactagcagtaccattttgcagctcgagagctaatggtgtatgtatgaattcagtgctatttagaaatactatgagaattgcctcattggcgtgtgatgatgccatttgccatgcttgtggtcgcagtggtcaatgttagtgcaaaatattgtatatatatttgagatccaccataggaatcatgatgcttgtgcagtacagttgtgttggtgttttgagtgtttgcaggtttcaatcaaaatgaatgttcatcgtgttgcaagccatgaatgaaagttttggagaaaacccatgctcaaactgcaatggggctgaaacattaaa

SEQ ID NO: 3713 - DNA, 3626 bp, Zea mays
  misc_feature (2822)..(2822): n is a, c, g, or t
  misc_feature (3229)..(3229): n is a, c, g, or t
ctgtggaatgtacctgtaacaatcttgatttaataaaactccctttatcgaaaaaagctgtggaatgtaccttgttgacagaccatgactcttgtcacaccttacatcatattgattaatcatgtaccttgcatttatcaggtttgctggacttccttctgctttggcatttaccttgttctaacttgtattttgatgaaattctatcccatgctgtgtagcaaggacactgacattttttggttgttgtttggcgtgaaccttactttttctctcaggattaggtagcaagttgtatgactgtatgagattacgactacaagagtcatgatatcatagtattcatgtctgaacattgaaaaggtttgggattctgtgttgccatttacatctttaactgtgtggtgtgaactccacatcatgctacagaatgcagattgtcaaactgaatagttaacactaagttttttaagaaatttcttcaatttaaaagtgagcttactattcatcatgcagcgtctctcttttttctgtaaaatatgatttatatgtggtattttttgtttatttaattcatattgatattggtatcaaatttgcacattggtagattcatggttctaatcttcgtggtctgttctctttcaggggttgggtgatcgaaatggaaatggtacacctagtttaccagtttctgagacttcacataacagcaaccattctgaagatgtagatggaaattctggggacattttaagtgacccaaaccttggctctaattttattcagtgtgttgaacctggggagcaaaatagcttaatgcttaatggaaatatcatatctaatgcaaatgctggagatttttttaataattccagccccagtgatgggttcctagagctgaaggattttgcagatgctgcagatctggatttccctttgggcaatggatcaaccatatggccttcagatggttgggcatggaaaacacctgactcagcggaagctgtaaatggagctaacgatgagattcctccactccctgatgaccagattttccagccagatgaactggaacaactgttgcagtcaatacaagaagattcccatttgggctcaactatcattgaccccatgcattcttctatgacacattcagttctgcctgaggacgattatttgatgttctatgatgcacccttcgattccactatgtgtgatgatgggtatggacagaatggaattcttggctccgcagcagccaatctatctggcattggcatgatggaggatggtatggcatactttgatgcaatggatgataattcatttaatgatactctgggctccatacagcagtcagctggtagcagttcccatgcttttaatggcccagtccttacccaagaggtatgctatcatttggagcaagagatgaagttgccgtatttgtttcaaatcatagacatgtactggtgatcacccaaaattttctacttttacaggtcaacaatactatgtgtacatatagtccaactcaaaaggttttagaacctaattttctagttggtgccccgtcatctgctaggttacctgaagctggtagtcagttaaattgtgttgttttaccaggtaatcttattatgggaaattacaataggttgctatatcttgatctctgatgggaaaaggagcatttttcttacatgttgcactagattcttttatgtgagatgtatttagttaccctcattgagcaagattgaagtattagatgatttgtgttgttgagaatctagctcaatcttgcttacttggggcagggttatatgcagctggcatgcattttcctggtcattagcttacacctgtaaatggacattgttgacaagttttttgtgttgtgttccacagatggtcaggctaagagtagtactattggaaagggatttgtaaagattttggactcaatctccgctcccccagcttttgctggagaattcccagctatccaccgcaaatctttggctcatatttctggggggcgccccaacacactccatgtttctgctgaagtgatccgcgtaggaagtttagctgttccttctggcgcagataagtgggcgctgcaaaaggatcaaggcatggagctggtcttttctgcagattttgagcctgatacccgtcttcactgtggctgcaacaccattaccgcggtgctgcgtggtggcttctgccttttctttgtttcggcaataatgctcttagtgagctatgaggtgggcatgtgcatctatggcaagtagcaggctggtattggattaagataaatctcatgacattagattaatccagtgttctgaggcagactcaactggggcctcctgctagcttttaaatgtattgcgttgcatggcgtggacctgtggggtgttcagcactagcagtaccattttgcttgcagctcgagagctaatggtgtatgtatgaattcggtgttatttagtaatagtatgcgaattgcctcattggtgtgtgatgatgccatttgccatggaaatcctgtatatatataattcagatctgccatggaaatcatgatgcttttgcagtatagttgtgttggtgttttgagtgcttgcagccttgcaggcttcaaaatgaatgttcatcgtgttgcacgacatatagagcctgcaattgcgtccgttcacagtgatgctaaaatggccggttggttctgtgtaaagcccaaaatttggtaggaaaaaaatatcatgaaataataaaataaagagataaaaaaatatatatacaataantgtggtaggaattttttttagaccttggaaatctattaggattcttcctcctcatattcaagtaataatattaaattagtaagtaactgataaattgataaagtgaagggattcttatataaattatcccttgttgaagttgataaatattatataaggataaatattagagcatcaattaatcgaggttatgcaatcgaaaatattttttttctcaaaataatcatatggagcaacatatccaaaagtatttacttatgtaggtaataaacaaataaataaatatatactttgcattatgttggatttttgtgctgtgcatttaactgtaaagttgaatttccaaaaccattgttgaatttgaacttgaaatcaaatttgaaaaactagaaaacaaaactgaaatntaaaagaaaagaaatggaaaaactcacctgtagccggtacatgggccgaaaccatacctggcggcccaagtatttcccactgcgcagctcatgcaccaacgcttatggcgttactgcctccgccatgtgggcccctcgtgctgacactgtgcgtcttctccgcgtaacaaaccaagcgcatggaccgccggtatctcgccagaattgcccataaatcggaccttgctctagtataaatcccttggccgccaaccatctccgggcgatacaagctaagccgccatggaacaatagcgcggagagagattggagcttgcacacagagagagatcggggaggaagagggtcgtcgaacagagaaggatccgcgccccccatatctggccttcaccgccga

SEQ ID NO: 3714 - DNA, 3613 bp, Zea mays
aaatcaattgtttcactgaggggtaattatgtgttgtcatggtcttatactgttttttgtctaagaaaaagaatctaatagcgggagcttgggagagatagaaagaacaagtaaccactctaatctatgcatgttactttatatgttacatgtttatttcactttcattaatctagtcgttttcttcatcaaccgattcaagtggcaaatagtcccactcccacctccatgacacggtcataccacgacacgtcacaagatgctatagaaggcccagatggctccgagatctccatatgacccgacgtacttataaatctaatactagtcgattgttcgtgttcaaaacatttataatatctctcatttatagaacacaaactaatatatattccagtggttagaagctaagactgtaaccctagattctgtacttatttttttgtatttttctggtagtgcgtgggagggagacgtgggaagaaattctcacttaaatctagtagtgattttttctatgtcaaaccagtgtatcattttcttgattgtactttgttcatgtctttccttttctaacagaaacggcctaaataaaatcttatcagacattgaccaatactgtatttgcaggccacacttgttctaatcccgtactgtacactgtcacaaacgcaaacggtctttcagttcgttagcaaatgaggccaagccaaaaaaaaaaaaccgtaaaagccagcacccagcagggcgtcagggcggggcaatgaggacgagatggggaacgaaagcaaaggcaaaaggcggacacacccactgagcggacacactagctcagtaaagaactcctccactccaatccgaaccattccttagttcctcttctccctcgtggcctcgtcgatccggcaaaaagcgaaggaaggcagagcatattgctccatcggtctcgccaaaagagcggtggaactggggatcgagagggcaccaagaaagcgagccgagcgcatcacgcagggctcccccttttcttgctcaaaagaatagatcactctctctcacacacacacacacacacacgcgtaggtagccacacttagaattggattgctgccactcacaattccctctcatagcctggcatcgtagctatagctggctagcttcctcctcctggctagctgctacccttcccggttctcaccgcgctgccattaaaacccccttccttgttaccacttcgaccttgagcaagcgcactcttcatgttgccgcctcgccgcagtagcagcttacatggatacgctgtttaggttggttagccttcaagcctccgaacagcagcagcagcagcaatcggcgtcctacaactcgaggagcaccacgtcgagcggctccaggtcgtcgtcgcaccagaccaacgcatcctacaactactactaccacagcaacagcagcggcggcggcggcggcgggcagtactactacggtcagcagcacccacagcagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgctggggcggcgcacgcgctgttcgaggcggccgacctgtcgttcccgcctgacctcaacctcgacttctcatccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgcggcggcgtccgaccggaacacgtccttcgactccacgcggcgcacggcgctgcggttccaggagctcagcccgtggtcgtcgtttgggcacgtggccgccaacggcgccatcctggagtcgttcctggaggccgccgcggcgtcgccggagccccagaggctccacatcctcgacctcagcaacacgttctgcacgcagtggcccacgctgctggaggcgctcgccacgcggtccgccgacgacacgccgcacctgtcgatcaccacggtggtctcctccgcgccgtccgcgccgacggccgccgtgcagcgcgtgatgcgggagatcgggcagcggatggaaaagttcgcgcggctgatgggcgtgcccttcagcttccgcgcagtgcaccacgccggggaccttgcggggctcgacctcgacgcgctcgacctgcgcgacggcggcgccaccaccgcgctcgccatcaactgcgtcaactcgctgcgcggcgtggtgccgggcggtgcgcggagacgggacgcgttcgccgcgtccctccggcgtctcgatccgcgggttgttactgtcgtcgaggaggaggctgatctcgtggcttttgaccccggcgcgcccgatgaaagcggcgacacggaggcagcgttcctgaaggtgttcggcgagggcttgcggttcttctcggcttacatggactcgctggaagagagcttccccaagactagcaacgagaggctggcgctggagaggggagccggacgtgccattgtagacttggtctcgtgcccggcgtcggagtccatggagcggcgggagacggcggcttcatgggcccgccgcatgcggtcttccggcttctctccggtggcgttcagcgaggacgttgccgacgacgtgcggtcgttgctccgtcggtatcgggaaggctggtcgatgcgggacgccggtttagacgactcggaagccggagcaggcgtcttcctggcgtggaaggaacagcctctcgtgtgggcgagcgcgtggaggccatgatagagatccccgtcgacgcaagatgcaagctcggtggagtacgcgcgtacgtggaacatcatgaaccacaggagaagcaagggcgccatccgccatacctagccggcgcgtggatgcaatgatccatgcagtggatcgggcgcacgtgcatgtgtatggcgagctgaatggcgcaacgcatctagggttttggagcagttaagtagggattgctagttcacgcacacatggttgtatgcagcaaggtgatccaggaggaggtatggtcgatggttttaggttttagacttgcatctatttcaaatttggatcatcgatcgccacaagctcttggcgtgatgattccgattttcttgcttctttgtttttttttttttgtcacatttctctgtgtttcttcatgtaattcaaggttaacgactttcttccctctggagggatttacgtgcatggttttgtcatactttctctcattcctctgtttgcatttgcattgcatggttgttgagatgtcgcttcctaaaaaaaaaaaaaa

SEQ ID NO: 3715 - DNA, 1792 bp, Zea mays
  misc_feature (160)..(160): n is a, c, g, or t
gacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgctgcggcgtccnaccggaacacgtccttcgactccacgcggcgcacggcgctgcggttccaggagctcagcccgtggtcgtcgtttgggcacgtggccgccaacggcgccatcctggagtcgttcctggaggccgccgcggcgtcgccggagccccagaggctccacatcctcgacctcagcaacacgttctgcacgcagtggcccacgctgctcgaggcgctcgccacgcggtccgccgacgacacgcccctcctgtcgatcaccacggtggtctcctccgcgccgtccgcgccgacggccgccgtgcagcgcgtgatgcgggtagatcgggcagcggatggaaaagttcgcgcggctgatgggcgtgcccttcagcttccgcgcagtgcaccacgccggggaccttgcggggctcgacctcgacgcgctcgacctgcgcgacggcggcgccaccaccgcgctcgccatcaactgcgtcaactcgctgcgcggcgtggtgccgggcggtgcgcggagacgggacgcgttcgccgcgtccctccggcgtctcgatccgcgggttgttactgtcgtcgaggaggaggccgatctcgtggcttttgaccccggcgcgcccgaggaaagcggcgacacggaggcagcgctcctgaaggtgttcggcgagggcttgcggttcttctcggcttacatggactcgctggaagagagcttccccaagactagcaacgagaggctggcgctggagaggggagccggacgtgccattgtagacttggtctcgtgcccggcgtcggagtccatggagcggcgggagaccgcggctccatgggcgcgccgcatgcggtcttccggcttctctccggtggcgttcagcgaggacgtcgccgacgacgtgcggtcgttgctccgtcggtatcgggaaggctggtcgatgcgggacgccggtttagacgactcggcagccggagcaggcgtcttcctggcgtggaaggaacagcctctcgtgtgggcgagcgcgtggaggccatgatagagatccccgtcgacgcaagatgcaagctcggtgagtacgcgcgtacgtggaacagcatgaaccacaggagaagcaagggcgccatccgccatacctagccggcgcgtggatgcaatgatccatgcagtggatcgggcgcacgtgcatgtgtgtatggcgagctgaatggctcacgcatctagggttttggagcagtggtagggattgctagttcacgcacacatggttgtatgcagcaaggtgatccaggaggaggtatggtcgatggttttaggttttagacttgcatctatttcaaatttggatcatcgatcgccacaagcttttggcgtgatgattccgattttcttgcttctttgttttttgtcacatttctctgtgtttcttcatgtaattcaaggttaacaactttcttccctctggagggatttacgtgcatggttttgtcatactttctctcattcctctgcttgcatttgcattgcattgcatggttgttgagatgtcgcttcctactttgttgattgttggggttgttacttgttagtgcttactgattagggcagacacttgcacggcctattacttttggttacagtaccaatacca

SEQ ID NO: 3716 - DNA, 1097 bp, Zea mays
cattctactcggtactcgagagtcgagaccgtctaaccactacccagcggcgtccgtttactcacacggtcacacacaccgcctcaactcgcgctgcccgtcgcccccaagcctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggcggaggtgacatgggtgcgtgacatgcttcgcggggacgatgcctatgagatgcgggtgaagcttatcaagcaagtcccggaggaatacccctacaaggatgatgactagttctattttagtgcaagattgcttgtttggattttgacatcgttttcgtcgatggtccgtagttctgctataacctgatatcatacgaggaaagctgcgtctgttttgcttgtgtattgtagaaatcatacataatctttcctgagttgcggctttgaattagtctgctggattcagggcgttcgctatgcaaattggtgttatctagaaataaagtattttcgatcttaaaaaaaaaaaaaaaaaaaaaaaaaaaaaaaagcaaacagaacctctcaaaaaaaaaaaaaaaaaaaaaaaaaaaaaaaaaaaaaaaaaaaaaaaaaaaaaaaaaaaaaaaaaaaaaaagggggggcccctttt

SEQ ID NO: 3717 - DNA, 988 bp, Zea mays
ctccgaggttctgccggggcactggcactgtgcccccgactgctctcgccccgcctcgcgcagacccggcccccccggtccgtccgcccccgtgacgcgagcgtcgccagggagccgaaagtaagcctcagttccgccggcgtgcgaggggttcgatctgggttagcctctcacgatgccgccagcccccaagtccggcgacgccctcttcgccagcgtggatcgcgtcaatgcggagctgttcacgctcacgtacggcgccatagtgcggcagctgctcacggatctggaggaggtcgaggaggtcaacaagcagctcgatcaaatgggttacaacattggaacacgattggtcgatgagttcttagcaaagtcaaatgtatcaaggtgtgttgacttcaaggagactgccgatgttattgcgaagcttggcttcaaaatgttcttgggtgtgactgcaactgtgaccaattgggatgttgagggtacaagttgcagcattgtcctcgaagacaaccctcttgttgattttgttgagctccctgacacttgccaaggccttcagtattgcaatttgttaagtggagttattaggggggcattggaaatggtgtctatgaagacggaggtgacatgggtacgtgacatgcttcgcggggatgatgcctatgagatgcgggtgaaacttatcaagcaagtcccggaggaatacccctacaaggatgacgactagttctatcccattggaagatacaggaagcctatttgcttgtttggatttttcacatcgttgtcgttgacagattctagttctgctataacctgatgccatacgaggaagctgtggattatattttatactcgccgtgtgtattgcttatgtattgtagaaatcatacatgatcttccatgagttgaggctttgaattatagtcagctgaattcagagcattagctacgcaacaagaaaccagccaaaaaagcggcc

SEQ ID NO: 3718 - DNA, 1052 bp, Zea mays
gggtacctcacgcggccgcccgggactggcactgtgcccccgactgctctcactcagtctcagagacgttctcctccgtccgtccgcccccgtgacgcgagcgtcgccagggagccgaaagtaagcctcagttccgccggcgtgcgaggggttcgatctgggttagcctctcacgatgccgccagcccccaagtccggcgacgccctcttcgccagcgtggatcgcgtcaatgcggagctgttcacgctcacgtacggcgccatagtgcggcagctgctcacggatctggaggaggtcgaggaggtcaacaagcagctcgatcaaatgggttacaacattggaacacgattggtcgatgagttcttagcaaagtcaaatgtatcaaggtgtgttgacttcaaggagactgccgatgttattgcgaagcttggcttcaaaatgttcttgggtgtgactgcaactgtgaccaattgggatgttgagggtacaagttgcagcattgtcctcgaagacaaccctcttgttgattttgttgagctccctgacacttgccaaggccttcagtattgcaatttgttaagtggagttattaggggggcattggaaatggtgtctatgaagacggaggtgacatggctacgtgacatgcttcgcggggatgatgcctatgagatgcgggtgaaacttatcaagcaagtcccggaggaatacccctacaaggatgacgactagttctatctcattggaagatacaggacgcctgtttgcttgtttggattttttcacattgttgtcgttgacggattctagttctgctataacctgatgccatacgaggaagctgtggattatattttatactcgcagtgtgtattgtagaaatcatacatgatcttccatgaattgaggctttgaattatagtcagctgaattcagagcattagctacccaaaccgtgtctcctagaaaatgaagtattttcctgggttgagggttgtcctgtcccttctcccggtgtgctttcggcccgttggggacccggccttcttcc

SEQ ID NO: 3719 - DNA, 842 bp, Zea mays
cgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatggctccccccccccccccacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagctattaggggggcattggaaatggtgtctatgaaggcggaggtgacatgggtgcgtgacatgcttcgcggggacgatgcctatgagatgcgggtgaagcttatctagcaagtcccggaggaatacccctacaaggatgatgactagttctattttagtgcaagattgcttgtttggattttgacatcgttttcgtcgatggtccgtagttctgctataacctgatatcataggaggaaagctgcgtctgttttgcttgtgtattgtagaaatcatacataatctttcctgagttgcggctttgaattagcctgctggattcgctatgcaaattggtgttatctagaattaaagtattttccgatctaaaaaaaaaaaaaaaaaaaaaaaaaaaaaaaaaaaaaaaaagtccctgcccggggggccccaggcgaa

SEQ ID NO: 3720 - DNA, 3487 bp, Zea mays
ctatgtacaccagaacttgtaatagtatagtatactatgcacacagaattaaacccagtcgctgagaagcaattttattggctacatgtttgacctcatgttcttttctgaaggcttagtaaactctgaaaagtattctgccttgtgaagttctgtttctgctgttggcatctccttcactgctgggtgtgagtgagcgttgtaagttgtactacttgttaatcagagtaatccattttacaataccattccttttggtattaatctgatatgcaaattatcttttccccacagttttgttttgtgtcacaggccgcggttttgcatcatttctctcgatccagacaaggacagctaaaactagtcaaagttccaagttgagattcacaaacacggacaccgtggacaagatctggtcgccaactcgccatactggaaccttccccctcctcagcaggcagcagcagctccttcaaattccccagtcaaagctgcggccgccatcctcacttgcctctcctcagcccgcacgagcacgaaacatcgcgccctagtaagctaagcagcaggctgattccccacgaaaagctccgactttgaccgccggcgagccatgtccgccgcgccggatgagttcctggcacaggggacctacctcgccgcccccgagcccttctccccctccatcttcctcgacctgcccccgacgccacgccccaacggcgacgacccgacctccgacgacccagcctcctccgacgatctcgtcctccccttcatctcgcggatgctcatggaggaggacatcgacgacaagttcttctaccagttccccgaccaccccgcgctcctcagcgcccagcagccgtacgcacagatcctctccgacgccaccgcctcctcctcctccgactccgccaccgccatcagctcagggaccgtcgggaactccaccctctcgtcctcctcccttgccgccgcatctgccgaacccacctggccctacgacccaatcgaactctcccagctgctgcgctctcctccgtacccggacatgggggtggggctcgatgatttcaccaccgaagaggtcaacgccgtcttcttgccgggacaagacgccgcgttccagccgagtccggcgttctttgttaccggcggtagcggccaacggctgagcgcttccctcaccgcccagaacgttggcggtgttggagctcaacagcagcgtgtttccctcgttgcccaggacgccggtgatagcgtggccatccagaggtcggcgttcttgaatggcgcggaggagacgaagacagaggccaccaccttgcctgctggtgatggtgaccatgccgcgctgttgtcggccttcttgggtgcgcagaatggggaaaacatggacatgctcaacgtggccttcctcaaaggcatggaagaggccaagaagttcttgcccaccaataatagccttcttgtcgaccttgacgacacctatggccaatccttgcctacagacagagacaccaagccgtgcactgcctttgctgctacccaagtgaaggaggaggaggtggcggtggatgtaatatcaatgtttggaggaagtagcaatggcaggggccggaagaacagtcacacccaagaggacttggagtcggagatgggcagaaacagcaagctgatgatgcctgaacaagaagaaactggtgctagtgagctattcgacgaattaatgtcctgcaaatatcccggcgtcttgaaacacatgcaggatctgcgcatcgccatggatagcgagtctgagaagagtgtgaggagggtgagtgggaagggggcacgagggaagcagcatgggaatgagtttgttgacctgcacaccatgcttatccattgcgcacaggcaatggccaccggtgatcgccgaagtgcaaccgagatgctgaaacagatcaagcagcactcctctctcagaggggatgccacacagaggttggcctattgttttgcagaaggactggaggcgcgacttgctggcacagggagccaggtgtaccagtcgctcatggcaaaacgcacatccgttgtggagttcctcaaggcatacaagctatttttggcggccatcagcctcaataaggtgcatatcatcttctccaatgggaacatcgtggatgccgtggcagggaggagcaagttgcacattgtagcatatggtgtacagtatggtttacagtggccaggcttgctacatttcctggcaggtagagaaggtgggcctccagaggtgagattcaccggcattgaccttccacagccagggttccgcccagcctaccagattgaagaaacaggccgccggcttagcaactgtgcccgtgaattcggcgtgccattcaagttccatgctatagcagcaaagtgggagatggtctctgccgaggacctgaacattgatccagatgaggtgcttgttgtgaacagcgattgccacttgagcaacttgatggatgagggtgttgacgctgacaccccaagcccccgagatttggtgcttaacaacattcggaagatgcgacctgatattttcatccagattgtcaatagtggcacatatggtgctccattcttcctcacacggttccgggaggcactgttctactactcagcactatttgacatgctggatgcaaccattccccgggataatgatgaacggctgctgatcgagcgggatattgttgggcgatctgccctgaatgttattgcttgtgagggtgcagacaggttggatcgccctgagacttataagcaatggcaggtgcggaaccaccgggctgggctcaagcagctaccgttgaatccagaggttgtaaagcttgccagggataaggtcaagaaatattaccacaaagactttctcatcgatgaggatcgccaatggttgttgcagggatggaaagggcgggtcctctttgccatgtcaacttgggttgctgaggataataactccaccttttagctgcttcactttgtcttgttttggattatgagtgatattgatgtttgatggatggtctgtgtctttattttaccaccaaactacgacccagcatctgtggcccgctggacttctgtttctagagggttttagtgctgaaactttgtaagctagtagaaaaataagtagatgcttagaggtacataggatgctgatatatttctggatatgttgcagaattgtgatgtgtacatcatctgtaactgataaaagcaattttattgattacttaatcgaccttttatccgtctcttgcagttctgtttattctgtatcattggactgttagcatttcccttgtgtctaggcgtgattatcaaagttgctctgtttaataaaagtattctatttggctcgatatcttccatcattttctcatccagacagacaagtacagctaaaagtgttcactggattcaggattatgtg

SEQ ID NO: 3721 - DNA, 6021 bp, Zea mays
gtctttgaccagatgtggttacgccttatatactgggacggagggagtattcaataaaaaatgtaccattcaacttttgcagaattagataactagttcatttagatgccatgacatccaaatgaactagttgtctggttttgcaaaagttaaatgacatttatacaattaatcctttttgatatggcgatatgccttttaccttcgacatctattggaaagatggatagtgctagaaagcgttttttttggaagagggaaatatcatttgattagatggactaagatcactaaacctagctaagaaaaaaaagattaattacatacttgtcaccctgtttttataaaattagataggtaattcattttgatgtcattgagcgacatgaaaataaactactttataactctttaaatttggagtggcatacttctaattaaccccaaaccagatatatttacttaagcagcaggtctacggtgtcggccaatgaaaaatccaccatttttttggcatactagatggtgtggctataggttactttaaagacacacttttctcattttttttaaaaaaaacgaggaccgtgattgttcagttgaagccatgaaatataaaaactagagcctcatttttaggagatggctacgtgaagatttacagagtcagcttagaagattgcaagatatcgttctaaaaaataacgatggccagttggtaattgcgagtgagataaatctggaaatttccctaagaaactgttttgtatgggcaaagttttaatataatctaaaaaggcaaaacaaccgtggagtgaaggtcttcacgtggttggtattacaagatagaagataccctcttcgttttttttatttatcacgttttagtttaaaattaaactagcagatgataaatattcaagaacgaaggtagtacttactattctctctaaagataatctctgtacgaacagtacatgaaattatgttgctgcaggcgttatggtgttattgtttcattgcaccttatttaattgaaggctgagtttgaatcttagtcgttgactctaaggttcatactaatctaatcagtagaacacacatacttttatgttttattaaataaaatctatttatataatatatagaaatagtagcagtgtattatttcatcatgacaaggccacaaaggtgaatcaagcgcctcacgtttttttaaggaatcagcaagcgcctgtgtggtaggttgcagcaagcggctgagccaaagcgggtcatgaatcactgggccgcttgtgctcggctcctctcggctttgtttcgtgggccagaagaccggaccacgggccgacagaagtgtcgcggtaccggccaggcggccagtttcgttccgtttcgtacttcggccgtggatcacgttcacctggttctgtggtcaacttctcgggtaggcatccgagtgaccgcgtcccctggagttcagctcacacggtcacacctcacaccactcaccctgatctgtggccccaaccggaaactgtcacgatcgacgcgacgcgactcgcgccgagtcggtaccacgcatcgtattcgtagagggaaaaaaaaatcaactaggagtaggagggaagccccttccctaccatgacgtctggccactgacgtgcggggtagactcagactgaccccgcacgtcagtgccccatatccctgtccatgcagctgcgccaggcggcaaaccaaccagctctcgtgcgcagaaaatcccgcgccgttccccacgcgtcaccgtggtgcgccgcccccttcctctcccgctcccctccacctcgactaccaaaacactgatccggtcgctgattcgctggtgctgctgcagtttaggctaaacaaatcacccagttgacgaagagggagctgctgccgcggtcctggcccagctcgagagaagtcttttggtcttggcctcttgctgccgctgccccccaatcggcgccgctttgcttcctggtttccgcaaggttccacacatcagcatccgagacttgggatggaaggcacggcgtcttcttggagccgcgactagggtgggaaggaaagttacttgctgccgtcttcgcggtctttgcgcaggcagggtagagccggagatcagagatcttggtgcagacaagtccttcggcgtgcagggtaaatatcgcctcctttttcttcagatatatatgcttgtcggcgaagtccttcggcgttccgatcatcagcttttcttccaatttgtagttctctctaagcggaatccttgtgttcttgagagagagagagagagagagagagagagagagagagagagagagagactcagaaaggtagcgcagaggtgagatttgtaacctgtaataagtgacttgtggcgctgaagatcgaaagtcagagaaatcttgtggatacaagctccacctccaaggaatgataatggaccctcgtcctcgtgacgatcccaacctcggtgctcgattgcccaccccaaatccacccgcacctcacatgattagcttctccctccagcagccacagcttcagttcttcccttcgtatggattccacggccacagccacagctctcctgtcagctcgcatccatctccaccctcggccatgcctggctgcaccacgccaagcccggcatcgacaaccacaaccgagccagacagcgtcgaggatttttccgagactgttgctgacgacgcggtcctagcatacatcaaccagttccttcttgaagacgaggacgaggaatcctatcctattaccagcgcgcctgtggaggattcagcactcctcgccgccgtcgagaaaccattcgtcgacatcctcgagtctgccaagcctatcgcagcacagggctatgaagtaaagtcttggatcactgatgactgtgattctacaggaagcggaaggtttcgcgatgtggtcacaagtagtctgcctcgtgaaatggtgcgggagggtttagttggtgctgctcataagggtcagaagaacccgcgtgacgaggacatggagatggaggggaggaagagcaaacagtcggcactgtgtgacgaagagactgtccgggagatgtttgacaaggtgctgttgtgtaccgacaagaactgtgagttccactcaccaatgccagccgatgcacagatcagcgggggatatgtgaaaggatctagaaataagcgagggcgaaggaaggggagatcaggtcctggtgcagaggaggagccagttgatctcacaaccctactcatacattgtgctcaggccgcggctatcgacgaccacaggaactcaagcgagctgctgaaacagatcaggaagcattcctctgctactggaggcgcgggcccgtgaccggcaccctccttcgccgatgggctggaggctcgcctagctggctctggcagcagcatctaccgttcgcttgctgcaaagagaacttccactggtgatatactgaaggcgttcagtttgtatgtcaaagcatgtccgtttaggatactatcacactatgtcgcaaacacgaccatcttaaacgctacgaagagcgccacaaggctgcacatcatagactacgggataatgtatggtttccagtggccagtcctcatgcagcggctctcaaagagacctggtggccccccgtaccttcggatcactggtatagactttcccctgtcaggattccgccctgcagagcgtgttgaggcgacagggcggcggttgcatgagtatgcccgtatgttcaatgtcccatttgaataccaagccattgctgccaagtgggatactatccaagttaaagatctcaacatgaagagcgatgagttcgtcgtcgttaactgcctctaccggatgaggaacatgatggacgagacggtgaccgatgacagcccgagaacgcgggttttgaacacaatcaggaagctgaatccccatctgttcgttcatgggatcgtcaatggtacttacaatgcacccttcttcgtgacgcggtttaaggaggctatgttcttcttctcttcgatctttgatatgctcgaagcgaatgccttacggatggatgagcataggctgctgatagagagagagttctttggccgggaagctgtcaatgtgattgcctgtgagggcacagagaggattgaaaggccagagacctacaagcaatggcagatgaggaacctcagggcaggcttccggcagctagctctggacagggagataatgaagagagcaaggtacaaggtaagcaagagctatcagggggatttcctcgtggacgaagataacaagtggatgctacaaggttggaagggtcgtatcatatatgcactttcagcatggactagctagacttgtaaatattagtgagctactgagctgcttagctgacctcttccattaatttcttgattaatcaccatttcattttgctgtattatgtttacgttgttgaatctagccctcttttagaaaccaaagttttgtatgtttgaattgactgcaataatagaatcttgtccgtgtctgcctgaaaaaaaaaaaaaaaaagtgtaagaggtgtttctctatctttgttcctgtctttggaaagaagacactgttttgttcgttgaatcagtagcaccatatcttgagtaaaagaagttgaggctcagctgaaaactcttacaaactcataaactgctttgccatttaatcttttgtggtgaaagggtctctagcttggtgggtaaggtttctagagtatcacctccaagttcgggtttgattccttttaggggcgaatttttcggtttggttaaaaaaaatcctcttgtgcttcatccgctctcgggttacgatgtcctgtacgccacaatttggttggaccgttgcagagtggatggttaacgtcggtccattagtgatgagaggtcagagttcgaggattttctcggtcaggaccaatgttttgttctctttttagccatcagtgaattgtatgcatccttgagtgccaaccctagacattaatatcaggaggacggccattccctcggttgagtttttatttaatattttatgatgttacgtcgatgaattctgaccctctttcgtgagcaaagatgttgatgttcaatttgactgcattaaatataacttcggcgtatctgcccgacatatttgtgtaacatggtaacaaaatatactctcttctatcatatataatatagtatgtgtcgcagtgtaacaataccagcagtggcagatacaagactgaaattaaggaggtgctatcgtgctagtgtaaaaaatatagcatatatgtagcacatgagtagcaagaaacattatgtaatataccactgagttgctacttgttagccatagacagtgatacgagtagtagacaatattattatgtgtttactcatggcttgagaacgttcgatttatttcatggcctgcgcttattgttagcagagatatttagtttactttttctagccattcagctaaaaaagaaaaaggatgaattgttacatgtggtacctaggaccaggggcgcgtaggggtacgctcgccctggctgcgccccctggatactaggtatcaaaagtatctagtctaagagatttatagagttagaaatagagcgaggagcgtaggcccgacttgctggatctagagtaccacatgagtcatgagtgatttataaaggttcgagctgtagaagcgtaatatcttatgttctatatatagttgatgaatttataaagacagaggtgaagaagattacatactcagaattcacatgagttagatggtcgactaaccttttctttactttcgttctagtgagatttctaggctaacgggtctctagttcaccttcgtctataaacacttggtttagcttaacctgtaaaattgaaacgagtttccctaggcgtaagtgttcatatgggtttgaatctatttctacgc

SEQ ID NO: 3722 - DNA, 1731 bp, Zea mays
  misc_feature (10)..(10): n is a, c, g, or t
ggtacccccnggtttgccgggacttgctgccgtcttcgcggtctttgcgcgggcagggtagagccggagatcagagatcttgatgcagacaagtccttcggcgtgcaggttctctctaagcggaatccttgtgttcttgagagagagagagagagagagagagactcagaaaggtagcgcagaggtgagatttgtaacctgtaataagcgacttgtggcgctgaagatcgaaagtcagagaaatcttgtggatacaagctccacctccaaggaatgataatggaccctcgtcctcgtgacgatcccaacctcggtgctcgattgcccaccccaaatccacccgcacctcacatgattagcttctccctccagcagccacagcttcagttcttcccttcgtatggattccacggccacagccacagctctcctgtcagctcgcatccatctccaccctcggccatgcctggctgcaccacgccaagcccggcatcgacaaccacaaccgagccagacagcgtcgaggatttctccgagactgttgctgacgacgcggtcctagcatacatcaaccagttccttcttgaagacgaggacgaggaatcctatcctattaccagcgcgcctgtggaggattcagcactcctcgccgccgtcgagaaaccattcgtcgacatcctcgagtctgccaagcctatcgcagcacagggcttatgaagtaaagtctttgggatcactgatgactgtgattctacagggagcgggaagggtttcgcgatgtggtcacaaagtagtctgcctcgtgaaatggtgcgggagggttttagttggtgctgctcataagggtcagaagaacccgcgtgacgaggacatggagatggaggggaggaagagcaaacagtcggcactgtgtgacgaagagactgtccgggagatgtttgacaaggtgctgttgtgtaccgacaagaactgtgagttccactcaccaatgccagccgatgcacagatcagcgggggatatgtgaaaggatctagaaataagcgagggcgaaggaaggggagatcaggtcctggtgcagaggaggagccagttgatctcacaaccctactcatacattgtgctcaggccgcggctatcgacgaccacaggaactcaagcgagctgctgaaacagatcaggaagcattcctctgctactggagatgctggccagagattggcacactacttcgccgatgggctggaggctcgcctagctggctctggcagcagcatctaccgttcgcttgctgcaaagagaacttccactggtgatatactgaaggcgttcagtttgtatgtcaaagcatgtccgtttaggatactatcacactatgtcgcaaacacgaccatcttaaacgctacgaagagcgccacaaggctgcacatcatagactacgggataatgtatggtttccagtggccagtcctcatgcagcggctctcaaagagacctggtggccccccgtaccttcggatcactggtatagactttcccctgtcaggattccgccctgcagagcgtgttgaggcgacagggcggcggttgcatgagtatgcccgtatgttcaatgtcccatttgaataccaagccattgctgccaagtgggatactatccaagttaaagatctcaacatgaagagcgatgagttcgtcgtcgttaactgcctctaccggatgaggaacatgat

SEQ ID NO: 3723 - DNA, 977 bp, Zea mays
  misc_feature (915)..(915): n is a, c, g, or t
  misc_feature (949)..(952): n is a, c, g, or t
cacgcccattgtctcaggtcctgctcctctcccctcccctgcccgccgccaccgccagttggcagaccgcctatcggccaccgctgcacatcgcccgtctggctgttagcaccggcacgcagcgcccgacgtcctgtgcgtagcagccaggcacacgacgaccaagcgtatagtggatggtaggatgccagtagagattgatgcatccaaagattggagtgtcttaggataattaaacaaagaaatataaggatgctgaaccgagtgcaatagatcttttcaaggacatgcattgcagcaagaagaaaggtttttctgaaaatgtaaagaaagcaattgttgacatggaagcaagggtgacaacaccagttgaggatggacaacaacaaaagtctcctatagaagttgtttctgaagtgctatggggctccagtttatttctacagaatgttggtctgcaagataactccaagaaaagctccacaacaactgtttttgctaaggttcaagaacttcataatcaattggagtctgagaggctagaaaaagatgggcttcaagaagaagtagaaaccttaaaggctcaggcacaggcctcaaaggagaccatggacaatatgaagagatcgatggaagaaaataacagtctcctccgtcaactgttgagcttcaatcgaagccaaacgtccccatcttaagtctgctatagtatcatgttatattagttctggattcaggttttataaatttggaatatgtttaaaactttcatactttgagttgaagttataggatttcctttgtattttaagttacatgatctacaatcatatgatttgaagttataaaagtatctcttgtatgaattgtgtgaatgttgaactaaataattcaatgttttggttattagcattnttttgcttacatcctacagaattaccatgttttnnnncgttttgtgtggggggtttcttcat

SEQ ID NO: 3724 - DNA, 2632 bp, Zea mays
aaccacgctaaaatctcgcccaaatcatccccgccccagcaatggcgacctccttcggtttcggcagctccgcgaccgcgggctccacggcctcctcccccttctcctccaccccatcagccttctccttctcccagccggcgtctgcctcctcccctgcccccgcctttggctcctccctcttctcctcatcctccgccgccgcttcttctgctccaacttttgggtcctccctgttcagggcctcgtccgccgccgccgcacccgcctcctctcccgctttcggattcggatccaccttctcgttcggtcagtccatggcggcggcctcatcggccgcgtccgcgccatcccttttcggtgcaacgcccgcatcctccgctggaacaacccttagcttattcggcgctgctacctccgccgcaagcagccctgggttcttcggcgccacctccactgccgcaagcagccccggcctcttcggtgcgtccgccactggctctgcggcaacctccccgagtctgttcggtggcacctcgggcctattcggcgggacttcctccgcagcgaccaccccgagcccattcggggccacctcttccacggcggcgacagttagtccgttcggcgccgcctcttctgctgcgtccactccaagcctcttctctggaggggccacgggatttagctttggctcgtcggcgtccggttccaccactaccacggccgccgccccggcaccatcatttggcttctcgttcaactcggggccggccgcgtcaagcactgcatccacgccgacatcagcaccggctttagggtttggcggcgccactggctcgtcgctgttcgggtccaccacctctgcgcccctcttcagtaccaccaccgcttcttctccagcgtctgctgcgaccaccacgccatcctttgggttctcttcttcgccagcaacaaccgcttccgccccatcgtttggctttacaccatcatcaggaagcgcgacgaccgcgaacacggctccttccccgcgcgccccatccgccaccacactaaccacaccggcgtcctcgtcctccactggcttctccttggccacttcgcaggctgcacctgctccctcattgttctctaccagtgcaataggtagctccgctggctcggcgcccggctcgtcctttggttcatcttcggcagcttctacaccaactttagcctctgtgtttgcaactggttcctccactgtgccatcagcggctgcagcttctgcagcatctgggtcgtcgttcccagctgtttctaccagtggttttagttttgcagttgcgccatcatcatcagcagctgcagctactgccactaccaccactgtcacaagtgcttctacatctgcaggcatgacaaccacggctcctttgactggaacaacggggtttccaaattttaatcttcaaacaactaccccagcttctacctcatctcccacactggcatttggtgtttctactactgctgctagctcatcagccaccagcaccacaactcaagcaacttcctcagctgttcaagtcagcagcacaggtccgactactactacatctatcactccagcagcatcccaagcacctaagctaccatcagaaattgttggcaaaaatgttgaggagattattagggactggaacaatgagcttcaagaccgtactgcaaaattcaggaaacatgccaccgcaatagctgaatgggataagagaattctgcaaaacagaaatgttcttattaggcttgaggctgaggtggctaaagttgttgaaacacaaacaggcttggagcgtcaacttgaattgatagaaactcatcaacgagaggtagacaaggctctacagagtatggaggaggaagctgaacgcgtattccaggatgaacgagtgttacttcatgaagatggagctgcttcagcaagagatactatgtatgaacaagcagaagttgtggagcatgaactgcaacatatgacagaacaagtaaaatccatcattcagactatgaatgctactcagggtggtgagctcgagtccgctgatagtatgacaccatttgatgttgctgtccgaatactggataatcaactgcgttccctgatgtggattgatgagaaggttaatgagttctctggcagaatacagaggctgcctaacaacagcgtttcagccgaacgtgactctggaattcccaggttttggttaagctgattaattcgccgcattttcttgcggccctaatcgaggttcagtaaacattcttcgcttggttattctgctgctccaccggccaaggtttcgcgttattttctccccgttcaagcactttggtgccatgtagctctagccggttcactctggattggtaccattcagtgtcacttgtgcacacttcagcatagtttctatttgtttaacgttggacgtgattacggcatgtttggatctatttgtgttaactgttttagaagctaaaattagcactatttacgctattgtgttcaatatggagcacaagtctgcagaactaatctcaactcactttcatcccttaaaaaaaaaaaaaaaggcggccgcaaacaagtgagctc

SEQ ID NO: 3725 - DNA, 4187 bp, Zea mays
atattagatttgtgatacaagtcggatgttttagaaacatccctaattggcacacgtgcccacgccatgagcagcgaataacggttgtgccacttatccccatgcggatcttctcttatctcttctcgcgactcacgaaggaggcgcgacgtgcgcgtgccgctgtgctgcactgctagtgttcctgcgcgccgtgctgtccggcccgcccgcgccgcgcaccgatgccgccaccgtcttcctcgcgctactccccgggccggctgctcgccgcgcgcccggcgtccgccaccacggcatgctcctcgtttccgatcctttcggccttttctggtcttggtcacctacgcaggcggaccgtgcgctgatatgttttgcacgtgcacatgcatcacaggtggggagatgggcgcgcttgtcgtgctcgctgtccatgaacgggtgcgcgccgggcgccggggaccgcggcgcggtgtgcgtgcgcgagacgcgggcgctgccggccgcgccggcgccgcacgacgcagtggggcggctcagggccgccgtggacgcgctctggtccaacgcagcgccaccggccgcgccctccggcatcatccgcatcgaggtgcccatcacgcagcgggtggacgccgtggagtggctgcacgcgcagaccacgctgccccgctgcttcttctcggcccgggcgccgttgcccgacgcgcccgccctcgccggcaacggcaacggcaacggcagtgtccatcggcagcagccggtgagtgtcgcgggcgtgggttcggcggtcttcttccgagggacggagcccttttctctagctgattggcgcgcaatcaagaggtaatcgtcttattttctgaatttgccatgttttggtacggtcgatactgaacctggctgcttgttacgcttgcgaattcgtgtacctatgaagatttcttccaagggactgtccactggtccgcgcatatggcgccatccgtttcgacgccacgagtgacgcttccgttgaatgggaggactacggctcattctacttcgttgttcctcaagtaagttgctcgatctgcaactgctaaacctcatttgtccatcttgctctgaattttgcttgcgaaacgtctcaagtatgttggtgcaggtcgagttcaatgagctcgaggagagctcagtcctcgcgacgaccatcgcgtgggacgactcgctctcatggacatggcacaacgccgtggaggagctccaatcgactctgcgaaaggtgttgcgcgttcctcgtcgtccggttttttaaccgtctgctagaagactgtaacagcctgtagtactttttttccctcagatatcgccttgctcttctgttcaagcgaacaaggccagcctacagacagccatcgtaagtctcaatcatgtcccgaccaaggcgtcttgggatcttgcagttactaaagctctccatatgatcaagggcaggcaaagagaattggtaaaggtaagccgttttttgttctctatttgtttagagcgtatctgaaaatatgaatggagttacctaccttctttcttacaggttgtactggcaaggtgtagcagatacattactgacacttgcattgaccctgtggaactgctggcttgcttgaaggtctgcatgctttctcaaatgcttactgtgttcctgagggccaaaatgcttatcaattctgcattgacatttgcattgacatttctgaaaatacattactgacacttgcattgacatttgcattgacactctgtaatctaactatgcaggctgagggccaaaatgcttatcaattctgcatacagccaccgggtgctcctgcgtttgtcggaaatagcgtatgtttactgtgttcttgtttgtttttatttttattcttcaaaatcagcaccgcacacttttgttttttccccccttctatttagtgagaaaaacaaatggatgtaacgacaatgctatatagcttttttcttcttctaactaatgttcatttcatgcaaacattctgaatagccagagcaactatttcatcggaagtacttgaacatttccagcgaggctctagctggtactcgggcaagagggaagacaagggcagatgactttcaaatcggtcaggatttgcttctaaggttcctttccctccttaggatctgtaacttcctgtgatcgagggagtcagcttcagatcaacaccttgtactaaaaactgagcgagtactcatacatgttttttttcttcttgcagtagcaaagaggacatcgaattcactatagtacgggccagcatcaagaacaagctggaggcaagttgagttctagagatactgatacatctcgaatgcattttttttttggttgttgggggaaagagtatggtttcctgcaatttactgaactagcatctgtaacctgatctgcagatgatctgtgatgaggtggttgtccatcccagcaaggctctgcggaaacttccaagagtccagcatctgtcagcgcagttagctgcgcgaataaggaacgaagatgatgaggtgacctatgacaaaacttctactacttgagttgggtgaacatcatataaggtaacgatagcaacttgtgctggcgatgcagtttgagattctaaacaccctccatccgagtccagctgtttgtggcttgcccactgaagaggcacgccaattcatacgggattgtggtatgcccaaatttgattattctgttcgaacatagcctttctgaaattagacacatactaactaggtttttggatattctgacagaaatttttgaccgtggaatgtatgccggtcctgttggctggtttggaggagctgagtgcgagttcgctgtcgggattagatcagcgttacttggaaaagtaaaccgaactccaaatcttttttaaacttgaacagattcgaaattgttagattttacagttacaaaacgcactttggttccagggtcacagcactctggtgtacgccggtgcggggatcgttgaaggtacaaacccatcttttgaatgggatgagcttgatctcaaagcatctcaggtaccattttgacgaattcatggcaagtagcgtgctgggtttttaactaaatagtaaggctaatgcatccagttttttgggtcattttcagtttgcaaagctgttgcggtaccaagaacgacctattcgctaccaagaggctgaaaatctgggaacggtgatctgaatagagaagtacagaagaaactagaaagtcatcacaaagttcggcattcatttagcgagttatttatacaattgtttgtttgatatagtaagctagaagggggattcagggggacttgtgtaattatggaatccagaacagcggcagtgctgaaaaatacattgattgaacctgaatgggaaattgttcaatgtaacaaaaatatgtttacaccataaactatttgattgaatcagtgcgtgaatgtgacaactagcaatagggtatcctcgcgtgggtgactcgggcggcaccaaaccctagccgccgccccactccccccttctctccgtctcatcacttccaaaggggttggccgggatgcccgcgtgggccccaggacagcggcggcgaggcatctgcccagttggaatcgcgtgcgacttgatccacacggggagggaacacgtggctagggcgtgctcttggtgaccatggtggagccgtgtgcccgcgtgagcatcgcagacagaggcgcgatgacggtggtcttgcttgctcgcggagcagcgactgttggcggtccgactggatccgcgtcgtagccgatagttgcggccctattgcgcggatatgggaccgccgctcctgatggcgggagtgtgaccctcgcggtggctgtgctcgtcggagtcatagtggtgtgtgggtgaagggcgtagcgcgtcgacgtgggggtggcgatgtggcttttggcttggactgcttttgtcttatcgggggtgccatggtggcacgactgatggcggcttgctctgctgttgctggcggcgtggtggttgtgcgactgttagcggccgagcggtgatttcctggtgatgacatggtggcgcaatcggtaggacctagctacctcttcatggcatgcaagctagaggctatcagatgtgcc

SEQ ID NO: 3726 - DNA, 835 bp, Zea mays
atttccagcgaggctctagctggtactcgggcaagagggaagacaagggcagatgactttcaaatcggtcaggatttgcttctaagtagcaaagaggacatcgaattcactatagtacgggacagcatcaagaacaagctggagatgatctgtgatgaggtggttgtccatcccagcaaggctctgcggaaacttccaagagtccagcatctgtcagcgcagttagctgcgcgaataaggaacgaagatgatgagtttgagattctaaacaccctccatccgagtccagctgtttgtggcttgcccactgaagaggcacgccaattcatacgggattgtgaaatttttgaccgtggaatgtatgccggtcctgttggctggtttggaggagctgagtgcgagttcgctgtcgggattagatcagcgttacttggaaaaggtcacagcactctggtgtacgccggtgcggggatcgttgaaggtacaaacccatcttttgaatgggatgagcttgatctcaaagcatctcagtttgcaaagctgttgcggtaccaagaacgacctattcgctaccaagaggctgaaaatctgggaacggtgatctgaatagagaagtacagaagaaactagaaagtcatcacaaagttcggcattcatttagcgagttatttatacaattgtttgtttgatatagtaagctagaagggggattcagttggatttgtgtaattatggaatccagaacagcggcagtgctgaaaaatacattgattgaacctgaatgggaaattgttcaatgtaacaaaaatatgtttacaacataaactatttgatt

SEQ ID NO: 3727 - DNA, 1979 bp, Zea mays
  misc_feature (8)..(8): n is a, c, g, or t
  misc_feature (13)..(14): n is a, c, g, or t
gctctatntctcnngcatcccccgggctgcggggagagctcactagtcccccccccccccccatttctcaaacaagagcagattccattacatatgatgttaaagttcagatgattgaaatatacaatgagcaagagggatttattaatgactgatggtgcaaacaaaagattagagatacgcaataattctcatgtaaatggactcaacatcccagatgccaatattgtgccagtcaagtgcgcacaagatgttttggatctgatgaaagttggccagagaaaccgagcagttggatcaactgctcttaatgaacgaagtagccgctcacacagtgtgttgacagttcatgtacaaggaaaggaggtaatttcaggctcaactctaagagggtgtcttcatctagtggatctcgcgggaagtgagagggtagacaaatctgaagcgactggagaaagactaactgaagccaagcacataaacaaatctctgtcagcacttggtgatgttatatctgcacttgcccaaaagagttcccatgttccatatagaaatagcaagttaacacaagtgctgcaggatgccttaggtggtcaagcaaaaacattgatgtttgtgcatgtgaaccctgaaacagactcttttagtgaaacaatgagcactctcaaattcgctgagcgtgtagctacaatagaacttggtgccgcccgtgcaaacaaggaagcaggccaggtcaaagacctaaaggaagagatcgccaagcttaaattggcattagatgaaaaggaaaatgaagtggcacagtttaaagatcttgctaaccgtgtgacttctgagatgagaaatgcaagaacaagatcacctttaaccgccagcatgtccttgaaacctgaagtcagtcaagaatccagtgtagacacctgtacaagtgagataagaagttcatcatctggcaagcaaagaaggttccgttcaccgttgtcagtgagagagctagacgataagtcacctgtcatcagcagggaactgtacctgagtgcgcgaaagtacaagactccctctcctccggttagaagctcactctctgtcgagagaggcagctttgccaaaatcgtggagaacactggaagcatcgactgcacaccgatatccaaggtcgaagtgcctccaaaagtgtggtccagctccagcaactcgaagaccacaccttcatctgtcctgacagctcagaacctacggaaattccgggactccgaggagaacagaaccaaaattccgcctgtccggcagagcatggtgaagaacaggtctgagagtacgccaaagactcacaatgaagagaaaccggcgaacaggcactcgggtaccaaagcgaggtctgaggccaggaacacgagggactcgtccgaaatcgagaacgagtttgcgggcgatgaacctactttccacttcaaccgaactgcgaagaagttaccgacaaaggtgatgacaagacagtcccagaacatagatgtcagtgtcagggcctctgtccggggggagatggagcctctgaccgaaggaaggcaacgccggaactggagcaagccgccgcacgccgagaggaccaatatgccgttgccggacatccggcgcagtgtctccctgccgcgcgggaagaaccctcttgtgtgaatctagctcgtttcgccaaccaggcattctttcattggttgtttgtttctttatcctgtggttcgatccgaatgtaggctctacggctgtgtagaacacgtcatccggatgcataacacaaagtctgtcgagttgcttccaccaggctcccatgaaaacgcaaagttcacgctcttatgcgcgatgtaaaaatgtatggattattgttgcactgcaggctgcagcatctcgttccagtggcgattccgtacccattttggtcctttttttttatatagaccaaaaaaaaaaaaaaaaaagcggcc

SEQ ID NO: 3728 - DNA, 3623 bp, Zea mays
gcacgaggctgtccagtccccaccaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagcggtggtggggggcccgcgttcgtgggccaggtgttcaccatgctcgacccatccgggaacgggctcatggccgttaccacacgcttcgagctcccgcgcttcctcaccaacaggactcctatgtggttcaaaaggatgctatcaccgtcgaagaagactgaaaatagtccagtatttaggttttttatggatctgaatgatgcagtatcctatgtaaagcgactaaatgtgccaagcggcatggtgggggcttgtcgccttgatgtagcatatgaacatttcaaggaaaagcctcacatgttccagtttgttccaaatgaaaagcaggtccaggctgccaataagctattgaagtcacttccacaaaggggcagaaggaaaaaacttgatggggttcctgtttttagtgcgcaaaacttgaatattgcagtggcaacaaatgatggaattagatggtacacaccatacttttttgataaaaacttgttggacaatatccttgaagcttctatggatcaacatttccattcgataatgcaaaatcgccatacacgtcgtagaagggatattgtcgatgatagtttaacatcagaaataattgaagaaagtgctgaaagcttgcttgagcccccagaggttcaagaattaatgaatgagattggcccagctggtataccattaaatgttgtaacgaaagctgcagagattcagtttcttgatgttgttgataaagtccttctaggaaataagtggttaaggaaagcttctggcatacaaccaaagttcccttatgttgttgattcatttgaagaaaggactgctgtttcaattgccaacattgctactaccagcagtttaactgcttcaaatgacgacagcagttgccagaataatcaagaaactcaatcttccgagccaagaggtgacaacagcagctacagaaatcacaataatgaagatcataatcactttccgtttagcaatctgcttccaaatatatggccagggcatgacagaaagttcaaatcacaagagagtgacaataagtttagcagatatgatgccgacgtgaagagtaagttacaagcaaaccctcttcttccgaaaatcaccatggttggcatctcaatgggtgatggtgcacagatgagcaaagccaacttaaagaagacaatggaagacttgacaaaagagttggagcaaacgagtgaagaaaatatgttcggtgatgaaaaagacccactttttgttgccaacgttggtgactactcaaggataacaaagattagctctgcatgaggctcgttgaccaacaggcgacagcaagggtgttgtactgaactgctaacgaagtctacagtccatgatactgatcttagagggctctactgatataatgatgcaaatcggaggtcatcagatcatatggacattcgactgtcgaccgttctgactttagaggctatccaacgtcaacagttacaagccaatctaaattttcggatatgatttgtcaaaaggatgattgtaaatagaaaagtttgcagtatgtccaccatgcagttaggcgtgaagatctgaagcaacatgttgttggatttctaagatcttagctcgtaacagctgtagagtatggtggtatatagcttcaggattgagatgaggggtcataggagactgtcaggtgagcagagtcgaataaaatgatgtgggtagcatttttcttcactagctgcgtatcggatctgagtttgtatggcgagaggtacggttaatgttggttcgcatataggtccttggattatttattgtacgcgatatggtgaaaggaggttgtagctaacatgttgtgtctccgatcatcaaactgacattattgtctctcatgatcttatacttgcttataaatagaacttaaaactttaaacagaaaaaaaaaaaaaagcgacaattgagagttgggtgcaatatgagcatgctggtgttaaggctacggcattctctcttcatcacatcactagatagatagattagcaggatggccttttttttttgcatcctcccctgttgcatttggatagggatcgccggcgtcgcttgggatccacgcacaactggctctactgaatagtatctcatctccagtatactaaattgtaaaactaataaatggtgagagacgctggagattcggtttgagaggctgcctgctgccatggccacctgcaggcagcagccatgtgcacccgagacgagaggcccggctatcgtttccgtgcgcttgtcgtcgtcgtcggctgcttcacatgcatatgcatgctgtgctgccgtctgcaacgcacgcagaggctgtcgtctcgtctgtctgcctcttgcccatgctgccacccctggagtctgtgtccgtccgtacacgtccccttgctctccgcctctcccagtccgcatcgctgcagtatgaaaagtttcatagatataacggatatttccgtagactaatcgtttcgtagttgcctgcactgtttggttggagcccttctaacacaaacgtagatgcaacaaacacaaacgtgtactgtagcaggcagcagcagagcactcgggcggacgacacgatggcgtggcgtggcaatatgcatgcatgcatgggttcaggattgaaggaaacgtagggaaagcaggcacaataatgattttgcacgtatactccgacggagcatagtggcacacaccccgtcccaagaacaaaactgcacttgtattgtacgtgtactacgtctatcgtccatgcccatgcatgcatgcatgccagtacgtagcgatgccaatgcaccagagattagacggagcaggtgaggtgacacagagacggagtgagagagagatggagattcccgtcgtcctcgtcccttccttccatcacgtccggccactggctgcatatgcatgctcagactcgacgtgtcccctccgtcaaacgcaaagctccggttggccatgctgctacacggacacggtccccgaatccgaacacacctgatcactgtgcttcgccttcccttcacatccagcggccgatcgaaccagagatggccatccacatcagctgtctcctttgtgccgtctcgtcaactcagcgccgaacatttattattcctctgtttctgccgaccgacaacaccaaatactacattgttttgtctttataaattacaactacatcatacaaacaactatttaggtcatgtttatttgggattataatctatgtaaataagctagcgagaaaacaaacaagcaacttatcttataag

SEQ ID NO: 3729 - DNA, 866 bp, Zea mays
attggtacctcgagccggcgggaaaaaataaaaaaaaaaaaaaaaaaaaaagccatacttccccgagtcgccgtcgtctgctccgggctgctgttctgcgcctccacaaggctttggcctctgttgtaagatttaagcttaacctccaaccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccacaaagtactactgcactgtcattgatgcccctggacatcgcgatttcatcaagaacatgatcacgggtacctcccaggctgactgtgctgttcttatcattgactccaccactggtggttttgaggccggtatctctaaggatggccagacccgtgagcatgctctccttgctttcacccttggggtcaagcagatgatttgctgctgcaacaagatggatgcgactactcccaagtattccaaggcccgttatgatgagattgtgaaggaagtttcatcctacctcaagaaggttggatacaaccctgacaagattgcctttgtccctatctctggttttgagggtgacaacatgattgagaggtccaccaaccttgactggtacaagggtccaccctgcttgagctcttgacagatcacggagcccaagaggccttcagaccagcccctgcgtctgccccccccag

SEQ ID NO: 3730 - DNA, 1387 bp, Zea mays
ttgggacctcgagccggcccgtggcccactcccctctccctcctccagtcttccaaaatatctccctgcgcttttccgagtccttttccctccaaggaacagaaacaaccggagcttttaccccacccgctttcccctccccgccaggaacaacagggctcctcgcaataattcatccatccatggcgaagctcgtgaacaagctggtcgattcgttcgaccacgatgaggcgccagcgccggacgtcggctgcgtgcgcgccgtgctggctgagctcgtcctcaccttcctcttcgtcttcaccggcgtctccgcctccatggccgccggggccggcgggaagcccggggaggctatgccgatggcgacgctggcggcggtggctatcgcgcacgcgctggccgctggcgtcctggtgacggccggcttccacgtctccgccggccacctcaaccccgccgtgacggtggggatcttggttcgcggccacatcaccaagctccgggcgctgctgtacgtcgccgcccagctgctggcgtcctccctcgcctgcatcctcctccgctacctcagcggcggcatggtgaccccggtgcacgccctgggcgctggcatcagcccgatgcagggcctggtgatggaggtgatcctcaccttctcgctgctcttcgtcacctacgccatgatcctggacccgcggagccaggtccgcaccatcggcccgctgctgacggggctcatagtcggcgccaacagcctcgccggcggcaacttcaccggcgcgtccatgaacccggcgcggtccttcggtcccgccatggccaccggggtctggaccaaccactgggtctactggatcggcccgctgctcggcgggtccctggccggcttcgtgtacgagtcgctgttcatggtgaacaagacgcacgagccgctgctcaatggagacatctgacgaccgtcggcccccagggcagtgagcacggttcatgcttgttttctgtaaaatagttcgttacctacaagcatgatgcatatattgaccaaggtaattaattagagagggttgctgttaaatagttaccctggtgggattgtgggatgtagaaattgttgctgggctttgcttttcttttttctttttttcttttcctcccaaggaattttttaagagggctgggttctgtaaaggatttgtttaggctattagttagctatatagtagaaaactagagaatgctatacgttggacgtgattttttttcacgtatattgttgtacgatatggtattttttatcttccggatggaaaaaaaaaaaaaaaataatctttttccaaaaaaaaaaaaaaaaaaaaaaaagaaaaaaaaaaaaaaaaaagcggcc

SEQ ID NO: 3731 - DNA, 1355 bp, Zea mays
cattgggtccctcgaggccgggcgggcacgtcccacccctcctgcatttcaaataatatctccctgcgcttttcctagccctttgcccctttgtcatccaaaggaacaataaacaaccggcgcttttacacccccgccaagaacaggccagagcaacaacaacaaggctcctcgcaattctcatccatggcgaagctcatgaacaagctggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgctggcgtcctggtgacggccgggttccacgtctccggcggccacctgaaccccgcggtgacggtgggtctcatggtgcgcggccacatcacgaagctccgggcggtgctgtacgtcgccgcccagctgctggcctcctccgccgcctgcgtcctcctccgcttcctcagcggcggcatggtgaccccggtgcacgccctgggcaggggcatcagcccgatgcagggcctggtggatggaggtgatcctcaccttctccctgctcttcgtcacctacgccatgatcctggacccgcggagccaggtccgcgccatcggcccgctgctgacgggcctcatcgtcggcgccaacagcctcgccggcggcaacttcaccggcgcgtccatgaacccggcacgctccttcggcccggccctggccaccggggactggacaaaccactgggtctactggatcggcccgctgctcggtgggcccctggcaggcttcgtgtacgagtcgctgttcctggtgcacaagacgcacgatccgctgctcaatggggaaatctgacgaccatcagcccctgtgctgtggcgcatgatgcttcatgcttgtttctgtaaaacaggtcatttatctgcaagcatggtacatatattggccacggtaattagagaggcttgctgtaaagcagtaggattgctggctgtagaaattgttgatgcgcttttctttttgggttttcctgccaaggaattctttcttttatataatctcaaaaaagattatttttttgtatgggctgggttctaatgttctatcaagggtttgttaaggttattagtttaccatgtagcagaaaaactagtgggacgtgaagttttttcacgtacattgtaatactttggtatgtttgtctaccagatgaaactggaagtacagagcaaaaacttctctaaaaaaagcggcc

SEQ ID NO: 3732 - DNA, 4750 bp, Zea mays
aagccatattttagattataaagttaagtactttcataaatctagattaacctgatctagatcaatcacttgtccttcactaacttcattttaccatatcttgttccacttcttaaactacaatgcagagtagtgatccaatcttcatatcggggaagtaacgatgatccgaatagattaatacacagttgtgaatatatgtagcacttaactcttgcatatgtcaacacatctttggataatttaagatcataatgatttcacgccagccgagagtacaatactccaccctctagcctatagtcaggataaatacacgctactctcgtagtatcttcacttccagtgcatggtagctgttctaccggagtgctatggtaggactgacgagtgacgaccacctatagtctgatcaatagtaagttccatcaccaatagctaatacaatggtagatataaatccacacagtaaccagccatcgtcacagcacactgctgcatagtgcaggtcgccacaactcttctaattttctttgttgttgctgagatggcgacctccagggccacgaaaaaactggactattttgcccacgcctcttggtacccattttccctttgcttttctataaaaccaggcgaccccccgccaggccggcgcccacgtcccacccctcctgcatttcaaaataatatctccctgcgcttttcctagccctttgtcatccaaggatacaataaacaaccggcgcttttacacccccgccaagaacaggagcaacaacaataaggctcctcgcaacaatccattctcatccatggcgaagctcatgaacaagctggtcgattcgttcgagcacgacgagatactggacgtcggctgcgtgcgcgccgtgctggccgagctcgtcctcaccttcctcttcgtcttcaccggcgtctccgccgccatggccgccggtacgtcatacgaccatgcgcccaccgcgcctctgtcagaccgtctcctctccactcgatcgccctcctatttgttatttatatccctctgggctctggccaggaaaagacaggtccttttccccctttatgaaacgtacgtggctctgcacgcgcgcaggatccgacgggaagcccggcgacgctatgccgatggcgacgctggcggcggtggcaatcgcgcacgcgctggccgctggcgtcctggtgacggccgggttccacgtctccggcggccacctgaaccccgcggtgacggtggggctcatggtgcgcggccacatcaccaagctccgggcggtgctgtacgtcgccgcccagctgctggcctcctccgccgcctgcgtcctcctccgcttcctcagcggcggcatggtacgctccacttccaccgtacccgcgcagattcatggatctaggagtaccacgtgattttactccaagtaattactgtccttggtaaattccgcggtccaaaggatgtgggggaggagagagagctcagaaaggggaccaaaaaatcgtgggtttccgtcgttgaatgaatcctatatatgcttgtttttgtggatcctatttatgttatgtttggtgtgcgctgtcggatggctattgtttcggtagtagagagacgcgggccatgcttgtctgcctcaaatcaacttgggccgggctcgaatgggtgagaggctttatggagaccttttagggtctttaatgggcttatggataattagttcactctttcttgtttagttttagtttgacccttaataaagggttaagggaaacatatttactacataacaatcaactgattttttttgcagcgctgtctgttgttttgtaaaaagtagtaaacatgaactaaaaatattttttttgccaaggttgtgtctacttggtatatatgacagtgaattttatctgctcctggcttctaataagtccatgccattctatttgacctgcctatctggtccatgagcttctgcctaccaatcaaatgtggcctttcagatttagaagagttagttagtggagtacacagcatggtcgagtaaagccaaagccaagagttggactgaatcatacttattatctcctatatgacaaacgactgaatccaccgatatttgtttaacgtcgcccttttgatcacgaaaattaacaacggaacggaagctggtgaaaacgactagcagtgctgaccaagatgtgcgatgcaggtgaccccggtgcacgccctgggcaggggcatcagcccgatgcagggcctggtgatggaggtcatcctcaccttctccctgctcttcgtcacctacgccatgatcctggacccgcggagccaggtccgcgccatcggcccgctgctgacgggcctcatcgtcggcgccaacagcctcgccggcggcaacttcaccggcgcgtccatgaacccggcacgctccttcggcccggccctggccaccggggactggacaaaccactgggtctactggatcggcccgctgctcggcgggcccctggcaggcttcgtgtacgagtcgctgttcctggtgcagaagatgcacgagccgctgctcaatggggaagtctgacgaccatcagcccctgtgttgtggcgcatgcttcatgcttgtttctgtaaaacaggtcattctctgcaagcatggtacatacattggccaaggtaattagagaggcttgctgtaaagcagtaggattgctggctgtagaaattgttgatgggctttttttgggggtttcctgccaaggaattctttcttttatataatctcaaaaaagttttttttttttggtatgggctgggttctatcaagggtttgttaaggctattagtttaccatgtagcagaaaaactagtgggacgtgaagttttttcacgtacattgtaatactttggtatttttgtctaccagatgaaactggaagtacagagcaaaaacttctctatcaaacagtatttatgcctaccgcattttagtagaaacaacaagaagaagaaaacacaacctcattctacaccattttccaaatcctgagaatgaggcctaataaggcatctttaagagtttctgcaacccattaccgattgaaaaaaaaaacgctctccaacagttgggaaaatcaactccttagagcatcttcaatcgttcctagaaaatcattagcaaagtaaaaaaaataattagtaaatctatgagtttttagtagtttctaaattcgacctcctaaaatatagaacctaatttttttaactatttcaaaatcacctcatacagatttatactttatttgtcttgtatatttacattgaaaacatgtcttactctccactagtctttgttggagcacccgcgcaagggtatacctctcactacgagctgattctcaacctctccgacacagtgaatcactcacaaccatgtacaacgtcgatccgagttaccaccaagtcctctgaggtgatcatcgtgtttcaattgccaccatacaggtgatgccaatcaccaagagtagcaagctatagacattcacttgaccatgctttggctctctcttgcgccaatgaggccttaacgacgggattataattttgctaatctcctcactaagcaaatgggtcttgcaagctttagcaataaataccaagtggttggggtaagacacttaaatgaggatgttggaaggggtataaatacccacaaaccaaaatatagtcgttaccgttctgcgtagtcggcggacgcaccggatcagtccgatgcgtcactcgacagggtgacatcacccaacggctagttctaacaactagccattacatagtggaggtctgccctaccagcagggccacacctagacctaatcatgggccacctgattcgatcgccccaaaagaactcggtccgacccgacccgccccgattcgatcgccccaaaagaactcggtccgacccgacccgacccatgcagcgggcgggtatgggccgtaaattttgacccaataattcatgggtcgggtattggccatgatttttgaaacaaaactcgacccaacccaaggccaaaaacctgatcccacccaaaaaaaactcggcctgacatgtcaaatagggaggcacgggcccccgacactacgagtacgggccatgctaaatggcccacgaaccgaccttgacccgacctgacgtttgaacatgcatagccacaccggactggtccggtcgccaaaccgtccaggacccaaaatagtgctctctggaagtctagtctggtgcatcaccagatcggtccgatgtccatttccagactgggcacatgaaggagtctctaggaacttggtacggtgcaccaccacgagactggtcgggtgaacccagagacccaactcttccttctatttggggttttcaaatttgttttgaccccaatatttttgtgggtctatgtgagatacccagcactagttttatgcaagtgcacactacacgagacaagtctaggtcaagttacttgtctaaaacctctctttatagtagaactaaaagaaaataaaggtcctattactagattaagtgggcaacaactttttcgacactaagaactagtacaccatggcctattttgtgtcctttcttagccatttcatcaatgttcatcctttggggtgttttctccctgttgaagatcaaattcctgcattgtgacttaatttaccatataatctgca

SEQ ID NO: 3733 - DNA, 1384 bp, Zea mays
  misc_feature (1346)..(1351): n is a, c, g, or t
  misc_feature (1369)..(1369): n is a, c, g, or t
gccattgggtacctcgaggccggccgggcccacgtcccacccctcctgcatttcaaaataatatctccctgcgcttttcctagccctttgtcatccaaggaaacaataaacaaccggcgcttttacacccccgccaagaacaggagcaacaacaacaaggctcctcgcaacaatccattctcatccatggcgaagctcatgaacaagctggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggctatcgcgcacgcgctggccgctggcgtcctggtgacggccgggttccacgtctccggcggccacctgaaccccgcggtgacggtggggctcatggtgcgcggccacatcaccaagctccgggcggtgctgtacgtcgccgcccagctgctggcctcctccgccgcctgcgtcctcctccgcttcctcagcggcggcatggtgaccccggtgcacgccctgggcaggggcatcagcccgatgcagggcctggtgatggaggtgatcctcaccttctccctgctcttcgtcacctacgccatgatcctggacccgcggagccaggtccgcgccatcggcccgctgctgacgggcctcatcgtcggcgccaacagcctcgccggcggcaacttcaccggcgcgtccatgaacccggcacgctccttcggcccggccctggccaccggggactggacaaaccactgggtctactggatcggcccgctgctcggtgggcccctggcaggcttcgtgtacgagtcgctgttcctggtgcagaagatgcacgagccgctgctcaatggggaagtctgacgaccatcagcaccttcatgcttgtttctgtaaaacaggtcattatctgcaagcatggtacatacattggccaaggtaattagagaggcttgctgtaaagcagtaggattgctggctgtagaaattgttgatgggctttttttgggggtttcctgccaaggaattctttcttttatataatctcaaaaaagtttttttttttggtatgggctgggttctatcaagggtttgttaaggctattagtttaccatgtagcagaaaaactagtgggacgtgaagttttttcacgtacattgtaatactttggtatttttgtctaccagatgaaactggaagtacagagcaaaaacttctctaaaaaaaaaaaaaaaaaaaaggccgccaaaaaaannnnnnaaaaaaaaaaaaaaattnaaaaaaaaaaaaaaa

SEQ ID NO: 3734 - DNA, 1480 bp, Zea mays
aaaacattgggtacctcgaggccggccggggaccatgtcccactcccctctccctcctccagtcttccaaaatatctccctgcgcttttccgagtccttttccctccaaggaacagaaacaaccggagcttttaccccacccgctttcccctccccgccaagaacaacagggctcctcgcaataattcgtgcatccatggcgaagctcgtcaacaagctggtcgattcattcgaccacgacgaggcgccggcgccggacgtcggctgcgtgcgcgccgtgctggccgagctcgtcctcaccttcctcttcgtcttcaccggcgtctccgcctccatggccgccgggtccggcgggaagcccggggaggctatgccgatggcgacgctggcggcggtggctatcgcgcacgcgctggccgctggcgtcctggtgacggccggcttccacgtctccggcggccacctcaaccccgccgtgacggtggggatcttggttcgcggccacatcaccaagctccgggcgctgctgtacgtcgccgcccagctgctggcgtcctccctcgcctgcatcctcctccgctacctcagcggcggcatggtgaccccagtgcacgccctgggcgctggcatcaacccgatgcagggcttggtgatggaggtgatcctcaccttctcgctgctcttcgtcacctacgccatgatcctggacccgcggagccaggtccgcaccatcggcccgctgctgacggggctcatagtcggcgccaacagcctcgccggcggcaacttcaccggcgcgtccatgaacccggcgcggtccttcggtcccgccatggccaccggggtctggaccaaccactgggtctactggatcggcccgctgctcggcgggtccctggccggcttcgtgtacgagtcgctgttcatggtgaacaagacgcacgagccgctgctcaatggagacatctgacgaccgtcgggcccccagggcagtgagcacggttcatgcttgttttctgtaaaatagttcgttacctacaagcatgatgcatatattgaccaaggtaattaataggagagggttgctgttaccctggtgggattgtgggatgtagaaattgttgctgggctttgcttttttttttacttttcctcccaaggaattttttaagagggctgggttctgtaaaggatttgtttaggctattagttagctatgtagtagaaaactagagaatgctatacgttggacgtgattttttttcacgtatattgttgtacgatatggtattttttatcttccggatgaaattggatgtacatagcatattttttttggaagcagtatttatgctatcatcgctcggggaaatatcataccctcaacaaccagcaaatggattcaaagatcttgctgttcattttaatcttaattcgtatggattggatgagattgagtcaagatcttgttgttcatttt

SEQ ID NO: 3735 - DNA, 9003 bp, Zea mays
  misc_feature (5608)..(5608): n is a, c, g, or t
  misc_feature (8979)..(8979): n is a, c, g, or t
aattcggcacgaggcgggcctgcgcctccaccgtgcccgcgaggttcgtgacctgacgcagccgccgatcgagttaatggacgccgaggctggcgtcgccggcgccgaccagctgccgcggaggcagtactacatgaatctattgcttttggcttaccagagctttggtgttgtttacggtgacctaagcacatcgcctctttacgtttataatcgctcattgctcgagccgcccgggcaggtaccaagatgaggagacagtgttcggtgtgctttccctcatcttctggaccttcactctgattcctttgctgaagtatgtcactattgtgctgagtgctgatgataacggtgaaggcggaccatttgctctctattcgcttctttgcaggcatacaaaactcagcttgctgccaaatcaacaagcagctgatgaggaactatcttcatactacagaaatgggtttgcacctcacaatggatcttcaccttggttaagaaggtttctggagaagcacaaaaaaatgagagttgtgcttcttctcatagttctctgtggcgctagcatggtgattggtgatggtgtcctcaccccagcaatctcagtcctctcatctatgtctggattacaagttcgagctactggtttaaagcatagttctgtagttctcctttcgtgcattgtgttggttggtctatttgccttgcaacaccgaggtaccccgaccgcggcctccgtgtttgcacccattgtcatcatctggctgctttccattggaggaattggtttatacaacattcttcattgggatccaaatatatatcaagctctctctccatattatatggttaagttctttagaaagacaggtaaagatggttggattgctttaggagggatccttctttctatgacaggcagtgaagcaatgtttgctgaccttggtcactttacgagtgcatctgtcagggttgcctttattactgtcatatacccatgccttatgctacaatatatgggtcatgctgcatttctgtcgaagaacacatttcacatgccgacaggtttttatgatactatcccagaacctgtgttttggcctgtcttcgtggtggccacactcgctgcagttgttggtagccaagctgttatttcagcaacattctccattgtgaaacaatgccatgctttgggatgtttcccacgagtgaaggttgttcacacatcgaggtggatctatgggcagatatatattccagaaataaattggattcttatggttctttgtgttgctgtcactattgcatttcgtgatactactcttatcggcaatgcctacggtaagcttttagcattgattcacaaacatcaggatccttcttgtatattttttttagaaaaaaaaatcagcattctcatgcactgggagtctgagcgtagtagtttacttctttcttgctgtgtttccaggtattgcctgcatgactgttatgtttgttactacattcttgatggcattgataatcatctttgtttggcaaaggaacataatatttgccctagtttttctggttttctttggatccattgaagctgtatatctttcgtcatctctcatgaaggttactcagggaggatgggttcctcttgtgcttgctttcatattcatgtcagtcatgtacatttggcactatgggttaaggaggaagtaccagtttgacctacagaacaaagtatcaatgaggtccatcttatctctcggtccaagccttggcatagttcgggttcctggtattggattgatttacacggagctggtcactggtgtaccctccattttctcacattttgtcactaatctccctgccttccatgaagtcctggtcttcctttgtgtgaaatcagtgccagtgccgtatgtttcaccggacgagcgataccttgtgggtaggattggacctaaagaatatcggatgtaccgttgcatcgttagatatggttacaaagatgtgcagcgggacgatgacaattttgagaacatgttagttatgaacattgcaaagtttattatgatggaagctgaggatgcatcttcttcagcaagttatgatgtctctaatgaaggaaggatggcggtcataacaaccaccgatgcctctggcagtccattggccatgagagatttcgacggcctagccgactccatgactatgaggagcagcaaatcagaaacccttcgaagtttgcaatcctcctacgagcaagaatcccctagtgtaagccggcgccgccgtgttcgctttgaggtaccagaggaggatggcatgggccggcaagtgaaagaagaactcatggcgctggtggaagcgaaacatgctggggtggcatacatcatgggccattcttatatcaaagctaggaggagctcaagtttcctgaagaagtttgctattgatgttggctactctttcctccggaagaactgcagaggtccatcagttacgctgcacattccacacattagtctgatagaagtgggcatgatctactatgtttagcctaatgcccatggccaaagttgacatgtggatacccggctgggacaattctgttttcccttcagtcctatctggcagcttgtgctttctgggccaaggatcctcgtgcgcttaagtttcagcttgtagagaagaaggcagactttccttgttaatattattttttagcctaaataaacaagcagaatgttgccggttatgtttctcatttggtatatttgcatgcatgctctgtaattttttctgcgggctatgtgatggaaatatatgcactccttataaactggtcagcgttcctctctctctctcgagcaggcatgaacctgtatttatttcattaaagaatggagttttaaacaaactataactcactagcgaggcacgagcttcagtcgatttcaatgttggcagcgttttcaatgttggtccacaaccccaaaaactggtcagttttcaccaatcgacttacaattttggatgctcctgttctttgactaaaacaactcgaagaaaaccctgaaaaggaaaccattatgctccgggccttattattgggaacatgtgtacagctgagaaggctttaacaggctgtacagcttaactgacaatcctatttatatttctcacatgtaaatatgtccacaggtttttttttaactattgttacactgggatcagaacatctaccaacatagcaggaggcaaaaggcctcaggctgagcttgcagcagccagtgtcttgttcagcagctcgcgaagcgacccaggagaggttaccggcgggctgcacttgaagtcctggcacacatgcgccaccgccggtttccccggagggctgccccgtgccatttgcgcgatgtttgcattgttgccgtcccagaattccatttcttctgtgttcctagggtcgatttggatcacctggttcaacaaataaggtgcccaaagtcactatcatacagcaggaaccaaaaatcatgcatacaactcacaagggtggttagatttgaaggaacaacacatatatcgagttcatacctgaatcagatagatgcaacgtggtaaaatagactgactatgataacgcgcatagttccctagtaactttattcatttggacagagggcttgaccagcaacttgtgctggcactcattctagtcacaagtggttttatgtatagaagacaggtgcagcaatggttatgtggtcataatatctgaggcacattggctagcagaactggtacactaaccaaaaagaataatttggccacagaacaatcttcacttactgttctattcggatcatatgacgaaaacgtagctgctaccatgtcctgaaattcttcagatcctttctgccccactatcactacctgcttccttgaaggaacagagagcatatctgctgcgcaacacattaaaggcaacgctatgctaagttgtcgtagcctggtctcaaagaccgcctgcaaaaccaaaaaaaagaaggaaaaaaaactgaacataagcaaatatgatgttcaaagataaagagcttgaaaaatatgactgcttgcatgtagaggcttttagcaattcttatgtgttgaagctacagtttttttcttatagaaaaaaggttttaatattgatgtctatttcaatatgatatccaggaaaaacaaatgaagttccctatcctagtattgtcacacatcatgttccaataaagagaatcaatttaaaccatagtcacaggaaatgggatcaaggccgcgttctgggtttgtcgtcccaaatcgtgggtcggagtcacaccgggacatcgtcctcatccgtacaagaatttcatgaagcatggactcacgatagatgggaccaggaggtggagaagcttaccacttacaaggtgttagatgcctatgcatgtgtctttgttctattagatctatacatagtccttgttgtacacggtctctatcctgtattagtgtatatatttgggcctaatactcatatattaaatcagtgttaatcacaacatggtatacagagacaaaaacaagggttattgcttcctttctctaattgttcctcttacgtcgcttggtggctctgtcctgttgccttgcggctctgcacagcttcgcagtcggctcatttggcctggtggcactcatcttcatgtccgcttgttggagttcacccgacaactgcaaccacccgtctatcggcgctcgctcgtccgtctacctgcctctagcaagcgcacccatctggccacccgctccagtcggctcgctcgtctgcccgcttcccgcccgcgtaggacgcctcttgccggcaccgcccgcacagtcagcctctcctcacctgcaccaaccacctctgctcgatcaagtgccatgtgtggcctcatgtgtcactcctctatctatgaactttgttgggttctgacaggtgggaaccaaacaacttgagcgactaggtgaaacaacgagacaaacgaggaacagtggttctcaaaatgtcttgtcaagtgtgtcctctccccgtttgagtgggggtatttatagggtaaccaagaggtagggctctaaaatatatccctaccctcggttacatgccacattcccgaaatatattgtacaacgacgtaaatacagggtgcggcccaaaccctaattacacccattattgtacccacagttggaacaaaagtgttccctggaccaacaggtgggcctgctggaccgatatgtgggcctgctgcgttcaacggaaggcccaccatgcccttgctgcctaaactcagctattcgacccctcatgttgagggccctcgactccaagtcttcgcagaagtcccctcagttcacccttgggctctacttatgccttcagggggccaagggctttgccttcagtggaaccttcgtctgggccttcacggcccacactggagcgagggactgccgcaggtacccaagcccttcgaaggactcggttcttggtaggtgaagtcccttcgagaatttggatcctcgatgatttgctgttgcttangctcggcagcattttacttctgtgatcattgctactggttttttctgttagtgctcatgatcctgctctttttgtgcacacataatctcatgggcagactttctttatgttgatgatacgatacgattataattggtgatgatgcacaatatattgccgttgtgaaggcacgtctgaatgagacgtttcttatgcttgatcttggtcctttgttattttcttggaattgaggtctccaccacacctgagggcttctatctatctcaagaaaagtatgtacatttagggtcttcttgatcatgcttctcttcctgatcactgtaccgttgagactccgatgggagctcaatgttcatattagtgccactgatggtgagcttcttggtgatcctacccattatcgtcacatagtcaggagtcttgttgtcactcgtctcgatatttcttattttgtgcatattcttaatttgtttcagcccccactcagcttcactatagtcacctgcttcatgtcatctattctttccattctttccacatacaagttctttatagctctaggctggctagtgatttctctgatcgccaatctctttctacggattgtgtttttcttggtgtctctcttatttgcttggaagactaaaaagcagacaacagtttctctttctagtgtagaggccgagttgtgtgcttcagctcttgtgactgtataggtaacttggttacgctggttgcttgcagattttatgtttctatacaaactcctcttttgactgacagtacaggtgttattagctgtttccataatgactcctcttttgattgactgtgttattagtatcactcgggatccgatcaagcatgagcttattaagcatataggtgttgatgtctattacacgcatgcacatgttcaagatgatgtgattgatcttcactatgtgccttcaaagcttcagttggcagatttcttcacgagggcgcaaaccagatcttggcataggttttctttccaaactccatgtgttgatccaccttgatttcgatggggtttttagatacctacgcatgtgcccttgttgtattcggtcccatatagtgtccttgttacacacagtctctatcatgtattagttatattgttatatattcgggcatagtgccattaaatgagtgctatccataacacaccacatcggagaggagcaaggatgcacagaaccactgcctgccatgtgcagtcaccatcattgacgtcactcgtcgtgcgcatccaccgtgcttgttgtaggggtgacctcaggtgcatgcacatccgacgcagcacgctgtcgccgccgtgcacagctgttgccgccacaacttcatccgaggagcatgctactattgccgttgtgaagtgtatcgccaagaagcatggatctagatagctctactcattttttctgtattgacccaaaatgctttggaacgtgaccctagccactcttaaacgtctcggattcatcgaaccccgtattcatcaacccaaacatatcatgaattgtgacactcgacctagatgtttgacccgggatcatccccaactccaagatttgtcccatcgaggtgtaccccccttgtaccatacctcttccaaatgtcaaccatcgacccgcgaccccgtcaccccgagaactttgtggctatgatttaaactaggagtacaaaaacgatggctatgatactgaaagtagtgtatgacatccagctgctgctggaatgtagtgatatgacctaacataaaataaccacataccaagagatgttccacattgcgcttgtaaccggtagattttgacgcatcaaatatactggataatctgatcaagttgattgctgcaactgagttaccagaaggttctgcaccatcataatcctctttaacatgcaagagaacagaagggtcttctccaggagtattaaaatagccacctccttgtttatccaaaaataactcatcctaccaatgcaaaaaattatgatataatatgattaattaagagtgaagatggtttcctcaagaaaaatgaagagagagaatgcaacactgaagtgtttaacgaatacagaaatacagttaacttgcctgagtgacttgcagttggacagcccacagaagccactctatctttccaccaaactcatagagatccagcaagccactgattaggaaagcataatcatctaaaaatcctggtgcttttgatggcccattacgatagctatgatgcagcctctttgagcttgcatcataaagtttctcctttataaagttagcggcattttctgcagtttcaagatattcaactggctgcaaaaacaccaagaaacatgagtgtctaacttgtccaaaaaaagtgatcatagatatactttgagtaaataacattgtgttatggagcacaggagcagggtagacccagtgccggagctcatgtgggtctggggaagggataaaccaaggcaagcctcccttgcaaatgcggagatgctgctttgaacacgcggcatggtgactcagtgcacccatggcataaagaaattatttgtagggtgactagagtccaccaagtcagtgcagaccactgacagctttatgtaattaatataatttcatacatattgtgaagacaaagaatgaacggggtatgatgatattcaaatcatagcagccacaactgttatgaccccataggcttctctcatgcattttatggatttcctttccaaaagaacagaacaggtgcaaatatgtggagcatacgaaaaaaaatctgacacattttcctctcataagcatgagatgacagataaaaaatgcaatatatcacaagggataactggtgcaaatatgatggacaacatcatggtacctcctttgacatgcaaggtgcaggcatcagagtcactaacaacttaacagttaagaaattattgtcatggattcccattaatcagtttgggcaagggaaactatcataacacatgttaagagaaatacaattgaagcaagcaaaatgaatactcctggaagtcatgctatattgattagatcatcatgcagtacagctgcaaatgaaagatgggatagaggaagaatcaaagccttactttgcatccagttacagggaaattgaatatagttccagatggtcctgacttcagaatttgcgaagcccttgcgaaagcagatattgctagcccattccaggaaacaataacctgaaaactattcgtagttagtagattgtagcctggttaaaatgagatgtgatgatatgtaaaagagaaccttatcatccaaatgaggtcttggcctttttgancggacatcaaacaattctgccggc

SEQ ID NO: 3736 - DNA, 2834 bp, Zea mays
gcacgagaccattacctagaacatcctaatcgaaaaatcgttctagtggtaccaccacagcctcctgtgccctcctgccgtccgtgacgtgacgcagccgagccgcgcgcgctctccgggccggacgcctccgctcgaatcgatggacgccgaggccggcgtcgctggcgccgaccagcttccgcggaggcagtactacctgaatctactgcttttagcttaccagagctttggtgttgtttacggggacctgagcacatcgcctctctacgtgtataaaagtacgttctctggaaagctcagacactaccaagacgaggagacagtgttcggcgtactttcgctcatcttttggaccttcactctgattcctttgcttaagtatgtcaccatcgtcttgagtgctgatgataacggcgaaggtggaccattcgctctctattcgctcctttgcaggcatgcaaaactcagcttgctgccaaatcaacaagcagctgatgaggagctatcttcatactacagaaatgggttcgcgcctcgcaatggatcttcaccttggttaagaaggtttctggagaagcacaaaaaaatgaggactctgtttcttctcatagttctctgtggcgctagcatggtgattggtgatggtgtccttaccccagcaatctcagtactctcgtctatgtctggattacatgttcgagctactggtctacatcatagttctgtagttctcctttcatgcattgtgttggttggtctatttgcattgcaacaccgaggtactcagaaggttgcattcatgtttgcaccaattgtcatcatctggctgctttccattggaggaatcggtttatacaacattcttcattggaacccaaatgtatatcaagctctctctccatattatatggttaagttctttagaaagacaggtaaagatggatggattgctttaggagggatccttctttctatgacaggcagtgaggcaatgtttgctgaccttggtcactttacgagtgcatctgtcagggtggcttttattaccgtcatatacccatgccttatgctacaatatatgggtcatgctgcatttctgtcgaagaacacatttcacatgccgacaggtttttatgatactatcccagaaccagtgttttggcctgtctttgtggtggccacacttgctgctgttgttggtagccaagctgttatttcagcaacattctccattgtgaaacaatgccatgctttgggatgtttcccgcgagtgaaggttgtccacacatcgaggtggatctatgggcagatatatattccagaaataaattggattcttatggttctttgcgtcgctgtcactattgcatttcgtgatactactcttattggcaatgcctacggtattgcatgcatgactgttatgcttgttactacattcttgatggcattaatagtcatctttgtttggcaaaggaacataatattttccctagttttcctggttttctttggatccattgaagctgtatatctttcgtcatctctcatgaaggttcctcagggaggatgggtgcctcttgtgcttgcattcatattcatgtcagtcatgtacatctggcactatgggtcaaggaggaagtaccagtttgacctacagaacaaagtatcaatgagatccatcctatctctcggtccaagccttggcatagttcgggttcctggtgttggattgatttacacagagctggtcactggtgtaccctccatcttctcccattttgtcacgaatctccctgccttccatgaagttctagtctttctctgtgtgaagtcagtgccagtgccatatgtttcaccagatgagcgataccttgtgggtaggattggacctaaagaatatcggatgtaccgttgcattgttagatatggttacaaagatgtgcagagagatgatgacaattttgagaacatgttagttatgagcatcgcaaagtttattatgatggaagcagaagatgcttcttcagcaagttatgatatcgctaacgaaggaaggatggcggtcataacaaccactgatgcctctggcagcccattggccatgagggatttcgacggcctagctgactccatgtctacgaggagcagtaaatcagaaagccttcgaagtttgcaatcctcctacgagcaagaatccccgagtgtaaaccggcgccgccgtgtccgctttgaggtcccagaggaggatggcatgggtcagcaagtgaaagaagaactcacggcactagttgaagcgaaacatgctgggatcgcatacatcatggggcattcttatatcaaagccaggaggaactcaaatttcctgaagaagtttgctattgatgttggttactctttcctccggaagaactgcagaggcccatcagtcacgctgcacattccacacattagtctgatagaagtcggcatgatctactatgtttagcttaaggcccattgccgaagctcacatgtggatacccggtcggggcaatgcttgtgctgtctgcggattgtggtgtggaaggagttcaggcttgttcgttctgggccaagtttcagcttgtagagaagaaggcagacttctttgttaatattatttttagcctaaataaaccagcacaatgttagacggtgatgtttctcatttggcatatttgcatgcatgctctgtaattttttctgcgagctatgtgatggaaatatatgcatcatctttataaactggtcagggttctactccttccgtttcaaaataatagttcctttacctcttgatttttatgtct

SEQ ID NO: 3737 - DNA, 1411 bp, Zea mays
gccgcccgcgaacctacctgcaggctgtggcctccctcaatgtctccatcgagctagggttttgaggcggcggcggcggcttgtcccatttaaagctggactgctccatcagactcgcctccctcggccgctatctgtttgttgtgttagggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtgggttcgaccagttcatgaatctggtggtggacaacactgtggaggtcaatggaaatgacaaaacagatattggaatggtggttatcaggggaaacagtgttgtaatgatcgaggcactggagccagttgcgaggtcacagtgaatcattgttctttagcactagcagcgtgaaaactgatgtaaaagatatcagtggaccctgttgtatttgactaatgcttttgcacagcaacataacttcggaggtggaatgtctatccctttttctatgggatgcttgtagctatacaatcatcgagctcttaaattacatgatctaacgcatgctcatcgagctcttaaattacataaactaaaacatgctcctggtccaaacagcggtgcctacatttactgtcttacggtgctaacactggcaatgagtcatgtcttttaatgttgtacagtgcccgttgccttgtgacttgtgaggcacatttgatttgtgggatcctgcattacggatcgccccagggtggatttgcctcggggagtctggacctgaaatgaaatcgtagttctggtcatttgttttttaaaagaatttgtttggttttttgttaaaaaaacttcggttttatagacatcaagaccagtagtttataaaaaaactgatgagtgttgttttagttttttacaatggtttttagtaaaaaaaatgaacaccgaatctctactgtatttcagtggtagtttcttcgtgcgtctagcaaaaataagcatctgcagggatttaaactcatgacctccccctcctaagacatgactgtttatgttgtaagaaggataaataatctaaatgtcgtgttatccaaagaattgatattgtaaaaatatatactaatataattggaaaatcactactagatttaagtggcagtttcatcattcgaacatgttcatttgtgttgtagaacacagacaactgactagtataaaggttacattgcagtgcatacacatttatatgatagattacacataaactaaaatgtaaacattatatacccataagggattattgatacatcatatatcacata

SEQ ID NO: 3738 - DNA, 895 bp, Zea mays
tcgaggccgcctcgtggccggccgggccccgatcgcgctctagggttttgacgcgccggcggcttgtgttccctttaaagcttggctgctcgtctgctcctgctgctgtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagcacccctgtttcaatggtgacttcattactgccttggcgctaacactggcaatgcatcatttcgtctattgttctacattgccggtgccttgtgaggcacatgtgacctgtgattcatcatcaatactctgtttggatattgatactggagaacatggaattcaattagattcaaaaccaaattagccatgatattaaaatgagatgtaattctaattctattgtttggatgtcactgtattagaatttggaattgagtggtctaatttcatgcaatatagagtggtgatctgcgaagggaaatgagtttctagtggcagtccattcct

SEQ ID NO: 3739 - DNA, 2042 bp, Zea mays
  misc_feature (23)..(23): n is a, c, g, or t
ctcgaggctttgccggcttttanccccgctcgatcgatcggcacccgcgcatcgcgtcggcattctctccagccgctactccctccctgcctctccacgatctcgcgaaccctgctagatccttgactcgccatgtccaacccctggggcggcatcgttggtgccggcgcgtgggcgctggacgccgagcgcgctgaggaggaggagcgcgacgcagccgcggctcccgtccccgcccccgcccccgccgcgggcttccccagcctccgcgaggccgcagcgggcgccgccggcaagtccaagaagaagaacaaaggaacaacgctctcgctctcggagttcgccgggttcggcccggggcggcggcaagcgccggcgccgccggagcccaggggcctcaccacggcggagatgatgatgctgcccacgggccccagggagcggtccgcggacgagctcgatcggccccgtggcctgggcggcggcttccgctcctacggctccggagaccgtggcggcgggtttgacgacgacggccgccgcgggccgcccggcaggggctcggatctcgacatgccctcccgcgccgacgaggaccgcgactggtccatgagcaagaagtcgttcacgccctctcccgccgactccggctcgcggagccggtacggtggcctcgggagtggcgcgcccgcgtccgtcggccgcgctgacgacgatggcgactggtcgcgcgggaagaagccgctgccatcaggcccgtcgcgctacccgagcctcggctccgcgggcggcggcttccgcgactcgcccgtctcgaccgactcctccgaccgctggtcccgtgccgcgccgagcaatgatgagcgtgagaggcctcgcatcgtgcttgatccgcccaaacgtgacgcctcggccacccctacccctcctgctgaggcgggacgcagccggccgagcccatttggagccgcgaggccacgggaggacgtgctggccgataaagggatggactggaagaagatggaaactgagattgatcagaagaggactagccgacccactagctcgcagtcgagtaggacagagagtgctcaaccatcacgtcctgggagccccgggtcacagatatcagccaccggtagtgaagccgcacccacggcgcggccgaaggttaatccttttggtgaagcaaagccaagggaggtgattctgcaagagaaagggaaggactggaggaacattgaccaagagctcgagcatcgccagattgatagaccaaagacaaatgaagagaacgtgttgaaagaagagattaacctacttaaggtggaactagacgaaagtcaaggcaagataagtgatgaggatgcaaaagccatgtctgagaaaataactcaaatggaagagcagctggaacttcttagaactgcgatggatgacaagatcagattttcgcaaagacctggttctggagcgggcagggttatagcatcgccgcctactaattttgtagatgaaccccaaataaaagagtccaaaaggccacgtgcacacagcggcacagagcaatatacaaaaccaactgaagaaagatgggggtttcaggggagcagagatagaggctcttttggtggcaacagaatttcagagaggtcgtccgcaggacagaggtggtgagactataggggtcagatttttttttaccatcgtttcttcgaaactgcagaagaataagttatgttcctcttgctacttgactcccattttgtttggcttggaagaatggagagcatcgtgggcaatacagattacattgcacgaacctgttaattaccacctttatatggtgtttttcttccatttcctctttttttgtgtgtgcgtattttttcttttgccctcctcttccatgtcaaaactggtgctttgagcctttcataggctagctattgctattgattcctgcataactgtgctttaacaaaaaaaaaaaaaaaaaaaaaaaaaaaaaaataaaaaaaaaaagaaaaaaaaaaaaaaaa

SEQ ID NO: 3740 - DNA, 1110 bp, Zea mays
gccggccgggccgggatgccgtcgtctccaaaaggggctctcaaagggccttgcatctccagcgtcggcgtccacgacgccggggaccagcgaccatgcggccactttcctgttgcgctctcgtccgtctccacaatttgtgcagaccaaagacaaagtaagagtgtgctgaaagaagaaattgacctacttaaggtggaaccaaacgaaagcgaagtggatctagaaagaagcatttaacgactggccgcaccagaccaaaccgtagcagaactcaactgaaggcaactgcgggcccgcggccgcaatgagtcaacagatgaagtgtttgagaagacaaattattattctttggggagagtgcataaatcttcgataagcgaaggaatgcagtctatcagatgatgaaaagcagaaggaatcccttctcagagagtgaaatccaaaactggtgctttcaaatatttcaagatctgatttacatgcattcgcatggatatttccaatgcgaccttaatcctgatatgtggttttgcattttttttacaaacaatattgcaatggttgatctatgattcctgtttgttgtgaaacaagtttctagccccaaccattttcacatgacattttagataagaaaatagttctccatgtagctcaatcttcatgtttaaaatatcatgtgtatttgactggagggactatcagttataagcccaagaatagctgccttgcaattttcctaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaagggccccaagggccggggccccctaaaaaaaagggaaccccccgggggggggaaattcaatataaggtttttcaaacccgccacccccaggggggggccgggaccccatttcccccaaaagggggccgattaacggcgccccctgggccgggttttaaaaacggggggaggggaaaaccccgggggtaccccaattaaaccccttggaagaaatcccccttttcccaggtggggg

SEQ ID NO: 3741 - DNA, 3886 bp, Zea mays
  misc_feature (3304)..(3304): n is a, c, g, or t
  misc_feature (3532)..(3532): n is a, c, g, or t
tgtatagtttttaaactctgaaaatttgtatataaaattcaaatagttaaattaaagtgtatatgaggagttaaataaggagaatggttggagatgaggtgaattaaaaagaaaggaaatatatttaaataggtacaaatagggatttaaatacgaataaaaagtataaatatggagatttggaagaacacatgagtgagatcctattttaaaatatagtactataggatctcaacaccaaaaacctgctcgaacagaggttatatttcaaaaaaaaaaaatcgtcaaacaattataagacccgatgtctcaaatcgtaaacagtaaatataggagacatatgctggagccctatcttttttttaaactatttctaacattttattttttaaataatatggtttattttttttaataacatgatataagactgaactgttggagatctaaatatttttatggccttaaatattttaaatcagattctatttcaacttttaaaatttaaatatagtactttttattggagatgctttacaagttgcattaaagttggccagtaggagttggacactgaaagtctgaagccagcggaaaagggaaggcggcctcgtcgtgtcatccggctgttcatctttctagaagaccatagaagaattcacatattctaatcagcaaaactaacatgatgaatcaaaaagtcattcgtgtctcttcacctggcgctgcatgcatgctgccacgtatccgccatggctgccacctccgttcttgtattgtatcctcgccgtacgtccgggaaactccgcctagccaccaacaccacaataatatcacctgcactccatttcagtgtcagtgaagttagccatcagtacgcggacacgctccatcagcgtcaggccacagccaccatggtgaagctggcgacggcgcgcgagtgccgcgcatacagcctcggcgccggcgcggggtccggcacggggttgcgcaaccggtgggagtacatcaacgccggggtgtacatcttcgcggcggtcctcctggtcggcgggttcctggcgcagctcctgccgtggggcgggcccagcagcccggggctcgtggtcgccgcgatcgggctcgccggcttgctggccgtcaacacgcacgacctcctcgcgcacgccgccggcgtcgattaccgcctcgggatggtggtcgggcttgacgcgcagatggggctcgtcgagctcggcgtccccgccgtgcagatcgttggcaccgcgctcatgctcgtcgctgtcgtcttctttgtgattcaggtcaggtgtcttcttcttccctggattgggactagggagtgctaagcgcagcctgtacaaaatccgttcaaattacgtgaagctgatcgtttgtttggttgcttattttgcatcatatacatggcttaaaatgaaattcaagttctgtttatttactttcctgaagcagagcatttctgaacctaatgctcttggtctgtgaatagaattcgcgaatgatattctcatgttctagataggcttactaaatgcattttgaacttattgatgtagaactggatgaatggctgcaaggaaggaatttgtttttactgtgatatgcgagtttcgcacatagaattcgtgctaccggctacccgatcatgctttgaccacgaccacgagtagcttgagttcactcagctgcaatttgattatacgatgcagatggagagaggctaccggcacagcctagccatgcacggcctgaacctgctcatagccgggccggcactgtggtgcctggggtctgtgcaaaacatctgccagttctacgagcgtgcgagcgggcacgtccagctcctgcagaagagcgtgcagatcccgctgctgctggggagcaccctcttcctcatcgccggcatcgtcaaccggcacgaccgccgcagccgccactccggcttcgtgctactggtaatttcaggatttcatttgtcaattttggtaatctaagagtaattgacagtagagccagctgacgtatttcttctctgggtcgtcactggtgtgtgcaggggaggagctgggcgtggttctgcctgttcgggagcctcctcttccttgccggcggcctgctgaacctgctcaaggtgttcaagacgcagcgcatgggcccccgcggcctggagaagctgcgcggcggctcgcaggagcggctggccttggagcgggagggcaaggtgccgctcatcctggagcacggacacggcggccggaggggccctgcgataccgccgccgccgcccgggtcttacaaggacgcgctcgtcagtagcgccagctaggaacagaaatggccttgtagatgctcagcattttacgttgaactgcatcctctgtttttaatcatcaatcacgttcacgcctgcttgaataagcttttactcgccgtttgctacacctccacttgattagtcttattaaaaacgaattataatttattttgttataatttgttttatcacttagcatgacttgaaattgtcatatatataggaacggatggagtagattgctttggatccacttgacaaagggcaagtataagataataagagactttcaagaggttaaataaaaagagaatacaagagacaagagtatttttacatgactttttatactccgtagtgaagggcaagtataagataataagagaagtcttaaagaggttaaatgaaaaaaatataaaaaaagacaagggataataaaagaagtcttaaagaggttaaatgaaaagagttttaagagtccatttttacataactttttatacatactccgttctaaaatagtagtttagctcttaatttttatgtctaaataatagtcgttttagctctaaggttttatatccattgtatttctaaaatagtaatagttttagctcttaatttttatgtatattgtatgaacctttcaattaactaaaacgaattttaatttgacatagagggagtactattttttaattatgtttattatgggactgattttaaggacattatatcacatcattaagcttgttaagctatcttttgtacttaaaaactgatttagagacttaaaatttgatctagagattaaaaatccgattcaaagacttatttaccttttgtacttgaaaaatcaatctagagactaaaaaatctatccatctcttgtacttaaaaaatcaatcaagagactaaaaaatctatccataggtttagtgttgtacatgtcttaatagaatatagagnagcttcacaagtgaagttaatagaatgaatacatatcgtgcaatatacaacactattttgcgctgcagactgaactgttacaaagtgaaatttgaaatagtagatagactagaaaatgttgttggagatagtgtcgggtacctaggaacatggtactccaaagtagacccacaaccttcttttggcttatttgccgatgagctctctgccgagcaacccaacgaggcngagcggccgaccaagtcctcaccgagctattcaatgaggtggagcgtacgaccaagtccccgtcgagcaacttagcgaggaagagcatatgaccaaatctctgccgagcaaccctactaggcgtaacgtacgaccaattcactgtcaagcaaccctactaggcgaagcggccgaccaagtcctcaccgagccacttagcgaggcgaacgggccgatccagtactgctaacccacgtcagaacgataagacgcgtcaccaccaaaacacgtccagaccaaaagtgagacataccgaaggggcgccaaagagtcgctatcaacataacggtacgccaacatgtacgatccctagtg

SEQ ID NO: 3742 - DNA, 1249 bp, Zea mays
cattgggtaccccggagtgaagttagcctcagtacgcggacacgctccatcagcgtcaggccacagccaccatggtgaagctggcgacggcgcgcgagtgccgcgcatacagcctcggcgccggcgcggggtccggcacggggttgcgcaaccggtgggagtacatcaacgccggggtgtacatcttcgcggcggtcctcctggtcggcgggttcctggcgcagctcctgccgtggggcgggcccagcagcccggggctcgtggtcgccgcgatcgggctcgccggcttgctggccgtcaacacgcacgacctcctcgcgcacgccgccggcgtcgattaccgcctcgggatggtggtcgggcttgacgcgcagatggggctcgtcgagctcggcgtccccgccgtgcagatcgttggcaccgcgctcatgctcgtcgctgtcgtcttctttgtgattcagatggagagaggctaccggcacagcctagccatgcacggcctgaacctgctcatagccgggccggcactgtggtgcctggggtctgtgcaaaacatctgccagttctacgagcgtgcgagcgggcacgtccagctcctgcagaagagcgtgcagatcccgctgctgctggggagcaccctcttcctcatcgccggcatcgtgaaccggcacgaccgccgcagccgccactccggcttcgtggtactggggaggaactgggcgtggttctgcctgttcgggagcctcctcttccttgccggcggcctgctgaacctgctcaaggtgttcaagacgcaacagatgggcggccggggcctggagaagctgcgcggcggctcgcaggagcggctggccttggagcgggagggcaaggtgccgctcatcctggagcacggacacggcggccggaggggccctgcgataccgccgccgccgcccgggtcttacaaggacgcgctcgtcagtagcgccagctaggaacagaaatggccttgtagatgctcagcattttacgttgaactgcatcctctgtttttaatcatcaatcacgttcacgcctgcttgaataagcttttactagccgtttgctacacctccacttgattagcatagtaatacatccgttcttaaatatatggtaaatatatgtcttaaatatatggtaaatatatggtaccttgacttttttttaaaaaaaaaacttagaccactcgtcttattaaaaaataacgggttataattattttgtt

SEQ ID NO: 3743 - DNA, 1433 bp, Zea mays
attgggtacctcgaggccggccaggtaattaatgataggtgtcaagtggaagtgcagtgatgtatgcagctggggcatcctcgcggcccggtagacttgaacactctctaccagtctaccctaaccagcccgacagccgccgccgtttctccatcttcctcgcagcgccggcactacatcttccgctcccactccgactcgcgctcaacacgcaggcgacggcggcagcagtcccagactcgggctctcagggacggcggggcagtcccagactcggcgtcgtcgtcagcggctacccttcccgcctctcgccaatcgcctcgcgccctcgactccggtcctccgcacaccggcctgcgaccctgccaatagtgtataacttggagatatggatttgcaagagaagacgaccccaactcataaaggaaaaggaaagaaaaaagaaagcgcaaagaaaaaagaaagagcaaggaagagaacgtcatctgttttggattccactaatgacacagtcatcagcgaggaaatgccagagtataatcttgatgaacctactatggaggaaaaactggcaaccctgaatttaatcaatagagagaatgaaatacatggtagtgagaagcaatcgctctctgtggcaccaccaagtgcagattcagtccatatcttgctgaagcaagctcttcgtgctgatgatagtgtagcactgttaacttgcttgtataatagagatgagaaggttattacgaagtctatatcactcctaacaccagcagatgttgtgaagcttctcaagttctttgtcttgcaaatacaatctaggggtgcagtgttggtttgtttactcccgtggctgcaaactttattgaatcgacacatgagcagcatagtgtctcaggagtcttctctgtcattgctcaactcgctctaccagcttattgatgcaagaacgtcaacatttaagtcagcattgcaactctctaccactctagattaccttttcagcgagattgctgatgatgaagctgatgaggaggtaccaccaccgataatctatgaagataaggacactgatgatgacgagtccgaagttgatgctatggaaaccgacagagaagaggctgaagagctaggtgctgttactgatgcctctgaaaattcagatggaagtgagatcatgagcgactgattgccttttactctcccaactgctgaagtccaaatatcaacatcaattattcacgtaagatggaattcacgataattgctcaagatagttgtgcttgtactttgtggatcttaattgagtgaatgtttcaaatagcttttggatgacatattgacatttgagctgagaaaagggtagttaatgcaattgattgagtaaagcaaccattacccatcttatagtttgtactatctgatagggtaat

SEQ ID NO: 3744 - DNA, 3761 bp, Zea mays
  misc_feature (1435)..(1435): n is a, c, g, or t
acacccgtttccgggaggagagagagggcgggggcgaaggggatggcaaagcgccggcgccacgcgttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgtcgagaggccaatcagagatgcgatggagcctggagtttatccagatctcgaggctgctgtttctgctgctaggccgggtgacaccattcttattgcggctggtggttcccatgttgcatgtaacatccaaataaagaagcctatttgcatagtaagttttgcctaccatgtccctgcgtcctggagatgtcaagtcgtcaacggagatttgatctgacaaatgcttcctgcacttggcgccaacatttgttttttttgtggctgcaactgtgaacccatttaacttacatcagattggcgggggcgatcttcctgatgacactgtattgacctgctcacgtggtttcgacaagtaagctctttccctcatgtggccgtttttcttgtcttctgctgctgctgcttcctgatcatttcatagttgtttatggtggtctatcttttacaagattgattactgtcatgtttatcaacttattgtaaatttgttaactttagtacaccttaaaaatgcaatgattatgaggcttcctgtagatttatctcagcagcatgttggctaggtttatttatgtcaagtgacacaatgatcagtataagtgtataacataactgaatctatacaatcttgatttatgcggtgcagtagtgaaaagttaagtttctcataatttattgttgtatgctttcctttttgccttggtaatggatgatgtcacaagggatatacatggggatatatcttggtatatgtttttttttgcggaggatgcagtgctagactgctagttgatgaaagccgtgcaagagtaaataggaaattagagtttgtggtgcgagactctaaaatttaaatgttttagactcagtagaactaaaactgaatatataagttgtgacttcggcactactacaaaggaggaaggatgttagtttggaggtcagtggtgcataggaaggatatttttttggtatttaggattaatgctatagagagacagtgatattgatgaagattttagccctagaaccaaagcagggtgggtgaagtggcgccaaacatctggctcctatgtgacaagaggtaccacaaaagccaaaaatcaagttttataggacgacgattatacctattttgtatgatgcataatgttggtctacaaaaacacaacgtgttcaacagataagtgttgcgaaaatgngtatgttgcattggatttgtggtcatacgagaagggatcgagtctggaacaatgatatacatgatagactagggataacatcaattgaagaaaagcttgtccaacaccggttgaaatggtttggacaggttcaacgaagacttccagagacaccagtgcctagtgggatcctaaggcacaatagtaatggaaagagaggcatgtgcaggatgaagttgacatgggaagataccgtaaaaagaagacttaagggctagtttggaaacttaaatctccttcgggattctcggggattgaagggaaaattaagctaattttctcttcaatccccgggaataagtttctaaactagccctaaaaggtggaatataccgaaagatttggcattcaataggagtgcattgaaaaaaactattcacgtgcctgaaccttgatttgtggcttatgttgggtttcaactctagccggccccatcttgtttgagactaaaaggctttgttttttttttgttatgcttgcgttaaaccttgtgtggtagcttttatttctgggagcctgtccttatggaaacatcgtaatagatgcatgtttcatggtgcatctccaagtttagctagagtttcattactttttttagggcaactagagcttttatattactcgctagtgaggagttgtaccctgtgggaaatagctggagcaagaggtattcttacctcttcgctgtacagccagtagacaactgaggcctactgctggtcgtggctgttctctctctctctctcttgttacaggcacatatgtgtatctagaatattgcatgtgtgctctcctctttcttctttttaatataatgatgcacagctgtcctacgggtttgaggagaaaaaaacttttattcctgggtatgcccccttttctgttttatgcttgacttaaggttattaattcaactatattctattgttagtagtttatgtctgtctgatagttgagaggatacaatttattgatctattgtcttttttcccatggaattgagttggtaaatggtaatgtaagttctgtctacttcagaaagcaatgaacttgcacactggtacatggttctgtttatcttgctgtttctgtcaatgtctcagtcttacctaggtttccattgattggcctatcaaacagcgcactggagtttctatcaacatgcaagattgcaaatctgactattagagcagaactcggatgctgcttgctgcatcgaggcggtagattgaccatccaggagtgtctgctgcagtgcgagcaaaaccctttggaccacctgtccttcccaataatcagcacagcgatagagtacgatccattctcatccctcaaggagcaagggcacggagtaacggtcgtccgcaccaggatcgaaggaggcgcgagggccgtcaggacgaacggcacactcgcgctgcgccatgtgcgggccatctattcccgcagctctgttttcttctggttcgaagtaggagagaaagtagaagcgcctgtacactagcaaaaaaacccgtgttcgttcttgtatgtcagtgttggtatcaccctagcgtgcgtttggtgaactcggacggctgcctcgtgtctgttgtgatctctttataattataataccccactgatgtttgaaccaacaaacaatggacatgttgcttttgtttttccttaaattgagccatggagtctgtagagtacagattcacaggtggcgatggcattgatgaaactttccccagtttttggatcgtccgctcgggtcattgattggctgcttgtggtgttttaatcacgccttgggcgttggatggcgttatctgaacggaaggacaggatggggaccaatctggatttttaccctgcgaggttgctatttcatgctgcagctcttgttaacttgttgctctgctgtgttgctggctgttgaagcaagaacaaagaactcaggtagcaatggtgtaccgtgtactgtagttgaattcctgtccatcttcatctccgtgtgtatcgtacacgtcaatacagtactgccacatgaacaagttggggaatccgttgttgatccttgggacggatccttttcatttccccccctgccagaaacaatggcagtggctattcaagtccatgtcgattactgtaataaatgcataattactcaatcctctgcccgttgcttaaatctatgcagtaacttgtccttggcacttgtttaccgcttgctcaggtgaggccaacgaagcgaagcagggaaaaagccagcgtgagaacgacgagtgagtgagtg

SEQ ID NO: 3745 - DNA, 1132 bp, Zea mays
acgtgaacgccgcagcagctacctcgcctctgacgggcagggcccaccagaagtgggggagggagcacgagaccattacctagaacaccctcagcgagcaaccacacccgtttccgggaggagagagagggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgttgagaggccaatcagagatgcgatggagcctggagtttatcctgatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggcttcgacaacgcactggagtttctatcaacatgcaagattgcaaatctgactattagagcagaactcggatgctgcttgctgcatcgaggcggtagattgaccatccaggagtgtctgctgcagtgcgagcaaaaccctttggaccacctgtccttcccaataatcagcacagcgatagagtacgatccattctcatccctcaaggagcaagggcacggagtaacggtcgtccgcaccaggatcgaaggaggcgcgagggccgtcaggacgaacggcacactcgcgctgcgccatgtgcgggccatctattcccgcagctctgttttcttctggttcgaagtaggagagaaagtagaagcgcctgtacactagcaaaaaaacccgtgttcgttcttgtatgtcagtgttggtatcaccctagcgtgcgtttggtgaactcggacggctgcctcgtgtctgttgtgatctctttataattataataccccactgatgtttgaaccaacaaacaatggacatgttgcttttgtttttccaaaaaaaaaaaaaaaaagtctgtagagtacagattcacaggtggcgaaggcattgatg

SEQ ID NO: 3746 - DNA, 6888 bp, Zea mays
  misc_feature (3555)..(3555): n is a, c, g, or t
  misc_feature (3762)..(3762): n is a, c, g, or t
tgcatgcctgcagaatatgacaagagaagagccatttcacaacctgaagagcctcaagcttctgcacaatctcaaagcattggctccagatctgaagggaggcgcagccgatctggaaagaaagggaaaaagagacctgctcgccgtagatcacaacagaaaatggatgaattgtcaactgtagaaggtggaagtaactattcttcacgcagagacgatgataaccaagtgttaagttctagttcacgatttgcatcgcctgaggactcaaaaaataaacagaagtcttctgttgagtctccaatggagataatttctgaaaataagttgcctgtagggcttggtagaaggcctcctgaaaagctaaaagaaggttttgttattgctctaaagacaagagacaattcaggtttttatgtttcaagagagagggtcactggcggtggatggtatcttgatgtgataccaaatgccacaaagagggatcctgctgctcagtttttagtcactttcagaaacaaggtggtgttattgtttgtttcctttctttttctatcctttgctgttacttgaacatcccattaatttggatatgtgcacatacatatactgataatatgttatatgaccgtcaggacactatgggattgcgatcttttgttgctggaggcaaactattacaggtatcgccttttaaattactgttattagaaagtgagctcaatattcctatgtttccagagttagtgaagtagggaggatactagttcagcagctatgctctgtttgtgtttggtagtaactgatgaatggtgtgggcgggcgtacgcgtctgtttaaccctaatcctattggataccatgtagaatattgtaagtgcttgatatattgcatagaggagtggggtacatacatatagagacttaaccctaaccctaatgggccagcagctcaatagtggtgccggcccacacacagtctaacaatacctttattccatgttctcagttatctaattgactgcaggatttgttcaaaaggtgtagtgttgctatctgctaaactgctctccttgtttcatcctttttgttgtttttgatgatgtacatgtgcactttatcatacttgatttgtagcttcaagcttaaaaggttgagaatcgtagctaccatgtttggtttgtactaaattactaattacccatgcatataaccccatattcagtgtattaggaattgaaaagatatctccagagttcccatatcttatctgcatttagtgtacactacagtctacaaggcgtctttgttcaattggcaaccaaaataaatggggggtgattcatgagacagacaaatctaatgtggaacataaagcagattaattagtccattacgggcatgtagccatctcatgtttgtctaaataaccttccaagacagtttgtcaaatgccaaataaaagagaatgggaagtaaatgtgttcatcttctaaagtgaaatatttgatcgccgttgatgtttctaaatgttggactgtcttttattgcattgtcaggctaataataagatggagttcgtcttcgcaagtcattcttttgatgtttgtgagagctggatgctggaagggtgcctttcagaatactgcaaacttgttaatcgcaaaaatgctatggtacgttcattcatccttgccattctaagcaggataaacttaacatacacaaatatccccagtagtcagacgaaacgaactacttgcactgattccatgtgttgtttctgccgttcctcggggttaatgttttctgatggctgtacttggggtctatattgaggtccttggagctccgagtgaagatggtgtcgttcggtggcttgattaatacatcaaggctatgctatatttagagaacattttaaggctatgttgtttctatagaacaatttaggcttatgctgccaactgctatcctcgggttaggtcttctctgagtctctcttgccaagtctcagttttggctgttctactgcatctgcatggacatggactcgcaacgcagtcttttttagtttgtttgtttttttactgtctgtttgttgtaagctgtgtctattgtattttaattatacagtgtgacaagcaatcgctattatagtattctctattctattttttttttttttttactcagctaatttatattttctttttactgaaaggtaggatcgatacccccaacgaatattacatgatcagtagcaaggtgcgcaagattttcagtctcatgtccagccggtcatttcttcttctgctttgccttctgcttctcaatctcttcctgccacagcacgggccagttggcccgggcctcgtcgatgccgagcagcgacccttccttgtcggggtcccagctagccgacagcgtgccgtaggcgatacccagcgccgacgtgccgaaggcgacgaggatggtcagcaatggcacccacgatggcaccaccaccccctggccgcgcttgagcgcgtcgtacacgttgagcagcgcgacgcccgacgccatgggaaggcccaccgtgaacgcgatccggcgcaggatgcggtcgaacacgggctgcggaagctcgtcgtcgtcgtcaacctcgccgttgctgccgccgccgtcttgcttcgccagggacgcttcttccatccccaggagctgctgctgccgttcctgcacgtcctgctgccgccgccgctcctgttgcttctccttccgggtggtcttcttggacggcgtctcgccggagctgaagctgctgtccgtggccgccgagcggatggctggggcgcgccgtcgtttagagagcggtgagaggcggctgtgtgtggagttgagagcccatgggcggtggggtggttttgcggtcggggtagccgcttggtggagtaaggcggccatggctatcctccgcgtggcttcaccgtcggaaacgacgacgagctctcacgcgcggtatggtgttttagtgcgtcgtttcgccccgccccaatgccccttatcgccttgagcgagctgtggcgcgtagtacatgcgttggagataagataatgccttttggtttcgcatgacacagatcggccggccccacaggaaaatatctcgtgcggacccacagcaaatatcccaggtcaggaaacgcagaccctgctgctagtgaaaagggcgatgtgaggatatgagatggggctcaagtccgggccgtgtatggggaggaggcccaagctggacaaattttagtatccaggccagctcaaaaaagaacatgtttttcagtttagggcccgttcgtttgcataggaataaacctagattcgttccagctcatcaaaatttatataaatgagagaaataatttggctaggaattattccggatctccaatcagtggaaaccgaacagggccttatagtgctcggattcaggtactgcgcagcaccatgtgatggttcttccttcacaaagtggcaactggcaacgcatagcgggctgatggaggaggattagctgntggcactgttgttgatgatcaagaataccgtatgcctgttattaaccaaaggtgtcacatacgtacaatcttacaaggcaagagatctcaacttgtaccaaaaacatcttgctattattaacatccctcccagtgtcctgtccctgtcccagactgctgccctgcctcccatccatcacctgctgtgttcgcgttcgtagctatccnactcccgaggagacagatcccgcgcgagcttgcatgcctgcaggcattttcaaagcggtcactgtcagagcgagaacaccgtgaagctcaacctgacattacacacacggggcatcgccgtacgtctctgagaatctggtcgtcttcgagcatatggaccacgtgcgccatcgtgggtctctggctgccgtccgggtccacgcaccggagcgcggccaggaccgcccgcttcagcgccttggacggcggcggctccggcagcctcgggtccagcacctcctccaccctccggtcggcgaccatgcgcttcagccactccaccaggttcacctgaggagagaagagcagcagcgatctagagcatgtttggacacatgcatggagctaacgagcagtagcacatgctttcaaacaccaattagtggtagcccacctcgtcggctggtctagtgtagtccactggagtcctgccggtcatgacctccatcgcgagcactccgaagctgtagacgtcgctcctctcgttcaacatcccggtctcggcgtactccggcgccacgtacctgcaacgcacgcgggagacgatgacgaactcccttgaactgaaacaacagccctctctccctgcgaaaaaaaaacagagaaaaagcgacaccgacccgaacgttcccacgacacgggtggtgacgtaggacctctccgagcagaggagcttggcgagcccgaagtccgacaccttggcgctccactgccggtccaggaggatgttgctggacttgatgtcgcggtgaactatcttgggctccagaccctcgtggaggtaggccagcctgaaacctcacaaactgtacatgagtgtctccgtctgcgtagaaatccaggtttcgacagctgtgacaaactggtactacagaggacacaggagcagagggcaggcagacagtgttgctttcagacgcaactcgccactccccctaatcatgcccattaaaacagcaagaccagtactgccgtgccgtgtcaacaaagtgctaacgttttctggccatcataatttcagtccggaggacattagatggatgggcagggcaggcaggctagtagtgaagaagtacggataaaagcaaaaagaaagcgttgttttaccctctggccgttccaaggagtatgcgcatcctgatgtcccaggtcagtgagctggtttcgctgtcgtcgtggtgcagccacttgtccagattactcttctccatgtactcgtaaacaagcatcctgaagtcacgatgggggggggggggggggggacacaacaactctttggatcaacgtactgccgatgaggtacattcatgtctcgtttagatacaatggtaatggtaatggtaatttgcactgtacctgcaagctccctcgctgcagtagccgagcaaactcaccaggttcttgtgccggacgcgcccgattgtctgaacctccattcgaaaatctttctcggcctgacccctgatcaagtatacagcaactgatgattttttttttgttgtaaaatgatcgattcatacgatcactggcgtggctaattacgcggttcatctgacactgatctgaagagtggatagaacttgaatttgtttgtgtacacaggaggaaacgtgaagcaatttaatccaaatcgaaacgtgccaaccacctcgatctattctcgcgggcatcaagcacatatttggtgataataaacttttcttttttaaaaaaaatgaaacgagaggtttttcagcatcagatccagcaagcaaaaaaactgaaaaatacgatcgcgaccagactagaaaagctttgcgtgtagtttctgctcacgcttcggagttcggatccaaccgaacaaatcctgaagcggagggaagaagccaacctgttgttgtggaggtttttgatggcgacggcggtgccgtcgcggagcacgcccctgaacacgacgccgtacccgccttcgcccaccatgttggcggcggcgagcccgcccgtggcctcctccatctcgcggcgcgtgtaccgccggccccacccgcgccgcgccgcctctggaacctccgcatcgctgccgccctggtcgctcgcggtgctctcgccgctcgtcgaattcgcgaaatgctccgcgaggatcagcggcgccttctgctccgccttgatggcctggatcggcggctgttcgaacgaagcggggcgccagcgagcggcagcctcctcggcgtccttgttggccggcggcgggagcggcggcattgtcgctgcttgatggtgcgcatgcacgcggtgcttgagggacttgctggcgccgggccgatgcgggcacggggccaggcgcggtgcgcggcgccggctgcagccgcgccagaggcagacggcgaggcagaagagggcgagggcggccgccgcagcgcctgcggcgacgaggacccaggcgcggaggccgaggactggggtgcgctgcgagagccaggctctcgggacgccgacgcccagcacggacgccgtggccccctgctgctgtggatggagatggtggcgcggcggcggcggcggcgcaggcgtggaacgggggtggcggccctgggcgcgccgcgcggtgtgcggtggtactggtagcgccctcggagctgtcatggccctgcgcgccgacgctgagccgtggaagctcgtggagttgtaagcttgtagctgtaggttgatcagttgccatttaattagggttttccagttaaaggcactaccgtttagattgattatcgagttgaaagtatagttcaaatttgttgcacaatcgcgacacaagagagcccattggttacttgtgggcgaggcttgtggagtgattttttttcttctagtaaaaaaacaagtagcgtatatacataaatacagcctctattcatatctgcaccccaaccgtattctgaaagaataatatcgtaaaacataaaaataaatttcaaacgaatacgccgtcaagttgagaaccctctcgttttcaaatctaactaatttgtcttgactgagaaatacagttttttttaatttaactcaaaacgtgagtgagaaaggccaatataggtcctctgctacgtgacg

SEQ ID NO: 3747 - DNA, 967 bp, Zea mays
  misc_feature (947)..(947): n is a, c, g, or t
ccagttttcacccacatcagaacacatactattggcatatggtcggcaacatagttcactgttgaggaccattttgatcaatggggagaccagagttcctgtgtacccacgcgtccgggtgtatcgagtttcagacatggagcttgtaagagttcttcctagtgtaggagaggaagtcaatgttgcatgttttcatccttcccctggatcaggtcttgtttatgggactaagcaagggaaggttaggtttcttcggcaccatggtgcatcattcacttgctggggagaacgttcatgagatttagaggcatgtgctacaaatgcagttctggacataataactgaatttgagcatcgcattcttgtgctgctgaatcttatcttgattatggcttcggcaacatcctggaagaggaatttatgatcaactgagatcatctccaagaccgagagggctaacagaaaacatcagatttcagcatccaattactcttgactaacgttccactctttgcaaaaccattgtgccggcaaggagggctactattttaggtccggttaacgtgtgtaagtagccccgtctatgagaaaatggacaaggaatcgcagcctcattcagcatgaattaccaacgatggttgactactactagtacaaggagacctcaagggatacggtcgcctgtacgaatatggatgcgagccatatactgacggccggcctcccaaagatgcgatgtgttccttagttcgatgattttttttttgaaactgtatagaagcctgcgaagaaatgtagtggttggctgagtgaagtgagggaagggataggcattatttcccttgggtgacattgaccctgtttggatcagattctagccgcgagaatctgattttcgtaataaaaaaatcgaaatcgaagtggtttacggtcaaaaaaaaaaaaanggaaaaaaaaaaaaaaaaag

SEQ ID NO: 3748 - DNA, 1829 bp, Zea mays
gcacgagaccattacctagaacatcctaatcaaaaaagcccgcagcccgcagcccgcgactccaggcatccacaaaaaaccatctcccccgcggccccggcaccgcacgctcccgacccggcgagtcccactcccacctaagctgagcggccatggcgcggcacctcgcgccttcgtctggaagcctccaccgtctcctcgcgtcctgccactacccgcccacctcccaggcgccgcctccccgtccgctcctcctcccgaagacccgatcggcggctatgcagctcccgcgacgcgggcggcgcgacgtcgtcgccgctgcagctgcctccgcaccgtccccctcttctccgggtaccgaggtggcagtctggggtaaggtctccgccgtgctcttcgatatggatggcgttctctgcaacagcgaggagccctcgcgacaggccggcgtcgacgtcttcgctgagatgggagtcgaggtcgccgtggatgactttgtccccttcatgggcactggtgaggccaatttccttggaggtgtcgcaagagctaaaggagtgaaagatttcaatcctgaaagtgccaagaagagattttttgagatatatcttgacaagtacgcaaagccaaattctggcatcggattccctggggctctggagctcatcttggagtgcaaaaattctggtcttaaggttgccgttgcatccagtgccgacaggattaaggtggatgccaatctggctgctgctggtttgtccgtgtttctatttgatgctattgtttctgctgatgcgtttgaaaaattgaagcccgctccggatatattcctggcagcatcaaagagcttaggtgtcgacacaaatgagtgcattgtgatagaagacgcgcttgctggtgttcaagctgctaatgctgcagaaatgagatgtatcgctgtgacaactactctagaggaaatagcgttacgacaaggcagtccctcgttcatacgaaagaatattggagacatttcaattaacgacattttgtatggtggttctaatgctcgccacaatgaaggggcaggaagtactgagaatagtagttcggtagggaatgctttgtctgagagtctaaacggagcaactgctgctggacattctgacacaaaaggttttccaatctcaaaaaataaagggctgttgggttctcgacgcgaaatattgagatatggaagtctgggaatagccttgtcctgcctttttgttgcagtcagaaattggaaggcaatgcagttcgcatctcccaaaggcctactgaattttctcatgggtggaaatagttcagtttttgccagaaatgaaggagaatctctgtcatcaagagttcaacaaataaagaagtatctagctgagtttgaatctgggggttctgccacatatgttcctgagtttccaagaaagcttgactggttgaatacagccccacttcagtttggaagagtaatttagaactcatcttaggttattatcgtagctgcaactttgctacagtattaattgcatgccctttgttctggatttaaactagaagatcttgcatgcatctctatcaccctattctatggggcagccagattgtaattaacatgatccaaaagtttcagtcttctagcatctgcaaagaaatttcagttactgttggtgcttttgtggtccggaagctccattcttgatgttaaacttctgatgcatatacatttttcatgaatatatacatgtaaatctactgatgatcccttctaaaacatcatattccctactattcctccaaaaaaaaaaaaaaaa

SEQ ID NO: 3749 - DNA, 1935 bp, Zea mays
gggccccggcctccgcctcgtccacgtcgacgccaaccgcgccgaggaggtcgcggacaccgtcatggcgctcttcctgggcctcctccgccgcacccacctgctgtcccgccacgcctcctcgtcgtccccgactgctgggtggctcggctccgtgcagccgctgtgccggggcatgcgccgatgcagggggctcgtactgggcatcgtcggcgtcaacgccgccgcgcggtgcctggccacccgcagccttgccttccgcatgagcgtcctctacttcgatccgctctacgaggttactgggaaagtaaagcgtccttctattgtatttccttctgctgcaagaagaatggatactctcaatgatctattagcagcaagtgatctagtttcgcttcattgtgcattgacaaatgatacaacacatatacttaatgctgagcgccttcagcacataaaacctggagcgttcatagtcaacactggtagctgtcagctcatagatgactgtgcactcaaacaactcttgattgatggcactatcgctgggtgtgcattagatggcgctgaaggcccccagtggacggaagcatgggtgcgtgagatgccaaatgtattaattcttcctcgaagtgcagactacagtgaagaagtgtggatggagatcagagagaaagcaatcgcaatattgcagtcctttctctatgatggtgttgttccaaacaatgttatttctgatgaagatgaagagataagcgaaatgggatgtgacgatgatcaacttgataaacaaggaaaagaacatcctttacagatttgtgatggtgaacagcaaacagaagaaagccaattgactgcagaatatgacaagagaagagccatttcacaacctgaagagcctcaagcttctgcacaatctcaaagcattggctccagatctgaagggaggcgcagccgatctggaaagaaagggaaaaagagacctgctcgccgtagatcacaacagaaaatggatgaattgtcaactgtagaaggtggaagtaactattcttcacgcagagacgatgataaccaagtgttaagttctagttcacgatttgcatcgcctgaggactcaaaaaataaacagaagtcttctgttgagtctccaatggagataatttctgaaaataagttgcctgtagggcttggtagaaggcctcctgaaaagctaaaagaaggttttgttattgctctaaagacaagagacaattcaggtttttatgtttcaagagagagggtcactggcggtggatggtatcttgatgtgataccaaatgccacaaagagggatcctgctgctcagtttttagtcactttcagaaacaaggacactatgggattgcgatcttttgttgctggaggcaaactattacaggctaataataagatggagttcgtcttcgcaagtcattcttttgatgtttgtgagagctggatgctggaagggtgcctttcagaatactgcaaacttgttaatcgcaaaaatgctatggctgtacttggggtctatattgaggtccttggagctccgagtgaagatggtgtcgttcggtggcttgattaataatacatcaaggctatgctatatttagagaacactttaaggctatgttgtttctatagaacaatttaggcttatgctgccaaagccagcccaactgctatcctcgggttaggtcttctctgagtctgtcttgccaagtctcagttttggctgttctactgcatctgcatggacatggacccgcaacgcagtctttttttgtttgtttgtttttttcactgtatgtttgttgtaagctgtgtctattgtatttgtgtattatacagtgtgacaagcaatcactattctagtattctctattcaaaattcaaaaaaaaacaccccccccc

SEQ ID NO: 3750 - DNA, 2031 bp, Zea mays
cctaaccgatcctagtctgataccatgtagaagagtgaactggatatattgataggagatggggtacatatatagggactcaaccctaaccttaatggaccggcagcccaacagtggtgccggcccacacactctcacacacacagtctaacacttatgccttgggccaagaacgccgacgacctaaacactagctcgttgagtttggaggcccctgccaaacctcgcgagcaaaggcacacccaaccaacagatggtttatagtttccatctcctggtcactgagaacaagcctccggatgaggcaggttccttttggccagacgatcagcagtccacacacgacaatggaaaactaaccaaatgaagaatttgcagcaagcaggagcccaggttttccaaaattttctccatggccaaacctgatggatccaaggaagaaagcttcataggcagatttactgctataggaaccatgttgcgttaattcccatttgtactgatcagccacgttttggcgtagaacgacaccatccaccatctcccaaatctgcagatactcaaccagcacctggacagtgagtgctcccttgatgtcatgcacctggacaagtggacagtgagagcctggacaacagtccgcctgttagcaattctctttgggactgttttgaccagattaggggccacttcagccaatgtgtccatctaaccacctatctttccagaacagaatttcctcatcaaagagggcctttgcctttgcaggaacaaggacatgtagagcagcccaaggtatatccggatttgttttttgtgcccacaaccaggatacatgtagaccagcccaaggtctaatccggatttgttttttgtgcccacaaccagcgtatcctcacggcaaatccaaggagttctaagttattaatcccaaccaattaatagaaggcagcctgtataactatggtgataaaccaataaaccagtaaaaaaaggaaatatcaattatcaaataaatatctagcagttagcagtagcactagtagcagcgcagtactgctgaagcacatcataacaccgtcacatagcatagtcatacataattacataacaaaaaaaaactcttcccctgcggggagtatgacagcctctggcattatattaaaaaaaatactttctcacatagatcgagaccacctgaccaactcagttagagaccctttcgccagtaatacataaccaaacaaggttcgaatggaacataacgagcaacaaaagcagccttcttgcaatcttgtggctattggctaattaagtagaccatcaatcaaccggaagcctcttcatctccatcatgattcttcgtcctcatccattgttgctgctggattagaaggttctggttcatattttcttctgttccatctttcccatcatctgctacagcgatatcttaagcccgtgcgtttcttagacgtttcttcttgctcaggtctgtttgacaacggtagcagcacaaactgcagcagacctacgcaagtgacgcccctataggtcttgagttgcaccaacaacttcatccacaacagcccaagtcaaagtatttccataaactttgtgtacaagtttattatttgcatcaacccatccattttttccatcaaaattcttcaagcaacagtggattgcattcctttctcttggaaccaagctctttaatttttttaaacctgttttgcattttccggttgtagctacaataggccaacttatttaaccttttatgctctaaccagtttcttttcttggtatggatctacaaaaaacagttgtcaagaggacaacaagccaaaaccataatattgtgcaaggaatgttatctccaaagtctgaactacttagtaggtagtagagtacttacatcagcaaaggcactccaattacgctcccatccagatgttgcacatcaaaggctaaaaaatgttccctaaactttggagctcataagctaggccaccatatgaaccccac

SEQ ID NO: 3751 - DNA, 1894 bp, Zea mays
cccagcgtccgcccagcgtccgcagcatctgaaggaggcgcagccgatctggaaagataaggaaaaagaagactgctcgccgtagctcacaacagaaaatggatgaattgtcaactgtagaaggtggaagtaactattcttcacgcagagacgatgatgccctcgcggtgtgttctcgttcacgatttgcatcgcctgaggactcaaaaaataaacagaagtcttctgttgagtctccaatggagataatttctgaaaataagttgcctgtagggcttggtagaaggcctcctgaaaagctaaaagaaggttttgttattgctctaaagacaagagacaattcaggtttttatgtttcaagagagagggtcactggcggtggatggtatcttgatgtgataccaaatgccacaaagagggatcctgctgctcagtttttagtcactttcagaaacaaggacactatgggattgcgatcttttgttgctggaggcaaactattacaggctaataataagatggagttcgtcttcgcaagtcattcttttgatgtttgtgagagctggatgctggaagggtgcctttcagaatactgcaaacttgttaatcgcaaaaatgctatggctgtacttggggtctatattgaggtccttggagctccgagtgaagatggtgtcgttcggtggcttgattaatacatcaaggctatgctatatttagagaacattttaaggctatgttgtttctatagaacaatttaggcttatgctgccaactgctatcctcgggttaggtcttctctgagtctctcttgccaagtctcagttttggctgttctactgcatctgcatggacatggactcgcaacgcagtcttttttagtttgtttgtttttttactgtctgtttgttgtaagctgtgtctattgtattttaattatacagtgtgacaagcaatcgctattatagtattctcttttcaaaattcagtacttgtatattactcagctaatctatattttctttttactgaaaggtaggatcgatacccccaacgaatattaccatgatcagtagcaaggtgcgcaagattttcagtctcatgtccagccggtcatttcttcctctgctcggcctttgccttcttcttctcaatctcttcctgccacaacacgggccagttggcccgggcctcgtcgatgccgagcagcgacccttccttgtcggggtcccagctagccgacagcgtgccgtaggcgatacccagcgccgacgtgccgaaggcgacgaggatggtcagcaacggcacccacgacggcaccaccaccccctggccgcgcttgagcgcgtcgtacacgttgagcagcgcgacgcccgacgccatgggaaggcccaccgtgaacgcgatccggcgcaggatgcggtcgaacacgggctgcggaagctcgtcgtcgtcgtcaacctcgccgttgctgttgctgccgctgccgccgccgtcttgcttcgccagggacgcttcttccatccccaggagctgctgctgccgttcctgcacgtcctgctgccgccgccgctcctgttgcttctccttccgggtggtcttcttggacggcgtctcgccggagctgaagctgctgtccgtggccgccgagcggatggctggggcgcgccgtcgtttagagagcggtgagaggcggctgggtgtggagttgagagcccatgggcggtagggtggttttgcggtcggggtagccgcttggtggagtaaggcggccatggctatcctccgcgtggcttcaccgtcggaaacgacgacgagctctcacgcgcggtatgccggcctcctcgcgggcctcgccgttccctatgtggccttatcgccttgagcgagagtc

SEQ ID NO: 3752 - DNA, 1566 bp, Zea mays
gtcactatgtttacttctttagagactaaaagtgactaaaatttagtcactaaactttagtcacccctaaccaaacggggccttagctaggttttactcacaacaatgcacaactttgactactttttgttaccagatgtttataaaatatgggaaaagtatatatatttgaaatcccgtttctagaaaaatctggtggtatgatttgcaagtatccgaactcaacacatggtaatatgcgatcaaatattagaattgttggcttaaccctccaaaaagccactttgtgacgggccgatgaagtattagaaaatttctttcgactgtgtttggatgtccaaagcattttagtactgttagaggggtttgaattgtcaactgtcaatcgtagacataaactaatttcaattgatgttccttaaaatggaaatggttttgcttttttgctgaaggtgatgggtgtttgggggaagaggaatttatggtcaactgagatcatctccaagaccgagagggctaacagaaaacatcagatttcagcatccaattactcttgactaacgttccactctttgcaaaaccattgtgccggcaaggagggctactattttaggtccggttaacgtgtgtaagtagccccgtctatgagaaaatggacaaggaatcgcagcctcattcagcatgaattaccaacgatggttgactactactagtacaaggagacctcaagggatacggtcgcctgtacgaatatggatgcgagccatatactgacggccggcctcccaaagatgcgatgtgttccttagttcgatgattttttttttgaaactgtatagaagcctgcgaagaaatgtagtggttggctgagtgaagtgagggaagggataggcattatttcccttgggtgacattgaccctgtttggatcagattctagccgcgagaatctgattttcgtaataaaaaaatcgaaatcgaagtggtttacggtctatttgttttggccgaataattctttccatttggcattaaatcgccaaaaaccaagaaaaaaagcatggtcctaaatggagtcctctccttttgcgtaaaaaaacataattgaagcaaaggaattggagcatagtattaaacttcggtgccttgggatacgtaagactggcttcacccgtttgcatgtgtcatcaaactccttcaacaatgactgaatctcctcttcatgagtacccactgtttgattctgcttggtctccaacagaactagagtccagatgtcattctcctttatccacttctgtatttgcatcactgaaacatcagctacctgagttacttccatattcttatctcctaccagcttgacctacactccatctttaaactgcagtatcttttgtttccagtcacactttatagagatatactgcatcaaccagtcatagtctaaaattgcatcaaatgcactcaagggaagcaccctcatactggactaaaaaaatgaccacaagctcaccactcgaagtttttaaccaagatgtcactcaacatcaactctccattagct

SEQ ID NO: 3753 - DNA, 889 bp, Zea mays
ccggccgggaaaactaccgccctgtcttgtgctgagctccgcttctctttgtcggcgattgggatcccccggccggcctctcctcccctcttctcactcagctcaccagtgctcgctcacctttcccctccctttcctttcctttgctttcctatccttgtgccctcgaactcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccgtgaacggccggatgtgggtcctgctcctgttcgattccacgcgcgcacgtatgcgattgtactgctggttgctgcttgatcgatcgatggatcgatgattccatgtacatatttgatagggggatgctgctgctaggctattagctgcaggctatagagtttgagggtgatatacttatcagtttgctgcctgtaagactggttttggttttgctataatcgtgatgtattcagatgtacagtaccctctttgctttggtttccccggtcttggaattgactgctggaaccgtccc

SEQ ID NO: 3754 - DNA, 1073 bp, Zea mays
ggtgcagacctcgtcgatccacaccaccactattgccaagtgtcaaatcagcaggcgtgggcgtacgatctcgacacggcagcaggagcctttgggccgtcgttacacgcacctatccatctcatctccgcggcacacgacacggcacgacacgatcgtggttggtgttagttacaccccccctatatgcgccggtgcggccccccggcccggccggcctctcctcccctcttctcactcagctcaccagtgctcgctcacctttcccctccctttcctttcctttgctttcctatccttgtgccctcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccgtgaacggatgtgctcctgctcctggctcctgccttagcgcgcgcttggtgtgcttgtgctcggtcgatcgatcgatcgatgaagtcctcatgtctttttttttttcttctttttgtcctctgcgcgcggcgcttgcttggtatgttgtactccacgcgcgcacgtatggatcgatgattccatgtacatatttgttagggggatgctgcggtgcaggctatagagtttgagggtgatatacttactgatcagatcagtttgctgcctgtaagactgggttttggttttgctataatcgtgatatattccgatgtacagcaaaaaaaaaaaaaaaaaaggccccta

SEQ ID NO: 3755 - DNA, 869 bp, Zea mays
ctgtgcggcgctcccgccggcccggccgggctctcctcccctcttctcactcagctcaccagtgctcgctcacctttcccctccctttcctttcctttgctttcctatcctcgtgccctcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgacggagagccgctggaagggccgctacgagcggggccccgccgagggcagctcgccctggggcgtcgccttgctcgtcctcctcctcctcgtgctcgccagcttccactccaccatccacgacatgtggggcccgtgaacggatgtagtgattgtagtcctgctcctgttcggttccacgcgcgcacgtatgcgcttgtgctactggttgctgcttgatcgatcgatggatcgatgattccatgtacatatttgttagggggatgctgcggctaggctattagctgcaggctatagagtttgagggtgatatacttatcagtttgctgcctgtaagactgggttttggttttgctataatcgtgatatattccgatgtacagcatacagtaccctccttttgctttggtttccccggccttgcaattgaatggtggaatgagacccgcctcatcctttgtctcc

SEQ ID NO: 3756 - DNA, 983 bp, Zea mays
  misc_feature (918)..(918): n is a, c, g, or t
cattgggtacctcgaggccggccggggctctcgttcatctctccattccatgccatgccatgccatggcccctcctcactttcgttcgctttgcgctttttgagtttaaaagaaaagaagaaagcggccttgcccacgtttcaaaccatcttgaagaaggagatcgagaggcattcctacggcaccgtctttttttcccgattctcctgttcttgtttgtgacttgtgagtgagagcgggatccgacatccgaggagaggtcgaggccgggcaaagtcgaagtccgcgctccggcctccagctgacgaagcaggatgcactgtgacgcgctggcccatggtgagcttctgatgccaattaggactaaacatgcttcctcgctgcgctcaagtgggagaacaagaaatcagcctagacactagtcatctgctgcaagcagaaaatgcacccttattcacttaagagttccaagggagcaccaattctgccacggccagtcttcgttttcttcatcgcgacatttggtttctatgtatgctatctctccttcaatcagataacgctagagaacaacagagaggggaatagtcgagaagaacaaagggacgatatttgcagaaagccttatgtgccgtatgaggagctcagttatgtgcactttccaaaacctacaagttatagcaggggggagtgctcgtgtactcctgttcggttctttgtaatcgtgtctatgcaaagatcgggaagtggatggtttgagaccttgatgaatagtcaccctaacattagttccaatggcgaaatctttaacagagtggatagaagagaaaataccccgtctatcttacaaacccttgacacgctgtatcatctggactggctcaccagcgccgccgaagatgagtgcacagctgcttntgggactgaagtggatgcttaatcagggaattttgaaaaccctgaagatatagttagttatttga

SEQ ID NO: 3757 - DNA, 2270 bp, Zea mays
gcacgagcataaacccctcctcgcctcctccgcccgagcctgcctcctcgcacgagaccattacctagtccctcctctccacgcactagcctcagccaattgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggccctcacgtgtcactcgcttcggatctcgcaggcgcccgcgaggctgacggtggcgaggccgccgccgccggcggcggcgaccaatggcgcggcggcggggacctgcgggttcgactacgatctcgtcatcatcggcgcgggcgtcgggggtcacggcgccgcgctgcacgccgttgaagagggcttaaaaacagcaataattgagggagatgttgtgggtgggacttgtgtaaacagaggctgtgtcccatcgaaagcgcttcttgctgtcagcggtcgaatgcgggagcttcatgatgaacatcatatgaagtctttgggtctacaggtttcctctcctggatatgacagacaagctgttgctgatcatgcaaacaatcttgcctcgaaaatccgtatcaacttgactaactcaatgaaagctctaggagtggatatattgacaggtgttggcactattgtgggaaagcaaaaggtacgatatggaaaagctggtttcccagataaagaaatcactgccaggaacatcataattgccactggttcagttccttttgttccgaaagggattgagattgatgggaaaactgtatttactagtgatcatgcactgaaacttgagtcggttccagactggatagctattgttggaagtgggtacattggacttgagttcagtgatgtatacacagctcttggaagtgaggttacttttgttgaagctcttgaccagctgatgcctggatttgatcctgaaattgcaaaattagcccagagagttcttatcaatcctcggaaaattgactatcacactggtgtttttgcaagcaagattactcctgcaaaggatggaaaacctgtgctcatcgagcttattgatgcaaagacaaaggagcacaaagaaacccttgaggttgacgcagcccttatagctacaggaagggcgccattcaccaaagggcttggcttggaaaacatcaatgttgttacacaacgtggttttgtgcctgttgatgaacggatgcgagtcatggatgcagatggcaatgtggtacccaatttatattgcattggagatgccaatggcaagctcatgcttgcccatgctgccagtgcacaaggaatttcagttgttgaacaaatatctggaaaggatcacatcctaaatcatttaagcatcccagcagcatgtttcacccatccagagattagtatggttggactgacagagccacaagccagagagaaggcagataaagaaggatttgagataaatgttgtgaagactagctttaaggctaacactaaagctttggcagaaaatgaaggagatgggattgctaagttgatttaccgacctgacacgggtgaaattcttggggttcacattttgggtttgcatgctgctgatctcattcacgaggcatcaaatgccatcgccctaggaactcgtgtgcaagacatcaagtttgctgttcacgcacaccctacattgtctgaggtcctggatgaactcttcaaagcagccaaggttaattccggtgtttctcattctgtaaatgaaccagttgcagcctagagaaaggccggatagcaagccaaggcagccaccccaaccactcctgaaggtcctcagcttcgtcacgaccctgttttcttccccaaaacgagattgacaacggtaacggggagggtgttgttgtaggcagttgctgtaggttacaaatttgaggaagaaattcatcagtgaatacaagcacacaaatgtttcttttttgggtccagattgttaaaagggtcttttttttacggtggggtgggtttttgttggcttcgttatttgcatatttgttgttggttgccctgtaagatgaagtgccgaggctagctcagctagtttgaaataattcatgtttcaaaactcagatgtattgcgccgacacaatggattagttggttatcttcagtaagctgcaaaacaatattttgcacggcaaaaaaaaaaaaaaaaaaaaaaaactcgagggggggccc

SEQ ID NO: 3758 - DNA, 1267 bp, Zea mays
caaaagtgacattgtataatggatacacatggtctatatattgatttgcttatgtggataaatgtttagaaaatcattgggcattaatacgatcaagctatatatttctagcttgatcatattaatgtagagtgatttttaaaatctttatccatataagcgaaccaagccggagaccatctttcaattgactttaaattagctatattatttacctggctaaaagggaaatgactggagagagttaatgactaggtgtaaataccggcgtgacgcaggccggcaggtgcataatcagtagttaatgactacagtaacaaaatgcaggtagcgtgtctatataaacacctcccccagctcccgggcgggacctcatcccaaatctcaacccaagaacaaaaatggccaccgccaccactgaagccgaagtccgtgagtccctcggcacgaagttcggtcgcctcaaggaacaggcgaaagacatggcctccaggcaccccgtcgctggagccgcggccgtcatcgctgtcagcgccgtgggcgcctacttcttgtggcccgtggcggccccggccgtggccatgatgaaggcgcctggatccggcggtgtgctcgtctcccgcgcggcgtttctcgcgaagaaggagctgtacttcaagctcttgcgcaccgggggcgttgcggcggcggtcgccgctttggcgtagctgcgcatgcagtagtggtacatgctgttcgtgaacgagcggcgggccggacgtttcaggttgtatgttgaccaagtggttattagtactttcctttcgttggtgttgagtctcgactctcgagtttggattatctgtcaaaaacctatgtatgcgtgcatgatcagtttgatgaataatggaactcttttaagaaataaagcaagttaaggtccagataaaaaaaaaaaaaaaaagcgccgggaatagcagattacaaaagaagctcaaacagtctgaatttttatcaattcatccaccgtaaaagtacgtgggtttcatgtttatcctgaattatcattattttcttgtgattgaagtcatgccaacatcttgatctatcgtgtcttcatcctgtacaaccctcactctattcataactccacattttaagtgctagtttgggaatcctaattctctctggaatccccgtaattttctcgaatagtaatatccagaggtgtcatttgaataatatatttagttatttatagatgattttctctctgagtttgtctccc

SEQ ID NO: 3759 - DNA, 747 bp, Zea mays
  misc_feature (722)..(722): n is a, c, g, or t
cccatccgcaggttggcttcggcgacgcccttcgccctccaggactccaggccttcactccaccccccctgttcgcaccggccacagccgccaccggccttcgccgcgagcccgcgacgacgcccagacttgctgccttactaccacggagacggaggcaccaccgcatcaggcagggaccggacgacgacgcccagacctgtttcaacctgccggtctccccaggcccccagcccccagcagcaggaggccaccatgaagcttgacgtgaacgcccttcgctacctcgccaaggacgacttccgcgtcctcaccgccgtcgagatgggcatgcgcaatcatgagattgttccaatagaacttattgacaggattgccagattgaagcatggaggcacatacaaagtgctgaggaatcttttgaggaacaagctggtgcatcatgatgccactaaatacgatggatatcggctcacctatctgggatatgacttccttgccatcaagactttggttaatcgaggagtttttgcttcagttggccgccagattggtgttggaaaggagtcagatatatttgaggtagccacagaggatggtacagtacttgccatgaagcttcataggttgggcaggacatcttttagagctgtgaaatctaagcgtgactatctaaggcaccgaaggagctttaattggctgtatctctcacgactcgcagnctttgagggatttgcctttatgaag

SEQ ID NO: 3760 - DNA, 1974 bp, Zea mays
cattgggtacctcgaggccggccgggacttcacgcagcgtccgcgctgtctctgtcctcacctccgcgaagacaggctaccgccgccgccctacgccaggtgccgaggcctctctgtctcttcgccggcgacgatccaatagccagcagcagaaggaggacaccatgaagcttgacgtgaatgcccttcgctacctcgccaaggacgacttccgcgtccttaccgccgtcgagatgggcatgcgcaaccacgagattgttccagcagaacttgtcgacaggatcgccagactgaagcatggaggcacatacaaagtgctgaggaatcttttgaagaacaagctagtgcatcatgatgccactaaatacgatgggtatagactcacctatctaggatatgacttccttgccatcaagactttggttaatcggggagtttttgcttcagttggccgtcagatcggtgttggaaaggagtctgatatatttgaggttgccacagaggatggtacagtactcgccatgaaacttcataggctgggaaggacatcttttagggctgtgaaatctaaacgtgactatctaaggcacagaaggagctttaattggctgtacctctcacgacttgcagccttgaaagaatttgcctttatgaaggctttaggggaccatgatttccctgttccaactgctgtagattgcaatcgccattgtgtgatcatgtcacttgtgcagggatatcctcttgttcaagtgaaagagttacaaaatccagatgacgtttttgacacaattcttggtcttattgttcgtttggcagagcatggactgatacattgtgactttaatgagttcaatatcatgattgatgatgatgaaaaaattacggttattgattttccacagatggtatctgtttctcatcgtaatgcccaaatgttttttgaccgagacattgaatgtatctacaagttctttaacaaaaggttcaatctgacatcagagaaaaatgaagaacaagctgggtctgaaagtgatgatgaagggaatagcagaccttcctttttgtctgtgaaaaagactgctggttccttggacaaggaactagctgcaagtggatataccaggaaagagcaagtggagatggacaagtacattgaggaagatgctgaaagacatgattccagctcagatgatgatgacgacgacgacgacaatgacaaggttggtgatgctgtgtctttggtttccttgaagatagaccaggacgattctgctgagcctgattgtaatcttgcctcaagggattcagatgtgcctggaactttttctgaagagcatgaaacaagctgtagcagtgagaagagattggaaagtccctcgggtgacaatggagaggctatgaaaccgcttgaatctgagggcaagacgctttcccagaaagacgacaacaatgatgatgactcatcagaggatgctgatgaagaagaagaagatgccgagctcacgaaacaattgaacaagcaaaggaaaaaggcaatagcagctgccagtggtcggagaaggccagtgtcgtccaggaacgcctacaaggacaagggtaagggcaccatgaactccaaaatccagaggcaggcgtgccagtggtgatggtcactcgaatgtctgcagtgcctctttcgacaatcgtaaagtagaccatgagtaggattttccatgagtgtagaaccgagggatccctgtactagaatcaactctggttttattcttttatcacatgtcgtatacctttttgtacacggttatggtgagatcatttgagttatgcttctgtttataccaactgaatagctgagcgtactgccttcttcaagagcccgtactgctgccctccggtctggcctaaacatgtcgcctccatgagcacaacactacggaaagtttcgcacttcataacaaaaaaaaaaaaaaaaaa

SEQ ID NO: 3761 - DNA, 815 bp, Zea mays
tcgagcgccggccggactactactacgcgcgccggacgcggcttgctcgatctcgagcacatcatgcgcccctccgaaaaaaaattccccacgcactagaccaccacccgttggctttctcccctcgcaccggggaacgcggctgccgatccgctcccgatcccctgccctcctccttccagccgactgagattccaccaaatcggcgcccgtgcagtccccgattcgattgacaagcacgattggccgctcctgatcagctacgggatacggctggatttgatttgattggatccccaattgggtgtccgggtccgcgcgttcgggcgggcgggcggggggattgctttagggtttcagcgggtgcggtcgctgtgtaggcgggtagggttttgccatggcggagaagggctgcctgaagcggctccagaaggagtaccatgcgctctgtaaggaaccgccgccgcaggtcgtggctcgcccactgcccaacgacatattggagtggcgtaagtagcctcagctaaccctactactcgtagatacgatccgtcgccttttgattggctaatgtttggagtcaaacggggtttgattgcgcttggttttgtcggaagcaatggtgtaggcataatcataacgcgcaacgcacaagatcatgttggtttagcaatcacttcgttcggttttgggaatttctatatacatgtggttgctccgtgtaccgcgtgatgtgctcagctcgtctgctcactgcttacagtttctgagcagtgcgtgctgcctgcaatttattgtttaaagtttaaattgtc

SEQ ID NO: 3762 - DNA, 1073 bp, Zea mays
gggtacccggccccccctcgagtttttttttttttttttttttaaagaataggacacttagcaagtcataagcatctcaaggaacatcctactccatctgctatacaaaaacgatcacgatgttcataccagctgaagctggctgggcattgtgatcaacacatgattatatagagaaaaaaacattgaaaaaaaagaaacatctgcagactgttcccttgaaaaaacaaaaatggctccagggaaacgctggcttccaagtaatcgctaaatccccgcaaaattgatcgtcgaccaatcagccccatcgcttggtgattgggcctcctcatatattgaccaaaagttgcccctctgtaatatgaactgcaatgattatcctccaaattactttgcagatggttctgtcaatggccttccatataggcggaaaagtaatgaggattttgacatctgaggctctcgctcgagtgccgctaccacatccttcatagaaatactccgcgccacttttgttagcggtgaccttctaacaccaccagatccaagcattgtggagtatcctctcttttcaacttcatgttcttcccttaagtctttcccagatttcagtgatggcctgtgttgcaacatgttacctggtacagagccagaagaaccatcacctccctcacttctctgcttattccgttcagctagtaattgccactttgacagcatgtcatctccccccgctgcaactcgtgcagcaacatttgcagctgtagttcgcatcttatcatcgtcctccttgtaagtctttgcatgctttgacaaaccacgggtctcgattctgtctttttcaagatcaacatttgcattgccatctccctagatgcttcgctggctggctaggtgactccttaagaaccttgcacatgacatatattggcaaatgagtattataagtggtaaaactgttccagtaaaagaggcagcaagcattccttgttcaacttagataatttaaaccatgatttatgtgaacagagattaaaaatcaaactgaaacatcacccgggaatccggcaccg

SEQ ID NO: 3763 - DNA, 922 bp, Zea mays
aagttcaggcagtttcgtgcccttttcttctccaccagctcaaagctgaacgcggcatccttcctttcctcccctcttctgcccccatttcgttcctttcacaccggagaccggagagcagagccgcgcacagcagaacgcggaagcaagaggaggcgatcgactactcgaccagccctctccgctcttgtctccgatggcggctcgcgtcctcgcggccctcgccctcgccctcgccctcgtcgccctacccgcgcccacgcgggcgtccaacgacgagggggacgcgctctacgcgctgcggcagcggctgtcggaccccaacggcgtgctgcagagctgggatcccacgctcgtcaccccctgcacttggttccacatctcctgcgaccaggtcggccgcgtcgtccgcctggacttgggcaactccaacgtctccggctccatcggccctgagctcggccgccttgtcaacctcaaatacctggagctgtacaggaacaaccttgacggcgagatccccaaggaattgggcaacctcaagaacctgatcagcttggatctgtatgccaacaagctcacgggaggaatccccaagtcactctccaagctcgactcactcagattcatgcgcttgaacaacaacaagcttacaggatcaattccaagggagtttgccaagctctccaacctgaaagtcatcgatttgtctaacaatgatctctgtggaactattcctgttgatgggcctttctcaacctttcctctccgaagcttcgagaacaacagcaggctcaacggtccagagctacaaggattggttccttatgattttggatgttagatgcccgatcacatgtaccaccttccccagttgaaagggggaagccaagatagtattatcatagaacctagctttcag

SEQ ID NO: 3764 - DNA, 1618 bp, Zea mays
cttaagagcctaagaccattgatattgcatttcaatgctagatcgttgaacttgtatttttatttaccactagaacttcgatgtgaatccgtatgtgttggtcggcccgcctcaacctttcctctccgaagctttgagaacaacagcaggctcaacggtccagagctacaaggattggttccttatgattttggatgttagatgccgatcaacaatgtaccaccttccccagttgaaagggggaaagccaagatagtattatcaatagaaacctagcttcaagaatgtcgtgactatatatatgtatgatattaagactagatttgataagggtggcatagcaagtcctgatattctgtgtgcattcagaatagctgcttttatgcccttgtgttgatattttgcaaaccaaaacaaactgttctgaaacgagggcacatattgttcatgaataaatttgagcctccaatacatacatttcatgttttctgtacaacaaaatcgcacgataaaagaataggacacttagcaagtcataagcatctcaaggaacatcctactccatctgctatacaaaaacgatcacgatgttcataccagctgaagctggctgggcattgggatcaacacatgattatatagagaaaaaaacattgaaaaaaaaaaaacatctgcagactgttcccttgaaaaaacaaaaatggctccagggaaacgctggcttccaagtaatcgctaaatccccgcaaaattgatcgtcgaccaatcagccccatcgcttggggattgggcctcctcatatattgaccaaaagttgcccctctgtaatatgaactgcaatgattatcctccaaattactttgcagatggttctgtcaatggccttccatataggcggaaaagtaatgaggattttgacatctgaggctctcgctcgagtgccgctaccacatccttcatagaaatactccgcgccacttttgttagcggtgaccttctaacaccaccagatccaagcgcaaaagatttatgactaagaaaacaaactagtgcatgcatggtagatattactctgtattacctaacctagaaattcagtatctaaaataaatttattcatatcgtacattctgtcttgtttatattttgacaagttgtttcattgactaaaggcatgtttgaaagcacccagtttttaaaaaactggtttatgaaagctgagatggttccaaacgtactagaaactggattctcaatttcttaaaaataaaaaaaaactacacttgcctagctaaacccagtttatgaaaactgaggtggttccaaacaccgtaacctagtttttttcgtaaaccagtttctaaaaactggagataaaactggatatttaaaaactaagttgcttctaaacaaggcctgagatagtttggtggtaccctgataaacacaggaatgttattgtcatcttaggttctattgaatttgaaatgaggtcattttaaagaatatttctagtttttactgaattagcgttggtagagtggcacatcactaacattttaaaaatagatacgtgtacacaacatttaaacaaaaatcaagggatgacctaaatagc

SEQ ID NO: 3765 - DNA, 1193 bp, Zea mays
cgctatactgtagttgcgctgacttgaccacccactggccacagcagctgaaccaagttcaggcagtttcgtgcccttttcttctccaccagctcaaagctgaacgcggcatccttcctttcctcccctcttctgcccccatttcgttcctttcacaccggggaccggcgagcagagccgcgcacagcagaacgcggaagcaagaggaggcgatcgactactcgaccagccctctccgtgtctccgatggcggctcgcgtcctcgcggccctcgcccttgccctcgccctcgccctcgtcgccgtacccgctcccacgcgggcgtccaacgacgagggggacgcgctctacgcgctgcggcagcggctgtcggaccccaacggcgtgctgcagagctgggatcccacgctcgtcaccccctgcacctggttccacatctcctgcgaccaggtcggccgcgtcgtccgcctggacttgggcaactccaacgtctccggctccatcggccctgagctcggccgccttgtcaacctcaagtacctggagctgtacaggaacaaccttgacggcgagatccccaaggaattgggcaacctcaagaacctgatcagcttggatctgtatgccaacaagctcacgggaggaatccccaagtcactctccaagctcgactcactcagattcatgcgcttgaacaacaacaagcttacaggatcaattccaagggagtttgccaagctctccaacctgaaagtcatcgatttgtctaacaatgatctctgtggaactatccctgttgatgggcctttctcaacctttcctctccgaagctttgagaacaacagcaggctcaacggtccagagctacaaggattggttccttatgattttggatgttagatgccgatcaacaatgtaccaccttccccagttgaaagggggaaagacaagatagtattatcaatagaaacctagcttcaagaatgtcgtgactatatatatgtatgatattaagactagatttgataagggtggcatagcaagtcctgatattctgtgtgcattcagaatagctgcttttatgcccttgtgttgatattttgcaaaccaaaacaaactgttctgaaacgagggcacatattgttcatgaataaatttgagcctccaatacaaaaaaaaaaaaaaaaacggcc

SEQ ID NO: 3766 - DNA, 3022 bp, Zea mays
gttcttgggatttttgtgaacaaagctagaccatgcatgcaatattatatttagatatttatttatgcagtcttctgtaacgcatgtcttagtacaaacaaccaaacaaagtttatgtatagcctacacgagcatgtataaacaatcaaataaaaatgtatgtatgaactcagccagattcaatcaacattgggctagactcatgccggcctggctcgatttataccgtaaccaaacgctggcgtgcgttttttttttttgcatgtccacccgaccgtcccatcccgttcggctgcctccaaactaaacgcacgcttgaggtagccagatttgaaacagggaacggacgcctgaaaaaacgccatagctagctggtttgaaacacactgacacacacactgttcgatatttcagtgcaagcagtgctggacttgtagggtggcacaaagatacgacgtttcctgttacgctctctcagtcagtcagacgagcactgccagtaggagagacctgagtatctatctatctgatgctgcacgcactggacgaccggcgaaaaaaactggaaaggctgccgaaaacgtaactgttgtgctcgccaacgccatccatccatgcggattcaaaccaagaaaccactgcagcacctgacctcctcgcgacgctgatgaataaaagccctaccaactccaggccaagcgccgttcatctcatggcctgcacggctgcactgcaggctgcagttgcactctcagtcccagccccagccttttcaggttttcacctggcgatttgacggcacccccgtccgtccatcgcatgcattctgctttctcctctttttcatgcacacaacaagaaggtactaacacgtctacacttgatgacttgaggaggtgcatgcatcgtgcactcactctcacacgggcataaattaagcacatggcaacgctgaggtcgtcagcactcagcagcagcagcagcgtggctgcatgtgtgaataagcatatgcaacacgccatcacgcaacaacgtttagcaaaatgctttctttaaccatgtacagtatacgattaggaaaatcagggcttgtctgataccacgacaggattaggagggcacaagaatctgctcgcaacctccttgtctccccattcattgctcgtctccttgtctcatctgtccactctactccgactaggtggttggttggccttggcccatgcccatgccccttctccctctcggccgcctctccattataagctccccgccatccacgcatccacagcaccctcctcctcctcggttcgctcattcttcttcagagttcatacctcctcagactccaccgcctctcttcttcctctcggcgctacacacaactctccgtccctctactacacccgcaatggcgtgcctgtcgccgtcgccgtccggccggcgcctgtcggagctgctggaggagaagcaggagccgttcgtcctggacctgcacctgctcgagaggggctgcgcatcctcgcgcctcctactcaacggctacgacgccgcgccgtgctggcccgccgccgccggcaccgacgccgccgccgcggcgctcaggcgcctcaccagcaagaagaacaacaagccggccgccgccgccggcaacaagcagcagcagaagcctgccggcgggctcctccgcctcctgctctccaagatcctccgcggcggcggcggcggtcgagcggcgaccccaccgcggaagcccgccgcgctgcagctctccggctccttcaagctggcgcccaccaaccccgccgccgtcgcgcctgcgccgtgctgctccgaccgtcgcctggagctggacgccgtcaagactaccgccgccgacgacgacgacgacgagaagcagcagctgagccccgtctccgtcctggaccacccgttcgacagctccccgctccacggcaacctgctgtccccgacgtccaaggacgtcttccgggacctcctggacgcggcgtacagccccgcgctgctggcccagctgctcgccaagtccgagcacctcctcatggacggtgacgttgacgccgacgcagacgaccgctactactgcggcggcggcggctaccgctcgagccccaagaactgccgcgacgacgagcccgccgccgcctactgggacgcgcacagggaggagctggcgcgggtgtcggggctggtcgcgtccgagctcccggcctccaggctcgacgccgccgacgtgcggcccgagcgccacgacgtcggcgccgcggtcgaggccgccgtgttcgaggcgctgctgcgggagctcgtcgtggatctcgggacatgctgttgctgactgcccgtgcgggaacgccgtccgtggcggtgcacgtctgcttgtccttgcgaccaagacagaacagagcggtgctctgcttcgctctgtttcgggtccgccgcacatgcatgatgtgatggaaaacgttttgttttcttgctctttttttttttttggagtttcgatgggtacccgctggtagatgggtccctatggctccgcgtttccctggcattctgtcagtgccagggggacgctgtagagtaatcaagtaactagccgtaataatattattaattattttaacttggatgctgccatgcaatagttacgtttgagtggtatgtggatagcatatggttgtggatatggaatgaaattgaggggaagtaatgcaaaacatattttaatcacagttttaccttataatatatattgtaaatcactaaaaacgacgatttagcgatacaagcacagttttgaagtatgtgttctgaatagtcacaaatataactaattgttagggggaaatgttaagttatgctttgcacaagtcaaaacacctctagttctagatgaagtgagtatatcagatggaaagaattggatttcaaatgaatataacacctgtgttaacacaagtggagaaccgatcaaatacaaggacaaaaatgtaactcaaac

SEQ ID NO: 3767 - DNA, 2126 bp, Zea mays
cctgccgggagtcctgtggtgctcgcggccgggaggccgggcattccttcgtcccccacctctcgcttcatctccatctcctcctcatgctgctgctgccactgccactataatagcccagctagctagaggtccggccatcaagctgcccattccctcgtgacagcagctgcctgcctgctccgaggcgccacccagctcttcctcgccccagcagccgcttcccgagatccttttcactttcaccaccagggtacatagaccgcatctgcggtgctctgcgctcctcggactcgatttgttggttcatccatccagctgccgccggacgtcgatcagctacctatcttgaaaccacaggaccgagcgtggaaactcccggaccggacattccattttccattccgaagggggggtgagaaggcggggaatgagtacaaccaaggtgaagagacgtgtgggcaagtatgagctcggccggaccataggcgagggcaccttcgcgaaggtcaggttcgcgagggacacggtcaccggcgaggccgtggccattaagatcctggacaaggagaaggtcctcaggcacaagatggttgagcagatcaagcgggagatctcgacgatgaagctgatcaagcaccctaacgtcgtccgcatatacgaggtgatgggaagtaaaacaaagatctacattgtgttagaattcgctaccggtggcgagctctttgatacaattgttaaccatggtcgaatgagggaagacgaggcaaggaggtacttccaacagttaatcaatgcagttgattattgtcatagcaggggtgtgtaccaccgggatttaaaacctgaaaatttgctgcttgattcatatggtaacctgaaggtctctgactttgggctcagcgcgctatctcagcaaatcaaggatgatggactgctgcacacaacttgtgggactccaaactatgttgcaccagaggtccttgaagatcaaggctacgatggagcaatggctgatctgtggtcatgtggagttatcctgtttgttctgctagcagggtatttgccgtttgaggattctaatctcatgactttgtataagaaaatatcaaatgcagaatttacatttccaccatggacatcttttcctgccaagaggttgttaacaagaatccttgatccaaatccaatgacgagaataacaatcccagaaatattagaggatgagtggttcaaaaagggctacaagcgcccagaatttgatgaacaatatgacaccacattggatgatgtggatgccgtcttcaatgattcagaagagcaccatgtgacagaaaagaaagaagaagaaccagtagctctgaacgcattcgaactgatttcgatgtcagcgggcctaaaccttggaaacttatttgactcagagcaggagttcaaaagagaaacaaggtttacatcaaaatgtccccccaaagaaattgtccgcaagatcgaggaagctgcaaaacctctaggatttgatgttcagaagaaaaattacaagttgaggctcgaaaaggtaaaggcagggaggaagggaaacctcaacgttgctactgagatactgcaagttgcgccctctctccacatggtagaagtccgaaaagcaaagggtgacactctggaatttcataagttctacaagaacctttccaagaccttgaaggacgtcgtctggaaatccgacgatcttcaaacgcaacatgcttcttagcagaacctcagagaggaggaatggcaaactattttgtgcaccatcctttcaagcaaactattctgcatgtaacggtgggtgcccaggaaattgcgctggtgctccaccatcgttgtatatgctgcgtcttgagttgcttgctgtagctgaagggaagttcattcagtaggttttgagtatgagttttgtatatccgtatatgcctatgactatgagccgtgctggaacactatgatcagaaactgcgaaatggagcccagaatgttcttgccaaaaaaaaaaaaaaaaaaagaccacgcttaacttgccttgcattttttgaagaagaaaaatggactactgaattgagaaaaaaaaaaaaaaaaaagcggcc

SEQ ID NO: 3768 - DNA, 2043 bp, Zea mays
cagttggaaatccattcattccttcgtcccccacctctcgctctatctccatctccatcccgcctcctcctcctcctcatgctgctgcggccactgccactataatagcccagctagctagaggccacccatcaagctgcccattccctcgtgacagcgcagctgcctgcctgctccgaggcgccacccagctcttcctcgccccagcagccgtttctcgagatccttttcactttcaccaccagggtacatagaccgcatctgcggtgctctgcgctcctcagactcgacttgttggttcatccatccagctgccgccggagcccggaggtcgatcagctacctatctgaccgagcgtggaagctcccggaccggacattccattttccgttccgaagggggggtgagaaggcggggaatgagtacaaccaaggtgaagagacgtgtgggcaagtatgagctcggccggaccataggcgagggcaccttcgcgaaggtcaggttcgcgagggacacggtcaccggcgaggccgtggccattaagatcctggacaaggagaaggtcctcaagcacaagatggttgagcagatcaagcgggagatctcgacgatgaagctgatcaagcaccctaacgtcgtccgcatatacgaggtgatgggaagtaaaacaaagatctacattgtgttagaattcgctaccggtggcgagctctttgatacaattgttaaccatggtcgaatgagggaagacgaggcaaggaggtacttccaacagttaatcaatgcagttgattattgccatagcaggggtgtgtaccaccgggatttaaaacctgaaaatttgctgcttgattcatatggaaacctgaaggtctctgactttgggctcagcgcgctatctcagcaaatcaaggatgatggactgctgcacacaacttgtgggactccaaactatgttgcaccagaggtccttgaagatcaaggctacgatggagcaatggctgatctgtggtcatgtggagttatcctgtttgttctgctagcagggtatttgccgtttgaggactctaatctcatgactttgtataagaaaatatcaaatgcagaatttacatttccaccatggacatcttttcctgccaagaggttgttaacaagaatccttgatccaaatccaatgacgagaataacaatcccagaaatattagaggatgagtggttcaaaaagggctacaagcgcccagaatttgatgaacaatatgacaccacattggatgatgtggatgccgtcttcaatgattcagaagagcaccatgtgacagaaaagaaagaagaagaaccagtagctctgaacgcattcgaactgatttcgatgtcagcgggcctaaaccttggaaacttatttgactcagagcaggagttcaaaagagaaacaaggtttacatcaaaatgtccccccaaagaaattgtccgcaagatcgaggaagctgcaaaacctctaggatttgatgttcagaagaaaaattacaagttgaggctcgaaaaggtaaaggcagggaggaagggaaacctcaacgttgctactgagatactgcaagttgcaccctctctccacatggtagaagtccgaaaagcaaagggtgacactctggaatttcataagttctacaagaacctttccaagaccttgaaggacgtcgtctggaaatccgacgatcttcaaacgcaacatgcttcttagcagaacctcagagaggaggaatggcaaactattttgtgcaccatcctttcaagcaaactattctgcatgtaacggtgggtgcccaggaaattgcgctggtgctccaccatcgttgtatatgctgcgtcttgagttgcttgctgtagctgaagggaagttcattcagtaggttttgagtatgagttttgtatatccgtatatgcctatgactatgagccgtgctggaacactatgatcagaaactgcgaaatggagcccagaatgttcttgccatcttgctccagttctcagcaccgggctt

SEQ ID NO: 3769 - DNA, 2316 bp, Zea mays
  misc_feature (338)..(338): n is a, c, g, or t
  misc_feature (929)..(929): n is a, c, g, or t
cccacgcgtccgcaagaagtcagtcacatctcacagctcagtgagatccagagccaaagggcggggcgtctccgactcccaatcccaagtccagccgccgccgccgtctcttgctcgctccaaaagccgttttccagagatctttttcagcgccagacgccagccgccgtctctcgcttgcctgcatttccgatcctgaggcagtcctcatctcattctcatgatctcatccaaccgggaggctgggaacgagatcacagctacagctacagctacctgagcaggatcctcctcagatcggcttcaaaaatcaaaaggggcgggggacaacaaggcangggatgagtgcaactgcaaccaaggtgaagagacgtgtgggcaagtacgagctcggccgaaccataggcgaaggcacattcgccaaggtcaggttcgccaagaacaccgagaccggggagccggtggccgtcaagatcctcgacaaggagaaggtcctcaggcacaagatggccgagcaggtcacttttccagctctgaagtatcgtgccatgtttggtttggtgtattctcacgtcttctacattgtgcatggccccttcctttcagattctgtctgttcctcctctagtgttagtgtctttactatttttttttactacttgcaggcccaatatgggctttggcatacttgttcagagttcagtcagtagatttggtggaactagtcatttcgctgacgatgacacaaactactacatggttcgatgcagattaagagggagatttcgaccatgaagctgattaagcaccctaacgttgttcgcatatatgaggtgatgggaagtaaaacaaaggtctacattgtgctggagtatgttacccgcggcgaacttttcgacacaattgctaaccaaggtcgaatgaggganaggcgaggcgaggagttacttccaacaattaatcaacgcagttgattattgccatagcaggggtgtgtaccaccgggatttaaaaccagaaaatctactgcttgactcatatggaaatctgaatgtctctgactttgggctgagcgcgctgtcccagcaaatcaaggatgatggattgctgcacacaacttgtgggactccaaactatgtggcaccagaggtcctagaagatcagggctatgatggtgcaatggctgatctgtggtcatgtggagttatcctgtttgttctgctagctgggtatttaccttttgaggactctaaccttatgacgctgtataagaaaatctcaaatgcagaatacacatttccaccatggacatctttccctgccaagaggttgttgacaagaatccttgatccaaatccgatgacgagaataacaatccctgaaatactggaggatgagtggttcaaaaagggctacaagcgcccggagtttgacgagaaatatgacacgccattggatgatgtggatgctgtcttcaatgactcagaagagcaccacgtgacagagaagaaagaagaagaacccgtagctctcaatgcatttgaactgatttcaaggtcagcaggcctaaatcttgggaacctatttgactcggagcaggaattcaaaagagaaacgaggttcacgtcaaaatgtccaccgaaagaaatcattcgcaagattgaggaagctgcaaaacctctaggatttggtgtccagaagaaaaactacaagttgaggctagagaaagtaaaagcagggaggaagggaaacctgaatgttgctacggagatactacaggttgcgccctcccttcatatggtacaagtccggaaagcaaaaggcgacactctggagttccaaaagttctacaagaacctttccaagaccttaaaggacgttgtctggaaatctgaagacctgcaaatgcgagctgcttcttagcatccactagatggcgagatgttcgtacgtgtcagattccattcccgtagcatgatgtgtcgtcagccgtttctgttcactgcactctgcatggtccggtgggcgcgtggcttggcattttcagagaccgcgttgctcgttgcagcccgggatgaaggcgatgcagtaggttttgtggatgtggtgagctctgtatatgcctattgatgagtcatgttgcaagctgtaacgacactatgatccgtgaagtgtagaagcagccaagtatgttctttctatgctgccccatttcccggcagtttccatgcattttgaagaaaaaaatagtggctaactcattgatatttgtatttggtcatcattaataaatcgcctctccatctgtgcatgacc

SEQ ID NO: 3770 - DNA, 786 bp, Zea mays
  misc_feature (3)..(3): n is a, c, g, or t
agnacaacctcgctgaacagttgcagggccacatctggaggactgggttcgagtgccaagaaatcaagggggtggtgttcgacgacgtgccgccggctctcgagaggtggcacgccagcggcattaagacgtacatctattcaagtggcagcagggaagcccagaggctcatcttcgggaacactacctacggcgaccttagaaggcacctgtgcggattttttgacgcaacaattgggtacgctgtacatctagtatcacacctttccgctcactgatgattcgtatgcgtcactgtgactatggctgttaatctatcctttttggcctggcgcgcgtctgcaacggaaggaccaagagagacgctcgcagctactacgagatctggcagacggtcggggtggaccggccgtctcagatactgttcctgacggacgtgtgccaggaagccacggcagcacaggctgcaggccttgaggtgctaatatctatcagacctggaaacgcgccactccctgctgaaacccatgggtttgggacagtcgagtcatttgctgaaatcttgacatgaagggaggatgcatcctcaacatgcatgcatgcatgctgtgctatttagagatggaaacggattgaactagtttcaaaaggcagatggaatggtttcatggccttgatttgcatcttcatactagctttatttacattgcccatgttcagtttgttggagaccataaacccatgggctcaccaagttatcttacccttgattggtttccttcaact

SEQ ID NO: 3771 - DNA, 844 bp, Zea mays
ggcacgaggctactcccgccgccttcgcctaaagaggcctcgccctccccccgccgccggaaaccgattcccttccccgattccctccggcgtttcctggtgagtttacgccagcgccgacttctccgatcaggtcccatcggttttgggtgcgcgcacctcgtttggcttcgcgtcgttcttcggtgcgcgcacgcgattcgtggatccggcggtcggatcccgcgccgtccgcagcgatggctgctccccaacccttgcttctttgcgcgcaccccttccccacggccttttagtttttacatggagaggggcgaccctcgctagccgcagggtccctctccatcctcaccgctttcttcctctgcaggtcccttagtgcaagcaaggacaccgctcctctagcgagctctgttctgaagcggcaagaaagatgattaatcttttcaaaataaagggtcaaaagaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgccagaacaaggcgcaccatcccaatattgatccgggaagcaatgtctgtctgaacattctgcgcgaagattggaagcctgttctcacctcaacactgttatttatggcctgaatcttcttttta

SEQ ID NO: 3772 - DNA, 1181 bp, Zea mays
cctcgaggcccccccggtttcgctagtgccgccgagacgctttccttccacctgccgaccgacgcacgcggacgcctccgttcgtactcccgccgcctgtagaggcctcgtcctctcgcccaccggcgaaaaaccgttcccctctgccgtttccgggtctcttagtgcaagcaaggaggccgttccacgctcctccagcgagctccgttctgaagcggcaagaaagatgattaatcttttcaaaataaagggtcaaaagaaagatgaggcagcaagtgctactggaaaggcccctgttaagaaacagtctgctggggagctccgtcttcataaagatattagtgagctcaacctgccgaagaccacatcaatttcttttcccaatggcaaggatgatctgatgaattttgagatcaccatccgacctgatgaaggatattacatgggaggcgctttcgttttcacctttcaagtgtccccatcttatcctcatgatcctccgaaggtcaaatgcaagaccaaggtgtaccatccaaatattgatttggaaggcaatgtctgtctgaacattctgcgtgaagattggaagcctgttctcaacatcaacaccgttatttatggcctgaatcttctttttacgcaaccaaacgacgaggatcctttgaaccacgaagctgcagctgtcctccgtggcaacccaaagatgtttgaggcaaatgtgaaaagagccatgaccggaggctacgtaggccaacactatttccaaagatgcttggcttgatgtgatggcttcaagccagcgggcccatgtatcagcaccagcgcgcccaggtttggaggatttttgtggatttagggcgcttctggaagcaaaggtcaaatcggtcgttgttgataatgtgatgtactccctcagttctttttatttttcatgttttagtataaaaatgaactaacaaacgacaaatattcgataacgaggtagtatctgtttgccctgtgacgtgtttaaaaccggtgaatttggggatatggtggtgtcacaagggaaaatgcttctccaattatatcactcgataaatactaaacgagaaatgggaactggattgtaaagaacatcgcttcttttccagaaaaaacaaaattgaggtggtatctttgattttgtactcggctgtctt

SEQ ID NO: 3773 - DNA, 1089 bp, Zea mays
gggtacctcgaggccggccggggcccaccgttcgaaaaacgttcccccctgccgtttcctggcgagtctacgcggcgcaacttctccggtcccatcggttttgggtgcgcggccctccttcggcttctcatcgttcttcggtctcttagtgcaagcaaggaagccgttccacgctcctccagcgagctccgtgctgaagcggcaagaaagatgattaatcttttcaaaataagccggccggggtccgatgaggcagcaagtgctactggaaaggcccctgttaagaaacagtctgctggggagctccgtcttcataaagatattagtgagctcaacctgccgaagaccacatcaatttcttttcccaatggcaaggatgatctgatgaattttgagatcaccatccgacctgatgaaggatattacatgggaggcgctttcgttttcacctttcaagtgtccccatcttatcctcatgatcctccgaaggtcaaatgcaagaccaaggtgtaccatccaaatattgatttggaaggcaatgtctgtctgaacattctgcgtgaagattggaagcctgttctcaacatcaacaccgttatttatggcctgaatcttctttttacgcaaccaaacgacgaggatcctttgaaccacgaagctgcagctgtcctccgtggcaacccaaagatgtttgaggcaaatgtgaaaagagccatgaccggaggctacgtaggccaacactatttccaaagatgcttggcttgatgtgatggcatcaagccagcgggcccatgtatcagcaccagcgcgcccagctttggaggatttatgtggatttagtgcgcttctggaagcaaaggtcaaatcggtcgttgttgataatgtgatgtacttctttttattttccatgttttagtataaaaatgaactagcaagcgacaaatattcgataacgaggtagtatctgtttgccctgtgacgtgtttaaaaaaggcccccttgggatatggtgtcacatatgacaagggaaaatgcttctccaactatatcactcgataaatactaaacgagaaatgggaactggattgt

SEQ ID NO: 3774 - DNA, 1058 bp, Zea mays
gcgtcccgttcggccaccccggccgggaccttacttttccatccgcggaacgacgcacgcggacgcctccttgttccgggtcctactcccgccgccttcgcctaaagaggcctcgccctcccccctccggcgaaaaccgattcccttccccgattccctccggcgtttcctggtcccttagtgcaagcaaggacaccgctcctctagcgagctctgttctgaagcggcaagaaagatgattaatcttttcaaaataaagggtcaaaagaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgcgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtgcttctggaagcaaaatcaaaccgttcatggtgtgaaccgtgatgcatctgtttgcccgcctttgtgatgtgtggtatagtggtggtgcataatgacagggaaatgcttctctaactgtatcattcattccataaatcctaaacgaggaatgggaagtggattgtaagcaaaaaaaaaaaaaaaa

SEQ ID NO: 3775 - DNA, 1136 bp, Zea mays
ctcaataaaatatgtactcggccgcccgggaagcggccttccttttccatccgcggaacgacgcacgcggacgcctccttgttccgggtcctactcccgccgcctatagaggcctcgtcctcccccctccggcgaaaaccgattccccgattccctccggcgtttcctggtcccttagtgcaagcaaggacaccgctcctctagcgagctccgttctgaagcggcaagaaagatgattaatcttttcaaaataaagggtcaaaagaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgtgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtacttctggaagcaaaatccaaaccgttcatggtgtgatactgtgatgcatctgtttgcccgcctttgtgatgtgtggtatagtggtggtgcataatgacatggaaatgcttctctaactgtatcattcattccataaatcctaaacgaggaatgggaagtggattgttaagcagattccttctgcagatgttgatgtcgtattcggcggtattcattgtcgcatcttccaggtcgacgttgacatgcacgtctagcggccggcccc

SEQ ID NO: 3776 - DNA, 747 bp, Zea mays
ctcaataaaatatgtactcggaatcggaccaacctgccttccttttccatccgcggaacgacgcacgcggacgcctccttgttccgggtcctactcccgccgcctagaggcctcgccctcccccctccggcgaaaaccgattctctccggcgtttcctggtcccttagtgcaagcaaggacaccgctcctctagcgagctccgttctgaagcggcaagaaagatgattaatcttttcaaaataaagggtcaaaagaaagaggaggcagcaagtgctgctggaaaggcccctgttaagaaacagtctgctggggagctccgtcttcataaagatattagtgagctcaacctgccgaagaccacgtcaatttcttttcccaatggcaaggatgatctgatgaattttgagaccaccatccgacctgatgaaggatattacatgggaggcactttcgttttcacctttcaagtgtccccatcttatcctcatgatcctccgaaggtcaaatgcaagaccaaggtgtaccatccaaatattgatctggaaggcaatgtatgtctgaacattctgcgcgaagattggaagcctgttctcaacatcaacactgttatttatggcctgaatcttctttttacgcaaccaaacgacgaggatcctctgaaccacgaagctgcagttgtccttcgtgacaatccaaagatgtttgaggcaaatgtgagaagagccatggctggaggctacgtcggc

SEQ ID NO: 3777 - DNA, 1040 bp, Zea mays
  misc_feature (1032)..(1032): n is a, c, g, or t
  misc_feature (1034)..(1038): n is a, c, g, or t
ggcgagttggtacccccgccgccggcgcctaaagaggcctcgccctcccccctccggcgaaaaccgattcccttccccgattccctccggcgtttcctggtcccttagtgcaagcaaggacaccgctcctctagcgagctctgttctgaagcggcaagaaagatgattaatcttttcaaaataaagggtcaaaagaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgcgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcgggaagtgcttctggaagcaaaatccaaaccgttcatggtgtgatactgtgatgcatctgtttgcccgcctttgtgatgtgtggtatagtggtggtgcataatgacatggaaatgcttctctaactgtatcattcattccataaatcctaaacgaggaatgggaagtggattgttaagcagctttaaaaaaaaaaaattatacacaccaaaacatacaaaatgaactcaaacatctttntnnnnntt

SEQ ID NO: 3778 - DNA, 1039 bp, Zea mays
  misc_feature (618)..(618): n is a, c, g, or t
atatatgatacatccatccaccattcgtgaggacatcagcatctgtgcgtctcttccacgagaggcaacctaccgtatagtactgccgacatggtgctctccggcggcctagtcgtgccgtggctcgcggcggcggtggcggtggccgcgctggccatcaccgccgccccggtcggcgccgatgcctacaagaactacaccgtcggcgatgacaagggctggtacgacggcctcagccagcccggggtcgactaccaggcgtgggctgacggcaagaacttcagcctcggggatttcctcatcttcaacacggacaagaaccactcggtggtgcagacgcggaacgtgacactgtacgagagctgcgactacaacgactcggggcccgacgacaccgtcgagtgggccgccgcgccgccggagttcagcaaggacgccgtcaccgtcgccgtgccgctcctcgacgagggccgcgcctacttcttctcgggcaactacgacggcgagcagtgcgagagcggccagcgcttcgccgtcgacgtggcccacggccagggcctgccgcctgacctcaggccgcccgtcgccgacgcgccggcgccctcctccggcggggcnccgccgacggcgccgccgcgctcgacttcagccaccccaagaacgtcaccacgccgagcgcgacggacgatgacgacgagcaactgggcggtggctcggcctcctccagcctcaggtccgctctgcccgtgaccgcgacgctgctcatcaccttgctcttcgcgttcgcggtgtaggtggcatgcgttagtttcgcttttgtttgtgctgctgctgcttgggcctcataatttgtttgtttaatgcactagtacagttgaagggtttctctgtatagggagagagatgagatatgtttagtgctgtagtagtgtagttgttagtgaaatgctttcacttgtatattctggctgtttatttggtccgtaccgtgctccgtagtaatggatctcgataaaataataattatctcattctttgg

SEQ ID NO: 3779 - DNA, 1111 bp, Zea mays
gggtaccccccgaggccggccgggaaagccactttctttctccatcactccagccatccccaaccccaactcccttcactgtatatatgatacatccatccaccattcgtgaggacagcagcatctgtgcgtctcttccacgagaggcaacctaccgtatagtactgccgacatggtgctctccggcggcctagtcgtgccgtggctcgcggcggtggccgcgctggccatcaccgccgccccgctcggcgccgatgcctacaagaactacaccgtcggcgacgacaagggctggtacgacggcctcagcctgcccggggtcgactaccaggcgtgggctgacggcaagaacttcagcctcggggatttcctcatcttcaacacggacaagaaccactcggtggtgcagacgcggaacgtgacgctgtacgagagctgcgactacaacgactcggggcccgacgacaccgtcgagtgggccgccgcgccgccggagttcagcaaggacgccgtcaccgtcgccgtgccgctcctcgacgagggccgcgcctacttcttctcgggcaactacgacggcgagcagtgcgagagcggccagcgcttcgccgtcgacgtggcccacggccagggcctgccgcctgacctcaggccgccggtcgccgacgcgccggcgccctcctccgcggggcccgccgacggcgccgccgcgctcgacttcagccaccccaagaacgtcaccacgccgagcgcgacggacgatgacgacgagcaactgggcggtggctcggcctcctccagcctcaggtccgctctgcccgtgaccgcgacgctgctcatcaccttgctcttcgcgttcgcggtgtaggtggcatgcgttagtttcgcttttgtttgtgctgctgctgcttgggcctcataatttgtttgtttaatgcactagtacagttgaagggtttctctgtatagggagagagatgagatatgtttagtgctgtagttgttagtgaaatgctttcacttgtatattctggctgtttatttggtccgtaccgtgctccgtagtaatggatctcgataaaataataattatctcattcttgggaaaaaaaaa

SEQ ID NO: 3780 - DNA, 2791 bp, Zea mays
attatagatcttacaaattttgtatttaaagtttcattaaacccaattaaatttatatcactatataattcactagtttaaactttacaaaactcacctaacccaagcacccccgcacccacaacctcaactaaattcaccaaacaaattacactcaaacaacaaattacactcaaacttaacacaccatcaaaaccaacgatttcgattgctgaatagcccaatcatacatattcaaatctaataaataatattatttgaatcattcattattcatctctcttccttgtgaccgcgccgccctcagcctcccctccccgctgcccctttccctcactcgtgctgccaccgccgccatcaacgcctctcgtgcagccgcgtcggccccttccctctcgtcaaaggatcgtagtgttagtctacgcttgtctcataaaaacaattaacttattattattaacacgaacaccgaacaactcattggagttgttaggggtgcagcgcagcagattcaatgacgggacgccgcaaccgaagctggtcgacgtggcctgctctgctcacatgatctcgtattagcttacaacataacagaacagattagaaactccagctgactgccgagtcccgtggcagcacagcgcggaacatggcaccccctcaactcgacacactcgctcatcttgtggtgcccagcttacccctatgttgctgtggtgaccgcgcgcggcacgccaactccggcagtccggcagagacagtggcattcctgcaatacggcggaatcgcatgccgaaccatacaccgccattactacgctacggcgatgaaacaaagagaggatatgctaccataccaaagccactttctttctccatcactccagccatccccaaccccaactcccttcactgtatatatgatacatccatccaccattcgtgaggacagcagcatctgtgcgtctcttccacgggaggcaacctaccgtatagtactgccgacatggtgctctccggcggcctagtcgtgccgtggctcgcggcggtggccgcgctggccatcaccgccgccccgctcggcgccgatgcctacaagaactacaccgtcggcgacgacaagggctggtacgacggcctcagcctgcccggggtcgactaccaggcgtgggctgacggcaagaacttcagcctcggggatttcctcagtgagtagagtactgcttgcgaacttagcttactccctctctctccctgattccactccacctacatgcatgtgctaatctcagcgatcaactagtcgatcatgtttactaaccgaaatgagtaattattctaatagttacagcagcaggtaggcaggcaggtagctccgcagctagatgaagatgacccaagcaagcaatgactgacccatgggccatggccctttcaggctcagctttgctttttgccaacgcgctctgtttccgttccgttccgtctgggaatctgctcgctttctctgtctctgatgcacatggtctgtgggggtagaggctcgatattatgccactctgttttcaattcaggtcgtcaagttatcagtcaccaccatcacaatggtatcactttgtttgctgtcatttcacgttggaagaacatggccaaagcgtacagcatcaggatgcttttgttgggggatggatctggagtacgaacgaacaactgctagcgcttctctgctagcatgacgattagcactctgtatagccagcccactcagatacgaagagagctgctagcagcagcagcagcagctcagctctctcattagctagctcctcgaccctgactagctagctggtggtggttgcgctcaccagacatcgcagcaattagttagaaaaaaccggtagccattgcatccagctactacatgattggtctgtctcctcctctcctgactagtcagtcccctgacgtagcccccccaacgcaccttcactgtctgcctgcagtcttcaacacggacacgtaccactcggtggtgcagacacggaacgtgacgctgtacgagagctgcgactacaacgactcggggcccgacgacaccgtcgagtgggtcgccgcgccgccggagttcagcaaggacgccgtcaccgtcgccgtgccgctcctcgacgagggccgcgcctacttcttctcgggcaactacgacggcgagcagtgcgagagcggccagcgcttcgccgtcgacgtggcccacggccagggcctgccgcctgacctcaggccgcccgtcgccgacgcgccggcgccctcctccgcggggcccgccgacggcgccgccgcgctcgacttcagccaccccaagaacgtcaccacgccgagcgcgacggacgatgacgacgagcaactgggcggtggctcggcctcctccagcctcaggtccgctctgcccgtgaccgcgacgctgctcatcaccttgctcttcgcgttcgcggtgtaggtggcatgcgttagtttcgcttttgtttgtgctgctgctgcttgggcctcataatttgtttgtttaatgcactagtacagttgaagggtttctctgtatagggagagagatgagatatgtttagtgctgtagtagtgtagttgttagtgaaatgctttcacttgtatattctggctgtttatttggtccgtaccgtgctccgtagtaatggatctcgataaaataataattatctcattctttggaacatgcaaaaaatcgtttcgttagagtttattcaccttgtttaatcgatggg

SEQ ID NO: 3781 - DNA, 867 bp, Zea mays
agcatatatcgcctggcggcagtgcctatgcatgtgcacgcacggcaaacgtactacttgtccgacatcgatccaaccgtcataaatcgagcgggactccatgggccaaggagctgccaaggcgaagcaagcggcggcggcggttgaggaggcagtgcagaaaagccccgagaagaagaatgacgggaagaaggcgctcaaatccagcgacgcagacgcgctcattgagttcatgaggaagaactacgacagcaaggtgaaggatgtgaaggagttcgatgacttctaccacgccatttacgagctcatcgagaaattttgcgaggaacgtgggcagctgcagtacaggataccacccaaggacgagctcaaggaaaagtacgagaggttccacacggggaaggggcggaacgtgacggcgcaggagttcgagagcatcgccagggccatcctcaagatagacagcttcacgttcggcaaggcggccattgacatcctcgtcgtcctcttcggcgtgcccgtgtgcgcgctcctcaccaagaggatcgtcccgggcctcaacgccatatccgacgacatcgtcatcccggcagccacctccggcgccgtcgtctacctcgccaagtccaacaagctctaaataataataataatgtaacccccaccaaaacaaattaagttgtgtatattattacatatatatatcgtccacttgctttccagaaagtaatttcatctattttaccggaataaatgccagtgagctgtgagtctgtgccctgcttggcttgatcgcgtccagaattgtaaaaacgacttaaaaagagttaattcgatcatgacatattataattgttcggtttgtag

SEQ ID NO: 3782 - DNA, 9640 bp, Zea mays
  misc_feature (3184)..(3184): n is a, c, g, or t
  misc_feature (6820)..(6820): n is a, c, g, or t
gacgctgtaggctgggctgtataatgggccgcaccaacggttgggccacacgaaccactgggctgcacgcaggcactgttatgggatttattagattagtaccataccggccactaagacagaccaaacgtggcttataaacgttggcgtggattgtttgttgctcagactaattcctctggtaccgcactaagatgtattttttggcgcggggatgtacgtccacggttgggaggcagaacgggtcggatcgcctggatgaaacgaacggtccagattacccggaggcaaacgaacggtccagattacccggaggcagaaccaggggaggcagcctaccccttgcgttcttaatagatagtatagatgtgtgtgtgtgtgtgctgaaacttgtgagggcacgagagaagcaggattcggatgagggaagggccttttgtccctgtcggtgtagacacgagaaaagctggaggaggagaactggatgtgtgtgcaggacaggtgaccgagtgagtgagtgacaactggccggccctcagttacgaactcggtttttgtactgtagttacaccggtcagtgtcaccagcgcgacggtgaggagccttcagtagacgaccgaccaccggctgccgagtgtcaccgcttggcaccacgcaataatacgtacgagtattcgcagagactctcctcccatccatgatccatatcggccagaaaccatcgatcggcgaactattcccggctcctctcctggacctttacctccgaggctaagcaagtttctttgcgcgcgattcgcatcgtcgcagtcccgtcacggcgtcacgtctcgtcgagcccaggggaagaaaaagggagaggtggggcgcaacgccaatggccacgtcgaaatttcaaggatatatctgatggacatcgaagcttgctgtacataatgcacatattaaattatcaccattcatcttagttttgacgtctcttattgatcattgcaatttaaaaataacatctttcacgactacatcccaccacgttgtagaacgtctttagtaaaatatatcaaacaactaaaaatgttaaattaaaatagataatactgatttaatatatgcaatatatacactaaattcaagtgcaccaaatatattctcttcaaatatacccgcagcacgcggcatgcagcatcgctttcaggcaccgaacgtcgccccaccattgcacacatgacatgagttgacagacatccgaagctgccgcgctgtgctgcctgcccactacgcaccgcccatgcccaggcaggccccagtctgaaacctatgtgccaaagcaaaccattagcggcgcgcggacgctgctctgctgcttaagcttattataaaagcaggcggggggtgctgctgccaacccccccccccaaaccgcgccacccattgttgtcgcttctcacttctcactcaccaaccaacccaaccgagcaacttggctcgtaccgtacgtactacctgctccgacacgccgaggagctagagaggaccgcgcgcgtgctgctgacctgcgggagctaggacagacacgatacgacagataccatgtcgacgacgacgacgaaggcgagcgacccggggtccgcgtggttcggcagcggtgcacggacccggtcggcggcggggataagccacaacgcgcggctcgtcaccaccgcggtcgccgcgttcgtgtccgtgctcggcctcgccctcttcctccacctctacgtctgccacgtgcgccgccgcaaccgccgccgcgcggcggccgtgctgccgacgaccacggccgccgcggcggcggaggcggccccgaagcgcgggctggatcccgcggccgtcgcggcgctgccgaccgtcctctacaggacgcgggcggcgccgacgatggcgccgagtgcaccatctgcctcggcgccgtgcaggaaggcgagctggtgcgggcgctcccggcctgcggccacgtgttccacgtcccctgcgtcgacacctggttcgcgtccagctcgtcgtgcccggtctgccgcgccgaggtcgagccgccgccgccgccggcactgagctcatcggctctgttcgtgcaggcggagaaggtggtgcaggacgccgtcaaggaggaggccggcagctccacgccggagagggggatcggtgcctgcgcgtcgctgatgaagatgctcagcagggagaggccggcgccgcggaggccacacgccgacgccggggacttggacgacttggaacggcagcagcattctgttgccgtcaataattagcctattgttttttattagaaaaaaaaggaaagaaaggcggcctttttagtctggtcgttctccacatcatttgtatatcccgcatttgcgtgagtggtgcagtagtaagacaggtctgtgactgtgagctcttgactttttttgatgaatgtaagagcccatttcaaaagaattggtatggttcgaatctctacaatttagttcaaatttgaactcaatcccttttttttgtccactatatatttcgctcgagtttcgctgcttaattagcaggctgcaaggcatggatgcgaagcttcaagttttttgtcctacacctttgctgtgtgaaaaaaaaagatatgtgaaagtgaaaccatggagtggataaagctatgtgacaataaagttaaagcaatgtggcccatactagagtatgtgctgtatatatatagttccaaaatttcgacgcatatttgtagaccccgaatggagacattaaaaagagtctaggccgtataatgacaggcaaaaaaactccctctcctccgcctgtccgccaattggcgcatctgctttttttttgttactggatgctgtcactcaaacttcactccctctgaattaaagatacgtcgtcagagttcctaatctcaattacagtaaaactcaactagaggaacttaatagaaaccacgcgcatctgctactgctgtatctttgaacagtaaaactgtctgccgttagtttggccacctcgtcgctgacacatgacgccgttctgtcgtttcctgaaacctgtttcttctgctcggttgcagatctgattttacttgttcaagttcacactttgaccaaagtttgtagtatatctagtaacatgcgagagttacgtcgatcanaaatctgaaatgtaccttgaggaaagagccttgatcagccaatagctacaagactttgtgcgatctctttgattctccttttggccttccttgtttcaaaaccctggttcctgggagtgcgtgctttgtacagtacgggccttaaaatccagagtacgcacttgaaagctaattgtcgccgacaacattctcgtgcgatctagaaagagcttaaaattcattttagcacaactcaactagaagcacgcttcacgttttgttgagtaaataaacaaatggttcagtatcccagacagtttctaagacatcaatcacttcacttcagcaagtggtagcatcgtgcgtgcagtgcgtgaccgcacgcgcttatattagatgggccgggtcatgcacattttggacgcactcgtctctaaataaccgcttgtttattaaaaaaaaaggagctgcgaatcgcacgtgagtacgtggcgatggtggccacgtacagtgtaccttactcgccctatataaaagcagtgctgtcatttttacagagattaaaaagaaagaaataaagaaagaaagaacattggtgggtgaacatgatgccgcatccttccggataagcagcgttgtcattttttactagtagagtagtagtacgagtaaggaaggaccagtcgtagaatgcgcgcgtgcgcaagttgactctcgcgccagcgcctcttttccgcgaccagaccacgcatttgtcccagtagcagggtgtggagtcgatcatgcacaggtcctcctgctcctcactcgcaaacgctcactggagtcaagtcaacaccgcagcaccagccaggcagccagccgggggtcagccgtcagcgtcagagagagagggaggaaggaaggaagggaggcggtcggacgcgtcgccgtcgcccaaaaaggagtccagacccgccgcccggttctctgcgcacttgttttacttggagatcttggcatctgcatctgcatctgctggaggaaaagcaggcagccgcgagtgcccgtccgacgcaaaagctgccccctccgacgcgaaagttgcggcgggtgagttggaaagtcgccggcgacgtcgctgtaccgggccgagaaaattcggttgggtcgccggaggagagtgacggcaacgggctgctagactagactggatgggtccggacgatcaggcatccattaattcgtcggcggattcgtgaccgtgagagcattgttccagatcgagttccatttccatgtgggataggatagtgcagtgcagtgcagcctccctcccggtggctgattttgaatgtgcagagaaacgaggcgtctcccgcgtacaccgtggctgtgggcagagcgagataagcatggcgagctagcgtttttgtttttggtttagcagtggccaagttttagtggggaatcggttgttttgtctgtgctccggcggcggtgcaatctgaaccgttcgatggcaggaatagattcggccatcgaagattaaggataaaagcaaaagataagaacaattccatgcttcccacccatgattagtagtactgctactgtgtaatctaaccttattaggctaacactagcagggctaaattaggtagtacaatggcatcgcaccaggacaagtagcagtctgtacagtgttcagactatctcatctgtagagacagcggctgtatgcctgtatcatctgtaattagattacactttttcccctgagatcatgactctttctttctttctttcctggaacctggccggatcggatagagagatttggtgggaagaccggccgtaagagtgacagagaatcaagtaagcaccatgagcgggaccaaaaaaaaaaaaaaaaagatccgcacctaaaagaaacatgtgttaaagacggtatagctttgttacgctgaacaactctagtatagagtttatcatgatgggcaaaaggaaaccagtagagtttatctgaaacgagaggcggactgaacttaacagatgtagcagtcagcaccacaggtgctgcatcagcagagagttagctggctggtgtacgtacatgcaagctggagtcttaattgggagtatagctaatttccaacacgcagatatttgcccacgcatgctcgcccaacttgttccacgatcgatggatggtccacgtcctgaacttggcataaacgacaagagctcttatcggttgggttgggagtaacaaaagcgaggcgtgagatagactgggtggtgggtgccccagccagaaaccgacgggacggtgattagtcgcatcactgagccacacacgtgtctaggaagagccgattgacagaattaatagtcagcggccgacctttgcatagcggccggaacagaatccgaattgcgctcgttcgtttcgcttttactttcaccaaacggcctagcacgccagtcactggcagcagagtctcgagcaggatccagcggcggcggcgaccccccagcatcctcgccgccgactagcccacccgcgtgccccgtcgtcggccgtcacaagccttttttttcttttccgcagctacaccagcgacagtagtgtaaatgggccacccgacacggcccagcacgggctcacataaaaaaccatgacatagattacatcgtgctaggcacactagccacgacacaaattagatagtgggccacaagagagacctacacatggcccatcaagacagtaatcaaactgaagctgctaattctgttcactgcattcgggtatttcaatctgaatctgattcctaccgtttctaaactatgaatctatgatttctgcagttcccgtcgtacactgtatggagcgagcaggtcctgggccagcactacctgtctgcaggatctagataaatcaacagtgctgtgtttgggccaatcctcatgcccacgtgatggcacgacactacccgacgtgtaatagtgtcgtgcttcgtcccgacgaaaatgacacggcatatgatggtctggtctcaggcacgattcattggcaacctatagatgccactcggtttcctactttcctggatcctgaaactcgtgtatcttctaggccctagctaaagtttagttcctatctcatcaactatttaaatattaattacaaatattaaataaagacttaattaggtttaataagtctattttatcttttagtcaatatctgtgtaattagttttataattagactaaaacattcgatgctaaataaactaaactttagttggggcaaccaaacactctaaggcctcgttagttttggctggataagcccattccgtgcctcattccggcaggaacgaatcagtccagtttagaatttggtccagtctcctagagttgttcgtttaacaaacccgcctgattttaattcccatccctcaatcctcggcccggaacgagtccaggtcacctaccttccggactggttccgaatctggaaacgagctggtgacaggaatgagtgacaacctatgattcacttgatcctgggctggctttgttactgactggtttggatcctggctgccgaacagggaaagcgcgcttagtagggagcccgagtggcgagagacagcgacggcgagnaaaaagacggacacacggttagatctctgatcccgaggggatttgcgaacatgctgctgtctgccggaacgatacgggcgcagtggtttttggggcgcaaagctgccaccaaagggtccgttgtttatttacgtagatctctgacacgaaccgcagcgcagactatggaagcaagtgaaggcgcccttccaacctccaggctccagacgaggacacggccgaccaggcgactttcgtttgcttcttgtaccggcagtgctaggcactcacccagctccatctccgccgccgctacctccgattcacctcggcatggagaatcgcctgctcacaagtcaccagtcaccaccaaacaaatcaagccggccatcactcggccatccatggcggtggtccagcagggcgcatcctcgtgacacggcgccctgcatgaaaacgaagctcgtgtcccggcatgtgatcaacacaacgacatgcatgtaatcgctctccctagctaattgcctaaataatcgcttggtttcaagtaccggcggccggcatcacacgatcccacccgtgccactgcccgcgccacggtcgttgcatggcgacagtgacgcggccatttttaggcggcacaacaaccgctcgctggtccgtttctagcgcccgcccgcagtgtcgccacgctcgcggctcgcccaaggcagcaaacgagggaggagcggtggatccgcgggcgggcgggcggacagcggcacgtggacggggattccctgcccacctacataactgcctgcctctgccccttttcagctttcgctgccactcgaaacgagcgtccactccactggatcgctagctagctagctggcgcaggctgtcctcatgttccaaaagtctcgtcccatgtgactgaccctccggttccaattcccatccgtctccatgcccctcgctcgtcctcgccccggcacaagctgcccgcccggctactgcacagcaccactatatataaaaccaaactccagcaggcgccggcgccaaatcgcaagagctagcgagagcacgcactgctggcggcgcggctaagaccgagagccgccgcgcacattgttcgcgcgaggccagccgccggttgcattgcatggcgcagcagctgccgcccaggatcccgaccgaggtgcaccactggcccgaggggggccagcacggcgcggcggcggcgtgggcggacgacttcgccgagttcgcggcggcgcggcggggcgcgcaccgcaggtcgctcagcgactcggtcgccttcgtcgaggtggcgccggccgacggcggggccggcgagttcgaccggctcgacgacgaccagctcctgtccatgttcccacccgacgaggccggcggaggcgggtcgtccgcggccgggtccgagaacggcggcagcagcgacagcgacggcgataagcgtggcgcgcgcggcggcccggcgggaggcgctccctccaccggcagtggcggcggcgagcagaacggagtcgtggatgcgcaagcgccggcggcgactggaggacaagctgccgtcgtcgcctccacggagctcatccgggaccctaagagggtgaagaggtgagcccgatcgaacgagctagcacaccatgcgtgcgccgcccgtaattgtgcgcaggcaaacaatgcgtttctcctgcaggcggtaggtaatccatcttgatctgtggactgaaacgcggccggcgggcttgaaattctggcaggatccttgccaaccggcagtcggctcagaggtcgcgggtgaggaagctgcagtacatctccgagctcgagcgcagcgtcacaacactgcaggtacgtatacacgcacaattactatacataatatcgatagtacgtatatgaagcttctacgactgcattcttgctcagcgtaaataatccaattatattctaccttcagcgtaaacactagcatgcatataataatggacattgcgcaagaaattactacgtacatacatgtgcaattgtgcaagcacgatttagcagctctccgtcaaacgtcctagatcgataaggacgcgcgcgcatgcatgatgcatttgcatccatgccgtggaacaaaatggtctgaaaaaaaaaacttctcttagacgattatggcgggaagcttcagctcgagatgagatgttattcggtctctgcaagcccagaaattctgatagattcagccattgtaataagggtaccctgttattaatgtaaaagaaaagaaagatagaaggagctagatacactgtcaaaaaaagtcgtgtgcaccaacactaagcaccaccgccgattgtcaagcccagacctgcaaaacgaccctacctctagaacgtgcattctcacttgatgcatcaacatcccctcacgaccgatatcataatccacggacgtatatagagtaacttctcttcgtttcagcacatgacatgcgtagtaggcgccaacagcaggggtagatggatggatagatagatcggcatgcagcgcacagtctggctagcattagcaatagcaacagcgtcgcgagtgatgccttgccccccatgtgcatgcgtgtgaaggccggccggccggtatggatcatagaagcaaagcaataaggacgcgctctcctagcttctcccgtgtcctgtgctgtgcatgcgcgcggtacgtaccaaaccccacgtagtgccatgatccaagcgcacatgcctctgcatcctgcatggcctggaggtggtccctgtgtgtctctctctgcgtgtgtgtgtgtgtgtcaccgtctcaccgagctgg

SEQ ID NO: 3783 - DNA, 2117 bp, Zea mays
cggcccggggtcgcacgcaagcgcaaatggctctaaaaaaagtccagttccaaacctagactagactcctcaccgaggcgacgacgcaagcagctcagcgcgccgccgctgccccgtcccgtcccgtcccgcgccacgccggcgcctcccaccccgtgcgcgccggatcctcgttccacgcgccgcggcgccgcccctggaccggtcgagaggagcggagatccatccatccggccgtcggtcggtgtcgtcgtctgtcgttggctgtaatgaaaagctgggcctgctagagccaggagttttcgttgcaaatctgcgtctccgctatgggttcaggcaacttgatcgtgaagaaggtggtaaagcacagctcttttgatctggacattcagctcgataagagttggatggaggacgttacctgcccgatctgccttgattaccctcacaatgcagtcctactgagatgcacatcttatgagaaaggctgcaggccgtttgtttgtgatacagaccagacccgttccaactgtcttgagagatttaaatctgcatatgaactgccttccaatgcgaaagtttcatcttttgccatgcctcctctcgatagcatcattcatattgtgccatcgaacgcaaacaaccgccccagctgccctctgtgtaggggtgatgttattggatggattgttattggtgaggctcggcagcatcttaatcagaagaaaaggtgctgtgaagaggattgctgctcgtttgtcggtaacttcaatgagcttcagaagcacacgcaacaaaagcacccggattcacgcccttcagagattgatcctgctagacaagttgattgggagaatttccagcaatcttctgatattgtagatgtcctgagcacaatacatgcacaagttcccaatgggatagttctgggagactatgtgattgagtatggagatgatgacaatggtgaggactatgaagttttccgcggtgtcaggactcactggtggtcatgtatattctgcaaggcgttttcgagatcttcaagaagtcgtagaagagcaagggaaagaaggggcagtggaaggaggattgggaaccaagctaatcttgaaaattttaacatcgaggttccagcacaatctgttgaattaagggaaattagatttgatgaaattgatgatgaatacatagtcacaggggccattcctagtatggcaacacctggaagaatggctagtttccattacaggtatgcataagtaatcttttttccctcccaattttgctcacatctgttgggagtaatgctattgcaaatgtgtagtactaagaaccaaaggtccttaaaaaagacaaaacacacacagttgcacaaagggctcatgatattccaaacaaaatccttaacatagatgttctacattgcaaaacatgaaagacgagcataagtatgtccttgtcatacatctatggtcccaacttgagctgttcagctgtatatatatatatatttaatcatatcttactctttggcatgttccttgtcgcacctggtggtgttaatgtgcattgatgaatgcttcatctggatcacattatttattctgctctatataatcagtatactatctgttggatattatatttatcttttaacggaactctgacaaaatccaatgcctcatatgcttctgtggatgtagggacacaagatacggacgttgatgcatagaatctgcagtaaaaaagaaaagaaaagaaaagaaaggaaatagctgttacgcgatgtaccgatcatcataaccatcgtacccgccccgcccatttgaattccttttccgagcctttcctcggtaggtgctgccgccgcagttcaaacttatctgtgcataaaaaaaaaagtagtagcaacagaagcccgccctggtcgttcgaaacaggcctcatcaccctagtttctattttgtatatatttagcacccatccatataggatgttggtgacagtttattttttccttttaattttttggaatgcgtcttggatttggatgtagcgcacgcagctttacataaaaacctggaaacaaacttcatccaaaaaaaaaaaaaaaa

SEQ ID NO: 3784 - DNA, 1607 bp, Zea mays
cccctcccctcccctcccctcctttctctccactcgtcgcacgcaagcgcaaatggctctaaaaagtccaactccaaacctagactagaggcccctcaccgaggcgacgacgcacgcagccgagcgccactccgccgccgccgcctcctcctcgtccccgtcccgcgccgcaacggcctcccccaccctgcgcccgccggccgcccctcgacgggtcgagcggagcggggaacccatccgtccggccgttggtcgctctcgctcgtctggtgttggttgtaatgagaagctggacctgttaggccgaagagttctcgttgcaagtctgtgcctcagcgatgggttcaggcaacttgatcgtgaagaaggtggtaaagcacagctcctttgatctggacatacagcttgataagagttggatggaggatgttacctgcccgatctgccttgattaccctcacaatgcagtgctactgaggtgcacgtcttatgagaagggatgcaggccgtttgtttgcgatacagaccagacccgctcaaactgtcttgagaggtttaaatctgcatatgaactgccttccaatgtgaaagtttcatctttagccgtgcctcctcttgatagcattattcatattgtgccgtctaacgcaaacaaccgccccagctgccctttgtgtagaggtgatgttattgggtgggttgttattggtgaggctcggctgcatcttaatcagaagaaaaggtgctgtgaagaggattgctgctcgtttgttggcaacttcaatgagcttcagaagcacacgcaacaaaagcatcctgattcacgcccttcagagatcgatcctgctaggcaagttgattgggagaatttccagcaatcttctgatatcgtagatgtcttgagcacaatacatgcacaagttccaaacgggattgttctgggagactatgtgattgagtatggggatgatgacactggtgaggactatgaagttttccgcagggtcaggacgaactggtggtcatgtattttctgcagggcgttttcaagatcttcaagaagtcgtagaagatccagagcaagggaaagaataggcagtggaaggaggaatggcaaccaggttaatctagaaaattttaacctcgtggttccgacacaacctgttgaattaagggaaattaggtttgatgaaattgatgatgaatacatagtcacaggggccattcctagtatcgcagcaccgggaagaatggctagtttccattacagggatacaagatatggacgttgatgcatagggtctgcagtaaaaaaaggaatagatgttatgcaatttaccgatcaacgtaacgttgtaactccgctcatttggattccttttccacctgccctcggtaggtgctgccgcagttcaaacttatctgtgcataaaaagtagcaacagaacctcgctgttcgtttgaatcaggcctcgtcattctagttcaaaaaaaaaaaaaaaatagcacccgtctctataggatgttggtgacagttcttttcggaatgcttctgcgatgtagcgcggttttacatagtaaccctgaaacaaacttcagcccgctcc

SEQ ID NO: 3785 - DNA, 1987 bp, Zea mays
tccaaacctagactagactcctcaccgaggcgacgacgcaagcagctcagcgcgccgccgctgccccgtcccgtcccgtcccgcgccacgccggcgcctcccaccccgtgcgcgccggatcctcgttccacgcgccgcggcgccgcccctggaccggtcgagaggagcggagatccatccatccggccgtcggtcggtgtcgtcgtctgtcgttggctgtaatgaaaagctgggcctgctagagccaggagttttcgttgcaaatctgcgtctccgctatgggttcaggcaacttgatcgtgaagaaggtggtaaagcacagctcttttgatctggacattcagctcgataagagttggatggaggacgttacctgcccgatctgccttgattaccctcacaatgcagtcctactgagatgcacatcttatgagaaaggctgcaggccgtttgtttgtgatacagaccagacccgttccaactgtcttgagagatttaaatctgcatatgaactgccttccaatgcgaaagtttcatcttttgccatgcctcctctcgatagcatcattcatattgtgccatcgaacgcaaacaaccgccccagctgccctctgtgtaggggtgatgttattggatggattgttattggtgaggctcggcagcatcttaatcagaagaaaaggtgctgtgaagaggattgctgctcgtttgtcggtaacttcaatgagcttcagaagcccacgcaacaaaagcccccggattcacgcccttcagagattgatcctgctagacaagttgattgggagaatttccagcaatcttctgatattgtagatgtcctgagcccaatacatgcacaagttcccaatgggatagttctgggagactatgtgattgagtatggagatgatgacaatggtgaggactatgaagttttccgcggtgtcaggactcactggtggtcatgtatattctgcaaggcgttttcgagatcttcaagaagtcgtagaagagcaagggaaagaaggggcagtggaaggaggattgggaaccaagctaatcttgaaaattttaacatcgaggttccagcacaatctgttgaattaagggaaattagatttgatgaaattgatgatgaatacatagtcacaggggccattcctagtatggcaacacctggaagaatggctagtttccattacagggacacaagatacggacgttgatgcatagaatctgcagtaaaaaagaaaagaaaagaaaagaaaggaaatagctgttacgcgatgtaccgatcatcataaccattgtaccccgccacgccccgcccatttgaattccttttccgccgttcctcggtaggtgccgccgccgcagttcaaacttatctgtgcataaaaaaaaaagtagtagcaacagaagcccgccctggtcgtttgaaacaggcctcatcaccctagtttctattttgtatatatttagcacccatccatataggatgttggtgacagtttattttttccttttaattttttggaatgcgtcttggatttggatgtagcgcacgcagctttacataaaaacctggaaacaaacttcttcccgctccgctcagctctaaaggatttgtttggagacgacctgtgtctctgggcagtgcttcagatataagggcttctgagccgtgcatcacattcacagatgcatgcggtatgtgtttttgctctggataagataccatcttgggcttaatcatttgtcggttgtgctcacgagctgaagcccttcagacagttgtctggaaagctacatgccccccatccaacgatccagtggtgcttcaccggcatagcctctggtttcttccacgctatctccattacttcggtcgattggatccatggcgatgctgttcaatttgtttacgatgacaccgctcggagacgttacgaactgagatgagcagggaaggaaggtacgttacgtg

SEQ ID NO: 3786 - DNA, 3071 bp, Zea mays
  misc_feature (707)..(707): n is a, c, g, or t
taattacctcgttgctgaagttttttaggcccagaggaactattcaacgtgtttgaagaaaagattactgccacaaagtataaaaaacacaaatttagtccttttacataccaatgatgcagtaatcttgaaaagtatgttggtgctgaggctctgacaatgcttacctctatgtattaatcaattgttcgcacgctgcatttcatgcgctttgtccacaggaactgatctaaagaaactataaaacacgaagggaaaaggggtgaaaatctgggaaaactaatagaaatacgagcagatcggctagaaatgaaatgggggtagcaatacgagcactacaacttttttggctgttattatctaattaagcgaacacagtgatcttcaaagcattagagtatggtaaaataatcaaacttacttcttgtgtttttttatatactacatctttgttacagcaagaacccttgctcgttgttttcaatctgaagtaatatttaaactgcgtaatttcaatcggtaagaaattgatttgagtaatattgatggttaaagaagctggaagttttaaacctgaagaacagaacttcatacattgaaaatgctaagtaggctgaagggtatgaagatcgtggtataatgttattctgctagacaataatttattaagagcctgtttagtttatgtggctgctcactgcagcgtntatgaggcaatgaaaaaatgatgttatagctgtgataacttttggtggtggaaaaaaaatgggtagaccgtagcaacctgtggcgtggtggagtttaccgctaatccaaatggtctggcgtgccacctatatagcgaggcagttgagatagcgaaccaaacagcccctaaattattagataatgaatggaagtggctgaagtaatctgcttatacaatttctgatatagatatcatatggcataccttgctggcatttaaacaaacaccttgaggggatggacacactacgtcaggtgcacttgtgatctcaccaccttttcttcttccaggaagacagaatcaccaaatgtggtagtagtggagtatggatgagagaggggggggagcggctcaccggaaggacaagcggcgtgtggctgtgatggccgagcgacgagcgcgctcgtgtggcaaagcggggaggaggaggcacgcgacggagatgagcgtggaggagacgcactgggtggttcgagcggcgcttcctcctgaggaagcgagagagcgacgaggcaaacctggacgcaccggtggctgacaggacggtcagcctccagcaccagctgctccggggcaggtagttcgtgggtatgagcttcctcagccacccgcgccggcgtgccgggcctgggaccaccgccactgccgtctcgacggtgtcgctagagcaaatgggaaggagaagcccctggccgagcaggtaacggctgtgcgcacgggttgcggacgggaggacggggacaaagcagcgccgagcgagcatggagaatgtaacacctcttgtgtcattggagagagctggcgagatttttgagcaggtgacagaagcctagaatcatccacacacgcgataggcacgggaaccatcgaacggccaaagagaatgatcgaacggcgaaagatttcttgccgacgtggactaacgtgagagcggcaatccttcctgctttcatatccagcatatatcagtctcaacagaacagaaaagaacagctgcgactctccagtctccacgccaccgaactccgaagaggtcacctcccctcatggcctcatcacagcgcctcctcacctcgtctgtcctcttcctctcgccccttatcttactcgtttacgtttcttctcgtggggagagagaaacagcagggctagattagataccacagagagagagagagggagggtggagaggatggcttcgctgcagagccagagcctgctcggcattggctgcagcagcatcgtcttggcacgagcgagggtgcagcagtgtctggcagcggcgtctcgctcacacgcgcccttcctgcaggccaatggaggcaggacgggcctcccctcctcctcgatccttaacgctggcaatgcgatcagcttcagccggcggagaaggagggaccagcgcgtcgtcgcggaggcggccgcggcggggccgaccaaggtcacgccggcctcgtctggcggcgtcagcatcagcgacgtgctctggccttctgccggagcattcttggccatggcggtactggggaaaatggaccaggtggtggcgttcaagggagtatccttgacgattccgccgctgggagcagtctgctgcgtgcttttcagcgctccagactcgcctgcagccaagaaatataatatgttcgtcgcccagatcggttgtgcggctttgggcgtattagccctgtcgttgtttgggcctggctggttagcaagaggtgcagccctttcagcctgtatagcattcatgatcatcacgggtgcctcacatcctccagctgcaagcttgcccctcctatttatcgatggcccgaagtttcacagtttgcaactttggtacgcgcttttccctggagctgtaggttgcatcgtcctttgcttgattcaagaggtggtggtttacctgaagaagaacatcaaattttgactcaagtatcttgactctatggattcttgtggcagtgattctattaattattcaatcatgtaccataaattacattgccaacatttgccaagcatgttcggttgtcctgcagctgtaatccatagagataaaatattgtaaaatacacaaccacagtcggattaaagtcgcagcaagccgtagggaacatgcggaaagttgtgaaaatgaaggcctcctatctcttgtattagttaaagaagaaagaggactttccttgataccttgtgctcgtcaaaatgcagaggacacaaatgtgtatataccattatctctgtcagtgtggacgcattaacccttagtgatgttttggtaattaatgacaagtatttgtggacaaaaaaaaaaaaaaaa

SEQ ID NO: 3787 - DNA, 1257 bp, Zea mays
ctcattacagcgcctcctcccacccacccaagagctcaccttccccgtcctctcgcaccttatcttactcgtttaaatacctgggtttcttctcggggggagagagctagagaaagcgtagagctagtcagagagagagagagagagagagagagagagagagagagagagaggcggggggcgggaggatggctttgctgcagagccagagcctgccaggcattggctgctgcagcagcagcatcgtcttggcacgagcgagggtgcagcagtgtctggcagcggcgtcgcactcacaggcgcccctcctgcaggccaatggcggcagggcgggcctcccctcctcctcctcgatccttaaggctggcaatgcgatcagcttcagccggcggagaaggagagacctgcgcgtcgtcgcggaggcggccacggcggggacggccaaggtcacgccggcctcgtctggcggcgtcagcctcagcgacgtgctctggccttctgccggagcattcctggccatggcggtactggggaaaatggaccagatggtggcgttcaagggagtatccttgacgattgcgccccttggagcagtctgctgcgtgcttttcagcgctccagactcgcctgcggccaagaaatacaatatgttcgtcgcgcagattgcttgcgcggcctttggcgtattagccctctcgttgtttgggcctggctggttagcgagaggcgccgctctttcagcctgcatagcattcatgaccatcacgggtacctcgcatcctccagctgcgagcttgcccctcttgtttatcgatggccccaagtttcacagtttgcagctttggtacgcgcttttccctggagctgcaggctgcatcgtcctttgcttgattcaagaggtggtggtttacctgaagaagaacttcaagttttgactcaagcagcttgacgctatggatttttgtggaagtggtccgattaattattcaatcatgtaacataaattacattgcctgcatttgcgataaagttgtgaaaatgaaggtttactgtctcctgtcttggttaaagaagaaagaagactttccttgataccttgtgctcatcaaaatgcagttgatacaaatgtgtacataccattctcccatcgaataaagtctgacaatttattcctttttccttctggtagcatcaatcctgtaatgtaattgggcaaagtgaaataaccaggaatactttgtgataaaaaaaaaaaaa

SEQ ID NO: 3788 - DNA, 1710 bp, Zea mays
atttctgttcaaaatgtggtaacaatatctaacgttggttagaatattcaattaccacaaattttctgaattctatgcaatttaaacaataaattaatccacgttggtttcataattaactgaaaaattgcataaaatactgaataaagtaccaaaagtacgcagcggaataaaatagtccataaatatatctgtaattttctataactggaaaaatatttctaagaattttctgcactgtttctaatttctggaaatagaaaaacaaattccagaaaaaaattggagccatttcggcctggccaaccacccggctcggccttgttcggcccacctcgggtctggccatgtggcccagccgcgcgctggcggcccatgagaggagagggcgcgcgcctgggctgcaacctaggcccaggccgcgaagtcagcccatgcggggcgctaccccaccccgtctaaatcctggccgtgcagccggatcgacggtccagattcttgcgcgcatgcgcacgagaccattacctagaacatcctaatcgaaaaaaaaaccctaaacattctactcctgtatcccagccgccacaaacagccagccggccgtcaggatttctccttgcgttcctgcatggctgcatggccactaacagactgccggccgccaggagctatccatgcatttctgcatgggcctcatggccgagctatgctcaagtgccgcctctgattcccttttttttttaattttcttctccccagccgctgctccactcggccgccagggagcatcacgcttgtttctttctctgattctttgtctgcgcagccgctagagcacagagctactggccgaacgtgcccgagtacggccgttcctgcgcgctgtctctttttcttttttttctttctttcactgtttactgattttggagattactaacgcacggttggcttcaatgaaccggagatggccggcctgagccgccccgcatccccatcccgccgacgtgcgcgtcccttcgggtgggcgcgccgtcgtcggatgggtgctgcgcggtggttgaggcccagtccgacgagttaagaactgcggcactgttagccgtcgtctgcgaacctctctctccccaggatctatcctcaactcgatccctcaagtgattttgtaacagagtcgagttttggaggtaaagaatcatagatctgggtcccgcgatatttctgttaaaatctgtgatgattttagtgcatctgtacacttttgattcacgcggtttttgaaaaaaattagggttctaaccctagcttcgttctgtacgacttttttctgatctgttcttgaccgtgaattaaaaaaatcacgagtccctgtttacaggtgtaccgattagggttaggtcataaatcctaaccctagacagttatgtgacctctctctggtttgaggccttacagtgaccaaacctaaatctcagggttgaaaaccctaacccgagagcatcgacttctttctgttctattatctctctgatcttggtgatgaacaataataaaaaaatgagctcaatcacattaatcgggacctttctgtgatctcataaaaccgatgtggattaggagttctagggttcttaggatgctccgataccattgttagaatctatactgtctaggatcgattcctaagtccctagaataccaatccgtaac

SEQ ID NO: 3789 - DNA, 682 bp, Zea mays
  misc_feature (654)..(658): n is a, c, g, or t
ctgtgcggcgctcgaggccgccgggctcactagctattttctgtattctcttcctgccggccgccagagagatcgccattttgactgagtccctttcgtttctgtacgccgtcagggagctttctccggccgccgttctactcggttgccagggagaaccagccgttggctgaacctggccactaatttcctagccgagcccaggcaactgaccggacgaccgtcgatgaatcggccggcagccatactcggctgttcagtctgcgcggcgaagcggggccctgcgggctctcccgccggcgtgcgcgtcccctagtgcgggcgcgccgccgtcggtagagcggtcagcggtggtccctgcaaacccggctaaatctgttgttactgtgactttctgttttctcgcccggatctagcctctatctcgaatccctctgagtgaatgaatgtatgaaatgaaactatatgtaattttgggattgagtatggaggtctaaagtgtggatctggttccctttgcgttttcccctgtgattcacgcttggatccagtctctggattaaacgaacattgctctgtgcaatttgaccgatccggattttagggttaaatcgattaaggttgaaccctaactcgttctgcgtttctgttaannnnnaaaaaaaaaaaaaagggcggccgc

SEQ ID NO: 3790 - DNA, 1708 bp, Zea mays
agcactcactcacgcccggccctgcactgcacgcgcgcggcgggagatcgagaagagactttgctcggttttggtaggcatccgcgcggagcgtgaccagacggtgtagagactacatagatcggaagggggtcggaaggggatctagacatagagactagagagcgaggaggatgaccggcgttgttgcaggcgccggagggggcaacaaggcggcgcccgccacgctgcggctgcaccactaccttgtgatggccggggtggcggcggcggtcgtcctcgcctgcctccggtacgcgccggaccccgcggggtacggcttcctggccgtggcgccgcggccggtggaggccgatgctggtgcccggcgggacaccactcctccaccgcgcccgtcgtcgtcgtcggtggtcatcttcaacttcggtgactccaactccgacacgggcggcatggcggcggtcaacgggatgaacattaacctgcccgagggacgcaccttcttccgccgccccaccggaaggctctccgacggccgcctcgtcatcgacttcatctgtgagagcctgcacacgcctttcctgagcccatacctcaaggcgctgggcgcggatttcagcaacggcgtgaacttcgccatcggcgggtccacggcgacgccggggggctctcccttctcgctggacgtgcagctccatcagtggctctacttcagggccaggtccatggagatgatcaacctaggacagaggcctcccatcgatcgcgaaggattccgaaaggccatctacaccatcgacatcgggcaaaacgacgtgtctgcttacatgcacctgccctacgaccaagtgcttgccaagatccccggatttgttgctcagatcaagtacaccatcgagacgctgtactcgcacggggcccgcaagttctggatccacggcacgggcgcgctgggctgcctgccgcagaagctggccatcccgcgggacgccgacgacggcgaccagctggacgcccacggctgcctcaagacctacaacaacgccgccaagcgcttcaacgcgctgctcggcgacgcctgcgcccagctccggcgccggatggtggacgcggcgctcgtcttcgtcgacatgtacgccgtcaagtacgacctggtggccaaccacacgacgcacgggatcgagaaacctctcatggcgtgctgcggctacggcgggccgccgtacaactacaaccacttcaaggcgtgcatgtcggcggagatgcagctgtgcgacgtgggcacgcgcttcatcagctgggacggcgtgcacttcaccgaggccgccaacgccatcgtcgccgccaaggtgctcaccggcgactactccacgcccagggtcaccatcgccaaactcgtcaactccacgctgcccaacgacgactagctggctggccgatcgatcgatcgtcgcgtcgtcattctgataaacatactgcaggcaggcttcatcgatccatatccaattgtccgtagaaatctacgactagctcattgtagatccgtaatgtgggctaagagatgcatcatgcatggcgatcgactagctgcccaactcgtcaagagctggttcaccgctctcgtcatgatcgagctagtttggacgagcaaattccatggcaccgagtaacacaattgatatcctcattggcaaaaaaaaaaaaaaaa

SEQ ID NO: 3791 - DNA, 925 bp, Zea mays
cattgggaccctcgaggccggccgggaacctcatctgctgcatgccgcctatacatacattgggtgcctcgaggcccgccccggcactgcactgcacgggcgcggcgggagatcgagaggagactttgctcgcttttggtgggcatccgcgcggagcgtgaccagacggtgtagagactagatagatcggaaggggatctaggcatagagagcgaggaggatgaccggcgttgttgcaggcgccggagggggcaacaaggcggcgggcgccacgctgcggctgcaccactaccttgtgatggccggggtggcggcggcggtcgtcctcgcctgcctccggtacgcgccggaccccgcggggtacggcttcctggccgtggcgccgcggccggtggaggccgatgctggtgcccggcgggacaccactcctccaccgcgcccgtcgtcgtcgtcgtcggtggtcatcttcaacttcggtgactccaactccgacacgggcggcatggcggcggtcaacgggatgaacattaacctgcccgagggacgcaccttcttccgccgccccaccggaaggctctccgacggccgcctcgtcatcgacttcatctgtgagagcctgcacacgcctttcctgagcccatacctcaaggcgctgggcgcggatttcagcaacggcgtgaacttcgccatcggcggctcgacggcgacgccggggggctctccattctcgctggacgtgcagctccatcagtggctctacttcagggccaggtccatggagatgatcaacctaggacagaggcctcccatcgatcgcgaaggattccgaaaggccatctacaccatcgacatcgggcagaacgacgtgtctgcttacatgcacctgccctacgaccaagtgcttgccaagatccctggattgttg

SEQ ID NO: 3792 - DNA, 582 bp, Zea mays
agaaccctagctattttctgtattctcttcctgccggccgccagagagatcgccattttgactgagtccctttcgtttctgtacgccgtcagggagctttctccggccgccgttctactcggttgccagggagaaccagccgttggctgaacgtcggatcctctctccctttttttttctttgtttctagtagctggccgctagtttctcttcaactcattctttttttttggttctagcagctggccactaatttcctagccgagcccaggcaactgaccggacgaccgtcgatgaatcggccggcagccatactcggctgttcagtctgcgcggcgaagcggggccctgcgggctctcccgccggcgtgcgcgtcccctagtgcgggcgcgccgccgtcggtagagcggtcagcggtggtccctgcaaacccggctaaatctgttgttactgtgactttctgttttctcgcccggatctagcctctatctcgaatccctctgagtgaatgaatgtatgaaatgaaactatatgtaattttgggatggagtatggaggtctaaagtgttggatctggttcc

SEQ ID NO: 3793 - DNA, 2322 bp, Zea mays
  misc_feature (250)..(250): n is a, c, g, or t
  misc_feature (321)..(321): n is a, c, g, or t
  misc_feature (345)..(345): n is a, c, g, or t
  misc_feature (483)..(483): n is a, c, g, or t
ccacatagcggtttaatctgtcttgtctgaccaactagtagccagaatatgcacttttgcaaagtaaaacagaaaatatttaggacgtctgaagtaaatactgaaacataaaacttgcatgaattaaatattcgacgttgatcaaataataatcatgtctgatctacaaattttctagttctaaaattctaaaccatcgttggatgatctagaaaacttaattcttgtataaaatgtggcaacaatattngacgttggtcaaaatattcaatcaccacaaaaaaatctgaatttctatgcacttaaagagaattaatccangtaggcttcataataaacaataangcatagaaaaacaaataataatctggttctaaaattctaaaaccatcgttggatgatctagaatatgtatacttctgttccaaatgtggtaacaatatctaacgttggttagaatattcaattaccacaaattttctnaattctatgcaatttaaacaaataaattaatccacgttggtttcataattaactgaaaaattgcataaaatactgaataaagtaccaaagtacgcagcggaataaaatagtccataaatatatctgtaattttctataactggaaaaatatttctaagaattttctgaattttctgcactgtttctaatttctggaaatagaaaaacaaattccagaaaaaaaaaattggagccatttcggcctggccgaccacccggctcggccttgttcggcccaccccgggtctggccatgtggcccagccgcgcgctggcggcccatgagaggagagggcgcgcgcctggactgcaacctgggcccaggccgtgaagttagcccatgcggggcgctacccccaccccgccgaaatcctggccgtgcagccggatcgacggtccagattcttgcgcgcatgctataaaaggcggagatctcggtgccggtggaaaaaaaaaaaccctaaaacattctactcctgtatcccagccgccacaaacagccagccggccgccaggatttctccttgcgttcctgcatggctgcatggccactaacagactgccggccgccaggagctatccatgcatttctgcatgggcctcatggccgagctatgctcaagtgccgcctctggttccctttttttttttttttttaattttcttctccccagccgctgctccactcggccgccagggagcatcacgcttgtttctttctctgattctttgtctgagcagccgctagagcacagagctactggccgaacgtgcccgagtacggccgttcctgcgcgttgcatgctcctatctctctcttttttttttctttctttcactgtttactgattttggagattactaacgcacggttggcttcaatgcaccggagatggccggcctgagccgcctcgcatccccatcccgccgacgtgcgcgtcccttcgggtgggcgcgccgtcgtcggatgggtgctgcgcggtggtcgaggcccagtccgacgagttaagaactgcggcactgttagccgtcgtctgcgaacctctctctccccaggatctatcctcaactcgatccctcaagtgattttgtaacgggatcgagttttggaggtaaagaatcatagatctgggtcccgcgatatttctgttattttctgtgatgattttagtgcatctgtacacttttgattcacgtggtttttgaaaaaaattagggttctaaccctagcttcgttctgtacgacttttttctgatctgttcttgaccgtttattaaaaaaaatcacgagtacctgtttacaggtgtaccgattagggttaggtcataaatcctaaccctagacagttatgtgacctctctctggtttgaggctgagacacactgtgtctcttacagtggtcaaacctaaatctctagggttagggaaaaccctaacctgagagcatcgacttctttctgttctattatctctctgatctcggtgatgaacaataataaaaaaaaataagctcaatcacattaatcgagacctttctgtgatctcataaaactgatgtggattaggagttctagggttcttaggatgcctctgataccattgttagaatctatgctgtctaggatcgattcctaagtccctagaatacaaatccgtaactgaaagtaaaaccttgatgacgtgtagatctgatctactgatctactgagaggaacggggaaacataccttgttgttgctgttgctatcttcatattgttgccctgcagagaagcagcaggcatcgtgatccgagccactt

SEQ ID NO: 3794 - DNA, 1430 bp, Zea mays
caccttttctttttcaagaggaagtttttaccatgctacagtttgttggacagatctacaattgggttttggcatgcaggtgagagcctgcacacgcctttcctgagcccatacctcaaggcgctgggcgcggatttcagcaacggcgtgaacttcgccatcggcggctcgacggcgacgccggggggctctccattctcgctggacgtgcagctccatcagtggctctacttcagggccaggtccatggagatgatcaacctaggacagaggcctcccatcgatcgcgaaggattccgaaaggccatctacaccatcgacatcgggcagaacgacgtgtctgcttacatgcacctgccctacgaccaagtgcttgccaagatccctggatttgttgctcagatcaagtacaccatcgagacgctgtactcgcacggggcccgcaagttctggatccacggcacgggcgcgctgggctgcctgccgcagaagctggccatcccgcgggacgccgacgacggcgaccagctggacgcccacggctgcctcaagacctacaacaacgccgccaagcgcttcaacgcgctgctcggcgacgcctgcgcccagctccggcgccggatggtggacgcggcgctcgtcttcgtcgacatgtacgccgtcaagtacgacctggtggccaaccacacgacgcacgggatcgagaaacctctcatggcgtgctgcggctacggcgggccgccgtacaactacaaccacttcaaggcgtgcatgtcggcggagatgcagctgtgcgacgtgggcacgcgcttcatcagctgggacggcgtgcacttcaccgaggccgccaacgccatcgtcgccgccaaggtgctcaccggcgactactccacgcccagggtcaccatcgccaaactcgtcaactccacgctgcccaacgacgactagctggctggccgatcgatcgatcgtcgtcgtcattctgataaacatactgcaggcaggcttctcatcgatccatatccaattgtccgtagaaatctacgactagctcattgtagatccgtaatgtgggctaagagatgcatgacgatcgactagctgcccaactcgtcaagagctggttcaccactctcgtcaggatcgagctagaatggacgagcaattccatggcaccgagtgacacaatttatatcctcattgactagtactagtagtcgtactagcaaaaagaaaacagggttgggccaactgagtgattctgtggggttaggcctttgaggcttttacatgcaattcgtacatgtgtgtgtgtgacatttacagtttttttttaaaaaaaattaggaaatccgatcaatgggtggagggaatgcgacaacatcaaaaagtttacgtaaaatccattaccttaaaaaaaaaaaaaaaaa

SEQ ID NO: 3795 - DNA, 2330 bp, Zea mays
  misc_feature (507)..(507): n is a, c, g, or t
  misc_feature (1784)..(1784): n is a, c, g, or t
caacgtaccttgtatctcaaaaaacagctgacacgtctccatgacccctgcacttggaaatttacctagctgtggtagagagagctgtccaaatttttacatgacagcgacgcaacacgaacgtaattactagttttttaagagccaggtgtccgatcctttaccgtctgcatctcttttgatccaacccaacaagcagataatcctatataatatattggctgctctcactgctggtggacgcggaaaagattgatgaatgcaggagcgccagcgcctagctagcttgcttgctagtgataatcacaattaatggtagtgtatatatattggtatgacatcgcaaatcatcacgcactttacacagtgagtgaccgagtagtatcaatgcaggtgtatcaattttagttttcttctggacaacaattattattgcatatatttatactaaaactatacatttaattcgctgtaatttatataggcacaacgtgtaattttttgttntaaaatttaaaactaactagacaagatcataaagaaaaaaccccgataaaatataatccgcgtcgtagtcgttgttacaaagacaattagcaattacatacaaatattttcgatagtcgaacaaggacaaagttttgatttgctatgatacgaaggtggatcataaatcataaaaagtaacaattcacttgtgtactagttattaattgtacaagagagtgacagtgttatatggaatcagcagccactaaaatacatatagaaaggaaaatcacgtacacgcgtccaacaacagtttgccggacctagctataaattcccttgcccttaccaggcatttgatctcactcacgtacagatccagcagcatgcagtgaaacacactgccatcacctagctagctacaaacctacctacaacgaggactcgaccgatcatcgttctcgagagtgagctactgagctacgatgaggtgcacactggtggtatggctgtctctggtcgtcatggccgcggccaccgccgccggcgatggtaatacgccggagccgaggccggtgatcactccgaagccgaagccaccacggccgtaccagccgaaaccgacgcctcaaccgtaccagccgaaaccgacgccacagccctaccagccgaagccgcagccagagccaggacacccgaagcccacacctcagcccaacccaacaccggaacccaccaaaccgaagcccacgccgcagcccgagccgaaaccaaagccacagccgcagccgatgccggagccccagcctggccacggcaaacccaagcctaagcccccggcgtactccccgggcacgcccggtccttgatcgtgttcgtatataaacacgcaggccgcatgagcttcgtataaataaataagcgggcgccatgcatgcatgcacacgacacgacgatgctttgtttcttcgtgcaaggtccgatcatgcgtgctcgtgcgtgacactactacctgcgcacgcacgtgtaaggaatgcaatgtttcatcacactactgactactgtacgtgtgtaaaagagtatgttgtatgcgttgtttttttgtgcctatctaccgtacctaatggccacctgttgtacgtgttgttgtggagtcgagtcacctgtactcactgtattgtaccgatgaataaaaagagaacgtgcatgccattgcgcgtgttcactaatgacaatccagagacgacgaacgagtcggacactcatgatacacaaaccaaatggtccgcttaggnctggatcattaattccgcacgttaaccctgatgcaaattaaagtaaccaaacatgcagaagcaatagatcgggattaactggatctaaatctctatcttgttacctataaaaatgtgaataaattcacaaacgtacatagtatccacaaaggttgttctccctttgcctcagaaaaaagttatgaattattattgacaaataactcggaggtgtgcaagcttcatacatataggaaagttgggcctatattcttaagagtttccttcaaaccgtgatattctttgcatcgacacctccatgcactacataacaaaaatgatatgttctcggcgcatgcttgattcaattatttagaggtttagagagttaagtttgaatagtaagaattactcatcaagaagattcactatttcttgtaactctgtgactagcttccacacggtcacggctcatcggggcacgaccgcacccatggttgtggccaccagtcatggtaggcgctacataaaggagacatagtacgacacgaatgccaacacgcctgt

SEQ ID NO: 3796 - DNA, 3409 bp, Zea mays
gtctctacaaattccaccaaataaattgcatctagatttaacataatatcaaaactaatgattcagatcgttggatatttctcatttcctttctcactaaaatccagtgaacaatattatttagatctccggcgttagcacatgctatatgctagtatttaccatgtttgggagaggctgacaggccacagagtagagatagcaatagagaattccccgtcggagaataccacccatctctgtccatgtgactaaaaaaaattccccacaggggtcccacaaacacttacagggaaggtttctttcccatctctgttctcttaaattataattatgatatacattatttattattaatataaaatattatcacttaatataaaaaatcattatatgtacattaaaataaacacatctgtacaataagtaatcttctgataagataattatttaattttattaataactattacataaaaacatggtcacatacaaatttaatatatcacgcgaagaacgaggatgaagaatttttcccgtcccatctctgtttacggagaacagttttttcccgtttataccctcgccaggaggtaagaaacttttctattcttattccctactagataaattccttgtggagaatcaggaatcaggtccattgccatcagaggtgcaaaacatcaatggctgtgctacgtagaagcgtagtgacactgacttcctaggcttcatgacagcaggcctcatattcggacagtttgttccgtgggtggcactggcactcaaggcctagtttccccagaaaacatggcgcaggatacctcaaaattgtggcctggtttatgggctcatcacaattgggttacaacttgcccaggttagccagggacggcccgatgggacagcaacgcgcgcaggtgtcagatcggtaagcccataaacacggtgcttcctcgcgggtgcgtcgtcgtcgttcacttgcgcccggccgacaccctgtcactacaagcagcgtgcggcaccctagtggccttgtacagcgtaccatccacgagcggacgagccaccaaacccgacgtcgagctccctccgtctccgacgcaaagctgtggctccgccgcttccacgccgcgcgcgcgggtggagcctggggcctcggggccgtgtgccatgtgcgctgccacccgccgcggctgccgcgaacctcggccgcgcgtgggcgctggcccccgcgggtggcgctgtctgatggctgtccggtgctctgcttctgctccgtgcttgctctccccgtgtcccgcacggccacggccacggccagccccgtgacagcatgacagcaacgccgcaccgtcgcggggatactaatatttcccgagccctggcgccttgtggcggcgcggtggaccacgcgacagcccgcacgaggggcggtcgtgtagcacgtgcgtgcaacagccgttccacacccggttcggctaggtgcagatcctcgacactacttgtgtttggttcggtctccggtgagcagtgagcttcaactccatcatcggtagcctcaagctgaagctccatgcaaatgggcccaagaatacgacgcgaacaggcgagatgcagatgaacaagtgcatgtgcacggatccaagctctctggatgccttgccttgcctatatcaatgggcgccccgccgcccggccggacacacttcaattacgattattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcccggcgtgctggcggcctcgctggtgtcgtcgctcgtggcggcgctctcccgcgcgctcggcgtcttccccgcgctcgccggccgcctcgtcacgctccacgacgacagcatcgtgatacggtgcggcggcgacgacgccgccgtcgagttctaccacgcggtggcgccgtctctgtcgctcggcgacttcctggtgcccggcgccgacgtgccgacccgtttgacgaacggcctgttccccatggaccggacggtgagctacggcggccacggccgcccgctcacggcgttccagctcaccgtgctcggcgacggcgccgtgttcgtcggcttcgtcgccaaccacgccgtcgtggacggcacctccttctggcacttcttcaacacgtgggcggggctgtgccgcggcgcgccggtccgggagcccgacttccgccgcaacttcttcggcgactccaccgccgtcctacgcttccccggaggcgcgagccccgccgtgacgttcgacgccgacgcgccgctccgcgagcggatcctccacttcagtgctgccgcaatcagcgagctgaaggcgacggccaaccgctcgaaaagagcaggtcaggaagccgaggctaacggcaagctcgcgcacgacgactccagacttgaagggcgttccggtgaaatctcgtcgtttcagtcgctgtgcgcgcacatctggagggcggtgacgcgcgcgcgccggctgctggctgccgacaagacgacgacgttccgcatggccgtgaactgccggcaccgtctgcgcccggcgatctccccgctctacttcggcaacgcgatccagagcgtggcgacgacggccaccgtagccgagctggcgtccaacgacctgggctgggcggccgcccggctgaacgccaccgtggcgtcgcacaaggacggcgcgatccggcgcgccgcggcggagtgggaggccgcgccccgttgcttcccgctaggcaaccccgacggggcggccctcacgatggggagctcgcctcggttcccgatgtacgacgggaacgacttcgggtggggccgcgcgctcgccgtgcggagcggccgcgcgaacaaattcgacggcaagatgtcttcgttccccggacaggctggggacggtagcatcgacgtggaggtgtgcctcgcgccagacaccatggcgcatctcctcctcgacaaggagttcttgcagtacgtgtcctcccctgcaccgtgaggcggtgacagagtgaatgtgtggcttgttgctgcgcagctacatatagtaactggatttgtaccctttcagcagatatcaagtgcttgccaactttaaaaaaaaaaaaaaaacgggggccccccgagtggcggcctcctcacccggggattaattccgggccggg

SEQ ID NO: 3797 - DNA, 1886 bp, Zea mays
aaatgtttgctcaaaaacacatttttttaagaaaaaaaagaagcgttcgttgacaatcaagcagacgagaagagagaaaaaaactaaaaaaaatggcgccttcattgacagggaaatgacctgacattgtttcagagctagtccgccgtacaagtacaaggatacagccgcaggcccgcagaggaagaggagagcctactctcctgccatggccgcgccgagtccgctcccccgcttcctgatactcctgctcgccgtaacctcctccgcgtttgccgccgccgcggcaaccggggctccggtggtgggggaggactacgtccgtccgccgccggcgcggtgccaccgcaaggcactccttagcctcttcccttggagcaagaaggaggagtccgccgcctcctccgatccgcagcaggtgcacatttctctagctggagaaaagcacatgagaataacatgggttaccaatgataactctgtcccatctgtggtggactatggaactaaagaaagtacatacacaatgaaatctcaaggagaaagcacatcctacagctacttattgtatagttcaggaaaaattcatcatgttgtcatcggacctcttgaagataacactatttattactaccgatgtggagggcagggtccagaattccaatttaagaccccgccctcccaatttcctttgtcattggctgttgttggtgatcttggtcagactagttggacaacatcaaccctgaatcacattaagcagtgtgagcatgatatgcttttactccctggtgatctatcttatgctgattatatgcaacacttgtgggattccttcggcacattggtggagccacttgctagcaaccggccttggatggtgacagaaggcaaccatgagaaggagcacattccattttttgagtcaggatttcaatcttataatgcacgatggaaaatgccttatgaagagagcggatctagatcaaatttgtactactcttttgaagttgctggtgcacacatcataatgctaggttcatacacagattatgatgatagctcagatcagtatgcttggctaaaggctgatcttgccaaggttgatagaaagaggacaccctggctcattgtgttgttgcacgtaccatggtacaatagcaattgggctcatcagggtgaaggcgacagtatgatggcttcaatggagcctttgctgtacgctgctcatgtggatatggtaatagcaggtcatgtccatgcttatgaacgtgcggagcgagtctacaattccagacctgatccttgtggcgctgtccacataactatcggcgacggtgggaaccgtgaaggcttggcccgcaggtaccgtaacccgaagccagcgtggtcggtcttcagggaagcgagctttgggcacggcgagctaaagatcgtgaactccacccatgcccactggacctggcacagaaacgacgacgaagagccggtgagaaccgatgacgtgtggataaactctcttgctggttcagggtgcatccaggagggcagccgtgaccgtgagtcgaggaagatcctgatgtctccttgatgcttagcagtatagcttgggcctgcgatgtactgtgtatataatgcgtgctacttgataatctaacacctagtaaaagttaatgcgtcgtgctgcttgcctgcgtgtatactggagactggtttgatctggcgcgtttgctgctcttgttgtgttgtaccactatggatgtttgtagcaaagtgacatacgacggtgttgtaatggactgaagatgaatagatgatgttccagttaaaaaaaaaaaaaaaaaactagcaaaagacagccggtacccgaaaaaaggcgcggtacc

SEQ ID NO: 3798 - DNA, 3237 bp, Zea mays
catcaagaagcaacgcatctgcctctccttccaggagcgtagagccggtcgggtcctgtgtgtatggtgtgaccgtgatccagagtgtaatattcgatttccacatgtgacatgggggaaatgagcaactgcctgcaccatggctggggactgggcgtggttgctgacaaaggacctgcaggaaactgtcctcgcccgttcgagaacaggaatttgtcctgcaaactgcagcgcaaccttggaagatttccatttcctttttggtgaaaaattgaagctttccatttcttatcccggcctgcaacaacgagaccatggacgcgatccgctcaaaccggttctagcagctttaccaacccctctccctcaactgccagacccaagccgagtcacacacgactacacgaggccaagtacccccggccaaatccggccggccgtgcaccgagatcgagcggccagcgttttgccccctttttttctgttatggcccagcgcgtcaggctgtcgacaacatctcggcttcaaaccgtttcgcctcaaagatagtgttttttttcttttggtgggaaaaaagtaaatactcctactagtgttgagttggagaacgacagcaataaagaaaggaaatgcacatgccatgacatgggtatccatcacatctggggccacaacagtcaggaggattccgtccgatttccagcctcttcaaccccagctcgcgcacaactcaacgcgccaagccacccacgccggccaccccgtatatatgctacccctccccgccttccgctccgtgtcttctcccatctcatcgtcccatcccatctccaactcgtctcacttgtccatccatccgtgtttcttcaccgccttctcttcggattgagattgtaatcagaatcggattgagattgtaatcagaatcggattccatcgttacatactcaaggcacatacagcagcaccaatgatgagcgacgcgtggccgtcatccccctactcctcgtcggcgcccgacggggaggtcctgcgctccctgcaccgcctggcgcgggacctgtcggcggccgaggcgccggcgccgttcctgcggccggtcttcgcagcggtggccaggcgggcgcgcctgctggccgccgtgttcgacgacctgctgctgtgcggcgcggccgcgggcccgctgctgctgctgctgctgccgcgctccgcgtccctgtgcctccgggagctcctgctcgtgctgcagcggttcaaggcgctcgtggccgactgcgccacgcgcagccgcacgcgcctgctgcttcagtcggatgaggtggccgcgcgcgcgcgggagctcccgcgcgtccgcccccccctccgcgacctgctccccgccgcggagctcgggctcgccgacgacgtgtcggacctcctggcgctcgcgtcgcggcagtgccgccgcgcggcggccccggagctggagctgaaggcgggcgtgctcgcgctgatccaggaggtggagcgggagatcgtgccggagcgggagaggcttgagggtatcctggaggacgtgggcatcaacgaccccgccagctgcagcgacgagatcgagaccctggagcgggagatcggcgaccgcgtcgccgagaggtggacgtcgtcgatgatcgccctcgtcggcctcctccgctacgccaagtgcgtcctcttcagtgccgccacgccgcggcccgtggactccaaggtggatctcgacgacgcggagccaccgtcgccgccgccggacttccggtgccccatctccctcgagctgatgggcgaccccgtcgtggcttctagcggtcagacgtacgaccgtgactccatcacgcgctggttcggctctggcaaatccacgtgccccaagaccgggcaagtgctgctgaatctggaactcgtgcccaacaaggcgctcaagaacttgatatcgcggtggtgccgggagaacggcatccccatggagagcagcgagtccgggaaagccgagccggcggcggtggtaggcgcgaacaaggccgcgctgaaggcggcgcgcatgaccgcgtcgttcctcgtgaagaagctgtcggcctctttctcccccgaggcgacgaagcgcgtggtccaagagatccggcagctggccaagtccgggtccgacaaccgcgcgttcatcggggaggccggcgccgcggggctcctcgtgccgctgctcctgtccgaggactcggctctccagctcaacgccgtcacggcgctgctcaacctctccatcctggaggccaacaagaagcgcatcatgcacgcggagggcgccgtggacgcgctctgccacgtcatgggctcgggcgccacgtggcgcgccaaggagaacgccgcggccaccgtgctcagcctggcggccgtccacgcgtaccgccgccggctcgggcggaacccacgcgtcgtcgagagcgtcgtgcggctcgcgcgcacgggcccctccagcaccaagaaggacgcgctcgcggcgctcctgtgcctgtccgccgagcgggagaacgtgccgaggatcgtcgaggccggcgccgcggaggcggcgctggccgcggtcggcgaggccgaggccgaggccgccgcggcggtgctggcgtcgctggcgaagcgcggcggcgcggaggcgatcgtcgcgctggacggcgccgtggcgcggctggtgaacgagatgcggcgcggcacggagtggtcgcgggagtgcgcggcggccgcgctggtgctgctgtgcaggcgcgccggcgccgccgcggcgtcgcaggtggtggcggtccagggcgtggagtgggccatctgggagctgctgggcaccggcacggagcgcgcgcgccgcaaggccgcgtcgctcggcagggcgtgccggcggtgggcggcggccgccaacgcggagcagagcacagagtgccctgccgccgccgatgcgccggcgctcacgtcggcggcgtgaagtgaaatccactactcaactactgcgcgatcagtagtagaagctccaagaacaagccgaagcatttttttcttcccaccacgaatgttgtacaaaatttgttcttggccgttaaggccttcccgattctttggtccgtggtagtgagtaattgatcaactgtaaatacaagataggtgtagtacgtacattttttctctttttcatcaaacattgttacgcattcattgtactgtctcaagaaaatacaaagg

SEQ ID NO: 3799 - DNA, 1802 bp, Zea mays
cctcgaggccggccgggaattaaaaaccgcagaaaaggaatcaatccgaccatccataaaaaggacggcgacgcggtcaccactacggcaccgccgccgccgccatcctcgacccctgaagtgaagaggcaacccgaggacgcctctcccatccacgcgcgaatcctaccgccctcccactcccaaaaacctagccgcgcgcgccacctgcatcccatggcggcaaccgcggccgtggcggggaccgggtcgtccctctcctcgcgccgcagtcgcagcgctgtctcctcgcccttccgcgcagctgcctcgcgcttccgctcgccgagatgcgtgctcgggagcgagcagctgcgggtggcgcatgaagggaagcggatgagcggcgccgagtccaggaccgccgcgtgggcgccaaaggtgcccgcaccggagtccaggcttgccgcactgccaagggagctgcgggactccaggatgaagatcttctccggcacggctaaccgtccgctcgctcaggaaattgctgcttacctgggtatagaactcggcaagatcctgatcaagcgctttgctgatggagaaatttatgtgcaactgcaagagagcgtgagaggatgtgatgtgttcttgatccagcccacatgctctcctgtcaacgaaaacctcatggagctcttcatcatgattgatgcatgccggcgggcttcagcacggtctattaccgttgttattccatactttggttatgccagagcagacagaaaggctcaagggcgtgaacccattactgccaaacttgctgcgaatttacttactgaagctggtagtgaccgtgtcattgtatgtgatattcattctacacaagcgttggggtacttcgatattcctgtggatcatatatatggacagcctgtgattctggattacctggccagcaagacgatatctgaagatcttgtggttgtttctcctgatgtgggcggcgttgttagagcacgtgcattcgctaagaaattattgaatgcccgtttagctattgttgataaaagaagacagggtcacaacatgtcagaggtcatgaatttaattggcgacgtgaaaggaaaagtggctatcctgattgatgacatgattgatacagcagggacaatcactagcgcagcggctttgttaaagcaggagggagcagaagctgtatatgcttgttgtacacatgctgttttcagccctcccgcgattgaaaggctttctggaggcgtctttgaggaagttattgtgacaaactccatcctgctgccggaagacaaatgcttccctcagctgactgtgctttcgatggcgaaccttgtgggggagacaatttggcatgttcatcgcgatggctccgtcagcagcatcttccaatagcagaaacgagcgcgtagcatcgtcacctcgtcttgcgttcgtgtgcttggtatagagaaggcacccagtgcctgtgctgcttgcgtattttcgtagggagtcaattttggcggcaaggtataataaggttgtattgcccgtgtacggggtgacaaataaggtggttattgccggcgtacgcgggataataaggttgtatgctggtgtaggactgtaggtgttctgcagcgtgttactaattaagtgcatctcttgtcctatcatgtattgctgaggtagttgttgtcgagtttcagtgtctgagatacatgggatagtgatgtacccagcacttggtcactattgaagtcctggtcattggaaatatgggaacaacaaaaaaaaaaaaaaaa

SEQ ID NO: 3800 - DNA, 3677 bp, Zea mays
gtgagatctttggattgaaccaatccttatttcagagccccacccttctatcaaggttctagaaacaggatatgagttttcctggtctgcctgtctctttaccttttttatttttaacttcattgagtttgaaacttatcaaaatacaatgattcaccatattctttatagctgtatagtttcattagtactgcaattgtatgcaagtattttcatcacctgatgttttgttaagcaatctatgtcacagtgagtcatccatgttttgactgtgttgatctgtgcaataaccaataaaatgcaattatagcttcgaaaactacagaggcctatatcatatttttgagttccttatgtgagtcatccatgttttgacttgtgttgatctgtgcaatgaaatacaattatagcttggaaaattacagaggcctatatcatatttttgacttccctacttttgagtacctttttctttcaggtcatgaatttaattggcgacgtgaaaggaaaagtcgctatcctgattgatgatatgattgatacagcagggacaatcactagcgcagcggctttgttaaagcaggagggagcagaagctgtatatgcttgttgtacacatgctgttttcaggttttctagttggctttatcgaatgtacttctggttttggtattttttatggtcacatcctatatgatgtggcttcatctctgagcactttctaatatttcgctgcaagaacattcacaacactgtacaaaaaagtacaccaggggtaatagtatctgttaacacctgtagctgtaggccatattaactttgctaatcttgggggcacccatattatcatcagcatcaatcctaacgatatgattgcttgaatcttatgcaatatgttttctacctcgtggtatcttattgtaggaaggtgcctgagaaatcttttcggcgtagtcacttgtctaaatttgactgctttcaataaatttgcctgtttgatgctcagtatgctactttatttcagaaagtagcaggacgctttatttggtttgaacaagttgctgcctttatattccgacatgcttattccctcagaggatttgtgtattaacatggttgacttttcagccctcccgcgattgaaaggctttctggaggcgtctttgaggaagttattgtgacaaactccatcctgctgccggaagacaaatgcttccctcagctgactgtgctttcgatggcgaaccttgtgggggagacaatttggcatgttcatcgcgatggctccgtcagcagcatcttccaatagcagaaacgagcgcgtagcatcgtcacctcgtcttgcgttcgtgtgcttggtatagagaaggcacccagtgcctgtgctgcttgcgtattttcgtagggagtcaattttggcggcaaggtataataaggttgtattgcccgatgtacggggtgataaataaggtggttattgccagtgtacgtgggataataaggttgtatgctggtgtaggtgttctgcaggctgcagcgtgttactaattaagtgcatctcttgtcctattatgtattgctgaggtagttgttgtcgagttgaagtttcagtgtctcagatacatggggatagtgatgtacccagcactcggtcactagtgaagtcctggtcattggaaatatgggagcaccaatttctgttttaaggtcggcattgtagctcaagctgttaatactcaaaattgcctgattgtctatgagcaccctgcaatatttactggtgtgatgctgcatatttgctcttatgagtgtcgtccaagattgaatatgcaaacagcgctcacgttgactccttatcttttcatctctgtgcttggaagcgtgtcaatgctgtccaaatgaacaacagactggcaaaggagctgttcagggaaacattactgattggaagacacattattcgattttaaagaagtaaccctttgaaacacgaaaacacattggtgagagtatctccgagagtgtgccttaaaaaagtgccctataatttaaaatggggcttgatttgaagtgtttgaagggcccaaaaatattttacctgcaacaatacagccctaaatcggttgattactgtaaacccgcctcgcctttgtctccgtgcaaaatagttggcgccatcttttcacctccgcctttcattttctttcacttttatgccgttgtttgtagctggcaacctttttgtttggacgcaacaccagcagacatgcatctggcgcaacagtggctcagtgaggcttctggtgcagcacaaacctgactccttttgtcaaatcaagtgtggttttcggtatttttcttttctatttgatcacatgcatctggacaggcagtaatttcttatgtatcaactgctacgatttgatgcctgccttgcatcaactgcaacgagaatgaagggaaactgtgttgccggcgatgagagaaggttgtgagtgttggtggcggggatgaaattgcacgtacacggtggcgctccctggctacgtggtcaacgtcgacgtcgctctctgtccagagtccagacctcgctggtgacgtccagacctcgctggtgacaaggaggctcgacgcgacaagaagatgggggcggcgcatggaggtccgcctcggcagagtagggaccggtggaaccttttctcgttccgtggctatggcgtgggaaaatgtcccgtgaagatctgtggacgcgctaaatagatagggcacactgaactggtgtagtatatttgggttacttgaacttgtatcctatttctttttgacaaaaattgcaatttagcattttttgggactgagccctatagtttatacagttcacttgtttgtttgagatgctatgataagattatcctaggccccagcatccgcaacgtgtctcagcatccgcaacgcgagacacgtttgcccaatcgaaaagatagccacgtgtagcaggtcgtgcatgtgcatgccgatctgctcttttacgtgacgttatgcgcatggaaacattcaatgcttatattcaatcatttcggaaaacgtccggtaactatcaagatatctcagttatagatgagtgcattatttttagtttaaggataacactagctcagtaattatttgtgggcctcaatttttagtgaatatggcccttataaagaattgagttgctatatctcgggtatcagctggatacccgtgggtaaaatactttactcgtacactatccaatgtattgtgggtatttgacctgacaggacccgtaggtgagttttttttatccatatccatgtccatcgggtatgaaacccatgagtattcatatccatgggtccaacggccatccctagatgccgggaggcagattcccatttcattgtagttgtggtagacatagaaaaaaaccccatatggcccatcccctcttgtttttagctcctcgactcatctctagggatgaaaacgatcgaaaatgatatcatctataggaaaacgttggttggaaatttatctgattttataattaatctacttattagtgactacaatataatatggttagtcattttgaaattcagattttaaatatggtaatttttggaaacgatattgtctttatggaaacaatacag

SEQ ID NO: 3801 - DNA, 1295 bp, Zea mays
aacgatatgattgcttgaatcttatgcaatatgttttctacccctttttactagccttttcatgtgatgttttcataatacactttcatgtatattattggtcaaagtttctaaagctggtggctttgtgcacacatccacaatcatcatgcatttgaaaatggagggatgctctattacgtataattgggactgctcaactccaattatagaagtaaccttattactttttgatggccccttcctgctgtacatgtattatgcaagttacctcatgcacggttgagtgtgaaactgatttgtggtggatgcggtttttgttaaggaaaattttcatataggttaatatgaaattgcactgtttgccatctgccactagttaatcatggtttactttcaccagacatggaaatggtgtccatttccaacatcacaaccagggatacaaggcctctaagcattgctcgtggtatcttattgtaggaaggtgcctgagcaaatcttttccgcgtagtcacttgtctaaatttgactgcttttaataaatttgcctgtttgatgctcagtatgcttggtgacctgccactttatttcagaaagtagcaggacgctttatttggtttgaacaagttgctgcctttatattccgacatgcttattccttcagaggatttgtgtattaacatggttgacttttcagccctcccgcgattgaaaggctttctggaggcgtctttgaggaagttattgtgacaaactccatcctgctgccggaagacaaatgcttccctcagctgactgtgctttcgatggcgaatcttgtgggggagacaatttggcatgttcaccgcgatggctccgtcagcagcatcttccaatagcagaaacgagcgcgtagcatcgtcacctcgccttgcgttcgtgtgcttggtatagagaaggcacccagtgcctgtgctgcttgcgtattttcgtagggagtcaattttggcggcaaggtataataaggttgtattgcccgatgtacggggtgataaataaggtggttattgccagtgtacgtgggataataaggttgtatgctggtgtaggtgttctgcaggctgcagcgtgttactaattaagtgcatctcttgtcctattatgtattgctgaggtagttgttgtcgagttgaagtttcagtgtctcagatacatggggatagtgatgtacccagcactcggtcactagtgaagtcctggtcattggaaatatgggagcaccaatttccgttttaaaaaaaaagaaagacaaa

SEQ ID NO: 3802 - DNA, 2423 bp, Zea mays
  misc_feature (2209)..(2218): n is a, c, g, or t
  misc_feature (2226)..(2226): n is a, c, g, or t
  misc_feature (2228)..(2235): n is a, c, g, or t
  misc_feature (2261)..(2264): n is a, c, g, or t
  misc_feature (2266)..(2266): n is a, c, g, or t
gtaccctcgagtcctggccgcgccgcccgccccacgcgtccgcctcgcgccaccacccaagtgagtgacccatcccctccatcggactctccactcccaccgtcccacgaccacgaataccgccgcccccggccctttcctcgtctcctcctcctcctcctttcaccgccaccatcgccgtcggtgcgcctcgcaggaggcgcgagaggtcggtcgaaaagcacagccatggcggcggtcaaggtggacaaggccaccaacgagctgctgctgggccccgactggaccctcaacatcgatatctgcgacgccgtcaactccgatcacgggcaaggaaaggaggtgattaaagctttgaaaaaacgtattcaacacaagaatgcaaatgttcagtttcttgctttgacgctattagagactctaataaagaactgtggggatcatgtacattatcaagttgtagagcgcaatatactggaggaaatgatgaagattgtgaagaaaaaggctgatatgcaagtgagggataagatcctgatgctcttagactcttggcaagatgcatttggagggcctggtggaaagcaccctcattattactgggcatatgctgaattgaagcgatctggtgttgaatttccaaagcggtcacctgatgctgcatcgatgtttatttctccggtcacacaaccagaatctttgccaacatatcttcaagcagggtatggaatgccagttgattcttcctcaaggcttgatgaggcaatgtcatcaaatggagctcctctgagcatctcagacttggaacgaatgctgggggctgtggaactattaaatgagatgttgagagctgtcaatccaaatgaaaaagatgctgccaatgatgaaataattacagaacttgtgacccaatgccggtcataccagaaaaagatcatgagttcagtaagcttagtaagggacgaggaactcttgggccaagctcttgatttaaacgatagattacagattctgcttgagaaacacgattcgatcgcatcgtgttctccttcatctgctgacgtgatagacgtggtgtgtgaagtgccatcgggaacagctccaaaccaaggaacaaatttccctccacaagctgcacttcgtacagccatagtaccgaccaatgttttggacgacgaagatgaggaaaacgaagacgacgagttctctatgctagctcgaaggaactcaagattccagcccacaaacacccagagcacctcttcaccaaccgtccatgatgaaacagcaagctctacagcatcgccatcagttgcgaacaacgcattgcctccgcacgatcctccagccccgccagtgagggtatctccagaagagcaggtcatgagtgaccttctcgcactcaccgtatcatcaaacccgtcaccatcctcctacaccccggtaacacctgaaccaggccgcctgaatcaaagcagcgcaccaacaggtgagcttccgcgggcttatcatggagaccaaggacacgtgtctgcaccttacgtcgctccgtgggctcagccgcagtcccagaccgcaggaagtcagcaaccgacacgcactcaggcacaggtatcttacagctcgtttgcttacccgccgccgccatgggcgtcacaggacagcaccgaatcgaacccttttgtagcggcagcgtcatctcagcaataccagtccacttcgagaacccctaccatgccaccgaacttgaggcctctactacagcagtcgcattcttttggagtaccacttccaaccgcgagtctggactcgccaataaatgggaacctgaagcaaccgctgtctgctggggctcgcaggccatcttatgtttcttccaacaagttcttcgacgacttgtttgagaggaactcggatggtagcctgaaagtaggcagcacaaggcacggtgatgtctatggaaaataaatgtcgttctcttgtcctgcttgcgtttgatgttatcagctgcctgcatattagaacgatttagttgatgcttctggcgaacttgctggccttttcataaataattttgccaaaccaaactatgtggaagcttcagcctatgagctgtccactgtccagacattttgaatggcaaaaggcgattcttcctaaattgtgtaatgaaacgggtttgcttctataaatagtgttctttagagcnnnnnnnnnnaaaaaaanannnnnnnnaaaaaaaaaaaaaaaaaaaaaaaaannnnangaaaagggaaaaaaaaaaaaactccgccggggggccggtaaccaattgcccctaaaggggccgaattaaaaatcccgggccgggcttttaaaaacggggggtgggaaaaacccggggtacccaattaaacgcctgggggaattcccccttcccaagg

SEQ ID NO: 3803 - DNA, 2213 bp, Zea mays
ggatggctttcatttcaaatcccctttctctctctactcccggctcaagtaatcaattccactgcgactgttgttgaaagagcaaatcaaaccaacccatcgaaaaccaaaatccccgcacgagctccggtttcaaattccctcggcagagctcgccgccgggcatggatgcggcgcgggagtccatggcggcgctcctcgacgccggcctcttcggccccgcccaaacgctggggtgtttccttgtgtcgtcagctggtgcgggcaacgatgctggtatgtccatgaaggtggaaagcctggtccagcatggggatgctttgtatggagagaaagaattccgcagggcactgaatgcgtacaagcaagctatgcaatatagtagaagtatccctaggcaagcaacaagtaacaccagaagttcagtatccgtcacaggccggtcaccttctccaaactcttcaaatctcttatcattcaatgaaaatgaggtgaagttcaagattgctctttgccattctgctctatgtgagcaccgtgaagcacttcatgagatggaaggtattccttcaaaagtgagaacactgaaaatgaatatgatgttagggaagctttatcgaatatcaagaaatagccgtacagctgtagtctgttataaggagtgcttgaggcaatgcccttatgttttcgaagctatcacagctttggcggaaatggggctttcagcaaaggaattttctttattattttcacaagcaccaaatagaggaggcaagctatcgggtgacttcgtagacacacaacgttggtggagtcggtatgttgaggcgcagtgttgcattgcttcacatgattataaaggtggccttgacatatatctagaactaatgcaacgattccccaataatgtgcatatcttgttggaaattgctaaggttgaagccatcataggcaggaatgatgaagcgataatgaactttgagaaggtccggctgattgatccaaacattatgacatatatggatgaatatgcaattcttctaaagtcaaaatctgactacatcagactgaataagttggtacatgatatgctacatattgaccctgcaagaccagagacatgtgttgctcttgcagcaatgtgggaaagaaaggatgaaagaaaagctttgacatatgcagaaaagagccttcgagttgatgacagacatataactggctatataatgaagggcaatctgcatctttcattgaatcgaccagatttggcagtgacagacttcaggggggctcaagaattgagggctgatcttcgttcttatcaaggattggtgcgtgcttatctagcactttctaaatgcaaagatgcattattcactgcacgcgaggcgatgaaggttatgcatcagtctgcaaaagctcttaagctagttggtgatgttcatgcaattagttccagtgggagggagaaggcaagaaagttctatgaatcagccattcgtcttgaacctggatttcttggagctgcactggctctggctgatctgcatgttgcggaaggacggaataaggaggctgttatgctactggaaagatatatacaacaatggtcagatgattctctacacataaaggtggctcaagtacatgcggcaacaaatatgctttcggatgcactttcccattatcaatctgcactaagaataaacccacaaaatgaagctgcaaagaatggattggagcgcttggagaaacaaatgaagggagtggacccagatgctccagaagacgatgaagagaacgaggaggaggacgtcgatgttgatcgagatgactttatttgaagctggctcattacaggtctcttatacctgtggaagctggcgctgattgatcacgaccatctttgtatagcggtggtagcagtggttttgtgctatttgtgactgaatagcaggtgttctagcagaaccccagttgttttagcttgtaaaaatgccgcccgaaacgaattttgcacgtgttgtatgccatttcctttcagttcttctttgtgtattcttttgcaccaaatatggttgacccaactcttctctccactcagatcacagtatttcccttaccgcctgttcaaagtcagctgacatgcccgcccataatacctctctgtcatcatctgctttatcagctgagttgcatgtctttgaagagct

SEQ ID NO: 3804 - DNA, 858 bp, Zea mays
  misc_feature (13)..(14): n is a, c, g, or t
tcgagggccggcnncggggcgagcaacccggcgaaagccccccaaaccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaaggacaaggacagagatcgtcgcagagaccgtgacagagatcgagggagagacagggaccgtgatagggacagggacagggatcgggacagagacaaggatcgccaaagtaggcatcaccgtgaaagacgggaacagcgagaccgtcctgatgatcacagagtccgtgattctgaaagaagaagagaacgcgacaaagatgggcatcgtaggcatcgttctcggtctcgttcaaggggtagagatcgaagatctaggtcacgttcaagaagcaagcgagttagtggattcgatgcgccacccccgcaagcaatgggttcaacatttccagttattccaaccccaaaaggcaaccatgtatggtaacaaggccaatcttgggtcacttgcctcacttctaccagtggaatgagctgcctactatagctttaatgtacaaggaagaatcagtgcgccggtttgatatcgtcatgttcatcttcaactggctagtactaggttactagcttcatgattattacatatttatttttgttcttgcacgtatggtgttagttctttgacatgattactgcatagctggttcttgatctatacagccttttaggagcatacaccaataccttactgattgctagttgattatgcttcctact

SEQ ID NO: 3805 - DNA, 2071 bp, Zea mays
ccacgcgtccggaaaaaaaaaccgggaataataaaaagccgggccccggccggccgaccgtgcgagcaacccggcgaaagccccccaaaccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaaggacaaggacagagatcgtcgcagagaccgtgacagagatcgagggagagacagggaccgtgatagggacagggacagggatcgggacagagacaaggatcgccaaagtaggcatcaccgtgaaagacgggaacagcgagaccgtcctgatgatcacagagtccgtgattctgaaagaagaagagaacgcgacaaagatgggcatcgtaggcatcgttctcggtctcgttcaaggggtagagatcgaagatctaggtcacgttcaagaagcaagcgagttagtggattcgatgcgccacccccgcaagcaatgggttcaacatttccagttattccaaccccaagtcagttaccaggctcttcgcttcctaacattggtggcatgtttccaaacatgctccctttcggtgttgctgggcagttcaatccccttgtcatccagccacaagcaatgactcaacaggctactcgtcatgctcggcgtgtttatgtcggtggccttcctccatctgccaacgaacagacagtggcaatttactttaatcaagtcatggctgctattgggggaaacactgctggtccaggtgatgctgttctcaatgtatacataaatcatgacaagaaatttgcttttgtggagatgagatctgttgaggaagcaagcaatgcaatggccctggatggcattatgttcgaaggggcaccggtgaaggttagaaggccaacagactacaacccttcccttgcagccgccctgggcccaagccagccaagccccaatctgaatcttgctgcagttggcctaacagcaggatctaatggaggactagaaggtccagaccgtatttttgtgggtggcctcccgtattacttcactgaagcgcaagttcgggagttgcttgaatcattcggtcctcttcgagggtttgatcttgtgaaggatagggaaactggtaactcaaaaggctatgcattctgtgtttaccaggacctcaccgtcactgacatcgcttgtgctgcactaaatggtatcaagatgggtgacaaaacccttactgtcagacgagcaaaccagggggcatctcagcccagaccagagcaggaaagtatcctattgcaggcacaacaacaggtgcagttgcagaaacttgtgtatcaagttggagcgcttcctacaaaggttgtatgcctcacacaggtggtaactgcagatgaattgaaagatgatgaagagtatgaggacattatggaagacatgaggctagaagcaggcaaatatggtaatttggtgaaagttatcatcccacgccctgaccccagcggacagccagttgtaggagttgggaaggtgttcctggaatatgcagatatcgatggtgctgccaaagcaaagacagcgctgcatggaaggaaatttggtgggaacccagtggtcgctgtctgctatgcggaggacaagtttgccaatggggaatatgatggatgaaaatcttatccctcttgaactatagcagtagccggtctttgtctttggctctatgctacctgcttgtttaattgcaacaaagatgaacggtctctcatttaagctgaacctctacctgtattgatatccctggattttttctgagccaccacctgttgtgatttgtgaacgttgtaagaataggtttctttgcttgggttcgcttgttgctgtcgaaaatatgtaacgaatgttattaataaagaatttcttgtatgactttaaaaaaaaaaaaaaaaaagagacgagcttctagaaaaaaaaaaagaaaaaaaatataaaggaaacaaacattaaaa

SEQ ID NO: 3806 - DNA, 1662 bp, Zea mays
gggttttttttttttttttgtaaaaaactatactgtttgacattatttacagataagtttgaaaagagatgagatggggtatccgatggagacagccttacagaaactaaattcagcatgtcatttctgcatttgtgaaaatttgacttgaaaatgggtacatttgtgagcatcaaaggggcccaaggtaggccaaggaccactatatcctcaaggagttcccactgagcagacccctagcaccttacatcaacggttgcaggtcatttctgcatttcacctatcaagtgatcacagcacaagcatcgtgtttgctccgtctttcacgtcggaaagcatcttcgttgcttatcacacgagggatattccatgttccatatgcatggcctgatgtttttccgccttccttcgtcgcttcctcacatcttctccagtaactacctgagagactaggatccagtttcttggagaagctctcgtatttctcttcagcctcgcctatgcacttggccagcatattcggtgcctctaatggtccatatattgcagcaaacatgcgaaggatattgaacgtattgttcataacgtcatcctcataatcatacaggtcatcagatatctcaaccaaaaattctgaaactgacaagaagtccatatgcaattcattgacatgctgaccagtaagttgaaacatcaacaggttaagaactcgatagtcaaatgatttcagatggattgccatcataacatcttcaatcgagatcttctcatttcttagtaatgcttggcagagcttcctctctagagaccaatactgaatgcctgatttgagttcagttcgcaatcggtctgtcattaatccttggcactgaagaagcccttcaaggggttcaatcatttgagacaaggatgtctcattgagagattcttctttctttcccaacacttttgaagtgttgtcatctgggactacatgtaaacagtcttcatttgaagcatctaactgatatatgtaactctctgtgaaagaaagaacaggtagatacttgaaaatggcttgtggcttgttaacatccaaaccatgaaacataaagtacgacctacaaaaatcttcaagcgtagacttagctcttgccatcgcatcaaaaccaaccatcggcatagcttgaacggttgatttctcggcatgcatcttaaacttcttaattggctggagtgaacctccagaacatatatctttattagcttccagatgggtgagatgctgcacttcttccaaagtattaggagtagcctttcttaatagctcagagatcaaaaggaacttattctccagggtaagagaatcaaacggttgcaccatgaagaggaggaattgggcgaggaagcggtcagcggcagcgccgccgcagctggagtcggtgtgggagaggccgcgtgaactcatgagggacagcaccctctgcatcttctcgagctccagcagcgcctccattgctgctcctcctcgccctccccgcttccgcttctcgcagtatcgcggcttcgcttcgagttgcttcaggttttgttcgagacttgcaaagtagcaaacagagaatggaggagacccggccggaaagagaaatgaggctgaggttaatgtgtgcctcgtgccgaatt

SEQ ID NO: 3807 - DNA, 3660 bp, Zea mays
  misc_feature (1300)..(1300): n is a, c, g, or t
gatcagtgagacatcataccttgggtctataaagtattccaaccgctctcctgatttggtatacaaactaataattgaagaagttttgaatggaggggaaatgagctcctctcggccagcagcacagccgttttataggcctccctagctcggcgccaagatctgtggcgccgagctaggaggtcgcgtcggtgtcacaccagccctagggaggcgctatcgccacgtcagagctcggggccatagcctatggtgccgagctgtgttgcctcaacgtcataggctatgacgccgaggttcgggtccaaatcaggaattaagttcttcagggtctaaatgtaattttttgtcataaaaatggctaaaaaacaaaaaatacaggcatgtgcaacgtttaatataacgatgcgcatcacaacataatttgttctggtttagcagcatccttgtgcttccaactactgcctctccgttcagttgtgctcgctccacagtttgaactttctgcaaagaagctcagccaaaaaaacgctgacatgaatctaggcccatgcccacaagctgacaaatgcatcgcagtgtttcctgacatggatctgacttgtgaagcttgacaagtgagcgacaagacatataaaatagatgtatatttacagacttttccaaggttttcccccaaaactatctgttagcaacactaatatctcaattcaaccaccggcagcaaagtactagaatataagagaatccgggtacatgtgagaggaagggaaaagagaagtatagatttctagacagagaagatgaacactagaacacagggaaatgagaatagagatggatatgtgtttcttctcaatatttgatacccccatagcttgaatcggtctccttttatagctgaagatgtccatttgtcacctgtcacagatcccatgtggcaatatgctgacattccccaccgcttgaaatacaacttgtccccaagctgtgatttgcataaccactaggattctaaacaaagactatgaaattgccttggacactggtaacagcacctagaccagaaggaacaagctaggtcagcggccacaccaatccatgaaccaacgttgagagctcgcattcctggctgaagattcttctcgaggagctccaggcaaactgcatgcatttgtggcactgatatggtggtattgtacccaatcgacatggagtcaatagctgactgtggagcaggaggtgtgccttgacgatcgttttggagtagtagatgctcaaatagagcttccagacttgnaccaacaactagactactgaaatttggatggacaacgtgaactctagggcctcccctcatgataatattgacatcactactaccaactgcaggagaagggatgcacccattatgagagtatgaatagcagttgacctctttccatgtgcagtacaagtcccttgtctaccatgtatatcaaacaaactatatcttcctatttctgccatctgttgctggataagggcagatatggcgtccgtcattccaattcttttggctcgatgctcttcaaagtccggttcaatgagaccataagtgttcagtacgccacccatctcactgctttcctggataaaaccatcattgcagctagaacaaatggtatcctgtccatgaaggtgaattggccgccaacaggcataacacccatgggtggccctattggacatcttgttcctatgcagttgttcaaccatgaacttgttcttgtcgctggccctgctagaccacagctcgagaccagtgccaaagccagctgagtcaaggtcgatgaagagggtcgtggaagcacgaaacacagagaagaccatgatgttccaatccaagcacgctaactccagaggtggaggccatggttgtttgatctcattgctgccaggaaagaggtcatcaccaaaattgtttgctaccagcacaattccctttccaacagtgtagtagccatgggcacagttgttagctgcatcctccttcgtccgctcccaccccttcccgttactttttccagttgattggcgagccggacaggatccagtaccctctgggatgcagtacacgatcatccttgatcaggtacaatccatcgtagagttgccaagggatgtagcagcagaagcagtgcgccatatgtaaggcacgggtcgggtaggcgaggcatttggacgcgagcacaccaatcatggctggcacgccgcgctccagtgtgaactgcatccgcgcctcatgagagccccgcagcgcgaacgacatggctaggatgtcccatgaaagcaggtatgcgccctagctcgtcaccccacatccgatgtcgagcgcgatgtggatggagccgtgggacaggacaagcctgccaatgtcgtcggtgtaggcgttggcgccgttgggaaatatggtcctgtcgtcgggaaacctgagcttgtcgccgccgacgtggatcaagttctgcaccttttcctcctgaggttggggacggagtaggtgcgccggttgaggactttcatcaaacacttggtgggcatgtcgacgggtacctcctcctctatggctttcttggtgctgaagatcagcgggatgaaactgtagaggttgggctcgacgtggttgtcgacgacgccgggaggacgcagagactccgactcggatgactccaccacctccgcctggtgtggtgatggcaaggaggagtggaggaagcggactacgcgggaccactctatctcgccaacgagcccgtcatggaccttctcgcgcgggttggaaaataatggctccatccagcgtaggcagtcgccggtcctagaggaggtgcctacgtggaccatgtacctgtcgttgtcgggtgcgaagtacaccgcgcgtggaagctggacctcctccctggatttcgatgggtggtcgagctcgttgccgtcgatgagcgtgtcggcgaggaccaggacgatggcgaggtcggaggggtcttcagagttggagcagtcgatcgcgtctccaaggaattcacatgctgcctcggcctccaccttgttgataacgccatcccttggttcctgctcgacctcgcctgccatggttagcacctggcgtcggcggtagtcgacgggctccagcgcagcggtcctgctggcgacctcacgggtgggtccttcaatcgcatcggtgatgcgagccgcctcgttgtactctagtaacgcgagcacctcgatgatctcattgcggtttggcttgtcgtagcggtcgtagacgacgagagttggaggagcggactccaactcgatcgactccaccatctccgcttgtggctgcaggtcctcctctccagagggatcttcgactcggtggtgctcgatgctgtcttggttggtgcagcaagggtcgaggtccggacagagcttgtcgatggcctcgctggtgggcgctaggtaggacggtgtggatccaaccagcgtagctgttaagcgctcctccattagtgtcattgcatcgagcagcttgcggacggtagcatctgaataattcatcggagcgattatgggcgccgcaacacaatagataacggattcaggacgatctaatctgataccaaatgctagcaacactaa

SEQ ID NO: 3808 - DNA, 8184 bp, Zea mays
accccccccccccccccccccccccccccccccaaagaggcaactgatccctgccactgacaacctactacatacactacacatgcaccattgatgaatcactttgatgtcgttatatatgcactgaacgtctgtaggtgctttggcttcatcgaatcccaaaacaggactgaaagttgctcttggaatcactagctcgatatccatcttgctctgcgcggcagttgttgctctgctccgtgcactacgaaggaaacacctggcgttggctgagatacagctagaatcggatgctcgaggaaggctctgttagcaacaactgggaaggggatccaagaggaagagctcagaggagaataagacttggagaagggaatagctgggaggaagacgagtttgtctgatatttgatagctaaattgttcatgcccctattacacaagtgtttgtcttttatatagtactactcgaacatcaagcgacccatagatagctgacccactacttggcccatattggctcagtaaccttggcgtttggacgatggactctcacgtgccgtggcttgttctcgttgtctgctcattgctcctgtctgagatgctgacattccccaccgcttgaaatacagcttgtccccaagctgtgatatgcataaccaccaggatcccaaactaagactttgaaattgccttggccactagcaacagcacctagactagaagaaacaaggccaacaaccatatcaattcctgaaccagctcgacaaacgattgctgtggaggaatggcttgggttggctttctcaaatggttcaccgaacgtagctgagattggatcactaatggtgatggggaagcggtcgagcttggcttgctttgccacagtaaccgaaagtcttcccagagcttgaagctcccagtcactcgtatccacattgacaccaagttggacaaaaaatccatgaactgcagttaagcttcctccaatggtatgaatggtgtactgaattttttgctcttctatctttggtgacatatttccaagagaaaatgtgctgaacctcagagattttattcccaaaggccggtaattatccatcagtggctcccaatcgtcgtccaacagcagcatgaaattcatcttgttgaacactctgtagagcacaccaaagaatcggacaaacaacttttgcttgtcacgggaagtgactgacgactggacatatggctgacatttctccattcttgagcttcggctggctcccaagccgatggaaatttttgataccgccaagatgatatgccatggaatgtgccagtctgtaatgcggaatagcagatcgcagccacaccagacctggacatctgacacccctaccactatgtagtcaccagttgaaaggttgagctcggtattgccctctgctccatatgactggatttggattgcctcaaccaggaaatactccacgatctggaagttgcctcctgtcttaatagcttgctgtttggtaaggacaacaacaagcatgtgttcgttgttcttaagatcattgcagccgccactaactttcttcaaaagatggtaccacgaaggcccttctccaggagtcgatctcaaaatgtctacaatgaagttgatacgttcccaatcaggcttatatgcatctgtgtaagcttgaacagcagcatatgtcatatcctgtgttatgcctctacagatagcattcgagtcaggtgctttgatacagtcgaacagaactgaaaatcccagcaagctaaacaacatcagataatgatggagattgataacatgagctctcagtagatcaaccacgctttgagggagcttctcgatcaatgatagaagcagccattgaccggtgtcaggaagcggcgtgacagttctcatgtgttttgacccaagcacaccaatgatctcggcaaccagtttgcgcacggggctggcctcctcggtgtggcggtcggtgatgctcacaacacggttggattgcataggtggtggccatggttgtctctgcatcactgcatcccagctgcaactgaccggaggcgagaaacaactctgtgtgaggatgaagcaattcatcaaacacctgttgggcgtagtggcgagaacctcgtcctccttgctcggcggcgtgtacgatcgcatacacggcttcccgtcaacgctggtgcagtcgaagacatgcgtgccggtggggatgccgagcacctggtccggcgacggtagggagaagtggatgaggtggacgtggcgggacagcttcgtcctgtcgacgaaccgacagcagatcttctcgcgcaggttgggtagcgcggcggtcgcggggaccttgtcggcttcgctgtgggacagctcagtgtcgccgctgccgtggacggcgatgacggggacggcccagtcgtagggagagtctggatctgaatccaggaggctgcggtggaagcggggctcctcgtcgaaggatgggacccctcgtcgaactcggaggtaggaaggatgtcgacgtccactccgacgtggttgccgtcgccagtcccggagtaggtgctgacgatggaggaccgggttggggacggagtaaatgccgcggttgaggtatattgtcgaacacttggtgggcgtgatggtgagaacctcctcctcctctgcgtcggtgttggggacgagcgcggggttcatcgcctggtctggtgacgacaaggagaaacggaggcggcggacttcgccggacaactccgtcccgccgatgaggaccttctcgtgcgggtcccgatggaacaacaccgcgccctcggggaggcacgggtagcgcggtgatccgctgctgtcgatgttcgagtcgagcggcgcatagacgaggacagcgcctgaatcgtcgtcagccgcgttggcgctcgcggcatcctcgtccaacacgtcgagctcctggaggaggtcatcgtcggggttggcgagagtatcgacaaacggctgtggcatggtgtagcagtcgtcgtcgtagagcggcggaatgtagcggtcggatatggagccggcgaggagcgtggtcgacgaagacatctcgtcggaccccagggacgcaagcaccgtggcggtctgctgcaggccaaagtcgtttcccgaatccaaggacgccaccttcgcagcgtcgtcgtggacgagaggcggaaggattgcctcgtcgcggtactgtgtgttgacgatggaagaaggaggcacggatccgtcgaagggggaagtgtgctcgcgtgcgtactgctcgccgcagcgacccaccagcgcatcggtcaagcgtgcctccatgcgcgccagtgcgtctagaatatcctgcatcgtgccggcccgcccggctcgggccccgcccgataccaaatgttagcaacatctgggaaggggatccaagaggaagagctcagaggagaataagacttggagaagggaatagctgggaggaagacgagtttgtctgatatttgatagctaaattgttcatgcccctattacacaagtgtttgtcttttatatagtactactcgaacatcaagcgacccatagatagctgacccactacttggcccatattggctcagtaaccttggcgtttggacgatggactctcacgtgccgtggcttgttctcgttgtctgctcattgctcctgtctgagatgctgacaggctcatggacgaggagtttgagaagggctcggggcccaagaggttcgagtacggccaactttctgtcgcgaccaagggcttctcggaggaggagaagctcggggaaggcggtttcggcgcagtttacagagggtttctgaaagagctggacctccacgtcgccatcaagagagtctcgaggggttcagagcaagggaggaaagaatacagctccgaggtgaggatcataagccggctcaggcatcggaaccttgtgcagctcattggatggtgccatcagggcaaggagctgctgctggtgtatgaactgatgcccaacggcagcctcgacacccatctctacaacccgactgttctcctaacatggccagtcaggtaagggtgaaaacgttacgtgaatgtgtccgttcgatgtgggcagagcaaacagaatacacgctgcagatctggatgtcgatctggctgtgttatgctgtgcaggttcaagatcgtgctcggcttgggatctgcgctcctctaccttcaccaggagtgggagcagtgcgtggtgcacagggacgtgaagccgagcaacatcatgctcgacgcgtccttcgccgcaaagctaggcgacttcggcctcgccaggcttgtcgaccacggccgtggatcgcacacgacaaacctcgcgggcaccatgggttacatggacccggagtgcctcgtcgccggccgcgcgggcccggagtcggacgtgtacagcttcggcgtcgtgctcctcgagatcgcctgcggccggccgcccgtggtgcccgagcaggaagaccagggcaggacgcgcctggtggagtgggtctggggcttgtacggacgaagagccgttcttgaagcggcggacgagcggatgggcggcgacttcgaccgcggagagatggagcgggtgatggttgtcgggctggcgtgcgctcatccggactgtagtctgaggccttccatcaggcaggctgtgagcatgctgcagtgtgaggtgacgctgccaacgctgcctgccaagatgcctactccaaagtactcgtgactcgctcgctgcctgctaccccgaggtatagtactggactagggtttatacatggcgtacgtattcatagctaattttttatgggggattaaatcctgtattctgaaatggagggttgattcgaatttgccctaccgagaggctaaatttctgtagaactccaattgaactagcaagctataaatttctttagatttccaattgaactagcaagggccctgcacttcatgcacaattgtgctgctagattcaaggatgacctgatctcagtatgcaatggtattgttaacattaaaacaactgagaccttcgatctatgtatatttatagatcttactattggttactgttgctagttggagactccaaacggaggctccacgttaatcttcacgagacatactaggaaaaataaactactctatatgttgcatctaatgaacgaggattccaaacagctctgcctagtgggctgctggccttgataaaatttgcggtcgctataacgggctgcctttttttggcatcaccagtgtggacgtacgagaaaatctgctttcacgcaccagcccatagttgccgcttcgtttcctagccggtgactacgatcttggatttacacaacggcccacgtctatatcaaacatttggatgatcaggcccagctagctaggcctattatgctatggcttgccttttgagaacaatctctagtcttgacaaaaaaaaacgccggatctgactccatatgaggaactgcgggttgcgatgtcgcgaggtcacgagcaggatgatccagctagagcatcggaatcgataccaagagtgcagtcctaactcacgagctgtcttggtgagtggtcgcccacagggtcgagtggtactcccacggaactttaggcatcatcttttttgcagcaccggttccctttctagattcagcagcgacagcaggctactacagctcaccaaaaagcggcgtactcgtcttcgcagttactgtagctaagctgagacgacaggttggtcttcagttcagtcttcagtgtggtggctcggaattgttgaacggtaaatgcgctcatggctggaagagtggaagtggaagcagccgacgggcacgggcacgggcattgccgctgccagtcgccctcgtccgctcggcacggtcagcagcactgactagcagtcgtcggtcggcactcggcgccaccaaccaacaggcgaaaacctgcccaggtttcgtgccggaaagaaagaaagaaagaaagaaagaaagaagggtcggaaacttggaatcgcgccctcgctctggtccagctcccgcggcgcgcgtcggtgagataggcggcagcgccgatcgaagcttgagacgttctgttgggcgcagtcacctgacctgacgtgacgaaagagaagtagtaggacttgttggcggtgcgcaaacctttggccggctcccacctcccagttcagactggcatatgcgctcgcggttgcgcgtcagcagattggcatgtacgttacccggggcgaagggtggtgacaccgtgacagtgacaccgcggcgcctcgctgtttcagctgtgagatcgcgacaaggagaaaaaggacgaagctgctgcgtcgcggcgacggggacagggagggtggtgacacagtgacagtagtttgccttgcccgcggcgtcaaattcaaggtcagaatccactaatcctcgaacacgcccgacttgctgggttcgaaaatagaaaggcgatcaggcgcgcacgttcttgcaacaagctagttgccagttgccacgcggtgtgggccatcaagttgccctcgttcggaaatgaaacatggggcgctcgctcagccgctgcatcgcagaaggtgccgaattgacaggtctggcattttagcagcgtacggtcgcccgccgaactcctgcgctcgatccgatgctgcagtctctctcccgccgatgcggatgatcctggcctggctagttccagcctatcagagccaccaggagctgcttgccggcggccggcgggtaatgattccacccacctgtcagcgcgaacggggacgcgggcacgagtccacgatttcccaaccgaaacgcgcgagttattacgctttatgcgcccgtgccgtgaggccgtgaccccaaacgctccttcctcgcttgattactagagcgtttcctccctccgcgcatcgcagccaacctcaccctgtgcctcagatctcgcccacctggtagactcgccactccgtccgcctcctccccgcctcgatcgccgtcgagctcctctcccccacgcttgactaaccccacctgcgcttggattggtggccagggagaggcgcggaggcgacgcgcccagctacctaccggttccatactctgaagtctgaactggcctcagctgttccaccacctcgctgttcttggcccagctgctctgctcttgtcgagggatgatggtccagtgctcctccaacaaggctccacaccgacattgagctactgtgccttagcgctgccggtccggggtcgctctctgtgggccgtggcggctgtccgatgggctgcaccgggtccaggcacgcgctgcgcggcggcgtccggggtggcagccggtcgccgcgcgcgcggagccgctccggcggcgtccaccacaccgtcgcgctcaagtcctccacgctggggtcgctcagcctcgaccgggaccgggacgacgacggcgctctagcaggcgcggcgaagacgctgatgcggcggcagaaacaacaagtgcgaggctcgccggccaaggcgcctgctcgcgagcccgaggtgatcaacgtgtgggagctcatggacggcctcgacgacgacggcaaggacgatgaggaggggggcgacgccgacgccgacgccgaggggcggcgggagaagtcggcgacagggtcacccgccgagttcgacttcgacccggacgtcatcgccgcgttccggaaggcgctggatgagaaccccccgccgccgccgtcggacgtccccggcaacgaggggtgtgtcgacaagaagcctgacggcccgggcggcgaggtgggcgtcaaggtcaagcagcgggagcgcgagatacagaggttccctggcatcgtgcgcgcgcgggtcagcgcgttccagcagaggatcgacgcgaagctgctcgccaagctggcaccgccgccgcccccggatagcgcccggaaggtggtgctgtacctgaccagcctccgtggcgtccgcaagacgtacgaggactgctggtccaccaggtccgtcctccggagctacggcgtgcgcgtcgacgagcgcgacctgtcgatgcactcggggttcaaggacgagctccacgccgcgctgggctccagccccaacgcgggcaggctcccgcag

SEQ ID NO: 3809 - DNA, 1185 bp, Zea mays
taggggcctttttttttttttttttcggcaatgaatggttgtcgattttaatgaacccaatgtaaaagcataataatcatttttttccgtccatttctatgaattccaacagatcgaagaacttcaacctgggagattaaaaaaaaaccctcttcggtataacattactgatttactgtacacagcacgccatattcatggttcgctcacttcttggacacgtaggcgtagtactgcgccatgggcacgacgacggcgatgacgagcaggccgccgacgacgagcgtgaactgcccgcgcttctcctccgtctcctccttggtcttgaagttggactcccgcttgttctccttgaacgacgggccaccagtgtccggcagcccgtcgatcgccgccgccagccgcttcgccgtgctcaagatcgcctcgttgtacttctcgtcggtcgcgaggactgggaggttctcagacacggtggcgtcgagaatctggtcgccgacggcctggatgaaggcgggccccccggtgacggcgccctccttctggcttgtgacgagcaccacgatgcccttgttgttgccctcctcaatcgtggggtaccacttctccaggacttggtccgcgtactcgaacgcgtcagccttgctcgtgagcttgcggacggtgatgaagttgaggcggatgttcttgcgggcctcgaggtcgcgggcaagccgcttgacgtcggacttggtgacgcggctcagcacgccggcgtcgtccaccacgtaggagtccacgggggccccgtcgttcagcacgtcgaactccgacgccaccgccggcgcgggcgccggggtcaggccgatggccagcgacagcgcggccgccgccaggccgtggtgcaggaacgacatccagttcctgccgacgccgtctccatgggaggaggcagcgacggcgccggcctgtggcctcttgagcgcgctggagcaggacacggtgggcctggacgagacgctagcagccagagacggtctcctgctggagccacggagtggtagcgtgaacaatgtggagggggagaggagggtctccattgctgccgcggggagctcgagccgggatggaggggaggaatcacgctcgcattgtgagggcgctgatcaccggagcttctgctgcgaccgcctgctctggattctg

SEQ ID NO: 3810 - DNA, 1153 bp, Zea mays
cattgggtacctcgcggccggccgggactaatcctaaaccaaccccttcgcgaaaagaagaaaagaacggtggtcgcctacccgatcggatcccaaaattctccacaaccccatggcggcgagtttgtggcgggcggtgatgggcaccggcgcggcgtccacgaacaccaccgactcctcgggcggcggcgttgagttctggcgcgccccggagcgcgtgggttggctgaccaagcaaggcgagtatatcaagacatggcggcggcggtggttcgtgctcaagcaggggcggctcttctggttcaaggaatcgaccgtcacgcgcgcttccgtgccccgcggtgtcatccctgtcgcctcctgcctcaccgtcaagggcgccgaggacgtcctcaaccgaccctacgccttcgagctctccacgccgcgcgagaccatgtacttcattgctgacaccgagaaggagaaggaggagtggatcaactccatcgggcgctccatcgtccagcactcccgctccgtcaccgacgccgaggtcgtcgactacgacagccgccctggcgacaaatgattgatttgtgagccggtcacacctgttactctgcagcgtctctatgctactttatctctgcagcgtctctatgataattagtgcctgtttggtttgtgctaattatgtcacgctttgcctaatgttagtcgtttcaattgaataactaaccttagacagaaaagttagtcaaagtgtggtaagctaggacatgtttggtttgatgactaaattatcacattttgtctaacttttatgtttaagattagtttttcaattcgaacgactaagcttagacaaagtgtggcgcagttagccacgaaccaaacaggtctttagtcaccgaaccaaacaagcccttagttaaacaggtttttagtcaccgaaccaaacaagcccttagtttcacacttgttattgttgttttgtggatgtatgatctgtgtatttgtataatattttggtcattggggaataagttcggcatcttatgtatagcgtgctatctgatacagtactgcatatcagttgtctactttcaaatttgtgcactgcccgtttgatttgtttggtcagggcccctaagaaaagggcggccgctct

SEQ ID NO: 3811 - DNA, 1110 bp, Zea mays
tgggtacctcgaggccggccgggaatgctaaccaaaccccttcgcgaaaagaagaaaagaacggtggtcgcctacccgatcggatcccaaaattctccacaaccccatggcggcgagtttgtggcgggcggtgatgggcaccggcgcggcgtccacgaacaccaccgactcctcgggcggcggcgttgagttctggcgcgccccggagcgcgtgggttggctgaccaagcaaggcgagtatatcaagacatggcggcggcggtggttcgtgctcaagcaggggcggctcttctggttcaaggaatcgaccgtcacgcgcgcttccgtgccccgcggtgtcatccctgtcgcctcctgcctcaccgtcaagggcgccgaggacgtcctcaaccgaccctacgccttcgagctctccacgccgcgcgagaccatgtacttcattgctgacaccgagaaggagaaggaggagtggatcaactccatcgggcgctccatcgtccagcactcccgctccgtcaccgacgccgaggtcgtcgactacgacagccgccctggcgacaaatgattgatttgtgagccggtcacacctgttactctgcagcgtctctatgctactttatctctgcagcgtctctatgataattagtgcctgtttggtttgtgctaattatgtcacgctttgcctaatgttagtcgtttcaattgaatagtcaaagtgtggtaagttaggacatgtttggtttgatgactaaattatcacactttgtctaacttttatgtttaagattagttcttcaattcgaacgactaagcttagacaaagtgtggcgcagttagccacaaaccaaacaggtctttagtcaccgaaccaaacaagcccttagttaaacaggtttttagtcaccgaaccaaacaagcccttagtttcacacttgttattgttgttttgtggatgtatgatctgtgtatttgtataatattttggtcattggggaataagttcggcatcttatgtatagcgtgctatctgatacagtactgcatatcagttgtctactttcaaatttgtgcactgcccgtttgagtaaaaaaaaaaaaaaaaaagcggcc

SEQ ID NO: 3812 - DNA, 1491 bp, Zea mays
gaaaaaagtaaactcatcagaagatgggggatttcaaagccaacatatctggttttgatctttcttgatgtttacataagctccaatgcatttgaatgtaatcaaagaaagtttgaaggaagtgccatcctgattaaaggtttggcattctttaaataccttggtataaaaccttggttctcgatagtgtgttggctatggaaaaaagtaaactcatcagaagatgggggatttcaaagttttttggacaatgtgcagtacaaagccactggaatactacgctatgaacgtatctttggagatggctacgtgagtactggtggagctgagactacaaaagaatttgtggagaaactgaatcttaagcctgggcagaaggtgcttgatgttggatgtggaattgggggaggtgacttttatatggctgagaagtatggtacacatgttgttggtattgacctttccattaacatgataatgtttgcccttgagcgttccattgggtgtaagtgcttagttgagtttgaagttgctgattgcaccacaaagacatacccagaccacatgtttgatgtcatctacagtcgtgacactatccttcatatacaagataaaccctccttgtttaaaagtttcttcaaatggctgaaacctgggggaaaggttctaatcagtgattactgcaagagtcctggaaaaccatcagaagagtttgcaacatacattaagcagaggggttatgatctccatgatgtggaggcttatggacagatgctcaagaatgctggtttcagtcatgtcattgctgaagaccgaactgaccagttcctcagtgttttacagaaggagctagacaaatttgagaagaacaaagatgatttcctgtctgagtttgcccaggaggattatgacgatatcgtgaatggatggaaggcaaaactgcagaggagctctgctggtgagcagaggtgggggctgttcgtcgccaccaagtgatgcgcgtgcgtatggctttattacaaataaatttggagctctgctggtgagcagaggtgggctgttcgtcgccaccaagtgatgcgcgtgcgtgtggctttattacaaataaatttgcttctgcaattcaccgatgggattcgcttcataacgtgattttacataactgaactctgagagtctatcctattgctttgtgctttgggacaatgagactgatataacttttacggtcctgttaaatatagagtgtgctgcactgatgctcctcctggctgtggctacatggttgacacatgacatgagatttgttattttcattttttttagaaaaatattttgcatctcaacttttgaccaatgtgcatcagatgcattgaatctgtgcatcattttataattttttaaaacttattagtacgtgtttcactagaattacgaagcatcgccattgtactgaacacgagatttacactgaatatgtaccgaccatgt

SEQ ID NO: 3813 - DNA, 1737 bp, Zea mays
gcgtccgacgtcactaccgtcccagaccagccgcgtacgcctgcccctgccctcggtcgcgatggaccagggccacctcaaggacagcctcctcgtcccgtcctcccgcgccgccgcgacgaatgggccccaccaccgccgcgccacgctcgcgccgggaactggcgccggaggcccatgtggcggagccggcggcgtgtccatcgacgtcaacggcctgaagcggcgtggcggcgggaggcgctcgtgggtgcgcgtggacgcggcgacgggcgccgcggaggccgtcgaggtcgccaagccggcgttgatgcggcggctggacctgcccgcgcgggacctccgcctcctcgaccccctcttcgtctacccgtccgccatcctaggccgcgagcgcgccgtcgtctgcaacctcgagcacctgcggtgcatcatcaccgccgatgaggcgctcgttctgcgcgaacccgacgccgctgggggcgccgcagcggaggaggccgtgcggaggtacgtcgacgagctgcagcgacgcctcgtcgaccgcgccgacgacctgcctttcgagttcatcgcgctggaggtcgcgctggaggccgcttgctctttcctagactcgcaggctattgaattagaggctgaagcttacccattactagatgagctgacagcaaaaattagtaccctcaatttggaacgagtccgacgcctaaagagcaagctggttgcattgacaaggagagtacagaagagatgagatagagcaactgatggatgacgatggtgatatggctgaaatgtatctcactgagaagaagataagaatggaagcatcaatgttagatgatgaggaccttcagggaattggcaatagtcataatgggtttggttcatctctatcggctccagtttcaccagtttcgacaacccctgcaactcggaggcttgagaaggaattcagttttgccagaagcaggcacagcagcttcaagagctcagatagcagccagtacaatatagaagaactggaaatgttgttggaggcctactttgttgttatcgattacaccctcagcaagttgacttcgctaaaggagtatattgatgacacagaagatttcatcaacatacaactggataacgtccggaaccagctgatccaattcgagctgctcctgaccaccgccacgttcgtggtggccatcttcggggtggtctcgggggttttcggcatgaacttcgaggtccctctgttctcggttccgcacgcgttcgagtggaccctcgccataactggggtctgcggcgccgtcgtattctgctgcttcatctggtacttcaagaagaggaggtttttccccttgtaggtgaaagcttctcttctctcgccctgtcaccagagtccagacagcagcgtacgtatgagactgggtacggcaattgtacatgctgcattgttctcgaaatgcgctgtctgttcacgtgagcttttctccctttttaagctcacgccgctgatcgtgtgtagcttcaccggtctgctgtacactttgtattattgttgttgctggctgctgggcctgggtagtgggtactgcatgtgacactgttcggccccggaagagggaaaggagcccaacagatcagatcagtgctgttctcctctcccttgcggtgcgtgttgttggcttgttttctatttgctgtggtgaccagtggtacccaggagttttgcct

SEQ ID NO: 3814 - DNA, 1634 bp, Zea mays
cgcttcaactggacttgtgtatatacagcatacatcggaagatccgcggctaatttctcaggtctcaatcaagcgataggagcgtggtttcgcgtcgagtgctcactcatctcaagcgtcaccgtcgaccgtggagcaccaaatcaacccgtgagacggggcagattagattcttcccatccaaggggcggtcgcaatgatgacagatgataaaggcgaggttcgcgtcgtcagtattaacgataaaaaaaacaccggcgcatcagaatgtccaaagtaaaactactactccttttttcattatttatcttcctaagactgccccggttggaccgaaccaaaccaaaccaccacctcgtatcgtctgtgcccaccgtgctagaataatagtatcgcactgcacgatgactatttccttttactttaagttacaaaaccattggatttcttacattacaaattaatttagttctaaataaaaataaatcatttttgatttatgatttattcgattagagatggtgtaattaatttagttctaaataaaaataaatcatttttgatttaggatttattcgattagagatggatgaaatgagatagaagtggattaaatcttcttctatttaaaatagaaggagatttaacctcctcatatcccaccctgttcgaaggagcccaagcccaaggggcgcacgcgcacgtgggttgagacgagtgatcactggccacatccggacccaaaaatatcacggggtcgggggaggcccattgggtacccaccggcccggggggaagcagagggagagcagtcaccaaaccaaaaccgctctcgagtctccatccattctctccgctcatccgcagctctcgagtctccagctctagctagccttagcctcgtccaagggacgaaggggccaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttccgcctcctcgacggcggcggcttcgggtccgcccagccggcgccgctccccgccgaggtcgccgcgctctacgacgccgtcttcgagcagttcgacgccgaccacagcggcgccgtcgaccgcgccgagttccacgacgagatgcgccgcatcatgctcgccgtcgccgacgggctcggctcccagccgctccaggtcgccgtggacgacgagggcgggagcttcctgctcgaggcagccgagcacgaggccgctgggatcgccgccaagatcgaagccaaccgcaaggcggaggcggaggcggaggcggccaagtgacgacgtgtccctcgtgcgggccctgcgcttgattttctgggtgtttgctactacgtactagtactacttacctggcggccgatgtgccgccgcacgtgtacggtatactacgtaactagaagcggccagcaccagctactcaaatcactgctgatgctacttgtgaacggaataaaacctgtcaatcattttagtggtcttgcttgcataaaacacctcgacctcctccgggctt

SEQ ID NO: 3815 - DNA, 826 bp, Zea mays
attgggacctcgagaccggcaccgggaacaggaaaaaaaagcagagggagagcagtcaccaaaccaaaaccgctctcgagtctccatccattctctccgctcatccgcagctctcgagtctccagctctagctagccttagcctcgtccaagggacgaaggggccaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttccgcctcctcgacggcggcggcttcgggtccgcccagccggcgccgctccccgccgaggtcgccgcgctctacgacgccgtcttcgagcagttcgacgccgaccacagcggcgccgtcgaccgcgccgagttccacgacgagatgcgccgcatcatgctcgccgtcgccgacgggctcggctcccagccgctccaggtcgccgtggacgacgagggcgggagcttcctgctcgaggcagccgagcacgaggccgctgggatcgccgccaagatcgaagccaaccgcaaggcggaggcggaggcggaggcggccaagtgacgacgtgtccctcgtgcgggccctgcgcttgattttctgggtgtttgctactacgtactagtactactttacctggcggccgatgtgccgccgcacgtgtacggtatactacgtaactagaagcggccagcaccagctactcaaatcactgctgatgctacttgtgaacggaataaaacctgtc

SEQ ID NO: 3816 - DNA, 4928 bp, Zea mays
  misc_feature (127)..(127): n is a, c, g, or t
ctcccccggccccaacaaacgctacaaagtggaatgtattgtttcggtaaaagtggaatgtattgtttaggtagcttttggttccggactttctggagtatggtgtggaacagagcccgttccactntcaaatttgttgttgtttggattgattccatatagaacgaagtggttctaaaatagaaaattatgtttaaatgttgaaccatttagcccatcaaaatcttctggacggagctgctcccgggaacggggtcgttctattccaactggttctggaatccaacgctactttagccagtgacagaagtgagtctacaggaaaccttgtactgacacataaaaacgctaccttagtgtcagaatcaatcgaaggtgtcagtggtattgatgaatcagcagggaatttgctgctgagctctggggactatggtattgatgagcagagctcgaaacttggcaactccagagatcggctcgtgcactgaaaataggttggcctaaaactagtgtaatcatctatattagcgcttgagttccctcttttactttccctgttggaaatcaaaatcagtatggtatacattatacttggtcactgttttggaatgtgtaaagctctgaaataaactattgatgctgtgcattttctcatccatgtgctcttttacattgcagataaagaaagctaggcttaaataggggtttggtcatccccacaatccaccacctaaacttgtacacatgtgacatgtctggttctttgcctgacgaagctccttctaaacctgaagtgaaggacatagaactccctagttcgaccgctgttgacgaggttgataccaccgaaaatcaaaccacggttggagcttccagtgtatatcatgagcgcagaacggtctgcacgaagaaaaggctgaaaaaggtccacggtaactaacaacattatatttcgatcaagatcctccagactgctcatttgcttaccattcacttactttattgcatttttttcatgcagaatgcgacgatcagcagcgtagttcaagcgacaaacctttcgcgaaagaccattgttaagtggttgtttgatgatagaagggaacgagatgggctccctgtgaccatcgtgttgcatttgcattcaagagatccctatctgagactggtgctagctcataacttcttcagataagcctttgttatacagtgttcactcggaacccttaaaaacatgtaactttgagcttaaagtgtggcggattttgcaagctcggcatggagtatctttttgtagcaatactactatcagatcagcctaccccctaacttgtttgggacggaaagtctttgtggttttaatactgtcagatcagccgatgtgacaggtacaactcctaactgtcacacatgatctttgtcgtagcctggtttctgtaggacatatgtgcctggtattttcgttcgttatttttagggtatgcaagggagctagagtgcaagatatcccagccattagtctttaggtgaaccaaaagtgaagtcgtgtgacaggacaatcaatatatagcagttgttaggaagaagcgaggcactgcaggcactgacagcgtaactgatatatatatatatatatatatatatatatatatatatatatatatatatatatatatatatatatatatatcatgcacaaagaattaagcatgacgtagcgttatatatggcctaaccaaccaattatgtggtccaagtagctagcttttgtgctggcataatagtgattgtgctggcagttgggtaactttttgtttgtatatatggttaattgacctgtttccatagctgtgattgcttgagtcttgggttttggttaggtcagttatatagtctgtagtacttttctgcctccgctacctcaaaatccatgctgcgctgcacctaactttgatagatatgtcttgctgttttcaataaaagagttttattagttgggtctgcactaaggactgcaggtcatgcatggcattaactgggctcagatggtaggcaataatttccattgaacaggtggtaggcgcgcgcatccagagaccatacatacctgctctatctctgtgatggatatttttgttgtcgttaatttccattgatttgggtataccacaagtgagactagcagagacatggagagatgcaatgaaaagaacaagacgataataattggtactaacttttatatgtcaaacctttatgtaccacacggtagtctttgttttcctctgacctaagttgtgtttggctgtcaactgagacagtatggcaccaagagcctagtacacaattgccatctgcctttgtttctccccctgggccctctcgagtctggactttttctccgctcgtactagcccatcatcaaccgaatttgggtgaagacggtcggtcggcgtcagagaggtttatttgtaaccaatctttggtagatacgtttagcggttccatgccgacgcgtgttccatcaaataattatcgtcatatcattgtcaaactttacagtggaatgtaaaaaaaaattactgttgaagaatgcatgcatattttctggtgatgcgcatgtaactctgcttgtatgcatgcacttgtcttctcttcctccaccacatgctcacggcgtgaagtaaaccccatggcatgtgccgcagaaatagatgggaaaaaaaggatgtgtttaatattctaatctgatgagttctttcttgtatactgttctacacgcacagataaaataaatataacctatgcagaagaaactccagttagttactggaaaacagacagccccagcgccggccccaggctccattccatggaccatggcaccggttgttgactgctctgctgtctgcacactaatggcagtctctgtcagtctacatatatatataacacagagtgagcctgcagaagcgggcacgtggggcaactcagcagaagcacaccactacggccggttcgtcgtccctagataagctggtgcgtctcgcggcgtggtggatcggaggagaggtgggacaggcaggcacccatggcggggctacagaggtcggcgaccacgttcagaaggtccgggtcctcgggcctggtctgggacgagcggttcctgaccgaggccgaggccgaggcgaaggcgaaggccggcggtggcgccgccgccgccgaggacccccagccggagctccggcactccaggagcgtcgggagcatcggcatgctgctccgtggtggagacagcgacgacggcaataagaaggcgaaggaggtggagaaggcgcgcggcgggcagcagcagcgggtgttccggaccaaggacgtggcccccgacatggacccgccctcgccgagggtgtccggctgcatcctctgcgccatcctgggcgggggctctggcggcggcaaggcacgccgccggtccaagcccaagcccaagcccaagcctaagcctaagcccaggaaggatgtagcgacgacggcggcgtaggcgcgtagcagcacgtacgtacgtcgcgttgtctttccgctgtaaaaaaacaagtttgggggtcatggttgtgtgagagtgcacatgtttatacatactggtagcggtaggcagcgtcatatgagcttgctactcgatgtaatgtatgtacaccatttttagtcaggttagtttcctctctttaatttgggtcggttgtggttttctgctcgaaccagatccatgcagcagctactgagatctgaattggtcttgttgctagcttggtgcgactctgttctggcgcgcgctggtctttccgatctctgatggttcgctgttcgcatgtggtgtcgcgtgcctttttgccggtgcagacggcggggcatatgggcgcacaccgcgtgcccatgtgaagcctgggcaggccttggccttgcggttttgttggggactgtgatgagggggggtggaccgatgatttggtcggtctgctctccgtgtgcccatgatgggtgggcgcggcggggcgcagatcagatgccatggtcgtccgtcctctgggcggctgagcttcaggacaggatcctcatctgaaatgacatggaagcaccgagtcaccgacaggaggaagtagctcgagtctgtccagtggtcgcagctagctgttggtggagtggaggatgcaggctaggggcattgaatggcgaggagaagaattggggcgggcacagggcatgacagagacgacgacgacgacgacgcaggctggttggcggtgctggcatggcatggcattggcatcttcagtgttgacactgcagatgagatgggtggcggatgattgagagtagtagcagtgtgttaatttacaagttggtgggcgacttgattgcgctgtggaggccgagagggacggccatccacgccgacgtcgatgtgaatgtgagtgtacactgtacacccccaggactgtgatgaggagtccgccgacgctcatcgtctaatgccccctatatgtgacgactgctggacgccgtctctttccccggcaccttctgggccaaacccttattacgtctctgttggaccacagacgactcgtcgattgatgaaccactcgttctccggtacggtatttaacagcttaatctgacgaacagtctccagctatcgcatcatcaactgtttcttaacgttcacagtccagtggcgtcctcgtgcgcaactggtagtcggcaccgcactggtctcgatcggcatgtggttgtgtaaaacaccccgtaaattaagatgatgccactcatgtggtcatcaggttgtttagaaagaggcgaagaaagcacgattaaaaaccaaacaacaagagcaacaaatgaaatacagtggagagacaccaaaacgg

SEQ ID NO: 3817 - DNA, 1417 bp, Zea mays
attgggaaaaagagttctcgtgattagagaagctcagagaacaaaagaacagctcgccgcggctccgaatggcaacttccccgaaccccgcgacgattcaccgagccggcgcccagtgacccttccagaagcttccagaaggtcaccgccatggccgcgcccttcttttccactcctttccagccctacgtctaccagagccagcaaggatctgtgacggcgtttcagatatccggtggagatgtgcaggtcctgcaggtgatgctgaagtctcaggagaagctgactgcaaaaccaggtgcaatgtgctacatgtctgggaatatgcagatggacaacaattacttgcctgaaaatgatggaggcgtgtggcagtggatttttgggaaacgtgtaagcagcaccattttctttaattctggatctgatgatggatatgtcgggattgctgcaccatttcctgggaggatactgccggtagatctaacaaactttagtggagaacttctttgccaggcagatgcttttctatgttcggtcaatgatgtctccgtctctagtacagttgagccaaggccacggaatattgagattggtgcagagatgatccttaaacaaaaacttaggggccaggggatggcttttcttgttggtggtggatcagtcatgcagaaaatccttgctcctagagaggtgataactgttgatgctgcttgtattgtggctatgtcggccaccattaacttccagttgaagagccctaaccagcttagaagagcagtttttgggggtgataaccagctaacagcatctctcacgggaccaggtgttgttttcattcaaagtctgccattccatcgactctcacagagaatcgccagtagatcagtggcaggcccaagcttgagggacaacccaaagttcttcatccagattgtcatgttcttcttcctggcctatgttatgattgtatcatccataattctgacagatgtttaggcgattcagtgagcttttggtgtattcctagacaagttatcgaagagttaaagctacctccccaatgttaatgtagatgtaagagaacgaatttcacaagctgttgttagaaaccttagcagaaggttcttcatttttttttctctaacagtttggagggggcggggcgggtttcttggttagcgtgtaaagaggaagacagcaaaatcaagttgcacagcgtatggtgaatatacagtaattttcctcctaaactggtgcgatgcattttgaataattgaatcagtgatttggcttgagcagttgtgtgctcttttcatcagtcatgtactcatgttgtgtgacgtatcatctcgaggggggccccgcgcccctgctcgctatatgcttgcctattgcttgagctttttttttacag

SEQ ID NO: 3818 - DNA, 581 bp, Zea mays
attgtgtagggtgattagtcatgagggagggggtccgaggcgatcgatgatccggctaagctagcagctctggcctcgccacccacacacatcacatgcatacatattatctatctttctatatatgtaatatgctcagatcactcttgctatgttcatctgcgtgctccaatcatatcattctttttcatggatcggatgtatcatgcatgatcatcacctgcgcctggatatatcctatctagctgctagactatgctgaaatgcatgcatgcttttcgtccatggcgcatgcatccaacaatgaactatggatcgcgcgcatgacgggacgggagaggagcgatttcacgagatcaatccgttggccgatatagaaaagccctttgtttgcatacatgtgctcgtcttcacgagccattttcagttcttcttttctttttcactttctccgtctcagatgatctatttctttttttcatcagctcagcaaaggtacgccgagttttaatttcccccggtttctatgaaattcggcgttgcaaagatatatagatggttcccaggattggtatgtattt

SEQ ID NO: 3819 - DNA, 2144 bp, Zea mays
gtctaattataaaattaattacataaataaagacaaaacgacatgaagaatttatttagtctaattaattcatgattagcaaatatttactgtagcatcacatgagcgaatcatggattaattttaaagaagaagaggattttagctcccaaactagctctacgagagaatttaatctcctccaatttcactccatctacctctaatcgaaaaagccttaaaactgacgtggatcctatggatcctgaagattcctttcaacggcctcgattcctccccggcctccttttatcacaccccgcctccccttcccctctctcgggcggccccgccggcgggaccgtcaccacacgcacacggcacacacaccttcttcgtccccttcacccccctgccgctaggctctccctcccctcggtcgtagccatggagaccacttcccctgcctcttcacctgggcacatctccctcccagctgctgcaggtaggactaagtagtaaatagccatatacataggttgagtggatcgttaagagagggtagccatatacataggagtactggatagtatacaagaacggtagatacagggcaggggacatgatgctgggaaagagatctgggcgcccgtcgccggcgtcgcggcagcacatgcggcggaccacgagcatgacggagttcgcggcaccgcacgtgctggtagacgtcgcggaggaggaggaggacgaggagctgcagcttctgccggcgcacgccgaggccgcaggggaggcggccgagcaggaggacccctacgggtgggccatcggcggcgccgcggcggccgggcgcgcggactggctggcggcgtaccgcgcccgcgcggcgccggcactggcggggctacgccggaactcggccgacttctcggctgccgagaccgccgcgttcctccgcgcctgcgggctctgcaaccgccgcctcggacccggccgcgacaccattcatgtacaggtacgcggctgtctgaactgtactggtgtgttgcctttagtttctctttgtggcatgcatggatatggatcctaaaaaccaatggatctgccgccgcgcgcgtgctactgctgcttgcaggggcgacacggcgttctgcagcctcgagtgccggcagcagcacatcaccatcgaggcgtggaaggagaagtgcgcgctcgccacgccgccgacggcgccggcgtccgacccggtggtgccgctgccgcccagcggcgcgggctccgacaaaccaggcacgctcgccgccgcatcctgattagtcatgagggagggggtcggaggcgatcgatgatccgactccggctaagctagcagctctggcctcgccaccacacacatcacatgcatattatctatctttctatatatgtaatatgctcagatcactcttgctatgttcatctgcgtgctccaatcatatcattctttttcatggatcggatgtatcatgtatctagctgctagactatgctgaaatgcatgcatgcttttcgtccatggtgcatgcatccaacaatgaactatggatcgcacgcatcacgggacgggagagacgaggcgatttcacgagatcaatccgttggccgatatagaaaaggcctttatttgcatacatgtgctcgtcttcacgagccattttcagttcttcttttcttttcactttctgcgtctcagatgatctatttctttttttcatcagctcagcaaaggtacgccgagttttaatttcccccggtttctatgaaattcggcgttgcaaagatatatagatggttaccaggattggtatgtatttatatgatgttcgtcaccgatgacaacccccccggcccggccacatgatggcatgaataatattttatttatgagaaaatgttctgatgattctcacgggctcgtgcgctcacgaatcttccacagatcgtgtacgttgtgtcagcagcactctctggaccacacactatggccctatatatgagcacattaccagatgtgacaaatcatgagagactaagctgcaggttgagctggcagctacaccgacgagaaccttcttcgaacgattctattctcatatcgattgctagtcactgtacgtgcctcgttg

SEQ ID NO: 3820 - DNA, 1119 bp, Zea mays
gtccgccgcaccgggcgggcgggcgacgtcacaccgacacggcacacacaccttcttcgtccccttcacccccctgccgctaggctctccctcccctcggtcgtagccatggagaccacttcccctgcctcttcacctgggcacatctccctcccagctgctgcaggtaggactaagtagtaaatagccatatacataggttgagtggatcgttaagagagggtagccatatacataggagtactggatagtatacaagaacggtagatacagggcaggggacatgatgctgggaaagagatctgggcgcccgtcgccggcgtcgcggcagcacatgcggcggaccacgagcatgacggagttcgcggcaccgcacgtgctggtagacgtcgcggaggaggaggaggacgaggagctgcagcttctgccggcgcacgccgaggccgcaggggaggcggccgagcaggaggacccctacgggtgggccatcggcggcgccgcggcggccgggcgcgcggactggctggcggcgtaccgcgcccgcgcggcgccggcactggcggggctacgccggaactcggccgacttctcggctgccgagaccgccgcgttcctccgcgcctgcgggctctgcaaccgccgcctcggacccggccgcgacaccttcatgtacaggggcgacacggcgttctgcagcctcgagtgccggcagcagcacatcacgatcgaggagtggaaggagaagtgcgcgctcgccacgccgccgacggcgccggcgtccgacccggtggtgccgctgccgcccagcggcgcgggctccgacaaaccaggcacgctcgccgccgcatcctgattagtcatgagggagggggtccgaggcgatcgatgatccggctaagctagcagctctggcctcgccaccacacacatcacatgcatacatattatctatctttctatatatgtaatatgctcagatcactcttgctatgttcatctgcgtgctccaatcatatcattctttttcatggatcggatgtatcatgcatgatcatcacctgcgcggctgcgcctgaatatattctatctagctgctagactatgctgaaaaaagcggcc

SEQ ID NO: 3821 - DNA, 2132 bp, Zea mays
caccacacgagcacgggcacgaggccacgactcccaaacggaaacgcgcgagtattacgctttacgcgcggacacgctgcccagccccagccgcccgtgaggccgcgtgacgcgaaacgttccttcctcgcgcggcttaaagcgtttcctctctttcccctcgcagatctcacccaccgtctacctctcagtttcgatcgccgtcgagctccaccacgcttaattgtccccatcagggcgggagcgggggcgggggcgacgggcccagctacctaccggttccttcctctgaatcggccaatcggccgcagctgttcttggcccagctgctctgctcttgtcgagggatggtccagtactcctccaacaaggctccccgccgacattaagctactgtgccttagttagcgctgccgattcggggttgcttgctctctgggccgtgcccgctgtcctcccatgggctgcacggggtccaggcacgcgctgcgcggcggcgtccggtcgccgcacgcgtggggccggagccgctctggccgcgctcaccacaccgtcgcgctcaagtcctccacgctgggctcgctcagcctcgaacgggacgaggagatgatgaagtggcgcgacgacggcggtgccggcgccgcgaagacgccgcagctgatgcggcggcagaaacaggtgccaggctcgccggcccgcgagcccgaggtgatcaacgtgtgggagctcatggacggcctcgacgacagggacgaggaaggcgacgacgccaacgccggcggagagaagccggccccagggtcgcccgcgttcgatccggacgtcgtcgccgcgttccggaaggcgctggacgagataccccctccgccggccccggacggccccggcaacgacgaggagcgtatcaagaagcctgacggcccgggcgcggggggcggcggcgacgaggtgtgcgttaggaagcgcgagatacagaggttcccgggcatcgtccgtgcgcgggtcagcgcgttccagcagaggatcgacgcgaagctcgccaagctggcgccgccgccgccggccgtgccgcccccgccggacagcgcccggaaggtggtggtgtacctgaccagcctccgcggcgtccgcaagacgtacgaggactgctggtccacaaggtccgtcctccagagctacggcgtgcgcgtcgacgagcgagacctgtcgatgcacgcggggttcaaggacgagctccacgccgcgctgggcggctccagcgcgggcaggctcccgcaggtgttcgcggacggcaggcacctgggcggcgccgaggagatccgccggatgcacgaggccggcgagctgtcggaggcgctcgaggcctgcgagatggcgcccccgccgagctgcccgggcggcaagggcgttgccctggaggcgtgctccggctgcggcggcgtgcggttcgtgccctgcgaggagtgctccggcagctgcaaggtgttcgtcgaggaggcggccacattcaggcggtgccccgagtgcaacgagaacgggctggtgcggtgtcctctctgctccttgtgaaaagtctcagagctgctctgctattgctatgggttatgagatttgtagtgtgccgtgtgggttactgggtttgtaagattttgctgaggagtaattttcgttctaaaaaaaaaaaaaaaaacgcaagttacacgcatgtgtaactttattgggtaggactgatgaagcgacagatgaccgtatttatgtttttgtttgatgactggatttgaatgtgtataagcacaagacatgacagcagtctgatgaacagatatgcattacaactgcacaagacatgacagcagtctgattgcgcgtgaaccggattgaagatgcgatgaagcaggtctgcaggtggccgtgtttgtcccgctcccgcaccgcatggatatgcgacacatgccaatgcagcaatgctacgtgcgcgcgtacgaattacgaacgtgcgaactgctacggggtcgccaaccgggctttttttttccattttattctacgtctacacttcggttgtgacttcggcatcttgacctacgaagtcaagaacgtacaataccaagcttacacggcacaaagtcaga

SEQ ID NO: 3822 - DNA, 4901 bp, Zea mays
aataaaaagaaacggagggagtaattcgatctggagcttccttcagatgtgatgtgtttatattcgggcacttgcgctgccaatgcattagtgcagctggagaactaacagatgctgctaactattattagctaccacattttgcatattattctcgtaagtggtaacctatttacattatagcttaatttgttctcctttatgctatactatataacaagtaaattctctctccgaataattgaagacgggtctccatgcatatacaaaataaaagcgtggcaacaagcaaacggtgttccagcttttgttgcttgtagttattattatttattagtagtatataacagcagcgctctccaaacaagacttgtgagtgcagttgcctgttgcagcctaccgttgtttaatggcttcacttgtttaagtggtctacgaatgttgcttatatatatatatatatatatatacatatacttcagcgatggtcaagtgtgttgatgtttagtacaaatgaaggaataatccaacttgtacttgttgtcaacacttggcaattccaagtgaggaggcgcatgcatgctattgcttgggctgggatcccttgtattgtatcttgccgttttaacttgcaatagatacgatcacgaagtttcgctgctcgtgcaacccaacccaaccggccccagctagctgtcaattcgagtggaaactgccaggcccactcgtcctccgcccccctgagaatccgacgagtaccacgcagcaccgcgtgatacataaatacgggcacggcaaaccccaaaactcagcaagccgcccagcacgaccgccagccatcaccggccagtgagacggtacagcaaatttcccccgtcgcgcccggtcattacgacggcgccggccgagcagacgccgccgccacgatgccgcccgccaccggcgccgtcgccgacactgcccccgccgcggggaccgtgctcctcggcaggtacgagctcggcggcctcctgggccgcggcgcctccgccaaggtgtacctggcgcgggacctgctcaccggccgctccgtggccatcaagtcgttccccaacccacgcgccggcggcggcgccggcgttggcgtcaacgccgccatcgagcgggaggcgtgcatcctccggcgcctgcggcaccgccacgtggtgcggctccacgagatcctggcgacgcgcaagaaggtccacttcgtgctggacctcgccggcggcggcgagctgttctcgctggtggacgcgtcggggcgcatgacggaggacctggcgcggcactacttccggcagctggtgtccgccgtgcgctactgccacgcgcgcggcgtgtaccaccgcgacatcaagcccgagaacctgctgctggtacgagggcggcgcgctgaaggtggccgacttcgggctgggcgccgtgggcggcggcggaggaggaggaggaggagaaggcctccggcacacgatgtgcggcaccccggcgtacgtggcccccgagatcctgtcgcgcaaggggtacgagcccgggaaggtggacatctggtcctgcggcgtggtgctgttcgtgctggcggccgggtacctccccttcaacgacgccagcctggtgaacatgtaccgcaagatctacgcgggcaggttccggtgccccgggtggttctcgccggcgctgcgcgacctgctgcggcgcgtgctggacccggacccgtcggcgcgcattgacgcggacggcatcgtggcgcacccgtggttccgccacggcggcgaggaggaccttggcggcctggtgcacggcgggtacgaggaggtagaggaggaggaggaggaggccaaggcggacgaggacagggagccgaccgcgttcgacatcctcagcttctccccgggctcggacctgtcggcgctgttcgtgggcgcggggggaggcggcaaggagcgcgtgttcgtgggcgagcctgccgcggccgtgctgggccgcgtggaggcggccgcgcggaagggcgggtaccgcgcgcggagggacgggaagagggcgacggcccacgcggccgcccacgcggccggcggcggcggcggcgtcctggcaaaagtgagcgtgtttaggctcgcggacgccgtgtccgttgtggaggtggtgaagggcgacggcgccgacgccgcgctggtctggaccgagctgctggagccggccgtgaagcccccggcgctgagctgatgaggtggggtggaagccgcgttcttggttgcgattcttttgtttcttcttttttgtcgtcgcctgctatatatcattggcgagatcgtcgtgtgtaaattattcactcgctccgtggctatatccaacaaagcaagcaaggaagaagaagaagaatccttgcggtttctgagagtcaactctagtggacgtttgcagctgacgcgcgacgccttagattgagaggaacaagtgctttgctgtgtagccgagaaaccacggcgattgggccagcaacatagcccgggtagcatcctctccggtgccttgctcgccccaccgccaccaaacgcggcagcggaggttcccaacaagttcctctcctccgtgccgtgcgcgtgagattccccgggaccgggggggagcgacggcgacgccagccagacacctccacccaccaccaccttcttcgtcgcttgtcgccttgccaattggcaccggcggatgccaatatgccgtcgcatatcccgtttctttctacacaaaccctacccactcctggtatgggcaccaggcggtggaggtgtctggccagtgtctctctttgcaaacgccgcctttcgtcaagagagcggcagcagctagcgacggcgggttcaaaaagtgctcctcccatttggatctgatacgagacatcgaggggtctctccctttgtacactgcacaccacggtttacaaaaccattttagctgaaaaaactgttttccaccggtaatgatttaccgccggtaaaccggtaaaaatcgaccgatttgtacaatccaaaccaaatttaaatctataccggtttatcgacgaaaaaacggcggtgaaccgtcttaaactgcagggttttcacgaaaacgaactggttttcactattttttatagaaaaaaaatagaaaatgaggacaggatttatttataatttgctcaattcatattgcataataaatattaagtgatccatacgacatatgttcaccaaaataatatacaacatacatatgcaaccacaaactccagttctcatgcaacaaaaaacaagcgaacttcgcaatactcaaatacaagtccaggagaatttgtaagctcgtaacggtttaccatttgaactggaactcaaccttggcatccaaactaccacttaaattgggcaaaaatagcatctaatatgcctaaaatgaccactaaattcataaactaaaactaaaccttgcatcaaatctggtttaccggtcataaaaacggtttactaacaattttcgtttttatgaattttttattttaatttagaacgaattttaaaaaaactatgggtaaccgaaaccgtatcccgacgtttcgacaaaaccggtcggttctataaacattgttgtacacttgattagtagcatgggctagaccaaagggtggggtggggccgtgggggtgggagtgggggcaccagatatccatgttttgtggccaggtttcgctgcactatccatccagtgtcccagaacagccacacacgtagcatactagtacacctaaaaaatttgagagttagcattttataattatttacaaactactagatgctaagaacaaggatgggacgttgtttcgtcaagcagttacttggatttgtgtgtgaacccattcccccaaaaaatgtaaccattacccttgcttggcttcccctcctagtagtaatgctttgcctttgtgggaaagtactaatctcctccatcgtttccgtcatgtgtacgtgtaataactgcgtacatgacagcgaggcaccagccaacaacaacagctagcagagcagattaaagccagctaatctagacacgaaaatattgtagaaacagtataaaatcggtacaaattaaatttaaatgaacagcctcggtggcatttttttttagcaagttcgaccggttcggtggaagcctagaaaagtggggtgcagtgcaaatgcacgcagggatctgaaaagctgtccataatcataacgaaccatacagtttcgtgtccgtaacaaacaggcttttacgtgacagtgatacactgacatatatagcacgagagagagagagatgaggaggaggatacgaattcgagtacgtctcagaaagcctgatgatcacgcgtgagaaacgtacttgtgcttgtcggaaatgaagctctcagaatgcattctgagctgagagctggggcacgataagtctaggaacttattagattgttcctaactgccttacggcacgagataagcctgataaatttgaggggggcaaattatgtgtggatgtaattcgtttatcagtgattttagaggaggttatgagtgtgatggggtgatttggttgggtgtgttttttttgcaaaattgaatccggacgatgggttatataggggtaatatagatagaggtagagagagttttgtgcaaactgaacttgttagagttaccaacgtaaagcaggtgacaaacaaacactaaactcttgcgtgcacgactcgccattagttttattgggacagataatgaatgaggtgagtgcgtttgattggagcttctcttgccgatcgatgactcgagttgacgtcgacgcccaaacaaaataataatgctcggctgagacgtgcaaag

SEQ ID NO: 3823 - DNA, 3587 bp, Zea mays
  misc_feature (1654)..(1654): n is a, c, g, or t
tcactactagtgatcagaccagtgagctagcgactgtaccatgcagcagctgtaggagagcctggtggtaggtaggataggagtagcgccagccgccaagtgcgcgtccgggctggctgcttcggcgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggcgcggcggaggcggcccaggaagggcgtcgcgcacgcgcccgcgcacgcgccggcgggggcgccgccgctgtccccgtccaccatcccgcccgtgtccaaggagatccaggaggtggccgtccacgtcggctcgctccgccactacctcgagacggggcacgcgttcctcaaggacggcggcggcggcgacggtgagtccgtggcgtacgggtcgcagcgcgtccacatcgaggccggcaagggccagcgcatggtcgcggcggcgtccgacgcgctgtcggcggccgtgggccccgaggtgtcgcacctcggctggggccactggtacacgctgcgggagctggaggaggccaccgccgcgttcgcccccgagcacgtcgtcggcgagggcgggtacggcatcgtctaccgcggcgtcctcgccgacggctaccaggtcgccgtcaagaacctcctcaacaacaggggacaagccgagcgggagttcagggtggaggtggaggccatcggccgcgtccggcacaagaatctggtccggctactgggctactgcgccgagggcgcccaacggtacagaagtgcattattattgcttcttgctttgtggtaaatttttgttcgtgcgctgcgcatcgtacctctacggctctacctaacctaaatgcggttgcttgtgatcccaggatacttgtgtacgagtacgtggacaacggcaacctcgagcagtggctgcacggcgacgtcggggcagtgagcccgctcacctgggacgtccggatgaacatcgtgctcggcatggccaaagggtgcctcctcccacactgcttttcgttctgctcatgtactctgcctctgaacggccggcatggccagagagagagagagattgatctgtgggatggttcaggatcacgtacctgcacgaggggctggaacccaaggtggtgcacagggacatcaagtcgagcaacatcctgctggacaggaggtggaacccgaaggtctcggacttcggcctcgccaagctcctgggggcggacagcaactacgtcaccaccagagtgatgggaacgtttgggtgggtgtgagccgccgccgtgcttaaaattttgagcttcttcccttccggggtgaaatgaaatgtccgatcgatgtgagagttcctttcttttttgttggaagctacgtggcgccagagtacgctagcaccggcatgctgaacgagaggagcgacgtgtacagcttcgggatcctgatcatggagatcatctccggccgaagccccgtcgactacgccaggcctgccggagaggtcagtgcggcgtttgtggttgatcaattnaacgaacgaagcaacgggatcctgatcctgctgtgctgctgctacaggtaaaccttgtagagtggctcaagaacaaggtgaccaacagggactacgaggccatcgtggacccgaagctgccggagaagccgtcctccaaggctctcaagaaggcgctcctggtcgcgctgaggtgcgtggatcccgactcgcagaaacggcccaagatggggcacgtaatccacatgctcgaagtcgacgacttcccgtatcgagaggtgagccctgtcgctagtagtggctctggcccctgtctagtgtctactctactatgcccaagtcaatcgtgctgctcattcgctcgcaatggacgctgcaagtcgatcgatcccaagctacgttacatctggtgatcacctgtctgtcaatattagtagaacggtggtgccttctgcatccgcgtcagggttcaaaaaatagcacaacgacgttgctctgaatacttagctccgtgaccactgggaccgggtgtaaaaaatacttgcccggagacagtgcctgctgcacgaactgcccgttgggatgttaactaatccgtcgtcaggaataataactatctcaaagaaaacaacaccaccgtccggctccggcggccatgttttactgccacccataggccatagggcccctaaactaaactattgccggtcagatcagatgcagagacggccggtttgtatactccactccaccatctgcacaggttttcagagaccccacctgcttgtttacgtgcttctgcaggaccgtcgaactcttcggccgggcaacggcagccccctggagaaggcgaggaatccggcggcggggtcatgcgacggcagcagctgctacgggggcgacacgaccaccgcgagcacgccgtccagactagtgcaggacatgtagtagtgatgtgtttgtagccagctgctgctggccttctgagctctgcctgcgggctgcggggcaacatggaagatggacatgctgcaactctgctccgtcgttaattaaaggttcccttcctaggtgttgattttggactcaacagtgacttgacgtaagttttgccgcccgatggccaactgtttgtatagggaactgctgctcttcatctcaggccctaagtttgactgttctttgattcgcgtcatgatgtaaaaataaaagcgtgcgtctgtattggtcagctcctacagtcttcagacagaagtgctagaccaaggattgatttttgaaccatcgtagaatagtttcgttaaatcgtctccaccagtggagctaattcgctaaggtgtttaagacagcttcgctttttattttttttattattatctcactgtcatatgggttccatatgtcagctctttgtcttatttttttcttcttctcttcttccttccttctccatgaatttctcctcaaacgacagagaaccggccagtccgggacagttgcgccgacgctcctgactactcaattgaggatgaatggaagtcagtattaaaaaaaaatctttgcataggacaatcctggtttactttccaaatcttcgtctactcccctaaaacatcaaaagtcatatatgagatgatcttgatactttggaaacgatcctagagtatataagagcatctccaaaagctatcttaaaattaaaggaaaatagggaaaatcaagcctccaacagggctcctaaaccttctccaactttttcatagccccagaaaattcccattgtgtagctacaaactgggaaaatttgtgttcccccaaaactccttccgtcggcctagctagtgccccgccggcccatccacacggccacaccatttcttcgtcgcttggttcgttcgccgtgctttcttcgtgaagtatccggtgctagcgccgccagccactccgcccgccc

SEQ ID NO: 3824 - DNA, 2599 bp, Zea mays
cccctgaagccaaaagtcagcacagtactaggcactaggcagcgcagacagtccagagattccctgcaatcgctcggcttttggactagcggggtcgtggatgcccggagctgcagaggccacttgcgtccgtccgatctgcccagtggacggtccagaccaagttggagaaatcgatgcggacaacatcaccaaccttcttcttcccgccctgcagctgccgagagttaattcgagctttaatcacctcaacaagatcctcggttctgacttccgagcatggattaattactccaggctagtttaatccaagatccgcctgtcagaggagacgagcccacaggcacagaaacggacaacccagctcaactctcccgggcccacaggaagccagcccatctgctgctaaactgcctgtcctgtatcatctcgtgctcgtcggtcgtcactagtcctcgctcatagcaggcgccaggcggcagtgactcatcactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggcgcggcggaggcggcccaggaagggcgtcgcgcacgcgccggcgggggcgccgccgctgtccccgtccaccatcccgcccgtgtccaaggagatccaggaggtggccgtccacgtcggctcgctccgccactacctggagacggggcacgcgttcctcaaggacggcggcgacggcgacggcgacggcgagtccgtggcgcacgggtcgcagcgcgtccacatcgaggccggcaagggccagcgcatggtcgcggcggcttccgacgcgctgtcggcggccgtgggccccgaggtgtcgcacctcggctggggccactggtacacgctgcgggagctggaggaggccaccgccgcgttcgctcccgagcacgtcgtcggcgagggcgggtacggcatcgtctaccgcggcgtcctcgccgacggctaccaggtcgccgtcaagaacctcctcaacaacaggggacaagccgagcgggagttcagggtggaggtggaggccatcggccgcgtccggcacaagaatctggtccggctactgggctactgcgccgagggcgcccaacggatacttgtgtacgagtacgtggacaacggcaacctcgagcagtggctgcacggcgacgtcggggcagtgagcccgctcacctgggacgtccggatgaacatcgtgctcggcatggccaaagggatcacgtacctgcacgaggggctggaacccaaggtggtgcacagggacatcaagtcgagcaacatcctgctggacaggaggtggaacccgaaggtctcggacttcggcctcgccaagctcctgggggcggacagcaactacgtcaccaccagagtgatgggaacgtttggctacgtggcgccagagtacgctagcaccggcatgctgaacgagaggagcgacgtgtacagcttcgggatcctgatcatggagatcatctccggccgaagccccgtcgactacgccaggcctgccggagaggtaaaccttgtagagtggctcaagaacaaggtgaccaacagggactacgaggccatcgtggacccgaagctgccggagaagccgtcctccaaggctctcaagaaggcgctcctggtcgcgctgaggtgcgtggatcccgactcgcagaaacggcccaagatggggcacgtaatccacatgctcgaagtcgacgacttcccgtatcgagaggaccgtcgaactcttcggccgggcaacggcagccccctggagaaggcgaggaatccggcggcggggtcatgcgacggcagcagctgctacgggggcgacacgaccaccgcgagcacgccgtccagactagtgcaggacatgtagtagtgatgtgtttgtagccagctgctgctggccttctgagctctgcctgcgggctgcggggcaacatggagatggacatgctgcaactctgctccgtcgttaattaaaggttcccttcctaggtgttgattttggactcaacagtgacttgacgtaagttttgccgcccgatggccaactgtttgtatagggaactgctgctcttcatctcaggccctaagtttgactgttctttgattcgcgtcatgatgtaaaaataaaagcgtgcgtctgtattggtcagctcctacagtcttcagacagaagtgctagaccaaggattgatttttgaaccatcgtagaatagtttcgttaaatcgtctccaccagtggagctaattcgctaaggtgtttaagacagcttcgctttttatttttttttattattatctcactgtcatatgggttccatatgtc

SEQ ID NO: 3825 - DNA, 2410 bp, Zea mays
ctgtctctctcccgcggtaggaggggttatttacttatttgtaaaatagcagagatgggtgttaactaactgccaccgtaactatcggaaagggactgttaccgctcgctaacggtgcatgtgcagggacggggtcaacctctgcggcagcgacctgtccggcgtcggcgacggcgaggcgagccgacgtggctgcgcggcgttggacggaggtctgcaagcggtggcctctcccccgccttatcgcttggcgtgggcgcgtggctggagcctggagggcaggccagccaacccccacccacgtcgctacactggatgcacccggtccacacgcgcgcatcgcatcgctcccgccgccaaaaaagaagaatagtccatgcaccatgtccacaccttagtggcctcatcattcctgccccggcaccacgcgtttccccttcttccaccccaaaccaaacgaacaaaaaaaaatccagaaaaaacgagtctttaatcctcgccatcgaccgcaaagcccccctctgccccctccttttcccctccctcccacacgcaccgccgcgtccgcccccttcgctgcccctgcccggtcggttccgatggggtacgtgctgtcggcggtggcgagggtgctggagcagcccacggcgtggggggcggcccgggagatggcgctcctcgcggggccgctctgggcggcggtcctcctcggcctcctgctcggctgggcctggcgcccgcgctgggcagctggcctcgtcgccgcccccgcccccgccgccgctgcgcagccgcccttcgccacgctcggtttctggaaggcccagctccccgcccgtctccgcgccccgctcggctccgccgccgccgtgcggcacggggaggaggaggaggaggacgaggtctccgtgcgaggtggcaggtcgtcggaggcggcgagcgaggagctggcggtggggaagcgtgacctggccaacctctggaggctggtggagggcagggacggcggcccggcctggatcaagatgatggacaggtcgcttcccaccatgacctaccaggcgtggcggagggacgcgcagaccggaccaccacagtatcagagtagcagcatctttgaggacgccactccggaggaagtgagggacttcttcggggacgacgagttccgtgtgtccaacaagtgggacgacatgcttgtttaccataagacgctggaggagtgccagaccaccgggacgatgaaagtgcattgggtccggaagttccccttcttctgcagtgacagagagtacataattgctcgccggatatggaaactggggggcgcctattattgtgtcacaaagggtataccatgctcgtccattccacggcgcaacaaacctcgaagagttgatctgtattattcaagctggtgcatccgtgcagtggaatccaggagagggaacggagggtcgacagcttgtgaggtgctcttgttccaccacgaggacatgggcatcccgtacgagatcgcaaagctcggtatccggcaagggatgtggggatgcgtgaagagaatcgagcctgggctccgggcctatcagcaagccagggctgcaggggagccggtgtcacggagtgccctgatggcccagatcaacaccaaagtcggcgacagctttgtccggtcgctggagtccgacagcgacgggtccgaaaccgtggaagcggaagagaagcctgcgaggaaccgtgtggcgaggttccttgtgcttggaggggcagttgctctggcctgtactcttgaccaagggctcctgacgaaggctctcatcttcggcgtcgcgcggaaattcgtcgggcagaggaaggcactgtagcatctctggcatttatttctcagcgtcgtccgcttggcccgtggtccgcactaaccggacctgtcctttcactgtcgtagagtggaggatagaggtggttcagtgtctgcctaattggggcaaatgccattgaccattgtggctgaaagagaacagagctgatgaaaaacattttggtgtacagatatgctgccggctgttggatagcgaggaatggggaatagagcaaacaatgtacttctcgtttggagaacggaactcctacgatatatataaatgtgtttcatctaatcttgtatctcagacaagaacagatcagatgactgtgcagatgagaacaagcatttttctatgtagcttactgcggctacggcttctacaatattttgtttctatggattgcaggattgcagccgcagccacttgcagccgcagcagtggctgtcagccaactgaacaataatttgaatctagaatttgaattccattctatatatgacgacgctcgaattttttaatctagaatttgaatctgcaggcatgca

SEQ ID NO: 3826 - DNA, 1675 bp, Zea mays
aaaaaagcccagcgggctcaaaaaactgggcggggccccccacgtcctcctccggctactcgctcgttccgccccggcgtcccgccctcagccgccgccgtcgccccctccctcggttcgcctcgtcgtcgtcatgggcaaggcctccaaggacaagagggacatctactaccggaaggccaaagaggaaggctggagagctcgcagcgccttcaagctcctccagatagaccaggagttcaacatcttccatggagtgaagcatgtggttgacctgtgtgctgctcccggaagttggagccaggttttgagccggaacctgtatgtaccagcaaaacagtcttctgattgcaaggaaggtgatcttcctctcatcgtcgcaattgacttgcaaccaatggccccaatagaaggtgttatacaagtgcagggcgacatcaccaatgctcggacagcagacgtggttattaggcattttgatggatgcaaagcagacttggttgtttgcgatggagccccggatgttactggccttcatgatatggatgaatttgttcagtcccagcttatactcgcggcattggctatcgtgactcatgtactcaaagttggtggaaaatttgtggcgaagatatttcggggtaaagatacaagtctcctgtactgccagctaaaactgttcttctcgcaagttacgttcgccaagccaaaaagtagccggaactcaagcatcgaggcgtttgcggtctgtgagaactactcacctcctgaagggttcaaggaggaagacctataccacctgctagagaaagtgggtactccctcaggagctggcgatctagattgcagaagcggatggctggagggaccaaacaaggtgtacatcccgttcctggcctgcggggatctgagcggctacgactccgaccgctcgtacccgctgcccagcagcacggacggtggctcgtaccggagcctggaccccgtgcagcctcccatcgccccgccttacaagaccgccctgcagatgaagaaggcttccagccacggcgccggcgcggacgccatcaagccgtccgcagactcctgagccgcagaccgtttccgtttaccaccttgcgcggtggaagttgctttcgctgggtcctggacctggctctctagtctctctctacagaaacagaaccttcatctacgaaactaaaaaaaaaggaaaaaggattggaaacattgttgtggtaattttgagctggggatctgtgcagcacgtaactggttactgctgattaggctgagatcactgtttgtgtcctttgcatatttttgccttgtcttcggcaaccggaattccgggtgggcagcgtctcgtgcggtcgtgccctcaaggggcagcggcagtcccgtctcttccttctccacatggacacatggttccatccgcacgagggctccgccagccaatttcactgtgacccaccgccgcaccacgcttttggttctgtagactcaagggtcggcggcggcgacaatttgccggtggatgtggatcagaaggcagcggaccacgtgatgctacatcggcccacataactctaggccgatctaataattcaaatatcgggcccaaaacgaaggcccacccactggagactagtgcagtcctagactgtctgca

SEQ ID NO: 3827 - DNA, 2320 bp, Zea mays
ccttttactaattttatcacttaagctctaaacagaccggctaataaatttgctaattgttagtaagagagctactaaactgtttgctcattcgccatttaactttactaatagatgctaatatattgtaaaaatatatttattactaagtctctaaacatatcctgctaatttttacaagttaattattagtcacaggtaaacaataagcgaggagtacctataaaaaaaagtcaattccttccctccccatggccccacgtcaaaaaaggagcgggccgtaccaaggctgcaaggcacctacacacctactccacgaacgaaacacacctctcctcttgctgtcctgcggtccacttcttcaactagttatcccaggttctcaactcccagtagaaaacttcacctgctggctggctgcctgcctgcccacagaaattgcgcccggccgccccccattcaccttcaaaaaaggagccaggcttcccatcaacgagggtgtcggccatctgagcagctcccctgcccctcgcagcggctactctacaggtctagcgactctttcgccatccatagagggaggaggcgcggcggagatggtgggcggtggcggcggcgggccgctgcggcgggtgggcaagtacgaggtgggacgcaccatcggggaaggcaccttcgccaaggtcaagttcgcgcagaacaccgagaccggggagagcgtcgccatgaaggtgctcgaccgctcctccatcctcaagaacaagatggccgaacaggtgaccaaactggcctcgtttttcttcgcccgttgggttggtacttgggatgtagcaggatcgagagctgctcctgcttcacccccaaataatgttgatggattgggatggattgctctaccttcatgttgggattttaatccttgctatgccatttctgtggacgaatttctcctcgctttcaaaaggtgtcatcgatgcttcgcgaactgttgtaccatgcctgcttctgcttctttcgcatcttcttctaaacattgatagctgtagtactttgagatgtacccctgcacaagctagctgtactggtagatgccttagggtgacacaattcttatttgcagattaagagagaaatatccataatgaagcttgtcaggcatcccaatgtcgttaggctacacgaggcacgcttatctatctctttcttataaccattttttaacatccttcttatcacttgtcttttttttaataaaaagtatcgtgtcatccattgtgttatgtgcaggttttggcaagccggaagaagatatttataattctggagttcatcactggcggcgagctattcgataaaattgtaagactgctttggttaactattaactgttcttttttcattcttagcttctcgatataatctaggaaaataaatattagttccatgcatttgttatttggattatatgcctgtcacattccatcttggatgttcaattgccacctttgcttttattgtaagaggggaaattcgttggacgcggaagagacacacatttccctcactccctcagagcctttgtatttaatttatatgtgaaaaaaagagcatgtcactataggttccttatgtccatcaattgtggatggtatttgtggttttgattctaatttcatttgaacgtgttactgttactcctacatgtatgtaccagtccaaggaatttaatttgaagacacacatagtctattatactttatcttacttaggtttggttcaaacaatacctttacatgaaaagaaaactaatgacactgaaacatacaaatttcagattcgtcatgggagactcagtgaagcagatgcccgcagatactttcagcagcttattgatggtgttgatttttgtcacaagaaaggagtctaccatcgagacttaaaggtgaccattggatagaaaataagtattaagtatgcatttcatgaattttgggatctttaatctcattttacatgcatgcagcctgaaaatctcctccttgattcccaaggcaatcttaaaatttcagactttggactgagtgcatggcctgctcaggggggtctccttgtgtcgcttcattatagcttattctttttgttcccttcttaggatgcttatcggtcaactgtagggatctttccttctacgtacaacctgtgggactccgaactatgttgccccagaggtacacctgaatcatacactcagttcagaattactaaatgtgccattgaaacaaagtggtgttataagtttataacctctccctcttaagac

SEQ ID NO: 3828 - DNA, 691 bp, Zea mays
tagggttttttttttttttttttttttttcaaggaaccacagatttatttcactttcaccgtagcatatataggtagcagaatacagcaaaccggcctgacgacgacgtacacttggatggatcggaatggaagccacgaaatagcatagttagttaacatctctagagagcgcaccaatcatcatgtctctttttgtttgtttgtttgttatgtggacctattgctgctctaggctctagagataaggctctctccaagatcacatccacttcactgcggcatgttggggtgcctcgtcatcctcttgtcaccgttgtccctgccccaagaactgctgctgctgcttccactgccaccagcaccagcaccagcagggctgctggactgggatcctcggccgccttcttcggtttcgatgtgcttcacgtccgtcttcaggtacttgtagtgcctcttcacgtcctcggctgtcttgccgcagccgactgcccgcgcaacgttgtgccagcggtctggtgtgtccttgtcatatactgccagcgcacgctcgaagagattgttttgactctcggtccaggacgaactcattgttttatcttcactcagcaagagaagacacctagctaggagagatgcagggcaagcaatggctgctgcctgtgtctgtttggatccccggcccgcccggc

SEQ ID NO: 3829 - DNA, 1921 bp, Zea mays
ggtaccctcgggccggccggcgcgtgggtgcccccagaaattgcgcccggccgccccccattcaccttcaaaaaaggagccaggcttcccatcaacgagggtgtcggccatctgagcagctcccctgcccctcgcagcggctactctacaggtctagcgactctttcgccatccatagagggaggaggcgcggcggagatggtgggcggtggcggcggcgggccgctgcggcgggtgggcaagtacgaggtgggacgcaccatcggggaaggcaccttcgccaaggtcaagttcgcgcagaacaccgagaccggggagagcgtcgccatgaaggtgctcgaccgctcctccatcctcaagaacaagatggccgaacagattaagagagaaatatccataatgaagcttgtcaggcatcccaatgtcgttaggctacacgaggttttggcaagccggaagaagatatttataattctggagttcatcactggcggcgagctattcgataaaattattcgtcatgggagactcagtgaagcagatgcccgcagatactttcagcagcttattgatggtgttgatttttgtcacaagaaaggagtctaccatcgagacttaaagcctgaaaatctcctccttgattcccaaggcaatcttaaaatttcagactttggactgagtgcatggcctgctcagggatctttccttctacgtacaacctgtgggactccgaactatgttgccccagaggttctcagtcataagggatataatggcgcacttgctgatacatggtcatgtggagtaattttatatgtattgttagcaggttatcttccatttgatgaagtggacctgactaccctttatggaaagattgagagtgcagaatattcattcccagcctggttttcaggtggtgcaaaatcactgattcgtagaattcttgacccaaatccagagacacgaatcaggatagaagagatcagaagcgatgaatggtttcagaaaaattatgaacctatcaaagaaatagaaaatgaggaagtcaatctcgatgatgtcaatgcagcttttgatgatcctgaggacgataatgaggatgctttcgaagatgaaacaggtcctctaacacttaatgcattcgacctaatcattctttcgcaaggattgaatcttgcagcgctctttgaccgcagacaggactgtgacaagcttcaaaatagattcttatcacgcaatccagcaaaggttatcttgtcaagcatggaggttgttgcgcaatcaatgggatttaagacacacattcgcaattataagatgagggtggaaggtctaaatgccgacaagactagtcatctctcagttatggttgaagttttcgaagttgctccatcaatcttcatggtagaactacaaagagcagcaggagatacttcagagtataacacgttcgtaaataactactgcggcaaattagatgatatcatctggaaatttccaactgagaagggaaaatcaaggataccccggttatcaaagtctcattcataatctagtgctgtgtgttatcaattactatggacttaagtggatatatttgcagagtgtatcgcaattggattatgatattctaagtgtagctcttcgagtagtatatgtttgtatattcagagtccccatgtacaaagaggccgttttaattgaggtttccgtacctcgattccctgtgcaaagttttcatcgatgttttagactgcacatctgtatattttgtcgagagcatcagtttcttagacaccacctatgtatcatgtgtttgttgccaactagtgtcatttttgtaagatctaacttgtgatatacttggattgagtggtatggttgaaaagagtgtgaaagtccattaaaaatgttagtg

SEQ ID NO: 3830 - DNA, 3741 bp, Zea mays
  misc_feature (3192)..(3192): n is a, c, g, or t
cgtggcggcgcgggcacgcacggtagctccagcggcgtgggagcgtgcggcgtagcgggtccagcagatgagagagggagaagtgagcacagagggagagagcgatgagagaagaacagaggggtgagagaggcgactcggagcgtgagggagtcggctaggaccgggagatagagggagagtgaagacatgggcttgacctaatgggctggagcgtgagggagtcggctaggaccgggagatagagggagagtgaagacatgggcttgacctaatgggttagttgggttggtttgaattgattgggctagtcttttccttattattattattattattattattattattattattattattattattattattattattatgctaaagttagtcgtttgaattgaagaactaaccttagacacaaaagtgtggtaaaatatgacaaattagacagcgaaccaaacaagccaaaataatgcaaagccggacgcaaaaacaaacaatctctatgaatccattttgtgaaaagtgtggctcaaaagcgaagattggaccatagattagtagtcaagacggacaggactaagccaggtgagtcagctttccacaagaggacatctgcttggataaaacgttgaggcgaaacaaaatctccccaattctttggtgtcgctttagccccctttagacgaagacactacatccttcggttgtttctcacttcagataaagctgtttgctccactcagagtattatcttatgattcgcaagtctatcttagagttagagccatacataagtacataatactgtacattatctatttcctaatttttttataaccaaatagtgtgccttttagaattgcagcaccacacatacagatagcagcttgtccatttaacccgtagtgctgccaaaaaaataatttatactactcggttactacttctcgctccattttaaaatagtctttattcttgttttttttaagttaaccatttttttacttttatcaaacatatataagaatgcattaatgtttgtagtatattattagtatcatcagataactctttaaacctattttatagtagatttacttaataatataggcattgataataccttttttatgaatgtaggtaaaacattaaaatatttgatcgatctaaacaatatagcgacagccaaaaagggaaaacctgaacatgactttcatttccgcccaggtaaattctccccgcagataaacccctgtaacaaaactgaacatggctttgatttcagcccgcgtaaattctcccggcagataaacccctgtgcctgttgcagagtgtagtgcaggcgatgaggcgataggccgatagggatgccagccacgcacagcacactcgccgcgccgcgcagtcaattgaaattggaaagggagacgctcggtctgccccaaagacacaggcaggaaataaagaaggcaaaagaaaagaaaaaagcgtgtggccctgcttcctcccggggcggcgggtcccgctgccatccccaatgaacaagtagagctgcgctgcatcaggttggtcgtccaagcgcgcgcgggttccaaagccgcgcgagccgaaaccggaaaccacgtggcggccttatcctctccagaccctcgtcataaaagtttaatgaggaaaacctgcgagaaatagctgtgcgggaccgtggcggcacggcacggcacggcacgtcatgccggacaggggggagatgatgataatgccgaatccatcgcataaataaaccgggctctcctctcctttttatctccacccctcgcgccggccggctgactctcgcctcccgtcgcgttcttatccatccaccccgtccggcacccatttatatcctgtcgtccctccctccctccttcggccacaccgtgtcacaccgctgcttgcttgcttgcgatcgggtttggatttggggagcatcatggaggcctacttcttgttccacagcgggagggcgcacgagttcgcgtacgcggagcaggaggaggacatcggctcgccgtcggattccgaacccccgtccacgtccacgtcgagggagtccgcgggctcgtcggcggagctcgacgacgacgccacctcctccggctccggctccggctcggaccgcttcgagatgtccgccctcatgacgcagctccctcccttcaagcggggcctgtccaggttcttcgacggcaagtcgcagtccttcgcctcgctcgccgccgtggggtcgctagaggacctgcccaagccggcccggaagcgcctcaagccgtcgcggagctgcggcggcgccctcgacgcgcaccgcggacgcctcctctcgccgcgcaggcattattgcaccaagcccaccgctaggactaggaaggcagccgcgaggagcggcacgttgtcggttctcgcggccggcgcgccgaggatgccgccggcggtggcgagggccgagggcgtggccgccaaggttctgatcgtcagttgagccgcggatcggcctgcctgagctcaacatcgacgcacacactcgcaggcacagctagtacggaccgccgcatccacccctctgcctgaagctgttcggttttctttttgtttcccaatgcgtctgtggtctgatctctttgtaatgaaaacgcgcagctcaattagaatgaacttcagttggaaactcacatgccttgcgcgtacatttcagcatcaatcgctttccctagggtaattgcagctagaattaaaacagaaatcgtattctctagggaaatctccactgtgatttctggctcgtatcatgccctgaaaactttggaatgcaagagcaacggtcgcatagctttcattagtgaacagtgaacccaaatatccggcgggaggggggagttcctactgggtaacgccttgttcgtttgtgtcggattgcacctgaaatcgttccatctaatcaaagtttatataaattagagaagcaatccggttaggaaggaggggggagttcctactgggtaacgccttgttcgtttgtgtcggattgcacctgaaatcgttccatctaatcaaagtttatataaattagagaagcaatccggttaggaaccgttccgacccaccaatccggcagaaacgaacaaggcctaactgagaaaaacctgnaacctactcaaagatcaccctgaaccttttcagcatgaaaaccagaaacttcgtaatactactagataaaggaaaacattgaatgtgcctctcgttcgtagtgtagctagacaggactaacagtttgtgtcataaatctctccgtgatacaaattagtgtagctagacacgactaacagtttcctcgaggttgttcggctgactgtagcggtaaaatactatagaagccggagccagattaaactgtagctgtaatccatagataagatactgtagaagccggagctagattaaagccacatcaacccacaacaaacagaaatacagccaaatccatgttgaggaactgttaaacttaaatccatgttgaggaactgttaaacttagagtccatctttataggctctggtggaaagcaatgttcgaaaaccaaacacttccatatctgatgtgcaggaaaaaggatctgagagacatggaaccatgttcatacagcacggtactcaataagggcatgttctcttgtgccggaattcatcctcgtcccag

SEQ ID NO: 3831 - DNA, 945 bp, Zea mays
cctcgagccggcccacactgtgtcacagcgctgctatttctctatctggcctgctctgatccttgcttgcgtttcgcgtcccgtctgatcttctcgggaagatcatggaggcctacttgtttttccacagcgggagggcgcacgaggtcgcgtgcgcggagcaggaggaggacatcggctcgccgtcggattccgagtccccgtccacgtccacgtcgagggagtccgcgggctcctcgtcggagctcgatgacgacgccagctcctccggctcggaccgcttcgagatgtccgccctcatgacgcagctccccctcaagaggggcctgtccaggttcttcgacggcaagtcgcagtccttcgcctcggtcgccgccgtggggtcgctggaggacctggccaagccggcccggaagcgcctcaagccgtcgcggagctgcggcggcgccctcgacgcgcaccgcggacgccttctctcgccgcgcaggcactggaccaagcccgccgccgcgtccggcgccaggaagacggccgcgaggagcggcgggttgtcggtgctcacggccgtcgcgccgagaatgccgccgccggtgcgaggcctgaggacgtggccgccaaggttctcatcgttaattgagccacggatcagcctgcctgagctcgacattgacgcacgccttcacgtcacgggggtgcgctgtcgcaggcacagctacgcatcagcgcatccacccgtgcctgaactaacagccaaatcaatggcatgctcgtatcctcttctgtttcccaatgcgtttgtggtctttgcagaatgcagactgacctttttgtaatgaaaatccacagctcaattagcaatggacttcggttgggaacttactggggtgtttggtttaagaaatcactacatccaaattaagatggtgcatcatgagtttattcctt

SEQ ID NO: 3832 - DNA, 2807 bp, Zea mays
gactaaaatttagttcctatcttgtttggttttaaagactaaaagtatttaaaacgtattaaataaattataagaggactaaaatacctctaagcattatcccacaattagtgcaactgaaataaatgagtgacaaaacgtgaaatttatatggtttagtctcttttagtctcctcttgatggactagaaactaaaatagtttagtctctattttagtcataccgtttgataatttagggattaaatatgactaaaatagatagactaatctttagtttctcaaaccaaacgtgacctaagattctttactctatacaacaattatgtttactctatatatcaactagcatatattatattattatttttcacctacatgtgcttatcttatctccctatatccttctagcaacacacgagactagatagagtatgtcccttacaacgatgtataactataatttacatcctacaacataatagacatacgctctccaatttcctattagttgtcacttagaacaataatacggtctctaaaatataactataattaatgttttttgttaaaatataaataaactcttagtatatttatatttttataaaaatacttgttaagacaaattaatgcttataaatattagattttaaaactaaataataaaatagttaattgtacttaaaattttataagtttaactaaaatcttgttaaaacgacaaccaataaaccaatagtacacatgacgctgaaggcgtattttaccctacgacggcatagttcagcgcgtgcagtccgccactgcggcctacagctgtaggcctgtagcctttgccttcctctctgctgtggctctgcatctcatcgctgcggctcttcatcctcgccaccggacctctgtcgctcacctgttgcccccaagtccaaatgatgaagtccctcctcttctccgcccaccccacgtcgctgctcctccccgctccccgccttcgcaggctcctccgcctccgcgccgcctcctctgcctccgcttccgcgccgccccgagccgaccgccgctcccccgggacgccttcgcgccgaccatcctcctccctctacgcgcgccccagcctcctcgacatggagcgggatcgcgccacccgccgcgccgatgtcgacgccttcctcacctccctcggcgtcgacccgggcgaactcgcgggcctcgagctcccagtcaccgtcgacgtcatgcgggagcgcgcggagtttttgggttccctcgggctcacccaggaggacctcgctgcctaccctctcgctctcggctgcagcgtgcgcaagaacatggtccccgtcctcgactacctcggcaagctaggcgtacgccgcgatgcgctcccggacctgctgagacggtacccgcaggtactacacgccagcgtcgtcgtcgaccttgcccccgtcgtcaagtacctccagggtatggacgtgaggcccactgacgtgccgcgcgtgctcgagcgctacccggagctcctcggattcaagctcgagggcaccatgagcacttccgtcgcctacctcgtcggcattggagtggggaggcgtcaggtaggcagcgtcatcacccgttttccagaggtgcttggcatgcgcgtggggaagataataaagcctttcgtcgaacaccttgagggcatcgggctgcagaggttagctattgcaagaataatagagaagaagccatatgtgcttggatttgggctacaggagaaggtgaagcctaacattgaggctcttgtggacattggagtgaggaaggaggccctagcatccattgtgatgcagtaccccgacgttcttggacttgaactgagggacaagcttgttgcacaacagagcttatttgagtcgagcatattggttagtcgtgaagattttgggagagtgctggagaggatgccgcaagccattagtcttggacgagctgcggttctgaagcatgttaatttcctcacagcttgtggatttatgctatctcaagtgagcaaaatggttgtggcatgcccccaactgctcgcactaaatatagatataatgaggatgaattttgaatacttcaagaatgagatggagagggatttggaggagctggttgagtttcccgcattcttcacatatggcatcgagtcgactgtgaggcctcggcatgagatggtgtcccggaagggcctcacatgctcccttgcatggcttcttaactgttctgatgccaaatttgatgagcgcatgaagtatgatacaattggggttgaggaaatggagcgtgaggattcttctgacatgaatgcatctgtggatgaggtagagagtgaggagtatgaagacagtgattatggtgactctgatgatgagtttgttcgataatttatttcaccagtcattagatttttaactttggagtatgtgcttggtacgcgaaatgtcaaattatagcttaatgatgcatttctcatcttccttactgatgtatcccctcagttccaaattataagaggttttggcttttccaggtatatagtattaatcatttaaatattcattatgtctaaatgtatagtaaaaataatgtaagtagaaaagtcaaaatgtcttataatttgaaatagaggaagtacttgtcaattctatgccaaaacactacgggcaactaacactagtgtgtgtatcccttcatgacagacaactagcactagatatatagttataacttttaagcacttagatatacactatctagatatatagtaaaaacgat

SEQ ID NO: 3833 - DNA, 2079 bp, Zea mays
aaaaacccccagatttctctatatcacgacgctacccctccacgccgccgcctctcgtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcggggccaagggcgccaccggcgaggggtgctcatctcttgccgactgggcgtgccaccgcaagcgacgacgggaggagctccgacgcgacaaagaatctagaaaatacatgccagatccagcaaactgcaaagttgaagctgaagaatgtgatgcctacgaggaaggcaatgagcctgtagctatgatagaagaatctccgcctgatattgaggcagatggtgaggatggaaaaagcagcgactcatactgtagtatggagtgtactcaggttttgagagttaagtctatgtacatcagctctgcaattctagctgcaaagagccctttcttttacaagcttttctcaaatggaatgaaagaatccgaccagaggcatgcaactcttaggataactgcttcagaggaaaatgcgcttatggagcttctaagctttatgtatagcggcaagttgacgacaaaccagccaactgtcctgctggatatattgatgatcgctgacaaatttgagttcggcccttgacggcggcactgcagtcaattgcttagaaatttgcctatgaccacagagtctgcactgctctatctggatctaccttcaagcatttcaatggctgctgcagttcagccattgacggacaccgccaaggaattccttgccaacaaatacaaggatttgactaagttccaagatgaagcaatgaacattcctcttgctggaattgaagccatcctatggagcaatgaccttcaggtcgcgtcggaggatgctatctacgacttcatgataaagtgggcacgtgctcaatacccaaaattggaggaaagacgtgagatcttgggcacacgcttgctgccccttgttcggttctgccatatgacctgcaggaagttgcggaaggttattgcctgcagtgatctggatcacgagcaggcgacgaaatgtgtcacagaggcacttctctacaaagctgatgcaccacataggcagcgtgcccttgcagcagacgtgatgacatgtaggaagtatgctgagcgagcttacaaatatcgcccgcttaaggttgtagagtttgataggccgtaccggcagtgcatagcatacttggacctgaagcgagaggagtgcagccgacttttcccatctgggcggatatactcgcaagctttccatctagctggacagggcttcttcctctcagcacactgtaacgtggaccagcaaagtgcgttctattgttttggtctcttcctagggatgcaagagaaagggtcgacaagtgttaccgtggattatgagttcgctgcaaggacaaggccgtcaggcgagtttgtcagcaaatataagggctactatactttcactggcggtaaggctgttgggtaccggaatctctttgcgatcccgtggccgttattcatggctgatgacagtctcttctttatcgacggggtattgcatctcagagctgagctgaccataaaacaaccctagatgaggccgtgtttgtgccgcgcgcgtgtccaaatccatgcaatggtgttctgcagtgtagaatatggaaatcttgtgtgctgttttgttttgaaaacgacaactcaattttctcttgttcagttgtttgtacacctgaggaggatcatgtcatgttttgtactctcactaaactgtgataagtgatttagct

SEQ ID NO: 3834 - DNA, 3386 bp, Zea mays
  misc_feature (2941)..(2941): n is a, c, g, or t
tgttcagatgtattgaagttggcccaagctaacttgtggtagagaacacattaattattttttcatgtaggcgatgggaactgttatgatccttagatcatttgggacaaccattagcaggaagatggctgagcaaagtcggcgtgaagagagacttagagttatttggggaaattggattaattcttcatttcttggcttcttgcttgaagggagatacaatcccatccttttatgagagtggacttaacccttaagaaactaatccctagaactaagggagcaacctgatgtaatataatctctttcctaatccttatcccttcctcataggtacactaccacgggtactgttcacattagtccagactcgttgtgaggagggtaggtgggctggccctccgtccactcataacacttttgctccttttcggagcagctcgcctatggtacataggatcctaatcaggggaaccttgcctaatacatcaataggatacaatcagataaaccttccctaatacatcaataccatctatgcagcctgggcccttaggactagcgcatgtgttagctactattctgacaaatttaaacatgcctggattaaaatacacacctcatcggctgtgttcctatgttatacatgacacttccaggacagctggactccggggtgtttcttgacctacgtgcaaaaagtttcttcttaatgcaatgccatgggggtggtctttcccctgcaagtcgagtttttattgatcacccaatccagtgctaacatccaaacaggctaggcatcttgtgatgccgcaatgcgccattttcttttgtcatatcagtgattcattcattttataatttaattggatattttcttgccaggtgaggatggaaaaagcagcgactcatactgtagtatggagtgtactcaggttttgagagttaagtctatgtacatcagctctgcaattctagctgcaaagagccctttcttttacaaggtatatttcttttctggattgcgctgataatgcactgtattgtggtattattaactagctcacaacatttgtttcattctttttagcttttctcaaatggaatgaaagaatccgaccagaggcatgcaactcttaggataactgcttcaggtaatgtgggagtattgcagtatgcttgattgttctaaaaaataggattacataagcgctgcctttgttactgaaatgatgggatccgtagtacagaaacgatcagtctgaatgaggtttgcacgacctaattttcggttgctaccttgttgtacattatccatctttccttgtctcaaaagttttaggtccataataacaagggactagtgtatatctgttaaatgctttcttttttaacagtttgaacttttgactgaaacattgaatttctactctgaacagaggaaaatgcgcttatggagcttctaagctttatgtatagcggcaagttgacgacaaaccagccaactgtcctgctggatatattgatgatcgctgacaaatttgaggttggttcctgtatgcggcactgcagtcaattgcttagaaatttgcctatgaccacagagtctgcactgctctatctggatctaccttcaagcatttcaatgcgcgcctgcagttcagccattgacggacaccgccaaggaattccttgccaacaaatacaaggatttgactaagtgagtaatctcttgtcaatggaggtagaagttaaaccaaggaagagacatggccattaataataataataataaacgattctcattttcaggttccaagatgaagcaatgaacattcctcttgctggaattgaagccatcctatggagcaatgaccttcaggtcgcgtcggaggatgctatctacgacttcatgataaagtgggcacgtgctcaatacccaaaattggaggaaagacgtgagatcttgggcacacgcttgctgccccttgttcggttctgccatatgacctgcaggaagttgcggaaggttattgcctgcagtgatctggatcacgagcaggcgacgaaatgtgtcacagaggcacttctctacaaagctgatgcaccacataggcagcgtgcccttgcagcagacgtgatgacatgtaggaagtatgctgagcgagcttacaaatatcgcccgcttaaggttgtagagtttgataggccgtaccggcagtgcatagcatacttggacctgaagcgagaggagtgcagccgacttttcccatctgggcggatatactcgcaagctttccatctagctggacagggcttcttcctctcagcacactgtaacgtggaccagcaaagtgcgttctattgttttggtctcttcctagggatgcaagagaaagggtcgacaagtgttaccgtggattatgagttcgctgcaaggacaaggccgtcaggcgagtttgtcagcaaatataagggctactatactttcactggcggtaaggctgttgggtaccggaatctctttgcgatcccgtggccgttattcatggctgatgacagtctcttctttatcgacggggtattgcatctcagagctgagctgaccataaaacaaccctagatgaggccgtgtttgtgccgcgcgcgtgtccaaatccatgcaatggtgttctgcagtgtagaatatggaaatcttgtgtgctgttttgttttgaaaacgacaactcaattctctcttgttcagttgtttgtacacctgaggaggatcatgtcatgttttgtactctcactaaactgtgataagtgatttagctaatcaaactttaaaattcccacccaccaactaccacctcctatccattgcatcacttattggtttgtgcatgtattataaatatatactaatttttttaaaataaaaaacagtgttgggtcgggncgagaagatggcctaggaatggcatgagcccactttaatcaggccaagttgtgatattattaatgccttagaccaacccaataggcacaacttatttagttatctatagttcagtatctcattcctcaccatccttgatctcgtgagcgtgaaaaagcgagagaaaaaactttatcttgtctaaccccacaccacatacatcgtcattcgcactcacctaatctatgagttcagatcgtgtttgaataactatcccatttaagcaatgtatgtatatatgatatataaaaaccataacgatgtacggacaactaactagtatccatcaacacaagaacatacttgagaaaaaaggtaactacgaagagcatcattgatatcacttccttaactgcttcatatgcaatcacttcctcctttccaaagggagggccatcattggctc

SEQ ID NO: 3835 - DNA, 1343 bp, Zea mays
cattgggtacctcgaggccggccgcgaaggccaccgggaaggaaccggttcccgttggctcggctcggcttggcaaggcccgccaccgccctccctccccccgcgaccgcgactctgcgagcacgacgagacccacggacccacctcgatccagatccagccaactgcgcgcgtcggcgttaccccttcctcctcgacgccactgccgtggagcggggatcatccgcctgaaccgggtcgaccgcttcgttccttggtggtgggtagctggttgggggagctcagaaccttacacttacaactatgttctccttgttctatggtctatggaagcacgtcttcagcaaggcagagttccatgtgcttatcctcggagttcataaggctggcaagacgaccttgctagaaaagttgaagtcgatctacttgaagggagaagggcttccgcatgatcgtattgttccaacagttggccttaatattgggcgtattgaagatgcaaatgtaaagcttgttttctgggatctgggaggccagcctggcctacgaacaatatgggagaaatattatgaggaagcccatgctgtaatatatgttatcgactctgcttctgcatcatcatttgaggatgctaaatctgctctcgagaaagttctccgccatgaagatctgcatggagcgccaatacttatatttgcaaacaagcaggattcaccagcagctgtcacggaggaagaattggctagacatctgcatcttaaggagttagacgagaggccatgcatgttccaggctggatctgccttcaatgggacggggatcaaacatggcgttgactggttggtggaagaaatggagaggagtaaacgcaccgaggcactaagggcgcgtacagaagcagctgggaagatttaacacctcaattcagggctatcacctgtgattttccaaatgcaaagcatctgaggaggatggcttctgttaactccatgaatagagacgcttgtccgggtggagccttgtcctttcagtcacgggatccccagaaaagatttcttggttgtgctgctcttgcagttttgtagtagggtgtccattgtagcaatggcaggggtgaccgttgcttgggtttgttgacctgcgtagcacttaagattgtgtatctaaagttgtagggattcatgttcatgcgattatgcttggatatacggagtgacatcgtggagcataaagatgatttgtacattcgtcatgttcatcgagagtcatgtgacttttatcaaaagaaacaaatacattgtgatatcaatcacgatatatgtttttcataaaaaaaaaaaaaa

SEQ ID NO: 3836 - DNA, 875 bp, Zea mays
  misc_feature (805)..(805): n is a, c, g, or t
aagtcgtcatcgtacaggaaaacgtcgtggggcactccggcccccgccctccttccccttcccatctccgccgccgcccccgcccccgccccttactcctccagggtcgcgcctcttcctcctcctctccagtggcgccgtccccccgtgccccttcctcctcgcagtcacggccgcgcggcacgtgctccgcctcgccttcgccgttgtcgtcgccgccgccaagtaaagagagacagggaggcgcagtcgacgggggcgtggtgaggagggagttacgcggaggaaggaaggaaggaagggtgactgcggctgccggcggactaccatgtcgtctctgggaacttccaaggggatccttgagatcgccaagttcggcgtctacgtctccgtgcccgtcgcgctcacctacctcgtcgccaccgactccaagaccctcaagaagctcatgggcctccgcccgtacgtggtttacccgcctgaaggcccacgccctccaccgccagaagaactgcgcgaaagggcacgggagattgcccggaagaggcagcagagctgaatggtatgctgtgggttctctaggcgcctgtgtggctgttgtgtctagggaacaacacggacgatgaatcctcccatctcacgagaacagcctgggctggtctttagcatcctttcactgctgctgttgttacaacaataataataatatactgagaagcgagaatcggctagatataatataatcccgtgtattttctccttgggagccaggtcatagcgcgcgcttgacttccgaccgtgctgntgtaatgattaagaaacttgtgatcctgtctgtggccaaggctaaccaaaaaaaaaaaaaaaaagcggcc

SEQ ID NO: 3837 - DNA, 2338 bp, Zea mays
gcaatatggggacgtacagacattcgacacatcctgcaagagccatggaattgttacagtgtcttactatgacattagagctgcacaggacgcagtgagagcagtccataacaaacctctggggctgatgaaacttgatgttcaattttcccttcctaaggaaaatgttccaaacaaagatcccaacaatggaacactggtggtatctcttattgactcttccatctccagccatgatcttctccaaaaatttagtgtttatggcgatgtcaaggagatttacaagtctcctacaagctgcaataagaaatttgtagaattctatgatatcagagcagcacaagaagcactgaatgacctcaacaagggtgaaatatcatgctcacaaatcaaagttgagcatagcttttctggaggagcaggatcttgcttcgcagagcaatattcaggagaacagaagcaaaatgccgtagctcaccaacttaagaactctccacctgggaccattgggaagttagatactaagagttgggacagcagcactgttcataatttatattctccagttagaccgcaacacgataaatcacaacatggcttctctgtgaatcctcctcagaagttgtcatcgcctatcagaattgaatctacacagcagcatagtaatcaaactgcttttggtgaacatagtggatctcttggtcatggcaactttggaggtgggctgcaagccttccacccgcactcactgccagagtgtcacaatggtatttgcaatggctataactccatgacattaaatgcaaggaattctaacttcagatttactgaaggaatagactacaataatcacaaagttgaccacagtgaccttcatggtcattcctctgatcaaaatgaagcaattagagttgctggaattggaagttgcccccttcatggacatcactatacctggagtaactcaaatggttttcctcaaagcccctctgctccaatgatgtggcctaactttcagcaaccagtgcatatgcattgctaccctgctatgcctcctcacatccggcgcagtgctgcccatcctatggaccaacatcacttgggttcagctccaaacagtgttggtggttttgcaaatgcacactcttttcatccaggatcccttgaaagcgtagggtttcctggcagccctcagctgtatccatcagatctctctgtatttgcatctgccagaggaaattacagggagaccatgttctctgccataagtgccgggtttccatcaattcagcaaattcttcatgcgaccaacggaaggaatcctatgatgcacgtctccacctcatatgacgccactaatgatcgcataaggagccgcaggcatgatggaaatgctgcccagtctgaaaacaagaagcagtttgagctggaccttgaccgcatagctaagggtgaagactcgcgcaccacactgatgataaaaaacattcctaacaagtacaccagtaagctgcttttggctgtcattgatgagaatcaccgaggaacttatgatttcatctaccttccaattgattttaagaataaatgtaacgtgggatatgcattcatcaatatgacggatccacagcagatagttccattttacaagacattcaacggcaagaaatgggagaagttcaatagtgagaaagtggcatcacttgcgtacgccagaatccagggaaggaacgctttgattgctcatttccagaattctagcctgatgaatgaagagaaatggtgccgtcctatgcttttccacaaagatggcccgaacgcaggagaccaggaaccattccctgtgggtaacaatgttcgttctcggtccgggaggaacagaccacttagcagtggttcggagactaccaaagaggcaagtccatcaacctctcctaactgaagagaagccggctcccgatattccaactcaggacaggcaggcggtatttgctcactaactggaggctgaagggcatgtaataaatcatccccagttttgctgcttctttttcttttggtcctcgtcagcaaggtgacctgacttgctgagtgtgactagctaacgagaattctgcactgcatgagcctgctgaagattcaccttaaagtaactatgccttggttttgccataccattgacgtcaacggctacaggtaatggagaagacctggagtggtagagggaggtgtgtttcaggcgggtgaaaattcaagttgtacagttgaactcaccaggattggaaaatggtcatcaattcaaatttgagttgtttttcttaaaaaaaaaaaaaaaaaa

SEQ ID NO: 3838 - DNA, 2240 bp, Zea mays
  misc_feature (749)..(749): n is a, c, g, or t
atgttcatgcttgtgatggatctatactaccactttctccaaatcattttaaactttaatggcatgtttattgaaccaacctatgatgttgtgtgcagttatgcatttttcagacctagtttactaattactgtaattatttgttgtatttcgtaaagatatttgttacaataccatagcctagctagaaaactctaaaaacttgcatggaccattcattttggtgtacaatgttcacaaaatagtttcaactcattcggacaaagtggtgacacacatcctaagaaaggcatacatctctcatataaggctaattactaagtgagagatgctattgcaagtgagagatgtatagtaccactattgcaaaaatatttcaaaatattataacataatcataaacccaactaatgtgtccataaatagataattgcaaaaaaaaacatagagataaataaaaaacaaagaattaatataaaatggtatgcaaaacacaaaaaaagtctccttgcaggcgcttgaaccttggagctcggccttatagttagcaagacaaaccattgggctatgcacatgttttcgacatatacccagcgctagtatacttaaacgcattagactccgcattgccaaacacattgggcgccaaaaacattttcgccgtcgtcactaaaatagactccgctctcatcctctatctcccgcactcctcttatttctcccccactcttctttctcccccacttctncaaacctaatcgccgccgccgggacacgacggctgtcgacgacctgccccctcgaccaggtacctcaccgccgccgctgggacacatccgccgtcgacgacctgccccctcgaccaggtacctcaccgccgcccccttacctctcatcgcgtcgatgagctgcgtcggcgccgacttcactcgccgcatcccgctctatctcattgccatccgcatttctctcgccccttccacctaacacgccccatccacattgctctcgccaacccctaaaccctaacatcgctggatttgggtcatcgcagacgaccttgatggtgaacaaaaggaggcacagaagtcagaaaggtccaacccctaaaccctaaccatcgctagatttagtttaattattcattcgttgttatcagagatattgtaaattgatttatgtaatcattgtgcactcatacagttgtgtttggttccttacattgtgttatatgcagtcacatccatgttttagtagagaacttatgtttctagtactggtagacaaggttcaagaaagcgcgattaggcgtgcgattaggcgcggttaagcgctgagcagagggtcaacgcatcgcttacctactaagcgggcaattaagcgctggccctgcttaatcgtgcccatccggcatgtttaagggagaagaggagggagaggaagaggaggaacacctccggggtcaatccagcaggcagcaaatcgacggatcaacgagagagagagagagcggacggacctacgatggctgcaggcagcagattggtgagagagaggcggagcggcttcgcggtagaggtgaagatcgcacgagggaggagaggcttcgggagagggagccggagagcgtacggcacggaggaggataggcttcgggagagggaggcggagagcacagggcggcggcgcggggcgtggaaggaggcagcagagtactaggtcatcacgggagaggggttttgcgttgagcctcctggcaggtgggcctagtgggctgcagactcatgaagagaggaggtgggggttaagggctgctgcagggtggcccaatatcatgtatttttttctctttttaacaaaaatgattaagcacgattaatcacgcttaagcattttcaccaccataccgctcgctcagcgcttagtgctttcttgaaccttgctggtagaaagagatgagaatatcttcactttttttgttcatcagcttgtgtaaatctacatcgcctaatcaatgtactagctagtactttgaacattgtttaagcctgcataaagatttccacaaccaaacaggggaaacactacagttacagtgcaaccacaattatgaacttgcacaatcataaccaagcttcataatgactgaatctacacatcttatctatttgcttttagtcaaatccttccctgcaaatagtagtacctcttagcttttagtaaaatcctttacactatct

SEQ ID NO: 3839 - DNA, 1923 bp, Zea mays
aaaccattcggccccgacgccgcaactcgcttactcataaaccctctcgccttgacggaagtcaaaaccaccgagcatcaaaccctaggcgaacccgaaccaggaacaccgccaacgggtggtggagctccgcgtcgaccgcgcttctccagccatggctgaacccgagatggaggtggccgtagcgacagcagcagcagccggtcagaagagagagagggaggaaggaggcgatcctgctgctgaatgcggcggcgaggagacggaggtggaaggggcggcggcgaagaagccgaagttggaggaggccaaggaggcggagaaggggagggtagaggagacggcggaggggaagacacaggaggcaaatgaggagaaggcagtggaggcggaggacaagcctgtgacagaggaggcaaatgagaagaaggcagttgaagcggagggaaagcctgtgacacaggaggcaaatgaggagaaggcagcggaggcggagggcaagcctgtgaagctggggcctaaagaattcgcctcggccatcgatatgttcaactacttctacgctctgctccactcctggacgccgcagcttgagttcaataagtatgaacaaatggtgctggaggatttgctgaggaaaggtcatgctgaacctgctaagaagattggggcaggagtcgaagcatttgagataggcaaccacccggtgtggaaaagtcactgcttctttgtgcgcaggactgatggatctgtggatgacttcagcttccgcaaatgtgtggacaacatactgcccctccctgaggactttaagatcggcaatggcaagaagtctggtggccaccaaaaggatggcggtggagggcgggcaggaggacgccgtggaggaggccgaggcggctggcgtggtggacggggccggggcaggaggggagggtaggttcttacttcttaactggccctgcaattttgcccagttaactataccggggttgccgtggaaacgaaggtaggttcttactattatgttggtttattatgtggtgcctgtcctaaagaccgataccaacttttttaccttgcaaccggtatatgatccacgccgagtgcttgccgcatgctgttcttagtttctgtcatttcacccgcccgtattttgtttcctgggcattttttctgtcattggctaaacctgtaccacatatccgatacctaaaaaaactcaaatccagtcaatgacactaaacaaattttaatctcattcacgccattattaatcgtatactgatagttttggctaatttataccacactataatcctccagttttaactttgcaaaaaatcacaattcaatcaccccaatttcataacccaaattaaattcaccagataaattgcatctagacttaacatcattaaaatcaatgattcacatagccggataatcctctttcccatacatacataaattcaatggataacatttgtttatatcatcttttccacgacatcccacttgatcacatccaatgtccacaacatgccaacgtcgaccacgacgcacgtaaccctatcacgtaaccctatcgagacgctcgttgtcatcgtcgagtagtgcgtcgagacgcagcagcatggactcctgcatgcaggcgttgaggcatcgtcatccatctcgtcagcgtctcagcgacgctcacgagccgcagccggccgcgacagtgctgtggtggttgaagttgaagtcagtgttgacgaaggtgacggcgaagccacagtcgaggaggcagtcggctagctccatgaacgagatcacgtggccctgcgccaggtacgggagcaacgactcgtacggcgtcgacgaccatcttttcttggtcttgacctcttgataagtaggtctaactgcaggcatgcaaga

SEQ ID NO: 3840 - DNA, 3317 bp, Zea mays
  misc_feature (3204)..(3204): n is a, c, g, or t
cattgtaaatggaaagaattgtactaatctttgcttttcttgtatggcactagtttttttccccaaacttattatttttcatttgtgtttttcggcctgcagtctgtataatttgtgtttccggtagcacttgaaaaatgatttgtgtttccggtttaaaaaataattaaaccgctgctgtggtagcacttgaaagtcaagtagatgacttgttaacatgattgcagactagttttcctgaaacaggcatacattataagtcactatcactacacctttgaagcacgagtttcttcgtgcgttgtgtccgcccgtccccacgcttccagtgagagctcctccaattttcaaaaagtggggtggggcgaggggattcaatccctggctgcctggaacaaagccttcgactcttaccactaaaaccaacgcccgtttgtgatatataaagttgagaaattctaaatataattatactaatagtttgaaaataaaaaaatataattgtattcaaagaaatacttcatttaagcaaggtctacctatatgatatatcgaaaccgtagtaatgtacgggtagctaactagttgaataataatggaaacatctgtcagttggttattgtgctgtcgaaaatgattgctatctgtgttgtgcccactaggtaattgaccttatgggccacaaaggtagtgacattgatctcccgtagataaacccatagccttcattaatatctgctcatgggcacatggttttcttatttggatctcaacttttgcagtatgaacaaatggtgctggaggatttgctgaggaaaggtcatgctgaacctgccaagaagattggggcaggagtcgaagcatttgagataggcaaccacccggtgtggagaagtcactgcttctttgtgcgcaggactgatggatctgtggatgacttcagcttccgcaaatgtgtggacaacatactgcccctccctgaggactttaagatcggcaatggcaagaagtctggtggccaccaaaaggatggcggtggagggcgggcaggaggacgccgtggaggaggccgaggcggctggcgtggtggacggggccggggcaggaggggagggtaggttcttacttcttaactggccctgcaattttgcccagttaactataccggggttgccgtggaaacgaaggtaggttcttactattatgttggtttattatgtggtgcctgtcctaaagaccgataccaacttttttaccttgcaaccggtatatgatccacgccgagtgcttgccgcatgctgttcttagtttctgtcatttcacccgcccgtattttgtttcctgggcaatttttctgtcattggctaaacctgtaccacatatccgatacctaaaaaaactcaaatccagtcaatgacactaaacaaattttaatctcattcacgccattattaatcgtatactgatagttttggctaatttataccacactataatcctccagttttaactttgcaaaaaatcacaattcaatcaccccaatttcataacccaaattaaattcaccagataaattgcatctagacttaacatcattaaaatcaatgattcacatagccggataatcctctttcccatacatacataaattcaatggataacatttgtttatatcatcttttccacgacatcccacttgatcacatccaatgtccacaacatgccaacgtcgaccacgacgcacgtaaccctatcacgtaaccctatcgagacgctcgttgtcatcgtcgagtagtgcgtcgagacgcagcagcatggactcctgcatgcaggcgttgaggcatcgtcatccatctcgtcagcgtctcagcgacgctcacgagccgcagccggccgcgacagtgctgtggtggttgaagttgaagtcagtgttgacgaaggtgacggcgaagccacagtcgaggaggcagtcggctagctccatgaacgagatcacgtggccctgcgccaggtacgggagcaacgactcgtacggcgtcgacgaccatcttttcttggtcttgacctcttgataagtaggtctaactgcagatgtgtcccgtcaaagcaggctgtctctgcaaattgcaatgcgcttgcaccttgtaggtgcctatgccgctatggtatggctacgctacgctacgccgacataattgcgtacgtcattattttggtttttgtttttcctttgaaagaactagccatgcatggtgtgtctcatactctcatttgcaagcggagggagttaagaggatacggaattagtgtatatttatctatctcccctctccgcgacctcgttgcccaccacctcctcctctcctcactcgctccattgccgttgagagcatctagatgagggtaaatatgtaatcttgcgaaacttgtttaaaacaatacaaacttagtctgtaaaataaattaaagtaagttaaaccaaatttagatgagataaggagataaaggaggactctttacttggttgctatcttgagatgtgtattagcaatatataagctcaaaggaaaatagaaatcaaagtaaagtaaagttgacaagagacacaacgatttttcccatggttcggccaaagcctactccatgttgtggtgatcttcttcgtcaagggttacactcaaccactctcaaatgattcaaatatcaaacttgagtgtcatggtattcttccttatatcaaactcatttgcaaggaatctccacacgtttggagtctctcacagccttacacaaaatgatcacaatcaaaattagagtaagagagggactgagatcacgcactcaagagcacaatagcagcaacaacacgcacacaaacaaataggagagcgcaagaacaaaacccagagtgacagctcagaaatgtgctcaaatctctctcaaacactagaacagcgtggccgcggagtttccgagctgtagtgtgctcttaaaatgcttggtgtacgggtatagacgcattcacgcatatgggcctcttttatagccccaagaagccaaggagactgcttcttcctttggaaactaaagattgccttctgtctgtgggtgcaccggacactctggtatgcaacggtcacaagatcggttgattggtcgctttccttttcgggtaggcaccggactgtccggtgaccctttctngactgttggtgtgctgacgcggccgacgtcgatcgcgttgtcgatcgtttgtcgtctggcccaccagatatgtccggtgcacaccagactgtctgggtaatttttagcagcga

SEQ ID NO: 3841 - DNA, 7511 bp, Zea mays
  misc_feature (6421)..(6421): n is a, c, g, or t
cgaatactgtattgacacatagtttaacaaactacataaattttatgtgttttgagggaaagagagagcgacggagagatcatagttttgctccgtctgctagaagaacttcatgtgttggaattgacaatatagcggcatgttatgcggaggcccccattttctcagccgtccgcgttggacaggaactgtccatatttagatcgagtactcattctatcattatccatgtttatccacaacagccaaaattagcaatccaatacacaaaaccaaacatgattcttggtaagatcatgagaaattcaaaaatatccgacgaacccgatgcacggccgcactgatcccaagcaataattcccgggcccaccctattgcatttaaaaaaagggggctcccacccctccagaattacactacatcccacctacctcctcgcatcaggcaggcgggcctcgcgtttataagccacccttcctctcctccacggccctcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggcgcgccggatctcgccgtccgcgccggacggcgcgctgcggcccaagccggcggtgctggtcgccgagaagctgagcgaggccgggctggccgtgctgcggcagttcgcggacgtggagtgcgcctacggcatgtcccccgcggagctcctcgccaaggcggcgcagttcgacgcgctcatcgtgcgcagcggcaccaaggtgacgcgggaggtgctggaggccgggcagggccggctgcgggtggtgggccgcgcgggcgtcgggatcgacaacgtcgacctccaggccgccaccgaggtcgggtgcctcgtcgtcaacgcgcccaccgccaacactatcgccgcggccgagcacggcatcgcgctgctcgcctccatggcgcgcaacgtctcgcaggcggacgcggcgctcaaggccggtgagtggcataggaacaccgttcgtgcggctattcctcgcttggctgcctaattagtactaactccaaactggctgctttcgtctcgtttgttttctgccgagggtggttgattattctgggttggtgtgtgtgtcagggtgcctaaccaattcatgaacagtaaaggcgtaaagccattctagaatctggtttattgacagtttgacaccggttcggatgcgagcagaggttgcattgtttgatgtcgccatcactctggcgacgcaaataaagctggtccctggtgcttactgatacaccaaatccattacgaactttgttctagtaataagatattaccactgcctttcccaagtcgaggataacactggctgttggagttttgttgcctgacgagtgacgacgacacgcatgagcatccgatcccagctcaggcaatagctcgatccgctctttaaatattttttgggccctcgtttgaggtcaccgtcgaatctggcagatctaagcagagaataaaatagatctggagcttttaataatttctggtgcctgattcgttttgcaaactttcttcctatattgaggatagatcactatagcgctgatgtaatctgttacgttgtctcgtgcgtggcaacgcacgagcatcactgcttagcttaggctacagttctattcagccccactaatgccttgcctactatttatactaacttttatgatagtgcgtgcgatccattcatttctacagcactgctactagcgtaccaccttttttttagttttacagttcaaccatgccacgctgggcaccaacacccaaatttgctgggtccccgcgcttctgttggattggagtacactgaattttgtactcgacatggcgacttgtacagtactttcgattaaaaaatggtggtccgctcggtgctgccctcgcgtccgtcccgtggcccccctttcgaatctatagagactctccagtctccaggatatgtgtgctgaaatatgggcaggttcaatgaatcctcttgcctacagttttacttgtgcccaccatctaatcatgttcgtataggcacactgtggcgagcagcctggacggactgttttttaccattttttttatacggatacagatcagaatgaatatgaacgacagtatggggggctacctgtcggatacgggtatagccggtggtctgctactgctgctacgttggtaatatgtccctattgaactacaatttcaaaaacgaacctggtgcttcagtttagtggagaatacgatccctgaacgcttgtcaattctaaccttttctttaattgtaaagtgactttagttaatcgctgcaactttccggtgctaattgtgtaagccatattgctatttaacttttggggctacttatcaagaaaagaaaagaaaattcagatacttgttgcttcctgtttttgcgtgacaaacatttttgctctgccaaactgaagcatggcacatgtaagcctgtcttaatctgacttcccagctgccaaaatctggcatgaaggtgggtgacgtaactataagatatctgcaccgtaaacatgacttacagaggtgtaattctgggctaaagatgcaactgtgacttgaacagattatattcttccgtcatgtctattctaactgatatactgatgccaattgaatggtttgatgtattttaagaaagtgaacaaaattcgctttgattttcacacaggtaaatggcaaaggaacaagtacgtgggggtttctctggtgggaaagaccctggccgtcatgggcttcgggaaggttgggtcagaggtagcgaggcgagcgaaagggcttgggatgcacgtgatagctcatgatccctacgcccctgccgaccgggcccgggccctcggggtagagctggtttctttcgacgaggccatcgcaagagccgacttcatctccctccacatgccgctgataccgacgacgtccaagatcttcaacgacgagtcctttgcaaagatgaagactggtgtccggatcatcaacgtggctaggggtggagtgatcgacgaagacgctctggtcagggcgcttgactccggcaaagttgctcaggcgggtgatcacaacttcgttcgattctttaatgtgagtacgtatatggatgtgtctctgaaagctgagttttttttttatgcatgcatgaccaatgtggagcaggcggctcttgatgtcttcaccgtggagcccccgcccaaggacagcaagctggtgttgcatgagaatgtcactgtaacaccccaccttggagctagtactgtcgaggctcaggtctgcatctctacctctacctaccatcgtgtcctgcattgatgcagaccgcttgccgctgtctctgacgacgtaccaacttcactgattgagcgctccaaaatggctggcaggaaggcgtcgctatcgagattgcggaagccgtggttggtgcgctgagaggggagctcgcagcaaccgctgtgaatgcgcccatggtcccagctgaggtaattaagtacctttctctcgacatgtcgccccgtggatggctcgatctgatgatggaatccatctctgtccggtctttcttttcgtttgccagatcctgtcagagctggctccatacgtttctctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaacgcggactacacggccaagcagcgcggcctccgcctcacggaggagcgcgtggcgcacgacagccccgcggcggaggcgccgctggagtccgtccaggttcgcctctcgcacgtgcagtccaagttcgcgggtgccatcagcgacggcggggacgacatcgtcctggagggccgggtcaagtacggcgtgcctcacctcaccctcgtggggccctacgaggtggacgtcagcctggagggcaacctgatcctgtgccgccagatcgaccagcccgggatgatcggcaaggtcggcaacatactcggcgacacgaacgtgaacatcaacttcatgagcgtcggacggacgttcaggggcaagcaggcgatcatggccattggcgttgacgaggagcccgacaaggacacgctggagaagatcggggccatcccggcgatcgaggagttcgttttcctcgaactatgatggctagcagcgagttttctctaggattgatatttgttatagtacgtactgaactggggtttgacgtctcatgtcatggccacagggaggaacctgatccgctctggtctgtctgtctgtctgtctgtttggtgacctctacattttttatgcggggagaaggaagcaatatatattgtaaaaggtgggtgccttggcttgcccccctgcctaaataagaggtgtgtgccgtttgtttatctgtaaactgtgtatgtgtatgtgcttaatgcgtgattctaattaagcacatcatcattgcgtctgaaatgaagacgggatgtgtactgtgtggggcaacaaattgtggtactgtttgttcaactcgaaaaaaaacaggtcaccccaaaaaagaaagaaactctcactaaacaaaatttagaaaacaaaagaaccactaaactctagttgacgccctaggagcctgatgccaacttgaacgtccacatcctctttgacgaggaatgcaatatcgaggggctaacaatttatgtgttgaaaaattcttctatttctttccttccaattattccaccaaaagtaacatattaggccatcaaagtcccttgtatcgatccttgggattcttagcctacattttctccgctagctgataagagactcgtcctcacgaatagctggtaagcgattaagactgaaccaactggctaactggttccaaccttgccctgagaaagcacaaactttgcagagacgagtaggtgttcctggtgcaatgttacagagcttgcagattgtatcatgtgcccagttctttctgtccaagttgtttgcagttaagattttcagctgtagaagaatccaagcaaataacttacactttggcactgttttagctttccaaattggtgtaagttttaacctctgagatcttccagtaaattgtatacaatatgcactagtagtgaatccatttccaccttatctcatcctcgacagattcatcttgttggtttcttgaatcacctcccacaaggaaacatactctcttatgtcctattgtgttaccacccccatgtaaatgagaaacataggtattattcttaagggatttttcgaacagtgatgttcttccgtatggatttgctaagacgtgacgtgaggtgctaggttttttttgagcttggccatttaaccaacttgaatgccagaaaaggtttttgttgccaatacctgctttaacaatcgtggaggcatggaataagtctttgtctattttgtcatacgagatctccatgtttgcctagggcttatcactattcttccatttaaaccaacaccatcttagacttagtgccctatcaaaatgctcaagatctaggacacctagtctcccaaaacttttggtgtagacaccattgcccaatttgccaagtagtggcctccatttacatttaccgattcttcgcctttgcacaagaaagatctccaacaacgatcaattttcttgattaaccatttatgagttcgaaaaacagtgagatggtacatttgttgcaatgaaagaactgtttttaccaaagtctcgtgtcttgcttctctttccaactttgcagtcaacctccaaatttggcaattagaggtcgaacatatatccttcttagcttgcgggtgtgcaatggtaggccctaatacttacctcggaaatttgcaatcttaacagggatactttgctggatccaaccaccttattttatgtgcagatggttgggaagatctctattttgttcaggtttaccttcaaccccgagtgacacccaaatatatgaagcaacttcataatacccgtaggctcttgttggcgtgagtttgcaaatatatcaacaacatcagtataaagagagtgttgcaaatctgntgcttttgggagaattggatgaaggtagcctttctgtgccgtcagctctatgattttgtggagcgggtctattgccaagatgaagagtaataggaagagagggtctccttggtgaaggcctcttgcatgcctaaaagattttcgtagtgtaccatttaagagggtcttgcaggatgtcgttgcaaggagagtcgccattcaattacgccattgttttacaaaaattgagtgtctccattatctcaagtagaaatggtcagcttactaagtcgaagacacatcatatgtccaatttgatgaaaagggaaggacacttggacttgtgcaatgccctgatgacaatctatgcatagaacaaattatcgtgaatacaccttttctttataaaagcttttcgattagctgaccctaagccattcaatctcaaagctagtatttccgataatatctttgtgatactttttgcaaagctattattcaaattgataggctagaagtcacttatttgggttgcatcagccttctccgataataccacaagttgtgctttcatttattaagtctagtcttcttgttcctaggaagtgaaaggcccccaaagcttatatcatgtctattttgatcatatgtcaatattttatttaaaacaacccagtgaaaccatcgagccccgaggacttctcatatagaagctggtgaatgataccatcaatctctttattttcaaaaggagcctcgatgccacatagttcaattttgttatagcataggccctcccaattaaaacttaggcttcttgcttgtgttaggcctaacagatttataaaatgattataaattaatttttccttaggcttcttgctcgatttagaagtgcacgtggaattcttagcgaggcatagtggagttcctctgctctgtccactcctcgaactagaatacccagccacgggcatggagaagccgttgatgaaacacctattgctagtcgtggcgattagtgaagatgaccaatagctattcgtggtagcgcttgatggcctgcatgtcgtcgttgtggatccccaactgctaaaagagtgtctcgatg

SEQ ID NO: 3842 - DNA, 2245 bp, Zea mays
ctcgccctgcaagacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggcgcgccggatctcgccgtccgcgccggacggcgcgctgcggcccaagccggcggtgctggtcgccgagaagctgagcgaggccgggctggccgtgctgcggcagttcgcggacgtggagtgcgcctacggcatgtcccccgcggagctcctcgccaaggcggcgcagttcgacgcgctcatcgtgcgcagcgtgctccatggtgacgcgggaggtgctggaggccgggcagggccggctgcgggtggtgggccgcgcgggcgtcgggatcgacaacgtcgacctccaggccgccaccgaggtcgggtgcctcgtcgtcaacgcgcccaccgccaataccatcgccgcggccgagcacggcatcgcgctgctcgcctccatggcgcgcaacgtctcgcaggcggacgcggcgctcaaggccggtaaatggcaaaggaacaagtacgtgggggtttctctggtgggaaagaccctggccgtcatgggcttcgggaaggttgggtcagaggtagcgaggcgagcgaaagggcttgggatgcacgtgatagctcatgatccctacgcccctgccgaccgggcccgtgccctcggggtagagctggtttctttcgacgaggccatcgcaagagccgacttcatctccctccacatgccgctgataccgacgacgtccaagatcttcaacgacgagtccttcgcaaagatgaagaatggtgtccggatcatcaacgtggccaggggtggagtgatcgacgaagacgctctggtcagggcgcttgactccggcaaagttgctcaggcggctcttgatgtcttcaccgtggagcccccgcccaaggacagcaagctggtgttgcatgagaatgtcactgtaacaccccaccttggagctagtactgtcgaggctcaggaaggcgtcgctatcgagattgcggaagccgtggttggtgcgctgagaggggagctcgcagcaaccgctgtgaatgcgcccatggtcccagctgagatcctgtcagagctggctccatatgtttctctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaacgcggactacacggccaagcagcgcggcctccgcctcacggaggagcgcgtggcgcacgacagccccgcggcggaggcgccgctggagtccgtccaggttcgcctctcgcacgtgcagtccaagttcgcgggtgccatcagcgacggcggggacgacatcgtcctggagggccgggtcaagtacggcgtgcctcacctcaccctcgtggggccctacgaggtggacgtcagcctggagggcaacctgatcctgtgccgccagatcgaccagcccgggatgatcggcaaggtcggcaacatactcggcgacacgaacgtgaacatcaacttcatgagcgtcggacggacgttcaggggcaagcaggcgatcatggccattggcgttgacgaggagcccgacaaggacacgctggagaagatcggggccattccggcgatcgaggagttcgttttcctcgaactatgatggctagcagcgagttttctctaggattgatattttgttatagtacgtactgaactggagtttgacgtcttccgctctggtctgtctgtctgtttggtgacctctacattttttatgcggggagaagggaagcaatatatattgtaagagggtgccttggcttgccccctgcctaaataagaggtgtgtgccgtttgtttatctgtaaactgtgtatgtgtatgtgcttaatgcgtgattctaattaagcacatcatcattgcgtctgaaatgaagacgagatgtgtactgtgtggggc

SEQ ID NO: 3843 - DNA, 2584 bp, Zea mays
  misc_feature (252)..(252): n is a, c, g, or t
gatcgttttggtgctctattaatgacagtggcggagctggcgagtatgtcgtcccggcataccctgcaagtagtgatttcccttcgaccccttctgcatagatacgtgctctacgttggctattcccgttttcaaaccttcgtacgcccgcagacggctgttggctaggaattgcaacggagaattccacattaggttttggctccacatacccgtcttcgtgacaaaaaagtttcccatagggatccccangaactcttatagacgacatttctttctcatcaccgttcctcgtagagataaattcctgtcggagatctctgtgcccgcttaaattataatcatgacatactttttttgttattaatataaaacattgtcacttatacacattgtcagatgttaaaaatcattttatgtacatcaaaataaacatatttgtgcaacgagcgatctctgaataatataattatttatttttatatatattacatgaaaacattaacatatataagtttaacgggtccccgcggaaaaagtgatgagaaatgcttcctcatcccgtcctggtttactcattatgggaggatttttttttcgtttacatcctgtgggagagaaccatcatcatccctaatgaaggaattctccacagcaaattagggattgggtgcacattgccatctctactgctggctacagcttgttcctagtgcctgcctacctgaggctgcggtggcgtgaccacgccggcctagtgggctggtggcctggtgccctggtagttgctagttcgagctagggcttgtgcacagtgcgtctgcggctctgcgccattgctaacctgatatctgttttttttttgttcatttatatacacacgttatcatgggccatggacccttaaataaatttattaaattatatttaaaagttttgaacgatatacccttaaataaaatcctagatccgccactaattaatgagacggttttttgtatttttgtattctcgtaagctttgagcttgattggcagcctttcatatagtgaattctgatatagagtacaaggccatataggataggaacctatacacaagtacacaaccacagaaaatcctagtacctctgtatgttctctcaccttgtacgtcatcaacctgccgaagtcttggcgtagccacctcacaccccggcgctatgcggtcaagaaagactgtatggtcacgtgttagtggttaattaactggatggaccgagcaaaatattgtcactccctatgtcacgttccacccgatcgaatttggctcggctaactttatacttctataaatccatagccatcgcgcggtgtggagcatagcaaaactcgtgctgacacaacacacaagcacaaattgtgaagtgcgtgacgccgcgaggggttaagtcagcaagcaagcaggcagatagccatggcagtcgcaagcgccgagaacacgtcgtcgctgctcccgctcgacggccgcgtagcgctggtcactggcggctcccgcggcatcggccgcgaggtgtcctcccaactcgccaccctgggcgcgcgcgtcgtggtcaactacgcgtccaattccgccagggcagacgagctcgtcgcggagctcgcctcccgcggccaccaggccgtggccgtccgcgccgacgtgtcggacccggacgccgtgcacgcgctcttcgaccgcgccgaggaggcgttcgggtccccgccgcacatcgtcgtctgctgcgcgggcctcctcaatgccaagtacccggcgctcgcggacaccgccgtcgacgacttcgacgccatgttcgcggtgaacgtgcgcgggacgttcctcgtgtgccgcgaggcggcgaaccgcgtcccagccaacagcggcggccgcatcgtgacgttctcgtcgtccatcgttggcacgctcctgccgggatacgcggcgtacacggcgaccaacgccgccgtggaggcgatgacgaagatcctggccaaggaggtggcggcgaagggggtgaccgcgaacgtggtcgcgccggggcccgtgcgcaccgagctgttcttggccgggaaggacgaagcgttcctgcggagggtggagcagcagtccatgggccgcatcgccgagacgacggacgtggcaccggtggtggcgttcctggccagcgacgccgcggcttgggttaacggccaggtcatcagggtcaacggcggttttgtctaataagggtccaagtgcgccagatgttcagatatagtggtatctgccacatacgcaagttttttaaaaaaaaatacgcaaaaatgtgagtggcgcgtgtgtgttttaataaaaaaaaatcaagttatgcagtgtactgagtgcggattatgccgtgtaactcaacttattatatgaacgtcatatcaagttactgcggaacaagggctctacagcgatgctgtccacgtttcgctttgactagagaggttatactgagatcgagtctattggcttagctttaatttgttatttctataataattttgtctctatagattacaactgtatgagtccaaacaaccgg

SEQ ID NO: 3844 - DNA, 1214 bp, Zea mays
ttttcttcttctgcttatcttctctcttatggttgtacttgtatttttattgtatctttaggccctcagtatacaacagctagagcgaatagttagtatgtactgggatgatgtgaatggtacaaacactatttcagcagaggtaagttggtcagtttccccaatatagtttacgatcttgtgccacatttggtttgtgttctttttcaaatgacatcccctgacaacttatctttctatagtttacatcaagcttgaaatctgccatacgtgatgaatccaatatggccacaaatttctctatactgctagatgatgattccaggtttgttaatctgtgaaaaatgttatccacattatttttttaaaaaaaatctattactactgatatttaatggtttcccttgttcatttcttaatgcagtatacctttttcacttgatgatattacaaagacattgccggtcattgagctggctgatgacgactttctgccatttgtccatgaaaacccaagctttgcgtttttattgcaaagaggggagtagtcttttttttttgtcaccattgtgacttcacctacctgtggataagtcaggattcctgctaggatgtacagtacgcgtgattctttttgtaccaggtagcaaggcatcaaagattagatgctaggtgagcttataggcttctggtttctattgatttgtttgttggttggatatttgtattcaggttttccctgccattttttctacttgtagccgttttttgggcttgtatactaggtggtaagggcagaagaccctgccctgtaagcatagttacacaaggtcttgctgtaggtatggaagctgtacatgtgttgtaacggattataaaagggggaaagtagtgcgtagtgatggctttgtggttggtgtgttgcttacctttgatcaatgatcatgtattggttcgtcatatattgtttattgtactgcaccccattccattgtagataacatacacgctcaagacttgttctgggatgtcaaatgagtaatctgtttcggtccagaaatgtcatgcttacttccagatcttctgtaatgaacacaaataattatcattttcatttatttttgttcttagatcctgctgcggcttttatagggtaattatcgagagaaacgttgcggtctaaggttggcctggaccaaaaatgcatgcgacag

SEQ ID NO: 3845 - DNA, 877 bp, Zea mays
gctgtcgatttcctggtgatttctcttaaaccaatgaggacattaagagagatacaccctgcggtgtgccctgccctcagcatacaacagctagagcgaatagttagtatgtactgggatgatgtgaatggaacaaacactatttcagcagagtttacatcaagcttgaaatctgcggtgcgtgatgaatcgaatatggccacaagtttttctatattgctagatgatgattccagtatacctttttcacttgatgatattacaaagacactgccagtcattgaggtggctgatgacgactttgtgccttttgtccatgaaaacccaagctttgcgtttttattgcaaagaggggagtagtccatttttcctcaccatggtgacttcacccacctgtggataagtcaggattcctgcctaggatgtacagtacgcgtgattctttttgtaccaggtagcaaggcattaaagattagatgctaggtgagcttataggattctggttttattgatttgtgtgttgattgtccatttgtattcaggttttccttgccatttttttctgtttgtagttatttttttgggcttgtatactaggggctaagggcagaaggccctgtcctgtaagcaaagtagcacaaggttttgctgtaggtgggaaagctgtacatgtgttgtaggagggggagtagcggttatcctgctggtgtagtgatgattttgtggttggtgcattgcttacctttgatcatgcattattgatccgtcatatattatttattgtaccgcacaccagtccattgtcgataacttacactcaagatttttttttttctgggataccagtcttaatgagtaatctgttacggtccagaaa

SEQ ID NO: 3846 - DNA, 1903 bp, Zea mays
tatatctatcggtatactacctatgtcgtcttcagatgcccaggtcttcgtcgtgtcctttttcggcaacgaacgggtatgttcgcctcttcccttcccttcttgctctacgaaaccttgtaagtgggggaggcgagggatgagggtctctgatttgctgcctacggtgcccgtgtattcataaaaaatattatgtgaaaagcgaagacaatcaataaaaaatcttgagatctttttttgaataatttacgtgatattattgtgagccgtcgcaacatacgggtaaccgactagtgtgcctcaatgaacgagtacgaccattgtaaccttacagattccatggcgagcctaagtggttatatgggccaggcctggaaatatatgggccgattcaggcctgcgatccaaccttagatcatatggggcgccaggcgcctgctccagcaatctgcccagccaagttcaagttcagttcagaatcagaagttcagaaccaaaactggtagtatcaatagcagtatcaatagcaatctagcacttgtcaacctaaccgattcccatccaaccaaccccgcacaccgccgcgggaagcagaagagactggaagagcctacaaaagcttgggggcgcggcacacaacgcaggatggtgggcttcctccgggccttcgccgccgcttccgctgtgcccgcagcagctgccgcagcctatactctctttccctcctccgccccttcctcctccaagctccgcttccctcttcctgactccttcctctccgccgccgcctcctcgacctccgggcgcgctcccaacgccgtgcccccgatggccaccgccgctgccacggctgatctctcggctgccgatgataagcgcgggccggcgcctactcgcagctcaccgccggtagtctgttcgcttcgcctgagaactgcgcggcttttctaaccttgtgtgtgtgtgctgctttggtgtgttgcagcagcgggactcggcgcttccggagctcacggtaggtgctctgactttactagaggcatagaatcttctgttttccacgatgagatgctccttgcgctgctaggtgattgcggtaagctgaattacttttgaaggactagtttgaattggtggttgagaggtggaaaatcgaatatatcaattctgtatctaggtctaaatagctcgagatcttggtccgagtgtggtggtatgctcaatccaatggcgctgcaggtggcataattgattggctagattgtttcttcttttctgcagttagtggatgtttttccaatttgtagagctagtaatccactagcgtgcgctagcggtatcctatcatctcatctagctatttagaagaaagaggagctgcatcagtgaattttggttgcatctgcagatgttgtgctaaagatcatgtctgtcttcatgacacattaagatatttgattcataaaaggtatcagcaccagtaatgaatctatcctttgatttgatttctccctgctgccagaagatggctacaagggattaagtaaattgtggatatgggaggtctttgaggagccactatctgatcttcagatcgtgcctttgacaggggcattcaattttactgtgaactaatgacaaaatttcagtatggaagtcagatggtaggtagcataaatcatccaaacacttatatttttcttggacatgtgttacaccatttggatggtatgaggtatcagctccaaattgtctggcttgctatgtcatattaataaagggccataacttagcaccaataactaaagggcattataattttctccaagcaagataagatcttgtgtgcagaagtgatgtattagattcggtaactcgggaactaagttatgtacttcgggag

SEQ ID NO: 3847 - DNA, 1282 bp, Zea mays
ccgggaaaaactgatagtaaatctagcacttgtcaacctaagtacctaaccgattcccatccaaccaaccccgcacaccgccgcgggaagcagaagagactggaagagcctacaaaagcttgggggcgcggcaacaacgcaggatggtgggcttcctccgggccttcgccgccgcttccgctgtgcccgcagcagctgccgcagcctatactctctttccctcctccgccccttccttctccaagctccgcttccctcttcctgactccttcctctccgccgccgcctcctcaacctccgggcgcgctcccaacgccgtgcccccgatggccaccgccgctgccacggctgatctctcggctgccgatgataagcagcgggactcggcgcttccggagctcacgacggaattcatggtggacatgaaatgtgagggatgtgtaacagctgtgaaaaacaagctgcaaactcttgaaggaataaaaaacattgaggtggacttgtctaaccaagtcgttagagttttggggtctcttccagtgaagacaatgttagatgcccttcatcaaacaggtcgagatgcacgactgattggccaagggaacccaaatgatttcttagtttctgctgctgtagctgagtttaaagggcctgttgtatttggtgttgttcgtctggcccaagtaaacatggagttggctagagttgaagccacatttagtggtctatcacctggtaaacatggatggtcaataaatcagtttggggatttgacaagaggtgcagaaagcactggcaatgtctataatccgccagatcatttatctgataagccacttggtgacctgggaacactagaagctggagagaacggggaagcccatttctcaggaccgaaggagaaattgagagtggttgacttgatcggccgctctattgctttgtatgcaaccgaggacagatcagaccctggcattgccgcagccgtgattgcaagaagcgccggggtaggagagaactacaagaaactctgcacttgtgatggtgtcaccatttgggaatcaagctaaacctgctaccagcgaattttccatactatttacttccgtatgttgtacgcacattaatgtagaaacaatcaaagtggcaactgaacatttggaataagcttgaatacattgaggaataaaggctgttctcatgtggagcttggacagtattttttttgcgtcggttagtggacctgttctgcttctgccgcgccgaaaaaaaaaaaaaaaaa

SEQ ID NO: 3848 - DNA, 1616 bp, Zea mays
agcacgttgtacgggtcgaggttgtccaggctccggccgggacggacgagcgggcaaccaccacacatttattcttcaccggccccggccgcgtctctccgatccgtcgcgcgcgatctggacgacgcgacgccccgatcgttggtggcgcgcacgttggcgtaggtagggcggcgtcgcggccgccgatgcgctgtcgcctgcctcctgtctccggttcgttttgtttaaaaaaaatggagcaacttgttcacccgccgccgcctcgccaagtgcctaaatgcacgcgccatgtgctggctcggcggactgccgcgccccgtgaccctgcttgtggcggcagcttggggagttcagaaacacgaacatggcatggttgcctgtccgatccggcgttctctcaaccttaacgtttgccaaggcgttttctttggtactctagactcctgtatgtactgtgacactgtagtgcggtctgaggtcgaggacagcgaacgcgttggctgttcaatgttcatgtatacgactgtcgcttaatcttgcaaatcggcaaatgcattttgttgagttaaataaaaacgtgtagcggccgaatctttccatgtggccgctcctgatgccgacgtggtgtggtggcaaatggcatggcaggtacaaggacggctccgcggcgcgcggcgtggtgggcaccgacgcggccaccatcgcgctgtcggggagcgggagcgaggacggcagcggcggcggcggcaggcgcgcgaagctgcagggcgtggttctgggctgcaccgccacgtacgacgggcagagcttccagtcctcggacggggtgctgagcctgggcaacagcaacatctcgttcgcgtcccgcgccgccgcgcgcttcgggggccgcttctcctactgcctcgtggaccacctggccccgcgcaacgccagcagctacctcaccttcggcccggggcccgagggcggcggcgcccccgccgcgcggacgccgctggtgctcgaccgccgggtgagcccgttctacgccgtggcggtggacgccgtgtacgtggccggcgaggcgctcgacatccccgcggacgtgtgggacgtgggccggggcggcggcgcgatcctcgactccgggaccagcctcaccgtcctcgccaccccggcgtaccgggccgtggtcgccgcgctcggcgggcgcctcgccgcgctgcccagggtcgccatggacccgttcgagtactgctacaactggaccgccggcgcgccggagatccccaagctggaggtaagcttcgccgggtcggcgcggctggagccccccgccaagagctacgtcatcgacgcggcgccaggggtgaagtgcatcggcgtgcaggagggcgcgtggccaggggtgtcggtcatcggcaacatcctgcagcaggagcacctctgggagttcgacctcagggaccgctggctccggttcaagcacacgcgctgcgccctatgatgatttgctgacggacgccgcgaatgcatgattgattcctctatcgcatcgcattgataaaatttgtgacgaggtttttttctgaatgaaatgaaaagatgattcttagcgcaacgggaaatcg

SEQ ID NO: 3849 - DNA, 2538 bp, Zea mays
tccgcgccgccgcgtccaggtcgtgggcccccatcgcgtgctcctccgacacgtgcacctcctacgtgcccttctccctcgccaactgctcgtcgccggccagcccctgcgcctacgactaccggtcagtactccccgattgcccattgccctccgccgatcgatcgcctcgtgccgctcgacccactgacacgcacacgtgctcctcactccaccggatcgtcacgctggtggctggctccggttccgtactccgtgcgcgacacggccggcctggctggcttcccaacccaacttcccaaacaggcagcgccgcagcggcttgaagtgccggttggtgggcgggtgggtcggggcctcgggggatctcgcgcgcgccattactcgcgaagctctttttctttttttaccgcgctcgtcctcctcctcctgctgctgctgccggtctcgccgcggcatgacagagcgcgggattcaattgcgtagcccggcagcaaggctctgcttctgctcgatggggttgctaccgccgcggacacgagtttcgctgactgggagccatctccatgcgccttgtgctttactcaacttgcacttcacttcctctcctacgaagttacttgagccgagcgagacattcagatacttgctagagtagagtacacgactcacggcgacagcagagtaggttctagggtttgaccaaccacatgctgtacgggtcgaggttgtccaggtccaggctgccaaattggatgcgccgttaatgttgttgaggtcttctgctggttgcggccgggacggtagagcgggagccgggaggggcacgcacacatttaaatttaccggtcccggcccagcccgcgttcctgtctggctccgatgcccatggtctttgaaacttgccagcgcgcttcgttgtcttctgatgctactgcggtaaacagtgtcacagtgtagcatgacctagccaacgcgttggctgattcatcagcagaaagccatgcagtcattcacccgtttaccagctaagcttttgaccggtcgggcactactactttccagctagttagtagttggtcaaatgcgccgtactacttggtaacatctcaactggaatggagaaaaaaaaatgacgtgctagcctcgggctgccccaggcataaccatcgtatgagctgggattactcttttcagccactttgcggactcgttgagctcagctttacagttcatgacgagacgtatctttccgtttcccccctgtctaaacgattccgaagtacagaccgcatcgaagatgagtagtagagttcttggtttggtgccctcccaaaaagaccagggtcccccattcgaatgcaaataatgcattttttatgagttcaatgaaagcgataagcacgttattatccttcgtattcgtaatatagtacagcacagcgtgttgcggccgaatctttacttgcacgcgggtggcggatcctggcgctgacgtggtggcaatggcgcggcaggtacaacgacggctcggcggcgcgcggcgtggtgggcaccgactccgcgaccatcgcgctgtccgggagcgagagccgggacggcggcggcaggcgcgcgaagctgcagggcgtcgtgctgggctgcaccgcgtcgtacgacggccagagcttccagtcctcggacggcgtgctcagcctgggcaacagcaacatctccttcgcgtcccgcgccgccgcgcgcttcgggggccgcttctcctactgcctcgtcgaccacctggccccgcgcaacgccaccagctacctcaccttcgggccgccggggcccgagggcggcgccgcggcgtccagcagctcctccgccgccgcagcgcggacgccgctgctgctcgaccgccggatcagcccgttctacgccgtggcggtcgacgccgtgcacgtggccggggaggcgctcgacatccccgcggacgtgtgggacgtcgcccggggcggcggcgcgatcctcgactccgggaccagcctcaccgtcctcgccaccccggcgtacagggccgtggtcgccgccctcagcgagcgcctcgccggcctgcccagggtcgccatggacccgttcgagtactgctacaactggaccgccgccgcggcgccgcagatccccgggctggaggtgcgcttcgccgggtccgcgcgcctgcagccgccggccaagagctacgtcgtcgacgcggcgcccggggtgaagtgcatcggcgtgcaggagggcgcgtggcccggggtgtcggtcatcggcaacatcctgcagcaggaccacctctgggagttcgacctcagggaccggtggctccggttcaagcacacgcgctgcgccctatgatgattgctcacggacgccgcgcatcattcctctatgccttgataaaatttgtgacgagtttggagggagttgggtttttttttcctgaatgaatgaatgaaaatataatttttagcgcaaagggaaatcgttcaccttgcatttttagcttggaggaactgg

SEQ ID NO: 3850 - DNA, 3122 bp, Zea mays
caccgaatcgtttttgcgcctagtactagtcaatttggggatgaagaaggtgacatgaatgccttccgtgataatattgctaatgcaatatttgccaatgtcaattgaattattttatatatatatatatatatatatatatatatatatgagtttcaacctagtacaaatatagagggcattcttgtcttcctcatacaaaagaatcctattaacaactcaaataatctgggtaaacaaacaggactactcagattatataatccaaattatataatcctccaaaaataatccagattatataatccatggaggtaaacaaacaggccctaaatttatctagctataatagttaatttaaaacttaaaggacgtatgttaccctatttatttgtagtttaaggttaaaaaatcaaactatcatataaggtggatgttggttgattggttgaataatgtactttacttttgaataaatatttttttattcctacgtaaaaatggtattacatcgatagattttgtgaatactttgtctatacctttgcgattatttttattgcaactgcatgtggacatgctgacttgctgccttgctggaatggcatggcacatgacatgagtctctagtcacctgacaccaagacataacaagtagataccgacacggtgaccacgagacgacagcaacaaaatccactgtagacacgcttttcttaatcccgaaagctgtaaaccaccattgaccaccacttaatcaagcagcacacgcagccctggggctgcggcggtgctgacggctggctgcctgagctggggctgaccagtgactgcactggccggtgattttgcacgaaccaccctgttttacgctaaaatctcgatacgatcctgcatctctgatcagctgattaaaatcctcgtccccttttgccgtctctctgttcacggccctcgccaaatccccaaaatccaagcgcgtcgccgacggcattgcgtcgccattgcctccaaatccgtgtgcgactcgcgtgatcccagatcccgctcgccgtattccccgcagtgacctctgacaagagcattttccgcgcggaaaatgccgccgtttcggccggctcttggaagggcgcttcttctgtaggaccgcggcgcgaggctgcgatggcgttcgccgccagcgagggaaatctttccccggcgctgcccctggccactctgatcggccgcgagctccgcggcgacggtaccgagcgcccgcacgtgcgctacggccactctggcttcgccaagcgcggcgaggactacttcctcgtcaagcccgactgcctccgcgtccccggagacccttcctcctctttctccgtcttcgctgtaggcccacttttccccctaagatattcttttggtgtctcgtttgggttcggtgatgtgatggtctgtttgtttggtttgacggatctgcggttcgcaggtattcgacggccacaatggcgtgtcggcggcggtgttcagcaaggagaaattgctggagcacgtgatgagcgcggtgcccgagggcatcagtcgcgaggactggctacaggcgctgccgcgcgcgctcgtcgcaggattcgtcaagacagacattgacttccagcgcaagggtagatggcaccaactcaccgagtgatctttggcttctctttcaactgcaaccccgttgagtatctgggctaacctcgctgaaaagatgctaattctgggaactggtgcaggtgagacgtcaggaacgacggcgacacttgttgtggttgatgggttcacggtcactgtggcgtcggtgggagattctaggtgcattctggatacacagggaggcgaggtctcattgctgactgtggatcaccggctagaggagaatgcagaggagcgtgagcgcgtcacagcgagtggaggagaggtcagccggcttaatctctgtggtggacaggaggtagtgctcactgctcagtcattttgatgaagaaggattctaggatacaatatgagctctatgctttggaaacatttctgcatgggattttttaattaatttctcccttttttaggtgggtcctctccgatgctggccaggtggattgtgcctttcaaggtcaattggggatactgatgtcggcgagttcattgtaccgattccacatgtcaagcaagtgaaggtgaaatcatgagttttggttaaaagggaaagaatttagctcttaacatatcctttgttaacatgcgggtttcttttggtaattgtagctcccaaatactggtggaagactaataattgcatcagatggaatatgggacgctctgtcctcagagagtgctgctcaggcgtgccggggattacgtgcagacctgcctgcaaaacttgttgttaaggtgattataaatgtggctgggctattacatcatcctgtactttattatctcaatcgtctaattagtaaccatcttgcttgtccagcaagctctgaagacaagtgggctgaaagatgacaccacatgtgtggttgtcgacatcatcccatctgatcattgttcaacaccaccagcattgtctccaaagaaaaatcagaacaagttgaagcatcttatttttggtaaaaggtctcatagttctgttggaaagctcagcaaatctgcttcattgggttcagtggaagaaatattcgaggagggatctgcaatgttggaagaaaggcatgttcttattttctcttgcagttcatgtatttctccactccctttgtagttgtatgcacattcttggtcatgaagcttttttagcgtgtgcaaattctttgttcactgattcattcttgatactctgtttaggagcttggggcatatagtaacaatgcagaaatgcttcacaaattatgctgcatgttttggtctcattcatttcccatgtgtttggtgttgcagaaataaaaagatccattagcagaggatagttcacatttaggaagcagtgcagtagaaactactaacctagtttgtccattctccttggttaggtacagttggatgttccagtcctggtgtcctgggaattccattctatgttctcattcctacactggcac

SEQ ID NO: 3851 - DNA, 2044 bp, Zea mays
cattgggtacctcgaggccggccgggctgatcatgctcgtgaccatccccgtccccttcctcagccaaactgttcacggccctcgccaaatccccaaaatccaagcgcgtcgccgacggcattgcgtcgccattgcctccaaatccgtgtgcgactcgcgtgatcccagatcccgctcgccgtattccccgcagtgacctctgacaagagcattttccgcgcggaaaatgccgccgtttcggccggctcttggaagggcgcttcttctgtaggaccgcggcgcgaggctgcgatggcgttcgccgccagcgagggaaatctttccccggcgctgcccctggccactctgatcggccgcgagctccgcggcgacggtaccgagcgcccgcacgtgcgctacggccactctggcttcgccaagcgcggcgaggactacttcctcgtcaagcccgactgcctccgcgtccccggagacccttcctcctctttctccgtcttcgctgtattcgacggccacaatggcgtgtcggcggcggtgttcagcaaggagaaattgctggagcacgtgatgagcgcggtgcccgagggcatcagtcgcgaggactggctacaggcgctgccgcgcgcgctcgtcgcaggattcgtcaagacagacattgacttccagcgcaagggtgagacgtcaggaacgacggcgacacttgttgtggttgatgggttcacggtcactgtcgcgtcggtgggagattctaggtgcattctggatacacagggaggcgaggtctcattgctgactgtggatcaccggctagaggagaatgcagaggagcgtgagcgcgtcacagcgagtggaggagaggtcagccggcttaatctctgtggtggacaggaggtgggtcctctccgatgctggccaggtggattgtgcctttcaaggtcaattggggatactgatgtcggcgagttcatcgtaccgattccacatgtcaagcaagtgaagctcccaaatactggtggaagactaataattgcatcagatggaatatgggacgctctgtcctcagagagtgctgctcaggcgtgccggggattacgtgcagaactggctgcaaaacttgttgttaagcaagctctgaagacaagtgggctgaaagatgacaccacatgtgtggttgtcgacatcatcccatctgatcattgttcaacaccaccagcattgtctccaaagaaaaatcagaacaagttgaagcatcttatttttggtaaaaggtctcatagttctgttggaaagctcagcaaatctgcttcattgggttcagtggaagaaatattcgaggagggatctgcaatgttggaagaaaggttgggaagtaattttccaccaaaagcaaatctgcctccatttcgctgtgcaatctgccaagtggaccaagagccattcgaaggtttaatgacggacaatgtaggtggctgctgctcaaccccatcaacaccatggggtggtccttatctttgctcaggctgtaggaaaaagaaggacgcgatggaaggtaaacgatcgaatcgttcaacgacgtgcaggtgaaggttctgataggaatcactgggactgggtcctgtgatcctgtcatgcaagcttgcaaagtagtctccgatttcggttttctgctccttgtaaaaagagaagaataaaccgtctgtcgtttgattgaagtattgttcggtgaaaactaactgcactccagcctgatctgagaaaaaccggggtactaataacaagcctgatttctattgacatcccctatcaaactttcgtttgctctgagaggatagctgacagaactttgaggctgtagttttgtgaacccttagcatgtagagggaaatgagtagcttaacaatgttttatagaacgatggtgtggcttctcattgttgctttagaatgcattttgtgtttgtggagcaaaaaaaaaaaaaaaattgcttcgggtggacccggtcaacttcaagctcctaagccactgcctgctggtgagcccatc

SEQ ID NO: 3852 - DNA, 3153 bp, Zea mays
  misc_feature (674)..(674): n is a, c, g, or t
  misc_feature (1027)..(1027): n is a, c, g, or t
tacaataattaatgtatgtgttccatatgtctagagaatgttgagaaattagatatttttcaaattaaatttccaaatataaataatgaccaacaataaataaactagcaagttgttctctaacaggctagtaatcagtacgcagaacacatctataacgacagataaactgaagtatgaaatcatatcacatgatgcgtactgattaaacatactaattgatgttgatgcctgcaaggtagatgacgacgtcggcggcaggatcgactataagatcgcgagcagtcgcgtgaggatgctttctaaaaatcttatttgccatctccctgtacaggatctcgaaggcgacgggttccgaagacctgctctcccgatcgtagatgtatgtcgatggtcgggatgaagagaactataatggcggcgcagttgtgagcagagacgaaaaccttatttgtgttgggatgggtttggcgctagctacccggcgccttatgtagggtcgtgtctgcgaaccgatctgcacgttatccacgaactgatagactcgtgctccgataatgtctcagatccttatcaagatcagatagggctctagacttaacagctaaacaaccaaaaaataaaacgacaaaaaagaagccgcgcccctgcaagacgaggggccagattttggnggatcaatcatgtgcatgttgtgtgccctcgccctatgcctcgcccaggcgaggcgagtgagtgtggttctctacactctctcacatcatccatgacttggtgagtgagtgtgacctctatatttaaactagtttcactacacttagactattaatatggtattatttgtttcaccgttctctagccatactcatatatggacatttaggatttattttaggatttaattgaatttataattggacctagctcataaatccaatagagaagagtcttatttgagccatttgttatctagagaagagtctaaggaaggctaagcgtagagagagcttcatatatagcggcgaancctaccttgccccattttatgtctgctaataagacaatgttagtatgttgtaatctttttctttctaacacgtaagtacagtcgcggaaaaaaactatgagacaagtttaagtctagtttttcttttgaacggggagaggggagtagagtaccacgtccacgttacggtgttcccatcatccctcagattatgacccttgttcagcttcaacacgactgaaaacggggtcattattttggagtttcttgtacacctccctatgtttcttggatgtattattgcacataattaggcttttataatggcatcaaagaaacaattgctattttgtcactcccaatttaggctctctgctattatgtcactccgtgtctatgagttgtgagaccatctgtgactatatatgatttatgagtccgatgataaactagagaagatcacacctcagagtgaccaaatagcaaatggctctctgctattatttcccggagcttattgcatttactgatcattctcgatgctcgctcgatcggttggctacttgttggctagctgtgaacatgtttatgcaacaactttcgcgcctcatcgacaaattttaacagtttaagcaacttccacatctttcatgatcaaaaagacagatctacccgtccgtaccgcgtggtgttcaaaacttcatacaatatatcatgcggtgttgtgtacactgtcgtacaagcaactccttggcatcattgtcatcgtccctggctcactccccgccatcgatgatcaccgcgaccaaccctcccgctcagcgtgcatgtccaccttttaatccttacaaaaaggtgatcggccgatgacgaggcgagcaccccaagaaaacatcgagcaagccatgcattattgacacccagaggccagttcccgtcgcaacgaccaccggaggtcgatcgagcgagccatgggtggcggcactccgcgcagcagcatcggccacatcctccccggcgccggtttcctggccgtcggcctgtggcacctgttcaaccacatcaggctcttctccctgcgccccgacgcgtacgtcgcgcccgtctggttcccggcgccgcgcgtccgccacctcgagctcatcctcgtcatcgccggcagcgccgccgagttctccatggagatgttcgtcgaccactccaccttcctgccgttcgacgccgacggctccatcccgtccgaccgcctgcacaaccacgagcacgccatcatctgcctcgcgctgctcgtgtacgcggcctccgcgctgcacctcgaccgcgcccgcgcgcgctgccgcgacgcgctctccctgctcctcgtcgcggccgtcttcgcgcaggagctgctcgtcttccacttccactccaccgaccacgccggcctcgagggccagttccactggctcctgcagctcgtcgtcgccgcgtgcctcgccacggcgctcctgggcatcggcttcccgcggagcttcgccgtcagcctggtccgctcggcgtgcgtcacgttccacggggtgtggttcatggtcatcggcgccatggtgtgggtcccgagccgtgtgcccaagggctgctcgctcgtggaggaggacggccgcaacaccgtgcgctgccatagcgaggccagcctgcaccgcgccaaggcgctcgccaacctacaattcgggtggtacctgtcctccatgacggtttttgtcgtcgtgctatacgtgaacgtgtgcaagtggtatcctgcggagacagcgtacgtgcggctaccgccggaagccggcgaagaggaagaacacctgaagcgcaagtgcgggatcgtgtgcagcggcgaccatggattcacgcccttggagattgaggtgtaatgtaaaactgcactggccaattgtacaacatgttcccctgcttaattgtaaacttgcacagtagcttacatgccccatacctccatgaattcatcgatctattcgtatgaatgtagtcacaagttaaggtttatccatgcactgtgctccttttctctaaacactaacactgttacttagtggtgtgtttcctttttttcttaaaacaagagtgaaattcatttgcagctcctaaacttctgcgtggcg

SEQ ID NO: 3853 - DNA, 3041 bp, Zea mays
gggacgttctgttcgaaccagtaaaaatcttgcgcccatcgcgcacactgtccggagcccaaaacacgcaataaatttatttgtgggagtgagttcgaaacaccgacaatatatactattttttagtctataaatcagaaaactaaaactctattttagttttcgtatttagcaatttatgttctaaaataaaataaaatagagaaactaaaaattagttcctagccaaacgcccctaactcaccttaatcgatgatgagttgtatggattacgcagcccaaaaaaaaaatcttaggcctatctggaaggaaagaagcagctcttacaattgtagtacaagatagcccacctcaatccagctcggcccactacctcctcttgttcacccgcttctggcccgccgcgccgcgcccctcgtccaccaaaaaaaaaaaatatccgcaacaaattcctagctaaaccctcctccccgtcgtccaccgccggtcgccgccatggcgctctccaagcctctcctctctcgcctcctcccccttcctctccgcctacgtcctcaggcccgcttcctctgcctcgccaccccgcctttgaccccgacccccacccaaatcgacgaccagccacccgcggacgccgccgccgagcgccgccgccgcaagcgccgcctccgcgtggagccccctctctcccgaggccccgcgccgcagcgcgcgccgggggctccccgccccgcgtcaaaccccaacgcgcccaagatcccggagccggcctcggtgctgtcggggaagcgcctcgacctgcaccgccgaatcctcacgctcatccgcgagaacgaccttgacgaggcggcgctcctcacgcgccactccatctactccaactgccgccccaccgtcttcacctgcaacgccgtcctcgccgcgctgctccgccaggcccgctacgccgacctcctatccctccaccgcttcgtcacgcaggcctctgtcgcgcccaccgtcgccacctacaacctcctccttcaggcctactgcgactgccgccgccctgacgtcgcgcttgagcacttccgcctccttctcaaggacgactcgcccgtgctcccatcccccaccacataccgcatcctggcgcgctccctcgccgagaacggcaagctagaccaggcgctcgagctcaaggatggcatgctcgagcgtggccttattgcccctgatacccaggtgtatgccttcatcatgggtgggtttgtcaatgccggggatggggacaaggcagtttcgttgtttgaggagatcaaggagaaacttggcggggagtctattcttgatggcgtagtgtatggcaacctaatgaaagggtattttctcaagggcatggagaaggaggccatggattgctatgcagaggtgcttggagagggttccaaggtgaggttcggtgctgtgagctacaacatggtgcttgatgcacttgggaggaatgggaggttggatgatgcactcaacctgtttgatagaatgtgcatggagcatgacccgcccaggacaatcactgtgaaccttgggagctttaatgtgatggttgatgcatactgccgcgctgaaaggtttcaagatgcgattgaggtgtttggaaagatggccgagaagaagtgtgctccagatgcactctcgtacaataatctgattgactggttagggaagaacaaacttgttggggaggctgagggattgtacaaggagatggaagagcgaggtgtaaaccctgatgagtacacctatgtcttgctcattgaatcttgctttaaggttgatagggtggaagatgcagttgcttacttcaacaagatgtttgatgctggcctgaggccgaatgcgaatgcatttaacaaagttatagatggcttggtgaaggttgataggctcagcgaggcacagggtttttttgatatgatgcctgagaaggaggtcaaaccaaacattgctagctatgagttgctattgaaggcatatattgatgctgcaaggttggatgatgcgattaaggtcgccaaatgtatcctgttagatgagagtgtcgtctttagtgatgaaacgaaagcacttctggaggaggcactagacaaagagggtagaaatgggcaaatgacaaagttatatgaagatgttgagatggagaaagcagaggcggctgcacgtgcagctgaagagaaggctagagcagaggcccttgctaaagaagaagaggagaggaagaaggccgaggcaaaggctaaggaagaagctgctgccagggctagccgagcggctattgaggcagtgctgggtcgcaagagggaagcagaaaaacaggaaccagttgatggactgaacgttgaggatgcagaggttgtggaatccaagagtgacaccagcgatgtttctggagaacagaatgaaggcgatgagcacaaaaagcaagagccggctgaagcatcatcgtgttcttagcttcgttatctttataagttccttactagttactatcatgagtgatctttagatccatttcagtagtataatgtgcttgggagaggctatctgagaaggttggctcaatgcttttatatgaacttacatggtttcaagtcgtgctgattgtttgctacattgaatcattggtgcaatcttgtgtaccacatctagcatttcttagataagagataaatataagttataaaatttctttaaaaaaaaaaaaaaaaaattcactgttttatattcgtactctttctactctactctctttatctctactgctttaaaagtagatacatgtagtttcttatcctcactcgttctagattggcctgcgctcccctcacatacatccagtttatgaaatctcagcataaagttttacttaatctgccatattctatcagttaaaaccaaaaagaaagaaaatctgtgtaaaggtaaacccttaaccctctattctactgatgtctcgaattctttttgttcttttgaaaatgctttaagtttggtgtctccaa

SEQ ID NO: 3854 - DNA, 5827 bp, Zea mays
  misc_feature (2172)..(2172): n is a, c, g, or t
tcaaaagcaacacttctctagtcaccatctccttcactcggacagcgcactcggcacttctgtttcctcttctctaaagcatgtacaactttatctaatatgaagtagaggtatctatggatttagatgaaaaaatgcaagaaatcagctcttcatgaagagcttgtgtgtacattacttttcatacatattgtctcttaactgcatttatggactatatgatcagagttgtatcacaaagtctttttaagtgtctcttatatatgcatggaaaactgaaccaacctattatggttgtacatgcggacatgtccttttccctattctattagatcatctccagcagtctgtgtaaacgtacggtcgtacaaagtactgtttttgtattgtacttttattatttgcagagtgaagtttgaaatagagagtgagatagctagagagtgggatatgaagtctgctagagatagatcacctaaaactttcttgctccttcaggaactctcagacttccggaaaattgattaatcaccccagccaccctactaggagtgttgttgggatacattaattagcattctccctgccctcttctatattactggatgtacctgataaaattggtaactgtgtgtccttcaccaccagtttgttcagtacatatatggatcacagatagagacatgaaacattgaggcacctacattttgttttaaaaaaaagcgtcatgaatcaccgcggttacttggctatagaaaatgttattgttgatgtatacatgtacgtattaccagggactcgggagtcgggagtatgtagggggtcgggagagttgcaagatccaatttcatgcatgcactatgccttcgatcttacaagttactgttcgtgttcgctgtccttggttcttttccggtcaatataatagacttttgcgatgaggaaacgttgcatcgctcatcagtcgtgtgttgggtcaagcatccttctccccgttgggaattgtacaaggaaagatcgaaggcacgcggagctagacaccaaccattgcaggtagcacctactggatagatgggtgtcttgcatgctatccatggcgagggatgggatcgtgatcatgcatttccattgtattcttaaaaacgcaccggcctacaaactagctagctcgcagattcactgaactactgtagggtgaaaaccctgcggcgtcgtcgagcgatttctcaacttggagaaatcggaacgcggtaggaagctacttgacgacagcgacgaacatgcatatgttcattttgcaattgaattgaaatttaattagccagcaagaaagaattatttccttcgtccaaagaattattggcgtgcttggcccccggccccgccgtgaatcatgcattgtctgtgcgatgtttttgattaagccgcgcaacctaactaggaagtaacattggcgggccggcgggcgggcagtatctagaagacctgctttatttccttgctgcgaaaacctagatatggcactgtcaaaatacaggtgaacacattgtttttttcaacaccggggcctgtgcgcaatcaatttttgctttattaagtgggcatgggatatttttcttccgaaaaaaaatgatttccagtcgctagcttgtggaggatatattatctgtggatttcgacacttgacctcactgattttgttcaggttccaaaccatcaagctaagtacgggttaggaccataatgaaccatatgcatcagcacaccttcttcaattgtcagtatgtcagatttgtcatgagtgtagtagctagggcaagatcttccgggggacatgtatgcggagcaagctctttagttcatagtacatgcagtatatattatatatcggggtgatttccgtcatcactacgtaccggggatacaacggtttttttactcgatctgtgtgctcgatctgtgcgtacagtttacctttcagtttccggcaaacttctgcaccgggggaaaaaaaaagaaaaggcacgcggcggcatgcaagatcagcagaattaaactagatcctgcagtgccctgtgcctgtgcgtgcatggtcaaaagagaaggatcgttgccgcatactttggccacactctaaagctagagccctccctccagtgtccagctagctantagctcgagcagctcgcccgccagcccttgatcgttcatctaccggaccaccaaacctttttcgcaagctgcgttcctgtcgaccatgtaagaaaagcctaagaaaatggcggtggtagttgacacgctgctagcgttgctcgccacgccctatatatggagggggggactccggtggctgtccctcccaacacagcacacattattcttcctccacccatctcttgagtcgcctggccggccgccgtcttggttcccctctagagctccgcccccgggcccctgtgtagcatagagcgaggtttaaccatcagcgcatggccatggcgatctcctctgctcttccgtgctccctcctcgtggcggccctgatgctcctcgcctccgtcgtccaagtgcaaggcatcacgaggcactacgacttcaatgtacgtcgtcgtcttcgttcgatcgatcgagcgtacaacatgtctgtgtcatgcatgctagcgattacactaatgctgtgttcatatgcttgcgcaacgcgaccttcgatcgcgaaaaaaaaagtctatgcatcatgctacgtacttgtgcataaaatgcatggacgcataatatatatacatgcatgcgcatgcaggtgaccatggcgaacgtgacacggctgtgcgccagcaagagcatcatcacggtgaacgggcagttccccgggcccaagatcgtggcgagggaaggcgaccggctcgtcatccgcgtcaccaaccacgcccagcacaacatctcgctgcactggtaataaagctagtactagtgatcgtactcgtaccggccggcccggtgtccatggaagtcaaaagtgcgcgcgccgccgttggtgtgcaccatgcacaccacccacttttagcaccacaacgccgcaccacacacacgccagcagcagaacacaagttcatttagttaattgattcggagcatcgtcttttcgttacataccatgtagtatactatctgatgatcgatctcgaacgatgaacaacccgggcgcttgccttgctgtgcaatgcgtgcaggctcggcatccggcagctgcgcacggggtgggcggacgggccggcgtacatcacgcagtgcccgatccagacggggcagagttacgtgtacaactacaccgtcgtggggcagcgcggcacgctgtggtggcacgcgcacatctcctggctgcgcgccaccgtctacgggcccctcgtcatcctgcccaagctcggcgtcccctacccgttcccggcgccctacaaggaggtccccgtcatcttcggtgagtgtccatggcgctggcggccggacgacgtcgacggccgagtgccgccagaaaacgacctcttgctgttgctccctgtgctaattttgtgctttggagtggtaggtgagtggtggctggcggacacggaggtggtgatcaagcaggcgcttcagctcggcgctggccccaatgtctctgacgcccacaccatcaacggcctgccagggccgctctacaactgctctgccaaaggtacgttcctttgaagcgctgaggtctaaactcatacgggagtacagtgttgctgtgttttgaaggatgaggcgttagtttaatacgtatatattaccgctcgagagacatcatcatagtcgccttattaacagagaaggggaaaaaaggtgacgttcacgggcgctctgtttttccacttcccaagcatgtgtctagatcctcaaacgcaaccataaatgaaaaaaaaaataaaagaggcctcgttttcactaaggtgagtggttcaagtcaccaaaggtgagaagattccgagttcctttctggaaacgggatctctgtgggaatgttcgcacgacgtcgctgtcgtcgtcggatcctaacacatccggtggacttacgcaacctagcttgccggccgccggtgtcgcacgtaaacaaaatcttagttacgcctccggataggtgcgctttcccattccgtcacgtcgtcgtcgatcgacttcgacgcacgacgaaacgttgcactcactcaccggtcacgcaccgcgtggcatgcctgcgcactacagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccgtcctacccgggcgccaactactacatgtccgccgcgccctactccaccgccaggccggccaccttcgacaacaccaccgtcgccggcatcctcgagtacgagctgtaccccgacgcgccccggccctccgcctccgcggggagcttcaacgaggccctgccgctctacagaccgaccctgccgcagctcaacgacaccagcttcgtcggcaacttcacggccaagctccgcagcctcgcgacgccgcggtacccggcggccgtgccgcggacggtggacaggcggttcttcttcgcggtcgggctcggcacgcacccgtgccccgccaacgccacgtgccagggccccacccacaccccgccgccggcggcgtgggtcaacaacgtctccttcgtgctccccaccaaggcgctgctgcactcgcacttcaccggcctgtccagcggcgtctactcgccggacttccccgtcgcgcccctggcgccgttcaactacacggggacgccgcccaacaacaccaacgtggccagcgggaccaagctcatggtcgtcccgtacggcgccaacgtggagctcgtcatgcagggcaccagcatcctcggcgtcgagagccacccgctgcacctgcacggcttcaacttcttcgtggtcggccaagggtacggcaactacgaccccgtcaacgacccgtccaagttcaacctcgtcgaccccgtcgagcgcaacaccgtcggcgtgccggccggcggatgggtggccatccgcttcctcgccgacaaccccggtaataagactctcatcgcttaagagcagctctgcctctgcatgcgtgcctttttcttacacatgtgcgtgcgcgtgctctatgaactgaactgaactgaatgtacaggggtctggttcatgcattgccatttggaggcgcacacaacatggggcctcaggatggcatggttggtgctcgacggcagcctcccgcaccagaagctgctcccgccgccgtccgacttacccaaatgttgattagactcttcctccatctctatcctgccggtcgcttcaaattaaagggaattgtgaattagacaaatgtttgtttttttcttgtttactttcttcattgccaattgcaattttttcaacttgcattttaactagtccgttccgttcctagctgacctggactttttgtaattttttttcttccatttgtttgccaccacaaatgtttttgtacactcctctgaaaataaagaatggcgtgacttgcaccagataaaaacatttcatctgtctctgcatggttccagcgggttccttttgtccaggtgggcttctataggatgaagagaaaactgtca

SEQ ID NO: 3855 - DNA, 2149 bp, Zea mays
cacacattattcttcctccaccatctcttgagtcgcctggccggcggcttggtttccctctagagctcaacagcagctagctgtgtagcctagaggtttaaccatcagcggagcacatcgccatggcgatctcctctgctcttccgtgctccctcctcgtggcggccctgatgctcctcgcctccgtcgtccaagtgcaaggcatcacgaggcgctacgacttcaatgtaaccatggcgaacgtgacacggctgtgcgccagcaagagcatcatcacggtgaacgggcagttccccggacccaagatcgtggcgagggaaggcgaccggctcgtcatccgcgtcaccaaccacgcccagcacaacatctcgctgcactggcacggcatccggcagctgcgcacggggtgggcggacgggccggcgtacatcacgcagtgcccgatccagacggggcagagctacgtgtacaactacaccgtggtggggcagcgcggcacgctgtggtggcacgcgcacatctcctggctgcgcgccaccgtctacgggcccctcgtcatcctgcccaagctcggcgtcccctacccgttcccggcgccctacaaggaggtccccgtcatcttcggtgagtggtggctggcggacacggaggtggtgatcaagcaggcgcttcagctcggcgctggccccaatgtctctgacgcccacaccatcaacggcctgccagggccgctctacaactgctctgccaaagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccgtcctacccgggcgccaactactacatgtccgccgcgccctactccaccgccaggccggccaccttcgacaacaccaccgtcgccggcatcctcgagtacgagatgtaccccgacgcgccccggccctccgcggggagcttcaacaaggccctgccgctctacagacccaccctgccgcagctcaacgacaccagcttcgtcggcaacttcacggccaagctccgcagcctcgcgacgccgcggtacccggcggccgtgccgcggacggtggacaggcggttcttcttcgcggtcgggctcggcacgcacccgtgccccgccaacgccacgtgccagggccccaccaacaccacgcagttcgcggcgtccgtcaacaacgtctccttcgtgctccccaccaaggcgctgctgcactcccacttcaccggcctgtccagcggcgtctactcgccggacttccccgtcgcgcccctggcgccgttcaactacacggggacgccgcccaacaacaccaacgtggccagcgggaccaagctcatggtcgtcccgtacggcgccaacgtggagctcgtcatgcagggcaccagcatcctcggcgtcgagagccacccgctgcacctgcacggcttcaacttcttcgtggtcggccaagggtacggcaactacgaccccgtcaacgacccgcccaagttcaacctcgtcgaccccgtcgagcgcaacaccgtcggcgtgccggccggcggatgggtggccatccgcttcctcgccgacaaccccggggtctggttcatgcattgccatttggaggcgcacacaacatggggcctcaggatggcatggttggtgctcgacggcagcctcccgcaccagaagctgctcccgccgccgtccgacttacccaaatgttgattagactcttcctccatctctatcctgccggtcgcttcaaattaaagggaattgtgaattagacaaatgtttgtttgtttttttgtttactttcttcattgccaattgcaattttttcaacttgcattttaactagtccgttccgttcctagctgacctggacttttttgtaatttttttcttccatttgtttgccaccacaaatgtttttgtacactcctctgaaaataaagaatggcgtgacttgcaccagataaaaacaaaaaaaaaagcggccctaa

SEQ ID NO: 3856 - DNA, 1122 bp, Zea mays
ctccacacgctccattaattcatgttatgaaggtcaaacctaacaaggtgaatttaataattggttctggtggaaagacaataaaaagcataattgaggagactggggtagatgctattgatactggagatgatggcacggtaaaaattactgcaagagacctaacaagcttagagaagtcaaaaattataatagctaatcttaccatggttccaaaagtaggagaaatatacagggactgtgagatcaagtcaatagctccatatggtgcttttgttgaaattgctccagggcgtgagggtttatgtcatatcagtgagttaagttcgggctggttggccaaggctgaggatgcttttaaagttggagatcgcatagacgtcaagcttattgagataaacgataagggtcaacttcggctaagttctcgagctttgcttccagacgtggattccgaatccaacataggttcaacaaaagaaaaggtgccacaaaaagatgatgtcataaaaatgacaacaaaaagaccaaggcgcaagaaacagtctgagccgtctggagctgaaaatgccacaacaaaggctcttgcgaaaagcgctgctgctccagctggttcaaagggcagtgaagcgtagtaggatgtggacagcttggtgccttaatcagacgattgactggccaagctagggatacatccttcaaccgactatatgatggtcatatggcatgagaaagagttcagacatgagggcacaactgtctaaacaggaatataatggagaagaattggttgatcgacctcgatgttagacaggtagagtgtctggttgatgcgttacacaaggcgtgcgcctatccagcagtaatggtgcccaggactggatcgtcgccctggttagcagaacagatcgcgtaaccaccatggaaacttgattgtaatcgccagaatagtttgtttacctttacctttgtgttgtaccgttctgtactaactacatattcttgccaatccggccaatgcaaactactgcgtgaaaaaaaaaaaaaaaaaaaaaaaaaaaaaaaaaaaaaaaaaaaaaaaaaaaaaaaaaaaactcgagagggggcgccgtgtacccaaaa

SEQ ID NO: 3857 - DNA, 776 bp, Zea mays
aattcaggctatcatccagtcatccatcagcaggaggcggggagagtgacttggccgtggcccgtgggggggagagtgagagctgccaaggatcgcatcgaaggaagctaggagatcatccagccgccggcaagaaattaggcagcagcagtacgtcgaggaagatgtgcatggaccgagctgccgtgccggtgaagagggtctggctcggcatcgccgcgcgcctcggcctccgccgaaagaccggcctggggaagctgcgtaaggaggtgcggacgtgcgagtaccgcgacgtgcacgtcatgtgggagatgctgcgggcgacggacgggctggtgccgctggcggagaaggaggccgccgccgtcgcggccgccgtcggcgccaggaagcgcaagaacgcgtggaggcgcttcgtctactactgctgcgcgttctgagatcgatcagtctgctggtgatcctagctcgctatagctcctgaaagatccaaggtcgcgaggttcatgaactcgcgcgtgaccaaaaaatcttcagcgcgtgaccggggttgtcgtcgctcgtcaggagacacgagagtacgagactgtcctgtccccgggataagattgactgattgagagacgatcgttcgttccagcgagagagcatgtgtacataggaagagatatttgaagcgcatatacaaaagctttgatcgaaatttgatcgaagtgtacccaaaaaaaaaaaaaaaaaaaaaaaaaaaaaagtactctgcgttgttaccactgctt

SEQ ID NO: 3858 - DNA, 1443 bp, Zea mays
ataaaaatgcattgggtagctccccggctcgccgggggccccaccccacgaggcgctagctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcctgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttttttgaagagtcaaaaaaaaaaaaaaaaaaagcggcc

SEQ ID NO: 3859 - DNA, 879 bp, Zea mays
cattgggtcattggggacctcccgggccgcccggacgaggcgctgcggcacggaaccagcgccattagaggccacaagcccacgccacgcctccctcgttctcgcgcgcgcgcacgcatgcacgagggggcctgtcgatttgattgaacttttcaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttaccgacctcaagttaaactgcctcgggtccgttctttccggactcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccacagatacactttcccggttgtgggcttcatcgtcctgtcgtgcttgatcgcggtgtcg

SEQ ID NO: 3860 - DNA, 2249 bp, Zea mays
ctgacttaaactctggcaatcaatccatttatctgtccaaacatgtgtttctacccttgcccaccaccgaagaaatcgctgcggagaagaaggccttaacagaaggatgcacatttattttaaaggatgcccatggctcgccaggttcaatttttttcaaccagagccaacgcaatctaagagcccaactcatcttttgcaggtttgagatgcccaatcctccaaattcttttggtctagtaaccttgttccaagctaccaaacaatgccctcccatagcttcttttcttcctctccacaggaaacttctgatgattttgtcaattgctttgatagcccaagaaggaaggtccgtggcgcataattaagtaaatagtcattgaagacaaaacagtctggacaagaatcaatcttccagctctggtcaacagaccagctttccaactgggtagaggatttgcaatctcgtcaatgaacggttgataatgatgcgcagttctcctgcgcgttcgagaaaaaaaatgaacggttggaggtgctgtttaccaagctttttcaaggttagaggcacccccaagtatttgcagggaagttggcaacaacgtatggcagcaggttgtgaatggtatctagattttcaacaacacagtggattgggaaaacgctcccccgcgcccgatttgttttaagcccagatgcctcaccaaaaatcctgagaatgtccatggtgatctcaaaatcagatgccacagggtggaggaagatcaccacatcatcagcataaagagatatacggttgtcatctgaatgttctgttagaggctccaacaatccatcatcagctgccttcttaattaacacaatacatccataaccaagatgaacaacattggggagagagggtccccctgccgaagaccccttagaattttatggcctggtcgtcaatatataacccgcgtggccgccgcccaggcacaatgttaagaaagatgtgcaatttttgccaatatctggtcttgtgggaaccaatatgaaaaccaggatggataaaagcatttgtagttggtgggatggcccatgtctttttgaagttctggaccgtattgtagttcctttacgtgaccccaaaggttcagtaaggatgccgattattgataaatataaggatatgggcactgttgtaatgggcaaaatagagtctggcactatcagagagggtgacagtttgttggttatgccaaacaagtcccatgtgaaagtcattggtttgaacttggatgagagcaaagtacgtcgtgctggacctgctgagaatgttcgtgtcaaattgtccggagttgaggaggaggatgtaatgtctggttttgtactttcaagtgtcgctaatcctgttggtgccgttaatgaattcatcgctcagttacagattttagagttgcttgacaatgctattttcacggctggctacaaagctgtgttgcatatccactctgttgtcgaagagtgtgagattgttgaactcatagaggaaattgacatgaagaaaaagaaaggagatccgaagaagaaaaaaccaaagaggaagcctctttttgtgaagaatggtgcaattgttgtttgccgcattcaggtgaataacttgatatgcatagagaagttctctgatttcccacagcttggaaggtttacacttagaactgaagggaagacggtagccgtaggcaaggttgttgatgttccgcctgctggcagcccaacattctgagcttaagccaattttgaacaggatggataatcatgaagcagtgcgttgtcttgagatacttttctttgggagaagtgagattagttgagcataggttttttccgagcccggcttgagaatggtctatgccttaatggtttaggcaacaagtctgtttagattggttccataatgttacatctctggttacatgtgaggtataatcagtatggatgagtgttccaaccttaatgcactgccaaattgtggtggcatttttgcgtacctcggccgcgcccacgcgttgtgtgtgaagtcaaatgggcaggctgcattactcggatgtgcagcgtcgtgtcacacctggttttaagggtaaaaccgaatgcataacatatgtgtgctaggatctattttaacatatatgttgacatcatgagtgtaatatatctaaagaacaatgcataaaagcgtaaataaagattatattaacaaaaaaaaa

SEQ ID NO: 3861 - DNA, 4419 bp, Zea mays
gctcggtctttgggggcctatcgagtcgacctgcagtgaggttccaaactttgataaaatcagacaaaacacttacagttccttgatgtgagagcatcgtggacactcctctttttagccctagaagagaccaacttgaccagatgaggggccaactgacttagactctggccatcaatccatttatttgtccaaaacatggtgtttctaccgttgcccaccaccgaagaaaccgctgccgagaagaaggccttaaccgaaggatgagcatttattgtaaaggatgtccatggccggccaggttcagtttttttcaaccagagccagcgcaatctaagagcccaactcatcttttgcaggtttgagatgcccaatcctccaaattcttttggtctagtaaccttgttcaaagctactttccttcctctccacaagaaacttcttctgattttgtcaattgctttgatagcccaagaaggaaggtccatggccataattaagtaaatagtcattgaagacaaaacagtctggacaagaatcaatcttctagctctggtcaacagatcagctttccaactgggaagacgacccgcaattttatcaatgaacggttggaggtgctgtttcccaagcctcttcaaggaaagaggcacccctaaatacttgcaggggaagctggcaacggcgcaaggcagcaagttgtgaatgatatccagattttcagcagcacaccggatggggaagacgctgctctttgccatatttgttttaagcccagaagcctctccaaaaatcctaaggatatccatggtggtcacaacatcagatgtcaccgggtgaaggaagattaccacatcatcagcataaagagatatacgggagtggtctgaatttcctgataacggctccaacaatcccacagcagctgccttttttgttaggtagcacaaaacatccataaccaggatgaaaagcattggggagagaggatctccctgccgaagaccccttctatggagaattttctgccctggcgcaccattaagaagaacttgagaagaagcagatgcaagaagagtgctgataatatcacaccaaatttgcccaaagcccaaatgcctcataacttcgaggagaaacggccatgagacagaatcaaacgctttggtgatatccaatttaagaaggatccttgcacaatttttctggtggagcataatggctgtctgctgaacaagcataaaattgtcaagaatggatctgcccttaataaaagcactttgattctgagataccatattgtcaaggtgactagccaatctatttgctagaagcttagtgatgagcttagcaaaggagtgaaccaagcttataggccgaaaatccttgacctggcaggcatcgtccttcttgggcaagagaaggatgtaggctgagtttagcagatctaaattcacccattttctgctccaaacagctgtagcagcagccataatatccccttttatgatctgccagcacgtcttatagaatttcccagtaaaaccatccgggccgggagccttatttagaggaagagataggactgttttccagacttcatcttcagtaaacggactgtccagcgatgtcagattatgggcagggatgtcaagctgagccaggtcaatggtgtgcgcccggtcaggtgaacatcccagcagcttgtggaagaaatcactgataacctccaacttatccccatgagatgtcttcaccgatccatcatcagaaatcagattgccaacaaaattcttgcctttccggtatttagcatggaggtggaaaaaggcagtgttggcatccccttcagccaaccatgagatcctggagcgactccgagccatagaacgctgcagcgatgagagggccacaatgcgaccatccagctgatccaccaaccacatttctaacaccgacaagggtctgaaatcttgagcagactgcaacttatgcatgatctcccttgccatcccaagttgagaggtaatatgtcccgtccttttttgagaccagctctgaagatgcttgaccgtggcactgaattttttggagagggtgacaaaagggcaaggggaggaggaaacagagttccaagcaacctccactgtcgacagaaaatcaggtgcctttgtccagtgagattcaaaatggaacctcctgcgcccaggagataaatcatgaagcccaaggagcagagggcaatggtcagacccgtcagtgctagcactctgcagaaggcaattaggaaagagttgttcccagtctggcgagcaaaacattctatcgagcttgacaagagtgggtggatcttgacgattagaccaagtgaatttccttccatgtaaagccaattccttcacccccaaatcgttgatgagtcttctgaatctgtccatgaggtgcctattaaaattgccagagctcttatcatcatccttgtagatgaggttgaagtcgcccattaaaatccagggcccaggacaagcagatctcacgttgcgaagctcttgcataaactgaattttgtcgctgtttccttgaggcccataaacacatgttaaccaccaaggctgctggtcacgtggactgaactgaattgtcacactatggtgatccaccctagaagcgcttgccggaccaatctcattactccaggccacgagaatccccccgctagacccaaccgagggaagggctagcttgtgcacaaaattactcccaagggtggtcaaaattgtatgcaaagaaatttcagccattttagtttcctggatacaaaccacattagctttgaaggagtttatcagattgcgaacagtatcctgacgtgccttggaatttaaacctcggacattccagcttacaattctggacggattcatgggtaactatggtgtaaacaaccggagccaaaacaaagcaacaggcatgaacagcggctcaacacataaccagcccaggggctgtccagccgaagagagcagcaagcgcctggacatgagacgggggaaggggctgatcaaaaagtctgctgtttttttgcaaggcctcctgactgatgccttcgttcgcgtcggtctcctgcagtgctctcattaccttcttcctgaatctgttctgaccatcaccaaaggcagattgaaattccactccaataccagcaatgcgcctactacggcgtggaggtgcatcagaagaattatcgttccccggtctgacaggaagaggagccggtaaaatgtgatccgcagtcttaataaccatggaacgaaggaagacccaggatgaataggggtggccagttcaggtgtctgcgaaggttcaacagccagaccaatgtccgagatgcagcaagggacagaccgaggaccagtcaaggtatccaaccgatgttgttgcgtcctccgaccccttctaaaataaaccttcagaggcatgcagtaccgcggttgagggggagctggtgaaaactgggacaccgcgagggaagaatccacccaacccgaagcaggcaaatcttcagacacagcagccggatcatcagaaataaatgacgtaataacaggatccaccagtgttggatgcgggggagacacaggcgccgcctgctcatcaaccgaagcaacgaaaggagctggcgcatcaattggtctcgcccgcacaggaaccaaaacatcatcagccactaatgctgaatctgaagagattgcaggcgcatgccccaccaaatctggtgcaataacaggcgtgccagccgccgcattaacactggcgcgcgacaaacatgactgaaccgaaggacgagcggattgacttggacgcgcggccccaggcgcgcaagaacagatggccgaccggctgaaggctgggagttgagacgacgcctctgctgattcccggaattgctgctacgatcttcatcctgcctgtccgaagttggcggtgaaggtggaggaggaggcggcggaaattgctccgtgcgtgggtaagtcaccgtgcgtgcgtaagacggcccaacgtccacaggcagctcctccacatggagatccaaagatgaaggcagattatccggatcatcacaccagacacgcagccggaatgaagacaaatcaacaacctcctcaggaccaagaagcagctcatgaaccaggcagtgtccaacgagaagctgctcagcagaatgaacatcccggagatgaaacgggaggccgcgaagctcaatatccagcaggaaaggcatctctcttccaccggaggccaagaactgacgagaccacctcctaatgtgcacccaaagaggaggtgcatagaaggactgaccctcactgagcatccgatcagccagctccatgttgggtagaagggcgatgaaggtat

SEQ ID NO: 3862 - DNA, 941 bp, Zea mays
ggaattcccggcgtcccatgtgaaagtcattggtttgaacttggatgagagcaaagtacgtcgtgctggacctgctgagaatgtgcgtggtaaattgtctggagttgcacggccggatgtaatggctggttttgtactttcaagtgttgctaatcctgttggtgccgttagtgaattcattgctcagttgcagattttagagttgcttgacaatgctattttcactgccggctacaaagctgtgttgcatattcactctgttgtcgaagagtgtgagattgttgagctcatagaggaaattggcatgaagaaaaagaaagaagaagatccaaagaagaaaaagccaaagaggaagcctctttttgtgaagaacggtgcaattgttgtttgccgcattcaggtgaataacttgatatgcatagagaagttctctgatttccctcagcttggaaggtttacacttagaactgaaggaaagacggtagctgtaggcaaagttgttgatattccgcctgctggtagcccaacattctgagcttaagtcaattttgaacaggatggataatcatgaagcagtgcgttcgcttaagatacttttttttgggaagtgagattagttgttgaggttagattttttttcagtccatcttgagaatggtctatgcctttatggtttaggctagcaagtcttagattggttgcataaaattacatctctggttacatgtgaggttgtaaaatcagtatggaattatggatgagtgtaccaaccttaatgtacccgttcaagattatggtggtatctttgcgtacaatgctgtaactatccatttttttttgtgtgtgtgtgaagttaaatataagatggccacacgtggacaggccgcattaggcctcgttcgtttacgtgggattgtacaaaaaaaaaaaaaaaaaaaaaa

SEQ ID NO: 3863 - DNA, 907 bp, Zea mays
ccgtggggtccgccccggccgggatccttggccccgcgcccccagacacgcaccgcacagccacacgcgtacacccgtacaccgtacgcagccatggcatcagtaggcttcggcacggtcgcgccggccgtggcatcatcgccggcggccaggacgacgagcgtgggccgcccctccgcggtgcacgtccctgcggcgacgaccaaggtcgtcgcggcggcggcgggtaagcgggtggaggagaagggcctgttcgacaccatcttcggcgcgctgtacaaggaggagcagctgctggagacggaccccgtcctgaacaaggtggggagcaagggcaaggccgccgccgccccggcgcccaagaaagccgctgaagagggcggcaacggcgggctcagcctcggcgggttcttctccaggcccaagaaagggtgaacgtacgtacgttatgtagctccgactccgagtgaggatcgttttgcgctgctcttgctttcttgtacgtaatccttggattggattggaatggacggctcgcatgttgtatatatatatggcacaaacgagagcagagcagagcaccagcgtataactaattccttcctttcagttgatctcgccctgtgttctgttctgcaacaagcacacaccccagccagcatcagtggttcgctgctggctgttgatcatcatcatcatcactagtaaatgtagcagttgtgtgtctctgtactgaagctcgtgtagcaccatggctcttggatgagagcttattattgtacttgctcttccagcagacccttgcgttgccgcggccattattttcctcagcggatcttgccccgtgccaaatgctaactcaattaagaatgaaagaaacatcagtcgggaccggtaatattgacct

SEQ ID NO: 3864 - DNA, 4796 bp, Zea mays
cgccggagcaatctctcactgtttcgctgccccgggcgaggactttgcgcatcagctcgtggtcgctgtgcttcgagtagatcaggtccttcactcggagtggtggcagctccggcaccggcgtgcacagctgcgactctggagcagccagcaacgtataggaggacatcataattcatttcagagatcgtgaatcttcatcgtctcttgactcgacccgatgtgcaattttctttgacgaaagagtgaatgaaaaccttgcggaggcagatagcccttttcgtggagcatggggtaggccaggaagcagccgaggcaggcggcgctcccggtgcgcagcaccagcgtgggcagtccgagcgccctggccgccctgtgcacggcgaggaggttggcgtcgacgaagaggcacgaggcgcggggccgcccgtcctgccccgcgaccgcggacgcccgcagcgcctccccgacggccggcgacgcctccatggcggcgttcatggccaggatgatgtcgatgatcctccccatggcggcgacgtcggcgggcgtgccgtcggggacggccacgaactggaactccgggtgccgcgcggggtccaacgcgttgaagcgcgtgtggagcacggtcaccgcgaggccccgcgcgtggagcacgcccgccaggtgcagcatcgggtcgatgtggccctggaagggcagcgggaacaccagcacgcgccgcgcgcacggctgatgaccaggggcgtcgccagcttcttgggcgccggccattattgctaactgtgcgctactgctgatggatggacaaacaagagtgctagctagcgaacacaaggtatgtagcagtcacgcgcacgcaatgaagccatacggttactataaaaaaggctgaatgcctgtcaagaactagctagatcgttttttttgttgttgttgagagcaagaacactaaaaacctgatttttatcggctactcctatattttccacacgtcattaaaaaatacaaagagaaactgttttatcaaacaaatttaaaacaactctagctcttccagagaagcaagaaagctagacaaacaagagctggaggtatttcagagcaaccataggcctgccaaaaagggtctaaatttcacttacgggccgtgtcgatgatcgaattgattacgtgtgttggcatacatacatgcgtcatttatgcgtggcaacaaaatttgtccttgacaagaaaaagatgttcggatccatctgctaacgtccaaacggcggccggcgacatatgtcatatgtgcccaatgaagacgcagctgcttcgtttgacgtcattgatgacgttagaccaacttcaaaagaatgtaaactaacctaaaacaaaacagatatcatcagtaaagaatagtgatttttcttgttctcgcattctcttcctaaaaaattagcatccgacgcgttctatccttcctcaatccatctctccgtgtgcattgaggctccacgtttatgtttcccacgcgtacggctggaggggatgcccatacgaagatagcgcaacgctcatacgcaggtgcaaggattggtgctttttgtagtccgtgaacagtgaagacccatacgcaggtgcaaagtgggccgtctggagaacgttttttttaaaaattgagtctagtctttttttttcaaattttgtttaagtagactattggagcatacacaataatttgcctctaaaaatttaaatgttagggacacgacgacgacgacgacgacaatgaaaaacatttaaatgttagggacacgacgacgacaataaaaaccatgaaaacgagtgctttatacagtagatagatagatagataaatgttagggccacgacgacgacgaaaaccataaaaaccgatgctttatatagtatatatatatgttagaagaagcttttaatgcaatacaataatatatttcttttgttttgctcgtaacgtttttagatttatctcaagtgtttatattagtattatatatcaaaagtaattaaaaggtctctattttaaatcttgtcttgtctggaaaaaaagaacgttgtggcatgggctagggctactgaattgaacatgtcgtagatcaaagatgaaccatttctcgttgggtgagatgaagcgctgaaccgtgcagcggcgtgtggataagccgcttgtggacggcacgagcttccggttccgcgccagacccgtgacccgggaaccccagtccgacccttggccccgcgcccccagacacgcaccgcacagccacacgcgtacacccgtacaccgtacgcagccatggcatcagtaggcttcggcacggtcgcgccggccgtggcatcatcgccggcggccaggacgacgagcatgggccgcccctctgcggcgcacgtccctgcggcgacgaccaagttcgtcgcggcggcggcgggtaagcgggtggaggagaagggcctgttcgacaccatcttcggcgcgctgtacaaggaggagcagctgctggagacggaccccgtcctgaacaaggtggggagcaagggcaaggccgccgccgccccggcgcccaagaaagccgctgaagagggcggcaacggcgggctcagcctcggcgggttcttctccaggcccaagaaagggtgaggatcgttttgcgctgctcttactttcttgtacgtaatccttggattggaatggacggctcgcatgttgtgtgtgtatatatatatggcacaaatgagagcagagcaccagcgtataactaattccttccttttcagttgatctcgccctgtgttctgcaagcacacaccccagccagcatcagtggttcactgctggctgttgatcatcatcatcatcactagtaaatgtagcagttgtgtgtctatgtataaatgtactgaagctcgtgtagcaccctggctcttggatgaaagcccattattgttaccagcaaaaaaaaaaaaaaaaaaccggcttgtgcagtgttttccttagcggatcttgcaccgtgccaaatgctaactcaattaagggtgtgttcgtttgttccggaatcgtggcctagaaccaatccaaccaggaatgtttatctaatttgtatagactttgatcacctgaaaccattccggccccaatcctgaacaaacgaacgcagcctaagaatgaaacaaacatcggtcgggaccggtaatattgacctctatcaagtcctctgtttccaccccccccccccaaataatttgctctaggttataaataaataatttaatgaaaatagtcaagacaaaaggcaacaagtcatcatgcgacatgtttcattatttatgagcaattagccttatatgtcgcttgcgatggcacgaaaagagtaaaaaatagtacttacttcgtctcgtctcagaacagtagtcatttcatctctcggtttttatatctatatctaaatagatgacgatgaatctataattgtatataaaacacatacatcaagactttgatgaatctactattacctaaaacgaattttattttggtacagaggaagtatatatacgagaattatgatactccatccgttccaaaatataatttgttttagacaaataatcatgcattcattattcattaacatatgaatgtcatccacatgtatgtctatatttctacttattaagccgatgcaacttcctccccatatagaccgtccacgtcggctacaaaatcctagacacacctgcagatactacttcgcattgtagccgtacacgtggccgaaagctgttccgactgctccaccagtatgcgtgggcgcgtggctgctggcctgctgcttctgttatgaaaggaaataaaaaaaaaatgggaaacaacatcgcctagaaggatcccgtggccttcagctgcttcaccagcacgtgtggccgatctatcttgctgtaaaaaaggaaataaaaaatgaacaacatcgactattagaagggtcccattctacctaccgtgtcgcaccaggacgaccctaccgaggcagcagcgacggtgcagctgcctacgccggtggatatctcccgtgtctgtcgtttttaggtaaatagatcattttcatgcttcccttcgatttttccatgttcattactcactgtacctttctcttgtatttggtttgaaacatttgtaatgtgctctcggatctacaccgaaaatcacatgcttttttgttccctttttctctccatctacaccgaaaggcacaaattatttttggtctcttttttatgtcacattagaaaccctaaatgtgttttcccctggaaaaaatcttgcaaaaactaaaatcgcgtagtgtggagcttcctttgtattttactggtcgccgcgcatccactcacgcgttcgtgcgcttcaaatgctacctaaaagccatgcttcttcgttcttttacctgctttacaaacgagtttacggtgttgtatttccctaaaagaaggggtgattcgctctgagctaacaaaaggcatgtttagaggtgcaatattatcccattagaaaccctaaatgtgttttcccctagaaaaaatattgcaaaaactaaaatcgcgtagtgtggagcttcctttgtatattcgctctgagctaacaaaaggcattttagaggtgcaatattatcccaaaaatgtagacttctctctatcatttcttatttttaccttttgcagatgtcatttcttcttattgtattgccttctaaaaaaatatttaagtttcagatgat

SEQ ID NO: 3865 - DNA, 3760 bp, Zea mays
gcgcaataagcgcaccaccaccgcttaccatgagtgggagttgcactagctaatcgctagccactccatagttagcatttagcactgcctgcctgtccggtgcccggccatgtcgtcgtcgttgtcgctgcgccgtctctgcttcgtgctgccgatggacgccgacgaggccgtcccaccggcgtcccacccggaggggccggcgcggcgcagcccggctagggtggcgtccctggaactcgagacggccgggtcgtacgcccgcaccacggccgtccgcctgttgtcgtgcctccgccgctggcggccccggccctgctgccgcggcgccggccggtggcacgacgactcttcggaaaaggcggcggcgttcgaggacatcgccggcgtggtcgacgacgtcgccggcaggaagcagctcgcgggcggcgggcccaggatattcagctactcggagctctacatcgggacgcgcgggttcagcgacgcggaggtactcggcagcgggggattcggccgggtgtaccgcgccgttctgcccagcgacggcaccacggtggccgtcaagtgcgtcgcagccagcagcgcgggcgcccgcagcgacaagtcgttcctggccgagctcgcggccgtggccaggctgcggcaccgcaacctggtgcgcctccgcggctggtgcgtgcgcgccggggaggagctcatgctagtctacgactacatgcccaaccgcagcctcgaccgcctgctcttcgcgccgcccaaggccgcggccccggcctcggctccgcggctcagctgggaccgccgccgccgcatcgtcgccgggctcgccgccgcgctcttctaccttcacgagcagctggacacgcagatcatccaccgcgacgtcaagaccagcaacgtcatgctcgactccgagtacaacgcacggctcggcgacttcggcctcgcccgctggctcgagcacgcggtgggcgccgacgacgccctgaacccgctgcacccggaggcgtcgccaccgtccctgcgcctgtcgtcgtcatctgcctcggccgcggtctcggccaactaccaattccggctcatggacaccagccgcatcggcgggaccatcgggtacctgccgcctgagagcttccatcgccgggccgccggcggcaccgccaagtccgacgtcttcagcttcggcatcgtgctcctggaggtggccacggggcggcgcgccgtcgacctggcgtaccccgacgaccagatcttcatgctcgactgggtgcggcggctgtcggacgagggcaagctgctcaacgccgcggacgcgaagctgccggacggcgcctctgcgctgttcgacgtcgcgcggctcatgcacctcggtctcctctgctcgctgcacgaccccagggcgcgtccgaccatgaggtgggtggtagagaacctctccgacggctgctctgctggcgacctcccgcgtctgccgtcgttcgtggcgctccccaagtacatctctctcacctcgtcgtcggcctccgactccggcgccacgaccgtcaccaccgacaggagcacggcggcgacgtctctaaccaattccaaccccgtctacgccaccgcggccgcggacaccatctaccacaccgcggaagacgggaggacgaccggttccaggtccgcgtccgctgactccggccggcggtcgtcgtctcggctagcgcccgtggcgatcccgcacgtggacacgccgcgcgagataccctacaaggagatcgtcgccatcaccaacgacttctccgagtcgcaggtggtcgcggagctggacttcgggacagggtacgagggcttcctggacaccggccacggccgcgtccacgtcctcgtgaagcgcctcggcatgaagacgtgcccggcgctgcgcgtccggttcgccagggagctatgcaacgtggccaagctccggcacaggaacctcgtgcagctgcgcgggtggtgcacggaccacggcgagatgctcgtcgtctacgactactccccggggggcctcctgagccaccacctgctccggcggcgcgactgcggcgcggtcctcccgtggcggcagcggtacagcatcgtcagggcgctggcgtcggccgtcctgtacctccacgaggagtgggacgagcaggtgatccaccgcagcatcacgtcgtcggcggtgttcctggaccccgacatgaacccgcggctcgggagcttcgcgctcgccgagttcctgtcgaggaacgagcgccacggcggcgggcaccacgtggtggtcaccgccagctcggcccggggcatcttcggctacatgtcgccggagtacatggacacgggcgaggcgaccaccatggccgacgtctacagcttcggcgtggtggtgctggaggtggtgaccggcacaatggccgtggacgggaggctgccggaggtcctcctcgttaggaaggtccagctccttgagcagcaggaccggccggtggaggccctggcggaccggcggctggacggcaagtttgaccgtagggagctcgtgcggctggctcggctcggcatggcgtgcacccggtcagacccggcggcgcggccgagcatgaggaagatcgcgagcattctggacggcaacgaagacgtgctggacaagctggagcagaggaaggagagctcggaggactggcagaggaggaacgcgaccaatcttgctctagtgaggagattccaggctcttggcatacactgaaaagtttgaaacagaggaaagtactagtgattcagcttttgttgttcttctgtatatagagaattttaatttcttctgtgagtttttgtggggatatggccaaaacttcctggtgtaaataatacttgctttaatttaggtttaatgttgagcagttacaactaacaacaatgacctttgccaaattctatcatcagtaggggtgcataataactgacttaacgggccaactgcaccatttatggagctttctttaaatttggtatatccctgggctgttgaagatcaaacttcaagacaaacataaagcaatccaagttatgtaaatttagcattctaaattatagagaaagttactataacacttgagtaaaaaatgtttatgctccaacattggttggtaattttttaagttgtcaatgtaaaaaaaagacatactttctattttaaatcgagttgatggcataaatttataccaataaccttccttaacgttttgggaggtcggagttgtcgatggaccagatgattgcaacaacagcacacactatccacggacgccctcgcaactacggcatggaggcagcacaggaggtgctctagcgacaccttggcacaagaggttatctagcggtggcagataaagagacggcgaaaccgtagtcagagtatgcttatcgcaatatcttaacaaaaacatttatttcaagagtcccaacaagatgataaatgtagggatcaaattagatttggtcaggagtttgtaaatttagaaatctgttttacataactgttggagaagagttttcttataaacttcttaaatttaaatctatatttataaagttgtttacataactcctgcctaactcgtgcgtaactcctgcggatgctcataatgagccaagctaaagtcaaaattcaccaaaaactaggtcatttttattttattttaaataagtccattcaaaatatgcattatgtctggattttgagtgagcattc

SEQ ID NO: 3866 - DNA, 1777 bp, Zea mays
  misc_feature (1760)..(1760): n is a, c, g, or t
taccctcgaggctggccggaaccacgcaccagcagcagcgaggagctagagcagcggcagagcgcgcggcgcacaccacgcatcgtacgtcctagctcacgatggcgggcgcctggtccttgctcgcgctcgccctatcgctctgctccgtcgcggccgtcgcggtgcagcaggtgaacacggtggccgcggcgcagcaggcggcggaccgggtggcggggctcccggggcagccgcccgtggggttcgcgcagtacgccggctacgtgaccgtgaacgagacgcacggccgcgcgctcttctactggttcttcgaggccaccgcgtcgcccgacaagaagccgctcgtgctctggctcaacggcgggcccgggtgctcgtcgattgggtacggggaggcggaggagctgggtcccttcctggtgcagaagggcaagccggagctcagatggaacaactactcctggaacacagaggccaaccttatgttcctggagtccccggtgggcgtcggcttctcctacacaaacacgagctccgacctgctgcaactcggcgacaagatcaccgctgacgacgcttacaagttcctgctcaactggttcaagaggttcccgcagtacaggtcccacgacttctacatcgccggcgagagctacgccgggcactacgtcccgcagctgtcggagaagatcttcgacggcaacagggcggggcccaaggagagctacgtcaacctcaagggcctgatggtcgggaacgcgctcatggacgacgagacggaccagacgggcatggtcgactacgcctgggaccacgccgtcatctccgaccgggtgtacgccgacgtcaaggccaggtgcgacttcagcatggccaacgtcaccgacgcctgcaacgccgcgctccaggagtacttcgccgtgtaccgcctcatcgacatgtacagcctctacaccccggtctgcaccgacgacccggccggcgcgtcggcgttgccgtcctcctacgacgcgcgcggccaccggaaggtcgccgtccacggcgccgcccccaggatcttctccaaataccgaggatggatcatgaagccggcgggctacgacccctgcacggcggagtacgcggagacctacttcaaccggcccgacgtccaggcggcgctgcacgcgaacgtgaccaagatcggctacaactggacgcactgcagcgatgtgatcaacacttggaacgacgccgccttctccaccctccccaccatccgcaagctcgtcgccagcggcctcagggtgtgggtcttcagcggcgacaccgacgggaggatccccgtgacgtccacgaggctcaccctcaacaagctagggctcaagaccatccaggagtggacgccgtggtacgaccatctgcaggttggtggatggacggtcgtctatgagggcctgacgttcgtcaccatccgcggagccggacacgaggtgcctctgcacgcgccacggcaggcgctgacgctcttcagcaacttcctggcaggcaccaagatgcctccaacggcgttcccctagtttcaaaagaatttaaaaaaggtgcctcctcttgcccggcaaagccggctgatatgtttctttccccccttctcgcttctactaaagttgtaagtgtaattcgattggaaaaaagttcagaataaaagtcatagtgctgacctcaatgctcagtcccaaaaaaaaaaaaaaaaaaaaaaaaaaaaaaaaaaaaaaaantaaaaaaaaaaaaaaaa

SEQ ID NO: 3867 - DNA, 1033 bp, Zea mays
tacccctgatgtgagctcaccgctcatatcatctcatcccgcgatggcgttgcttcccccagatgccgctccggaggaggagatgcccgccgcggccgaggaacaggcagcgcctgccgcgacggtgaaggtgctcttcttcgcccgcgcgcgggacctaacgggcgtggcggattccgcggtggaggtgccgccggggagcaccgcgggggagtgcctcgcgcgggtcctagcccagttccccaagctggaggagatccggggctccgtcgtgctcgcgctcaacgaggagtacgcggccgactcggccgcggtcgccgacggcgacgagctcgctgtcataccgcccatcagtggcggctgacgttattaaccacggccgacttgtgtggaggtaataaaagatatgaagacatcgatcgttgaggaaaaaaaaaagagagaagaaaggttcctctcccttcttcatggtcagtttatcaccacgaatgattgaaattattatatgctcgataaaataatctcttgttcttgattacaaaaaaaaaaaaaaaattttgttcacgttgatcaatagttttttgttgtcaaagaatggatgaaatgaatgcttctcaactagctgatacatgggttactcgctcaccactcatcactgatcaacagcaacatgtaaatactccttgcgcaatggtacgcaatgggaaaaaactcgtcgttagctaatccttcagaaaattagtttttttttttaaaaaagaactctattcttcagtttccgcaatgctcaggatccaccaagggctgctcagttctgttcaatgtaaaccaaaaagttcagttcacaactctgttacggccttacacacgagcaccaatccttgctttcttaacaccttgagagcacccagatgatctatgcatagtaacagacagcaggggaccaacacagatctgattacacaatactgtaggaattcaagctgcagcatacagaaaacgttgcgcacccagtagggcctgtgaaccagga

SEQ ID NO: 3868 - DNA, 687 bp, Zea mays
ctagaacgaacagccgtctcatttttcgttttgtcttctgactccgttccggtaagtaatcagagtccaggcggcagcacagcagcttcctttcctccggcgatggcgaagaatcccaaagatgccgctccggaggaggagatgcccgccgcggccgaggaacaggcagcgcctgccgcgacggtgaaggtgctcttcttcgcccgcgcgcgggacctaacgggcgtggcggattccgcggtggaggtgccgccggggagcaccgcgggggagtgcctcgcgcgggtcctagcccagttccccaagctggaggagatccggggctccgtcgtgctcgcgctcaacgaggagtacgcggccgactcggccgcggtcgccgacggcgacgagctcgctgtcataccgcccatcagtggcggctgacgttattaaccacggccgacttgtgtggaggtaataaaagatatgaagacatcgatcgttgaggaaaaaaaaaagagagaagaaaggttcctctcccttcttcatggtcagtttatcaccacgaatgattgaaattattatatgctcgataaaataatctcttgttcttgattacaaaaaaaaaaaaaaaaattttgttcacgttgatcaatagttttttgttgtcatagaatggatgaaatgaatgcttctcaactagctgat

SEQ ID NO: 3869 - DNA, 4439 bp, Zea mays
  misc_feature (21)..(21): n is a, c, g, or t
  misc_feature (28)..(31): n is a, c, g, or t
  misc_feature (2266)..(2266): n is a, c, g, or t
  misc_feature (2408)..(2408): n is a, c, g, or t
  misc_feature (2811)..(2811): n is a, c, g, or t
ccccccccccccccccccccnccccccnnnncatgccattgggtacccccgggccggccggggagaactccccttctccgccactaccgaagcccttgtacccctcaccgccgccgctgctgctagggagcttccacccgcgcgcgcctacaacgagagctagcagcagtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccaccggcgccggcggttgtgctgccgcctccgccgcaggtgatccgcatgttcgccgcgcctcccccgccgccgcgtgggggcttcttctccgcgccgcagccccggccgttcgagtactatgcgcctatcggtgaacgcagcggatttgctgccaaggagcaacaggcgccggagctggaagcggagatgctcccgcccgccgcggtgaagacggagccagtggtggatgggctcgacgacgaggtggtgcacaagatcaccaagcaggtggaatactattttagtgacatcaaccttgctactacagaacatctgatgagattcattaccaaggattctgagggatatgtgccaatatcagtaattgctggctttaagaaagtaaaaacttctgtgcgcaataatgtgatgcttgctgcggctctccgaacctcatcaaaacttgttgtaagcgatgacggtaagagagtcaaaaggcagcagccatttacagaatctgatttgcaggagctccagtcccggattgttgtagcagaaaatcttcctggtgatccctcctaccagaatcttaagaagatattttcagctgttggaagtttgatttcaatccgaacttgctatcctcagactccaaatggcactggtcctgcaactaatagatcttccaagttagatatgctttttgctaacaagctgcatgctttcgtggagtacgaaactcctgaggatgctgcgaaggctattttggagctcaatgatgagaaaaactggagaaatgggcttagagttcggttgctgaatacttgcacggtgaagggggcaggcaaaggaaaaaacggaatgaatgaaactgatggaaatagtgaggaggatgtctccactttgaaccattctaacgagaaacagtttgaacaatcctctcaactgttagatgtactgccggaacacttgtttgatgagaatttcaacaaggaagttcccaagcgcggcaaagggcgcggtcgcggtgcaaaggaagtccaactactcaagaattttctagtttccttcactgataaaagtttgtttatctatgcctattagtagtactcgggaacaatccttttccttcaattttttacaatgttgcagctttgtgaaaaaaagattgttacaagtgtcacatgattgaagttatcaatccaaacttgaatattttttaatctatacttttgctgcacatgtgattttttcattagctcatattcattgatttactgatgagataatattgttcctttgaaatagctgcatgctttcgtggagtacgaaactcctgaggatgctgcgaaggctgtatgtgtcagttcatgttttagattgcttgcagtaaatatgcatttttatgctatttcttaacattggttggtttcatgaagattttggagctcaatgatgagaaaaactggagaaatgggcttagagttcggttgctgaatacttgcacggtaatactgtttaactctgctgtgtagatttcaccttttggtccatcttgtgtgttcaaatcattaaacttccacatgatcgaattggaatatctttttccttcaagtaaacagttatgattaaaccttaggtgctgtttggttcacccagtggagcggggcgctgcctatgtattcttcatcttttaatttaatggggcacagttctcctgcgtttttcgagaaaaaatgtaatcaggtcccgctgctagcgattaccgtgtaacgattgacgccttttgtttggttgccagccggtagggtaggggtatccgattgcggtgggttcagagcggtatcgactttgtatagagcggtatctaattacgctatgaccggattactggagggccgaaacaaanacgaagcaatggaatacgatacggtctgtagtcgagtaccattacaatatccaaaccaaacgccaccttagatgtattccatgtcttcgtactgtactgcagtttggttcaagtttttgaaacttatgtgcccctttccttnttgtacacttaacttctaatgtttctcctgatttaggtgaagggggcaggcaaaggaaaaaacggaatgaatgaaactgatggaaatagtgaggaggatgtctccactttgaaccattctaacgagaaacagtttgaacaatcctctcaactgttagatgtactgccggaacacttggtaagatactgttgtgggccttctttttctaaacccaaaaaatagactagagcaaaaaggacctataatttatttagtgccttgacattttgtgaagaaccatttgggtgacgatccattaccacccctacatagaatacgagtgcatttatactcgtgttagataccatctgatttcaaatgtaggtcatttaggacagtaacatggccttctatatgacaaagnacttttaacatttgttaaaatataccattctgaatagtgaattatttttaaggaagtattttcaatgatgctgttggtagatcaaccatgtgttgtgacttttcatatattgataaagcaaagatgaaaatgtttgaccagatacaattctgaaacaacctatatttggaatcatgtacgtttgaataggccggtatcgattagtagtgtggaatctgattatggttggacttgaacaaacatgatttaacattatcatttactcattacattataaatatgtgaaccaaacaacacctgaataggccggtatcgatttctagtgtggaatctgattacggttggacttaaacaggcatgatttaacattatcatttactcattacattacaaatatgtgaaccaaacaacacctgaatagttcatgactcttcatccttggaagtcttgaaggtgataaagcttcccgataactaaacattgggctgtgtacagtttgccggccgggtcaacaaggaagttcccaagcgcggcaaagggcgcggtcgcggtggcagagggcatgggcgtggcaaccatcaatataacaatcaccatcacaataaccagcaccaccagaacaaccagccgcagtacaataaccatggcaacaaccaccttggtgggaaccgtggcagccttcactctgttggtactacaccgcataacctgataaccaagcttgagccgcatccgcagctgcctattggggccaacaagcttccaccaggcccccgcatgcctgatggcaccaggggtttcaccatgggcagggggaagccacaggctgtgctacctgggttgtgtgctgttggtgttgagtgaggcatgcagattgctgcttgtatgcttgtattgtatatctttgtggtgggagtatttgtgcgtcacactttgtggacacggcgagctgtcaaaaccggtatattacattcgctttgtaatcgtgtatctggcaatttggccggttggcacgggtatgaatctgcggcctttgaaatcagtatctatcatagaaaaggacaagcacactaaaatgtagcgtggtgatttagggcacgtttagtttgtggctaaatgtgccacactttgcctaaggttagtggttctaattgaataactaaccttagtcagaaaaattaggcaaagtatgacaattgaggtaatgaaccaaacatgactttagtctgccctcctattgcgtcattttgttgtcatttcctaaagcagtgacaaatagttaatttttctgtcagctgttgacgttacgctgaagtctaggatgtgttttgtttggcttttggtagtgattttttgccctctaaaagtcaaatcaaaaggcctaatccagctagcgatttttttcttctaaaaattggttttctcatggtgtaaaattaaacccacctttgaatatatttttaacgggtttttagacggaaaagctttacaaatgtataagtgaaagaatctttagcggttatcaccaaatgatttagttttttcattgcatagaacaacatttttttaatcttttttacggtcacataccctttcatatatgagccttcatggaattctagtttaaa

SEQ ID NO: 3870 - DNA, 2018 bp, Zea mays
gcacgagaccattacctagaacatcctaattgaaaatttcttttgagaactccccttctccgccactaccgaagcccttgtacccctcaccgccgccgctgctgctagggagcttccatccgcgcgcgcctacaacgagagctagcagcggtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccaccggcgccggcggttgtgctgccgcctccgccgcaggtgatccgcatgttcgccgcgcctcccccgccgccgcgtgggggcttcttctccgcgccgcagccccggccgttcgagtactatgcgcctatcggtgaacgcagcggatttgctgccaaggagcaacaggcgccggagctggaagcggagatgctcccgcccgccgcggtgaagacggagcccggtggtggatgggctcgacgacgaggtggtgcacaagatcaccaagcaggtggaatactattttagtgacatcaaccttgctactacagaacatctgatgagattcattaccaaggattctgagggatttgtgccaatatcggtaattgctggctttaagaaagtaaaaacttctgtgcgcaataatgtgatgcttgctgcggctctccgaacctcatcaaaacttgttgtaagcgatgacggtaagagagtcaaaaggcagcagccatttacagaatctgatttgcaggagctccagtcccggattgttgtagcagaaaatcttcctggtgatccctcctaccagaatcttaagaagatattttcagctgttggaagtttgatttcaatccgaacttgctatcctcagactccaaatggcactggtcctgcaactaatagatcttccaagttagatatgctttttgctaacaagctgcatgctttcgtggagtacgaaactcctgaggatgctgcgaaggctattttggagctcaatgatgagaaaaactggagaaatgggcttagagttcggttgctgaatacttgcacggtgaagggggcaggcaaaggaaaaaacggaatgaatgaaactgatggaaatagtgaggaggatgtctccactttgaaccattctaacgagaaacagtttgaacaatcctctcaactgttagatgtactgccggaacacttgtttgatgagaatttcaacaaggaagttcccaagcgcggcaaagggcgcggtcgcggtggcagagggcatgggcgtggcaaccatcaatataacaatcaccatcacaataaccagcaccaccagaacaaccagccgcagtacaataaccatggcaacaaccaccttggtgggaaccgtggcagccttcactctgttggaactacaccgcataacctgataaccaagcttgagccgcatccgcagctgcctattggggccaacaagcttccaccaggcccccgcatgcctgatggcaccaggggtttcaccatgggcagggggaagccacaggctgtgctacctgggttgtgtgctgttggtgttgagtgaggcatgcagattgctgctcgtatgcttgtattgtatatctttgtggtgggagtatttgtgcgtcacactttgtggacacggcgagctgtcaaaaccagtatattacaatcgctttgtaatcgtgtatctgggcaatttggtcggttggcacggggtatgaatcaattttttttgaattcagtatctatcatagaaaaggacaagcacactaaaatgtagcgtggtgatttagtctgccctcctgttgcgtcattttgttgtcatttcctaaagcagtgacaaatagttatttttctgtcggctgttggtgacgttacgctgaagtatagggtgtgtt

SEQ ID NO: 3871 - DNA, 1309 bp, Zea mays
gtcagggctcggcgggcaacacgccagggccaggcaaacagcagcgtagagctgggcctgggcagagcccccgagccgagcagttggtttggtggcgcgcctttactgccgctgccgctcactttcccagggaggggttaattgcctccgcgggcctcgctctcgcgtcgcgtccttcggatgccgcactgaccgccaccaagtcacgcagctcagccgcgcggcgcgatgggcgagaggaggaggcgtgcgagcactgcttccctcgggggtggaggtggaggcggagctggaggtagcggtgttgcgcccgcgcggaacgaggaggacaaggccgcggagcagcctccaccgacgttgtggttcgcgctcaagcggtcgctgcactgccgctccgagctgtcggaggtccacgtgccgcgcgccaacaaggccgccggtcccgtcgtcgcgggcagcggcggcggccacctgtcgtcgttcgtcggcacgctccgccccggcacgccgggccccgcgtgggccggagccgggcacggcctgccgtgcagcggctccgtgcggggcggtgtgcgctgcacgccgccgaggtccccgtgcgtgctgctcgagaggaacggttctgtggtcagcggccaccgcgcgtcctcctgcgaggagaccgcaaaggacggcggcgccggcaagggttccggcgggctcagctgccacaggtgcggcgagcagttcagcaagtgggaggcgctggaggagcaccacctctccaggcacgcagtgacggagctggtggaaggggactcgtcgcggaagatcgtggagatcatctgccggacgagcctgctcaagtcggagagcagctgcgtccggatcgagcgcgtgttcaaggtgcacaacacgcagcggacgctgtcccgcttcgaggagtaccgcgaggccgtgaagctcaaggcgagcaagctagccaagaagcacccgcgctgcctcgccgacggcaacgagctgctgcgcttccacggcgccacgctctcgtgcgcgctcggcggcggctccggctcttccagcctctgcgcctccgacaagtgcgccgtgtgccgcatcatccggcacggcttctccgccaggaaggagggcaagggcggcgtgggcgtgttcaccacgtccaccagcggccgcgcgttcgagtccatcgttgaggcgccccccgccatcggcgtcggcgacgacgacggagcgggccagctgggcctgggcaccgcgcgcagggcgctgctggtgtgcagggtcatcgccggccgcgtgcacaagccgc

SEQ ID NO: 3872 - DNA, 2000 bp, Zea mays
  misc_feature (1991)..(1991): n is a, c, g, or t
cctcgaggccggccgggccgggctccctccgggccccccgggaaccggtagcgtaaagccggtcgatttccggaccccatattttcttctatcttcccagctgccgttgccggcggaagaagccaattgacgtgatccccgccgccaagcccaaccccgccgaccggagctgcatcctctccttctctctcccataccacgacgagacgatcccatcggcgcccgcgcggtcccttcgatccaagcaagcgtagtcccttgttcctagtataacctctaaatgattccatgggaactccaaacgaaatgatggcatactcttccctgtccaaaatggacaccagccagaaccacggagctgctctgtccaatgtagttgctggaaacaactatcctgttcaggattatctttatgagcaagcatccgaaccagacttcccagagtatgattcaagggatgacctgttcgctccaacacgagctagtccaaaagtcaatctaaatactgttctaggtggtctggtttcgattgttacaggtgtaaacaagagtgaggatgatgcatcgcagcatgaaagttttagcacagacatatcattccttagatctgacaagaatggtaatgtcaatgtgcacccttccgtctgtgttccaagtgccccaccactacttgaagcgaatgctttacaatatagtgcatacaaggaggtgttgctagcagatccaccagagtggttgccagatagctctgctaatgtgtgcctacagtgcaacttgcctttcacggctctgactcgtggaaggcaccattgtcgggtctgtggaggtatattctgcaaaactgttccaaaggaagatgtttgatgcccatgaaattcaggatccgtgatcctcagagagtttgtgatgcttgctatgagaggcttgatccacttcagggattattgatcaactacaatagtaactgcatgcagcaagcaaaacacgatgtcatggattggacaagcactagaagctggttgaacatgcctgttggtgtatcaatggagtatgagatatacaaggctacaaacacaatgaagaaatattgtcaggttgctagattaaaccctgagaagtccatcccatcatctattctcaagggggcgaagggacttgcaattctaacagttgccaaggcaggtgcagttcttacatacaaagttggcactggtcttgtggttgctcgcagatctgatggatcatggtctgctccctctgcaattttatctgttggcctgggatggggagtgcagattggaggagaactgacagacttcatcattgtgcttcatgaccgtaaagctgtcaaggctttcagcagtcgcattcatctttcacttggggcaggattgagtgctgcagcaggacccattggcagagcatttgaggcagacgttcgggccagtgaaaagggttctgggatatgctacacttacagctgcaccaaaggtgccttcgttggggtttcactggaagggaatgtggtgacaaccagaatggagaccaatctacgcttctacggtgatgcatacctgacggcaaccgatatcctgtttgggagggtggagcggccccgagctgcccagcccttgtactcagctctagatgatctgttctccaaaatggtttgctagcccatttagattggcgtgatactctgcattggtggcatgcagtcatgtatgtatataaacataaggtagcagcaaaaatcctaaacaggagatatggaagcggaaagaatgtacagcttttgatggatggtttcactactgatagcagtccatacatgtaaatattggcagaagaagatttaagggctgtttggttcgcacactactgatatcagtacgctgcagtgtgccactggtggactcatccatgcaatggaaaattttaatacatttgttaaaaaaaaaaaaaaaaaaaaaaaaaactcgagggagggncgcggtacc

SEQ ID NO: 3873 - DNA, 737 bp, Zea mays
atcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttctaggtcgagcggagcaccgaggagggcaagcctcctccccactacggtaaagaaatcaatgtgccggataaagcatgtcttgactgagagggctatagcggagcccgatccaaggagatcttcggaaatgaagcggatgataaatgccctgtgattcactcacaggcattctcccttgggacttttgatggtacttattagaaagatctgctgccttctgttgtatctttatcccataagaactgtgagaccaaatcttttcgatgcccatggtatggtagcaaaaattagactttaacttatccgatccaataattgtctgttgagcttattttttcttcggaatgtgattccaatttagcccttaattgggttgccaatccaactgctcgattgagcagcgatgctggaattttacccctctagggatccgtagtcttgcacttatgcggcattacgactccaacaccctcatacagactgtgcaatactctatttattttaaattataagatgttatatttctttctgaaaaaaaaaaaaaaaa

SEQ ID NO: 3874 - DNA, 2549 bp, Zea mays
  misc_feature (25)..(30): n is a, c, g, or t
cattgggtacctcgagggccggccnnnnnnaaaatacaaaatcgggtcagtaagtaggtgcggcccccagtcgtatgtcgcatcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctccccactacggtcgcagctggaaggcttctgaactgcgactaaaatcttgggatgaccttcagaaattgtggtatgttcttctaaaggaaaagaacatgctaatgacacagcgtcaaatgctgcattcagagagcatgaggttcccaaatccagaacgaatttccaaggtaaagaaatcaatgtgccggataaagcatgtcttgactgagagggctatagcggagcccgatccaaggagatcttcggaaatgaagcggatgataaatgccctgtgattcactcacaggcattctcccttgggacttttgatggtacttattagaaagatctgctgccttctgttgtatctttatcccataagaactgtgagaccaaatcttttcgatgcccatggtatggtagcaaaaattagactttaacttatccgatccaataattgtctgttgagcttattttttcttcggaatgtgattccaatttagcccttaattgggttgccaatccaactgctcgattgagcagcgatgctggaattttacccctctagggatccgtagtcttgcacttatgcggcattacgactccaacaccctcatacagactgtgcaatactctatttattttaaattataagatgttatatttctttctaaaaaaaaaaaaaaaaagcagcctttgtatttaggagtataattttgttatttaggtacatagtagaaaacagctaaacccccttacaaattaggggttgtttgtgaccaagaggactgagtggccacaatcctctttctattcaacgatctcattgttaataacgttagttgggaagctgtttggctccgagaaaaagaaatcacggagctcattgttcggctcgaaggattgaccgtcgtgatgtctctcggtcagacctgttaggtttggtgatctacgtcgtgctctaataattctatatctttatatatatatattgtgtcttaatttacgcaatgttaatagttagtgattgcctaggatcaacgctagagcctgcatcccttactctatctttgtcaaaacaatcttgtctgtctattgcctaggttactaagttggcacttgcaagtgccctgcatgaagaggagagatgcagatgcacgcagaggctgagagatgagctactagctaactgatctcggtaaatctctctctctctctctctctctatctatcgtgctgtccacgggaacgggacccacgcggtgtcgccacgtgtgccgatgtatcaacaagcaagcgccgtcgccgtgcaagaaaaaagagaacgacacacgccgccaatgcatggaagccgtctagtagcacgcaagcctagtttgcctggccccaccaccgatgacaatacagtctagacgtgtagtaccactaccacctcgccgccggcaggccattgggcgcaacttgcttgcgagcacggcaggtgtgatccattccgtgggggcattcgccaattgcgccgcgtcattttcaccctccaaccccaatcattcttcacacacctccactcctaatcgctctgctacgcgcaccccgctcgagatcatctacacacgcggcgaacgggacacctcggccttgcttatgctacgtacacacgcggctgaaaggagacccatcagtcgatcgtttttgttttgttttgttttgttgttgttaatctatctgggagttcttcgttttaacactcctagttccgtttcccatctccgttttagaataggaaggaaaaaaaaaacaatgatatgggagatctttgggtgggcgcgtggctactctttgcttggccatttggtgatgtagatgttgctgcgacgctaggaaaccgagagaccatctgttctgttcaacatgcttacgatcggagagtcttgctattgagttattattattattattattattattattattattattattattattattattattattattattattattattattattattattattattattattattattattattattattattttgctcgggaccgatttgtttgggatttcccttgcttttgtgtggatttcaaaggagtgataacccaatagagcttgttcgattctaccataatccatatgcattgagaaggattgagagagtttcaatccctagtaaatcaaaatctctctcacttcatatcaatccccccaaatttatatggattgaaaataaccgaacaag

SEQ ID NO: 3875 - DNA, 606 bp, Zea mays
agcatatatttctaccgatcatgatgaagggtggtagcaagaaggaggtgggcgcggtggtggtggccatactgctggttctgcagctcatggcagccccaccgacggccatggccgcccgctcgccgcgcggagccgtgccggatggctccctcgccacgacgcccaaggtgacgatgctgtcagccacgctgtgctacacgggggagacatgcaaatacattacctgcctcactcctgcttgctcctgtaactatgatgatcgtcgctgctacatcatatttactcctgctgctgcttgaggccattctgtacgtgaatgaagccactatactctcacacacagcatgcgccggccgacgacgcgtacgtacgtacgtacgtatatatatacgctacctcgtgagcttttgttcgagtgatacgtgtttcaaggcatccatccatccatggatgcttatgtacgtatatgtgttagtcgtgtgtcaggcaaccgggcagcagaagggggtgttgtattatatatatttacgtcttctggtgattaaataataaaggggggcatgttggatgtgtgcaaaaaaccaaacaaagaaaaaagaaaaa

SEQ ID NO: 3876 - DNA, 586 bp, Zea mays
  misc_feature (586)..(586): n is a, c, g, or t
catatatatccacttatcatgatgaagggtggtagcaagaaggaggtggtggtggccatactgctggttctgcagctcatggcagctccaccgacggccatggccgcccgctcgccgcgcggagccgtgccggatggctccctcgccacgacgcccaaggtgacgatgctgtcagccacgctgtgctacacgggggagacatgcaaatacattacctgcctcactcctgcttgctcctgtaactatgatgatcgtcgctgctacatcatatttactcctgctgctgcttgaggccattctgtgtacgtgaatgaagccactactactctcacacagcatgcgccggccgacgacgtgcgtacgtatatatatacgctctacctcgtgagcttttgttcgagtgatacgtgtttcaaggcatccatccatgcatggatgcttatgtacgtatatgtgttagtcgtgtcagggaaccgggcagcagaagggggtgttgtattatatttacgtcttctggtgattaaataaaaaaggggggcatgttggatgtgtgccaaaaaaaaaaaaaaaaaaagaaaattaagcn

SEQ ID NO: 3877 - DNA, 886 bp, Zea mays
caccccaagtggtttcccaacgtgaacctcatgcagcttaaaatacagccagttgcgatccatctgccacagtatattacctgtttctacctcagatgtgctacacagtgtattgcctgattctacctcagatgtgctacacagttgcatacgatcgactgcctataaaatggccgggatcggtgaggctgctggaactggggtgggagagcatatatatccaccgatcatggtgaagggtggtagcaagaaggaggtggtggtggccatactgctggttctgcagctcatggcagctccaccgacggccatggccgcccgctcgccgcgcggagccgtgccggatggctccctcgccacgacgcccaaggtgacgatgctgtcagccacgctgtgctacacgggggagacatgcaaatacattacctgcctcactcctgcttgctcctgtaactatgatgatcgtcgctgctacatcatatttactcctgctgctgcttgaggccattctgtacgtgaatgaagccactacgatctcacacagcatgcgccggccgacgacgtacgtacgtacgtatatatatacgctacctcgtgagcttttgttcgagtgatacgtgtttcaaggcatccatccatccatggatgcttatgtacgtatatgtgttagtcgtgtgtcaggcaaccgggcagcagaagggggtgttgtattatatatatttacgtcttctggtgattaaataataaaggggggcatgttggatgtgtgcaaggcatatctgtagagcaattttattgctcgcactgccataatgacaaaaatccaaaaatcttatgcctggattttattcaaacgaaaaaagcaacaccaaaattgttagcaagc

SEQ ID NO: 3878 - DNA, 3412 bp, Zea mays
  misc_feature (38)..(38): n is a, c, g, or t
  misc_feature (55)..(55): n is a, c, g, or t
  misc_feature (195)..(195): n is a, c, g, or t
  misc_feature (347)..(347): n is a, c, g, or t
  misc_feature (418)..(418): n is a, c, g, or t
  misc_feature (1653)..(1653): n is a, c, g, or t
  misc_feature (1925)..(1925): n is a, c, g, or t
cgccttggcgagaactgtatctaacacatcaaaattgncggtaacccaattgggncaagctaaaaaaaatgagaaccaaacaatgtgttatatgggccaggtttattttgaccaggcaaccaaacattttaggttggctcattatatacgggctcccttgagcctggttctctcactgagccaggctcaggctgnaccaggcaaccaaacatatccttaggtgctgctcgtctccacacctcctctggccttgttgagcactaaaaagtgccatgtttgacattttattgggacctcatctatcctcaccgcaaggagaaaagcctacatgggaggggatggatcgnccttgtagaagggatatctcatacagtacaaggtgccttgactactgaagacaagttatcaactagatatncttagaagccaagtaacttggcaagatccccttggatatgactagatttccttataaccaactaggaaactttgtcttaaggtcgattaggatttaggactccatgggcaacctattctatgggctatatgagaagggatatataggggacccctaactgacatattccacacaactcatcatagaaactttctgcactataactagaatccaacgaccctgtaactcgagtgcatatcacaaagagaagctttctgcactggacgtagtgtactttgtacttgaaacttatataaatttgtgccttttatactccatcgttcgaaaatatagtacttttttgtctcttttttcgtccactcattcgaatgataataaatatagacatacataacaactatatttataggttaattaataaatatatatttagtctaaaacaaaatatattttacccattttattccttatgcatgaaacgttgatctacttgtcagatggaaaaatactacgacgttgttgtaccagaccgcacctaaatcaaactgttttcagagatggccattctattattgtagatttgtgatacgatgtacttttttatccataaaataccataccattatgatatggatatcttgatgagagggactcattatctctctctctatatatataaacacctatatatcaaacaggcataaagaaaaaacagatgattttttttctgaagtagagtgacagaagcagaagtgtgagtctttttgtttcaattttataatgtgtaaagaaaatgacgccaatgaaatatgtgtctgggctgacgtgttgtttggtgaaagccaattttgttgtatataggggggccagagcccagttgtatttgttgccgggactggcgcaaaaaaaaatccccttggatatgactagatttccttataacgaactaggaacttcatgttaaggtcgattaggatttaggactccatcggcaatctattctacgggctatatgaggagggataggggtcccctaagtgacattccacacaactcatcatagaactagaatccaacggcctgtaacccaagtgcatagcataaagagaagctttctgcactggatgtagtgtactttatacttgaaacttgtataaatttgtgtcttttatactccctcagtttgaaatatagttctttctagcctctttttttccgtccacactcatttgaangataataaatatagatatacatacaaactatattcataggttaattaataaatgtatatttagtctaaaatgaaatatattttacccatcgtattccttatgcatgaaatgttgatctacttgtctgatggaaaaatactacgacgttgttgtaccagaccgcacctaaatcaaactgttttcagagatggccattctattattgtagatttgtgatacgtacgatgtacttttttatccataaaataccgtaccattatgatatggatatnttgatgagagggactcattatctctctctatatatataaacacctatatatcaaacaggcatcaagaaaaatagatgatttttttttctgaagtagagtgacagaagcagctgaagtgtgagtctttttgtttcaattttataatgtgtaaagaaaatgacgccaatgaaatatgtgtctgggctgacgtgttgtttggtgaaagccaattttgttgtatataggggggccagagcccagttgtatttgttgcccggactggcgccaaaaaaaaaaatccggatagtactattccgctaactgtgtcacactttatctaaaattagtcatccaaattaaagaactaaccttagatacaaaaaattaaacaaagtatgacaagttaggtagcaaactaaactaaagaggataacacaacagttaaccgtcgacgtgcgcggcctgaatttactactacagataacacgacagttaacgagcgggtatgggttgttttccttgagcactgttgttctctagaatctctgaatctctctctgtcttgatgacaccgagcggaaatagcagggggaccgggtgattgggcttcagcgcgcgatccaacccaagtgggttccacaacgtgaacctcatgcagcttaaaatacagccagttgtgatccatctgccacagctgtttctacctcagatgtgctacacagtgtattacctgtttctacctcgcagatgtgctacacagttgcttatgactgcctataaaatggccgggatcggtgaggctccccgcgtccgccccgcagagcatatatatccaccgatcatgatgaagggtggcagcaagaaggaagtggccggtgcggcggcggtggtggccatactgctggttctgcagctgatggcagctccaccgacggccatggccgcccgctcgccgcgcggagccgtgccggatggctccctcgccacgacgcccaaggtgacgatgctgtcagccacgctgtgctacacgggggagacatgcaaatacattacctgcctcactcctgcttgctcctgtaactatgatgatcgtcgctgctacatcatatttactcctgctgctgcttgaggccattctgtgtacgtgaatgaagccactactactctcacacagcatgcgccggccgacgacgtgcgtacgtatatatatacgctctacctcgtgagcttttgttcgagtgatacgtgtttcaaggcatccatccatccatggatgcttatgtacgtatatgtgttagtcgtgtgtcaggcaaccgggcagcagaagggggtgttgtattatatatatttacgtcttctggtgattaaataataaaggggggcatgttggatgtgtgcaaaaaaaaaaaaaaaaaaaaaaaaatcgctcgcactgccataatggcaaaaatccaaaaatcttatgcctggattttattcaaacgaaaaaaaaaaaaaaaaaatccgta

SEQ ID NO: 3879 - DNA, 592 bp, Zea mays
aattcggcccgaggcgatcatgaagggtggcaagaaggaagtggccggtccggtggtggccatactgctggttctgcagctcatggcagctcccccgacggccatggccgcccgctccccgcgcggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccccaacttttacaatatgcatgcgccggccgacgacgacgcgcgctgcctctcgtgagcttctgttcaagtgatgcatgtttcaaggcatccatggatgctttacgtatatgcgtattaattaaccgtgtcagggaaccggacagaagggggtgttgttttatatttacgtcttctggtgatcaaataaaggggaaatatatgttggatgtgtgccaaaaaaaaaaaaaaaaaaaaaaaaaaaaaaaaaaaaaactcgagggctcgagaaggggcgccggtacc

SEQ ID NO: 3880 - DNA, 704 bp, Zea mays
gacccacgcgtccccccacgcgtccggtgggagcatatatatccaccgatcatgatgaagggtggcagcaagaaggaagtggccggtgcggcggcggtggtggccatactgctggttctgcagctgatggcagctccaccgacggccatggccgcccgctcgccgcgcggagccgtgccggatggctccctcgccacgacgcccaaggtgacgatgctgtcagccacgctgtgctacacgggggagacatgcaaatacattacctgcctcactcctgcttgctcctgtaactatgatgatcgtcgctgctacatcatatttactcctgctgctgcttgaggccattattctgtacgtaaatgaagccactactactctcacacagcatgcgccggccgacgacgtacgtacgtgtattatatacgctctaccccgtgagcttttgttcgagtgatacgtgatccatccatgcatggatgcttatgtatgtatatgtgttagtcgtctcagggaaccgggcagcagaagggggtgttgtattatatttacgtcttctggtgattaaataataaaggggtatgttggatgtgtgcaaggcatatctgtagagcaattttattgctcgcactgccataatggcaaaatacaaaaaaaaacttatgcctggattttattcaaacgagaaaaaaaaaaaaaggggcggc

SEQ ID NO: 3881 - DNA, 1392 bp, Zea mays
gcgtggtcgcggccgaggtacgcggggaaagccaatcagatagagagagcatagtcgatcatgaagggtggcaagaaggaagtggccggtgcggtggtggccatactgctggttctgcagctcatggcagctccaccgacggccatggccgcccgctcgccgcgcggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactctcacatgcatgcgacgacgctgcctcgtgagcttctgttcaagtgatgcatgtttcaaggcatccatccatggatgctttatgtttatgcgtattaattagccgtgtgtcagggaaccgggcagaagggggtgctgttttatttacgtcttctggtgatcaaataaaggggaaatacatgttggatgtgtgcaatgcatagaattttattgctcgatctgcatgagggttgctgatctatgcctctatatatgtgcgagtaacaaaagtcatcacgcaaaaaaaaaaaaatccaagatcttatacctggattttattcaaacgaaagcgacaccgaaatatattattagccaacgagatgaccaatatatgaataatttgaccgctttgagagagcgcaacctcacctatttctattgttttgctaacgcagtaatgcgtgacatcgatcgtcattacatgtactgcaaaaattaaaaagaaatgaaaacacatgtttggagactaaatgtttgtaagaagtaaaagtatccccactctactcttatacctaaactcatgcattgctacgaaatcaatattataaaatacattgatatataaaaatactaattattatatatttttattagcataattaaatggatgcttacgtaccttgaaagatatatagtacaatagtacttatatatatatatattaatatatcgcttccaaagtttcaatcatcttcccatattctcatggcggctgtcaggtcatggcatcatgcatgtgtggtttctatggtacatgatgatagaccctttagctgatttgttgtgctgttatgtgcgtggccatgcccgtagagacaccgtacaccaaacgatcgcctcgctcaacattttgctgcttagcatgccttcagaagactaaactaaaaaaatattgatcaggccacggcaaattaatttggaactcgaggaggtatccatctcctatggattttgttgactgcacaaacattgtgagaggcgacttcttcgtagctgca

SEQ ID NO: 3882 - DNA, 794 bp, Zea mays
ccaaggcagacgggagcgacgaggcgcacatcgtgctgtgccgcgtgctgatcggccggccggaggttgtcccggcaggatcttcgcagttctgccccagcagccgcagctacgacagcgccgtggataagctggagaatccacagtggtacgttgtgtggaacatggatatgaacacgaggatcctcccggaatacgtggtcagcttcaagtgctccaagctgcaacagatgcgagaatcatcagaagcgacttcaaagctgaagaagccggcaccagtggctcgcgacatgttcccgacgcttcttgcagagatcgagcagatcgtgccagacaagtgtgatctattgcaggagtcatacaaaaacttcaagatgggtcagattaagaaagaccagttcatccagttcctccgcaattacgtcggagacgaagtgctgaaaaccgtggccaagaaacttcgacgatgctaaatttctagtgcgcggtgcgacatcattatctccttgatttctactcgagctgtctgtagtagtgctcagtagagatgaggaggttcacttctgtttctgttgattcaagtttctgtcaagggcctatagggggtttggcgcgctgttcttacattaaccaacagtccaacacaaaggatagatgcagtttctgatactgagacgtttcgattcttcttttagtgtcctgcagcctgtgataatctgtacagactgaaatgatatatgcataaatggaaccattgcagagtttaacaaaaaaaaaaaaaaaaaaaaaaaaaa

SEQ ID NO: 3883 - DNA, 459 bp, Zea mays
ggtcggattaagaagcacgagttcatccgattcctccgcaattacgtcggagacaaagtgctgaccaccgtggccaagaaactacgaggatgctaaatttctagtgcgcgtgtctccttggtttcgccgtcttggtggtggcatacgtggtggctctgactacagcgattcaagcttgtctacgtgctagatgtctgcagtagtaccaaatagagatgaggagctttacttctgtttctgtttattcaagtttctgccaagggcgtatgcgtatagaggctttgcagcgatgctcttccattaaccaacacaaaggataggtgcagtttctgatcatgagacgtttcagttcttctgtgtcctgcagcctgtggatataatctgtgcagactgaaatgatttgatgaaaccattgttgaaccgcccaaaaaaaaaaaaaaaaaaaaaaaaaaaaaaaaa

SEQ ID NO: 3884 - DNA, 1064 bp, Zea mays
tccccctccccacctattttatggtgtgagcgtcagccgggagcactcccccgcccgaccaagatccaacagacacttacacctatccaatccactagctaagcgcgccatggcaaagttcgctcttggtcaccaccgcgaggcctccgacgccggctgcgtccgtgccgtcctcgccgagctcatcctcaccttcctcttcgtcttcgccggcgttggctccgccatggcaacagggaagctggccggcggcggcggggacacggtggtgggcctgacggcggtggcgctggcgcacacgctggtggtggccgtcatggtgtcagcggggctgcacgtctccggcggccacatcaacccggccgtgacgctgggcctcgccgccacgggccgcatcacgctgttccgctccgcgctctacgtggccgcccagctgctcggctccacgctcgcctgcctcctcctcgctttcctcgcagttgccgacagcggcgtgcccgtgcacgcgctgggcgccggcgtcggcgcgctccggggcgtgctcatggaggccgtgctcaccttctcgctgctcttcgcggtctacgccaccgtcgtcgacccgcgccgcgccgtcggcggcatgggcccgctgctggtgggcctggtcgtcggcgccaacgtgctcgccggcgggcccttctccggcgcgtccatgaaccccgcgcgctccttcggccccgcgctcgtggctggggtgtgggccgaccactgggtctactgggtcgggcctcttatcggtgggccgctcgctgggctggtctatgacggcctcttcatggcccagggcggacacgaaccgcttcccagggatgacaccgacttctaggcagtaggtgtgtgttctcctgaataatttgaattgaaaacacatgtattgaagcctctaatgtttcggtttcgattcaaatggaatggaagcagcagtatcaaaaaaaaaaaaaaaaaggcggccattcacttaaacatatgtttttaagacctgctttgaaagtaagttattaagagaaaaagaatcagaagct

SEQ ID NO: 3885 - DNA, 1083 bp, Zea mays
cggccggggtctcgtgcgcttttactacccacgcttacggatgtatccgtctccccccccccctctagtctggggcgtcggggccggccgggagcactcaccaagatccagcatacacttatcccatccactagctaagcgcgccatggcaaagttcgctcttggtcaccaccgcgaggcctccgacgccggctgcgtccgtgccgtcctcgccgagttcatcctcaccttcctcttcgtcttcgccggcgttggctccgccatggcaacagggaagctggccggcggcggcggggacacggtggtgggcctgacggcggtggcgctggcgcacacgctggtggtggccgtcatggtgtcagcggggctgcacgtctccggcggccacatcaacccggccgtgacgctgggcctcgccgccacgggccgcatcacgctgttccgctccgcgctctacgtggccgcccagctgctcggctccacgctcgcctgcctcctcctcgctttcctcgcagttgccgacagcggcgtgcccgtgcacgcgctgggcaccggcgtcggcgcgctccggggcgtgctcatggaggccgtgctcaccttctcgctgctcttcgcggtctacgccaccgtcgtcgacccgcgccgcgccgtcggcggcatgggcccgctgctggtgggcctggtcgtcggcgccaacgtgctcgccggcgggcccttctccggcgcgtccatgaaccccgcgcgctccttcggccccgcgctcgtggcttggggtgtgggccgaccactgggtctactgggtcgggcctcttatcggtgggccgctcgctgggctggtctatgacggcctcttcatggcccagggcggacacgaaccgcttcccagggatgacaccgacttctaggcagtaggtgtgtgttctcctgaataatttgaattgaaaacacatgtattgaagcctctaatgtttcggtttcgattcaaatggaatggaagcagcagtatcaaataaagtctcggtgaggtcgtaattcattgtaaaaaaaaaaaaaaaaagcggccaaaaaaaaaaaaaagcggcc

SEQ ID NO: 3886 - DNA, 1148 bp, Zea mays
caccacgcttacggatgtatccgtctccccctccccacctattttatggtgtgagcgtcagccgtcagcccgtcagcactcaccaagatccagcatacacttatcccatccactagctaagcgcgccatggcaaagttcgctcttggtcaccaccgcgaggcctccgacgccggctgcgtccgtgccgtcctcgccgagttcatcctcaccttcctcttcgtcttcgccggcgttggctccgccatccccgcggccggccgccgtatatagtacaatatataacacatgcgccgtggcaatcatgcatgcacgcacgcagggaagctggccggcggcggcggggacacggtggtgggcctgacggcggtggcgctggcgcacacgctggtggtggccgtcatggtgtcagcggggctgcacgtctccggcggccacatcaacccggccgtgacgctgggcctcgccgccacgggccgcatcacgctgttccgctccgcgctctacgtggccgcccagctgctcggctccacgctcgcctgcctcctcctcgctttcctcgcagttgccgacagcggcgtgcccgtgcacgcgctgggcgccggcgtcggcgcgctccggggcgtgctcatggaggccgtgctcaccttctcgctgctcttcgcggtctacgccaccgtcgtcgacccgcgccgcgccgtcggcggcatgggcccgctgctggtgggcctggtcgtcggcgccaacgtgctcgccggcgggcccttctccggcgcgtccatgaaccccgcgcgctccttcggccccgcgctcgtggctggggtgtgggccgaccactgggtctactgggtcgggcctcttatcggtgggccgctcgctgggctggtctatgacggcctcttcatggcccagggcggacacgaaccgcttcccagggatgacaccgacttctaggcagtaggtgtgtgttctcctgaataatttgaattgtaaacccatgtattgaagcctctaatgtttcggtttcgattcagatggaatggaagcagcagtaccaaataaagtctcggtgaggtcgtaattcacttaaacatatgtttttaagacctgctttgaaagtccgccattaagagaaaaagaatcagaagct

SEQ ID NO: 3887 - DNA, 2401 bp, Zea mays
attttttttatatggagattatttctggtttatataaaaggacacaagtggggacgaagcagcagaagacttcccttcgtctgcttcccagagacccagccatggcgatctcccagatctcacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgccccctggtgtggtcactgcaagaagcttgctcctgagtatgaaagacttggtgcaagttttaagaaagctaaatctgtcttgattgctaaggttgattgtgatgagcacaagagtttgtgcagcaagtatggagtttccgggtatccaacaatccaatggttcccgaaaggatccttggagcccaaaaagtatgaaggacaacgcactgcagaagcccttgctgaatttctcaatactgaaggaggcacaaatgtaaagctggcaaccattccttcaagtgttgtggttctcaccccagagacctttgactcaattgtccttgatgaaaccaaagatgtccttgttgagttctatgccccatggtgtggtcactgcaagagtcttgcaccgacgtatgagaaggtggcttctgttttcaagttggatgaaggagttgttattgctaaccttgacgctgacaaacacagggatttggctgagaagtatggagttagtggatttcctaccttgaagtttttcccaaagggaaacaaagctggtgaagattatgatggtgatagggacttggttgactttgtcaagttcattaacgagaagagtggtaccagccgtgacacaaagggtcaactaacctcagaggctggccgtatagcaagtctggatgtcctggctaaggagttccttggtgcttccggtgacaagcgaaaggaagtcctctccagtatggaggaggaggcagataagctcagtggttctgctgcaaggcatggaaaggtctatgtaaccatcgcaaagaagattctagagaaaggcaacgagtatactgagaaggaaaccaagaggcttgatcgcatgttggagaagtccatcagcccctccaaggccgacgagtttatcatcaagaagaacgttctttcgactttctcatcctaaggcatctgctagctccattttcacgtttcagatataggcgacaaaaactgcaggattataagtgtgataatgagagttaaatggtgctagaactaattttggggctttccctcgaggatatgtaatactcgtacgtcttgcgaattagttcttttccttgtgcttctggatttattccgtagcaccatagtttattttttggtttgacatggaggacattgtgactacagaactgagttttactatccaataacactgctcacttgatggggcttatgcgaaaaaaaaaaaaaaaaaaacaaacaaaaaaaaaaaaaaaaaaaaaaaaaaaaaaaaaagcggccaaaaaaaaaaaaaaaaaaaaaaaaaaaaaaaaaaaaaaaaaaaaaaaaaggggccccgccaaaaaaaaaaaacaaaaaaagggggagggcgtggcaactgacaaccccttgttggcgccccgacaaaatcgtttattgtccgcgttccccctccctgaaaggggggggaaaacgcccggccttccccccttttgtcccctgaagaaccgcccccctcccccatcgccaatggaaaacaaaacaaccctgccccctccaccgcgtcacaagagggggcccccccaaaagggaccgtgaaccccgcccgaccccgaattatgaccccggggggttgcgtttcttcacctccccctccccccccctttttttcccccccccaccccccccttcctctccttttttctccgtttccttccccccggtttgccggattttccccccctaaaaaacagattaaggggccctttcccccaaagagtttaattgatgtgggctccccccccccccccaaaatatttgttgatggaggtgtttaccacagggtcccctcctccaaaaaaggaatttatcttccctctctttgtgcagaaatagaaccttatttaaagcggtatttttgccaaaattgggacaaaaaaccaaaaaatttttctggattttttttttattttttaataaaagatgtttttcgccattacctcaccttttaaaaaaaaaaaattgcccttttttttcacaaaatttttatccgaaaaatctttatttttttgattaatccttttaaaaattgggggggatcaatttttttttttaggaaaaaaaaaaaaccacacctttttttttttttttttt

SEQ ID NO: 3888 - DNA, 837 bp, Zea mays
cattgggtacctcgaggccggccgggaattcactactcaaatcacatttgaatctttaagcctcacccacacgaagtctctgacttgtgagcacctttgcgaattttccttctactactttgataccccactacgcattcgcctacctataccatggcacccgcgatcggaatcgatcttggaaccacatactcatgtgtcggcatcttccgagatgaccgcattgagatcatcgccaacgaccagggtaaccgcacaacaccctcgttcgttgcctttaccgacaccgagcgtctcattggtgactcggcaaagaaccaagtcgccatgaaccctaccaacaccgtcttcgatgccaagcgcctcattggtcgcaagttcgccgacgctgaggtccaggccgacatgaagcacttccccttcaaggtcattgacaagggtggcaagcctgtcatccaggtcgagttcaagggcgaggagaagacattcacaccagaggagatctcatctatggtcctgaccaagatgagggagaccgcagagtcctacctcggtggaaccgtcaacaacgctgtcgttactgtcccagcctacttcaacgactcacaacgtcaggccaccaaggatgctggtctcatcgccggtctcaacgtcctccgtatcatcaacgagcctaccgctgctgctatcgcctacggtcttgacaagaagacccagggtgagcgcaacgtcctcatcttcgactttgggtgggggtaactttcgatgtctctctcttgacccattgaggagggtatctttcgagggtcaagtccactgcaggtgacactcacttgg

SEQ ID NO: 3889 - DNA, 1635 bp, Zea mays
gcacgggggggagaactcacagcagagattctagctgccttagttagcttgggtcatggcggtggcgacgactgctcggtggctcctgctcctggctgtcgtctcggcggccgcggcgtccgggaagcacgagaggtggagggtgggcggccaggtggtggagaaggagcgacggcgggtggtggcggagagcgaggccggctcggtctcggccgtggacgtcgccgacgcggcgggcacggcgtaccggctgcacttcatcaccatggaccccggggcgctgttcctgcccgtgcagctgcatgccgacatggtgttctacgttcacagcgggcggggcaaggtgacttccatagaagaagagagcagcgaacagagctccctggaggtggagcgaggagacgtatacaactttgagcaggggagcatcctgtacatccagagctaccccaacgccagtagacagcgtcttcggatctacgccatcttcaccagcgaaggcatcaacgccgatgacccctcgaagcccaaggtggaagcttactccagcgtcagcaatctggtcaaagggttcgagacagacgttcttcgcctcggatttggggtccaatccgaggtggtagaagcgatcaagtctgccaagacaccgccaccgatcatagcctacaacccagaggaggagaagggggacaagaaacccggctggaggaccgaggacatcgtcgacgctctgttgggcctgcgcgatccggaggagttccttaacaagaagaagaagaaggacaagcacaaggacaagaagtccaagagcaaggcgttcaacttctactccggaaagccagacgtccagaactgctacgggtggagccgggcgatgactagcaaggacctcgacgcgctgcacggatccagcattggcatgttcatggtgaacctgaccacgggttcgatgatggggcctcactggaaccccaaggcgacggagatcgccatcgtgacagagggttcaggaatcgtgcagacggtgtgcccgagcagcagcccgtcgggcgggagcagtggaggccaccaccacggtcacaagcggcgcggcgggccgggaggccgcggcgatgagggcgaaggcgaaggcggccgcgcgcggtggcagtgcaggaactcggtgttccgcgtgaaggaaggcgacgccgcccgggtgccgcggttccacccgatggcgcagatgtcgttcaacgacgactcgttcgtgttcgtcgggttcagcacccacatggggcaaaaccacccgcagttcctggccgggaagggctccgtgctgcaggccattgggaagaaggtgctggcgctggcgctggggcagcgggacccgaccgccgtggacaagctgctgtccgcgcagcgcgagtcgacgatactgccgtgcgtatcgtgcgctgaggagctggcggagaaggccgaggaggagaggaagcgacgggaggaggaagggggagggaaagggaaaggaccgggagaacgtgagaaggaaaaggagaggagggaacgggaggagaaggaaaaggaggaagagcgggagagggaacgggaggaaaaggagaggaaggaaagggaacgggagaaaaaaaaataaaaagg

SEQ ID NO: 3890 - DNA, 842 bp, Zea mays
ctcgaggccggccggggcactgtttcctagtaataaagacgcccactctttggctcctcgcctccctcctcccctccgtctcatatcctccctgtaggagcatcccgtgtcttcaccttttgctcccccacgttgatccttgatcctcgtgctcctttcttgattccttctccgtgggatctcttgccaggagtagcctgccccgtgtccgcgctcgcactcgcacagacatgcttcttgccgcgtcttgaaaggggagaaagtgaagatgggtgcttgcgcttcagttcacaaggactcggggttccccaaggagcagtttcttgactcgcccaccaaggcggaggctgcaaacgggaagggcggcagcggcggcggcgttgcttcggttggtgacgatgactttgctgatttcaagtcgaaggtcgactctgagcagcagcgggcagagttgaaccccaagagcccagattctggtagcaaggatgaagtgttcttcgaatctcgagcttggttagattccgactgcgaggatgacttctacagcgtgaatggagatttcactccatctcgtggcagcacacccatccatcagcccagagcgcagacggtgatgagcaacatctttgaaccagacacgcacagttccaaatcaccggagccttctccaactggacggaggaagctagctgagctcctgcaggaggcaatgcaaaacggccccgaagaaacaccgaccaggagctgcagttgcgatctgttgccgcagatggggaagccggtgtctgaatcacatccagctccgcttgcagcagtgtgccgactccgatcgcagtcgctac

SEQ ID NO: 3891 - DNA, 3040 bp, Zea mays
cccctgatgtggatctaatcgaaaaataacacatcctaacaacaagtttaatactcgagattatggtgggttctaatcctgatcatgtgatctgcagctaacaataaacatattcatatactaaagtcgactctaatgttggcttttagacgaatcatacgtctatttctctttcattcttttgtcttgaaatccatgtaccacctagctattgtataagagcgaactatctttactttgttatgtctctctctcccacattagcaaaattgccatagaagtatgcttagagctcactattgaacttgctatagtttatctcaccactagtacttggtcccacacgtaatacgctcagtttcttagaatatgtgaaaacttatatctatttgctcgtcgctagctattcttgttttccccatattttctacccacgtagtaaagagagtgaatctagctagtgaatagctagccattggagacgccctaagactatctctaacaaactagccaaatggctcgtcaacccaaattttagctactcaacagcaaaataactctccaacataccagctatctgactcgccaagctattcgagccaaacttggctagccacctgactagtcaaactagatagaaagtctgttaaagggagaatgtgagatgctacgtatagagtgtaatctttatgaaaagataaatcgagagaaaaaataaagagtctcttgaagatgtttacttaatttacgctctgattgcctatcgaaacaaaaagtcgatgccttcgattttgtctttgggcgctatcattatagacatggaccccccacctttagcatgtggtcctctatcaatcagtctagcaatatcccggaaacattaacacgttcatttatggactttgacattctcaaggaagttctgatgcacccaagtttattaatgtgttttgcttcagttgctgcataaccataggtcgtgctctttatgcagatttcactccgtctcgtggcagcacacccgtctaccagcccagagcgcagacggtgatgagcagcatctttcagccagacacgcgcagttccaaatcaccggagccttctccgaccggacggaggaagctcgctgagctgctgcaggaggcaatgcaagacggtcccgaagaaagcgccgacgaggaggagcagcagcagcagtcgctatctgctgccgctgatgggaagccgccggtgtctgagtccacgtccagctccgcttgcagcaccgtgccgactccggtcgcagtcgccaagagccggaaggagaaggcgtggtacaccggacgctgttgcctgccgagctttgttcatagcctgaccttagacgagagtgagagggggcagaagatgagctctaggccatgtgctgtttgactgtggggctccagtgccctcctgagtcctgccctgagctgtatttagcgcgatatgttatctgaatgcccgattgggacgctgaagctactgtattgagagtactatatagtaatcaagtggataataggcactcgttaaatcctgtggagaccatgtgtatgtgtcgaccaatttgcgcgggtagagcatctacctcaaggaattgcccttccctgtgcatgtctaactgaatctttgaataaataaacacactgtataatttttcagatgcaaaaaaaaacaacagttcctacaatgttattggtatgagatgtcctcttggcgcttgcttgattcacgccagacaaatgtgttgtttcactgctctgttctataccaagtggacctttgttttgtttccttctaaaacaaatggtttttatttggcagctgtgtcatggatcatgcagggttcgtggtttttagcgctgatcgagcgtatgacaagggcaggctaactgctaagaatgtgatgtgatcaccgtttcagttccgtccgtcccaaatagcgcgtgcctgactggataaccacaaggatggccaggagcccaagaacttctacatcctttttgtttgtttctgaacatgcgtacctgactggaactgatgttaggcagaccaatgaatcttagcagtggccatgaacccattggatcaaacatggcattggcaaccgaaccaacgaacgaatgcccaaaaaaacgtacgtagtatatacttatagcacccatgggtatgaccgtatcacaacacaatggcccgccctgtgtttctggtttcccatgatgctcttttgtgtagtcatttatatcaagattgtgtttctgttttctaattgtgaaataaagcatctgttgatacaatgataaggcaatgtagcattacaaactacaaggttcctttaacggtacagtattcagggttataactccgtgttgctacacctgaaatcacgccaaccgcctgtctgacgaggaacatgtcgatagcatcatgaagatcacactgatccttttcatgctcagtacctgcacccttggtccccaacaagatcgacctcccagtgttcgtacaatggtacatgtagctccaaccgtcacgataaatgactaccgaagtgtggtagccatgaaggaccggatacgttgcaggagttctgccttcaccgaagcaggcactgatgctcttcctttcggaacaataacatgaatgaggtcatctaccctcacattatttcttcctttcttccttacatagtccctgcagaatgccttcatctcatccatccagccgcactcgacgagccgctcgcggaggagctccgtcagcttctccttctctccactctctacaaacttgatgttaatgatttctacgagagaaggctccttgtcccgatcctccaccgcgctcggcgtaggcggacgattaatcgattccctcatgcttcaattcggcttagatgcgccctcctttagcttcgtcgctccttcgattcctgagcggctgagcgtcgtcttcctcggtttggtggtggagtgcgtcctggcatctgatgggtcatcatgccggcctcgaggtaccc

SEQ ID NO: 3892 - DNA, 1335 bp, Zea mays
cattgggtacctcgaggccggccgggacgcccgtttctaaaaagggagaggataccccgcggccggccggggtactgttcccagtaaagacggccactccttccctccccccttctcccctccgtcttcttcccccaggggcatccgtgttttcactttttgctcccccacgttgaaccttgatcctcgtgctccctttcttgattctttctccgtaggatctcttgctaggagtagcctgccccgtgtgcgcgctcgcacggacatgcttgtttccgcgtcttgaaaggcgagaaaaagtggagatgggtgcttgcgcttcggtacacaaggacccggggcaccccaagaagcagtttcttgactcgcccaccaaggcgaaggccgccaacgggaagggtggcgggggcggcggtgttgctccggttggtgatggcttcggtgatctcaagtccaaggtcgacgctgaggctgagcagctgcgggcagagtttaaccccaagaacccggattctggtagcaaggatgaagtgttcttcgaatctcgagcctggttagattccgactgcgaggatgacttctacagcgtgaatggagatttcactccgtctcgtggcagcacacccgtctaccagcccagagcgcagacggtgatgagcagcatctttcagccggacacgcgcagttccaaatcaccggagccttctccgactggacggaggaagctcgctgagctgctgcaggaggcaatgcaagacggtcccgaagaaagcgccgacgagcagcagcagcagcagcagtcgcgatctgctggtgctgccgctgatgggaagccgccggtgtctgagtccacgtccagctccgcttgcagcaccgtgccaactccggtcgcagtcgccaagagccggaaggagaaggcgtggtacaccggacgctgttgcctgccgagctttgttcatagcctgaccttagacgagagtgagagggggcagaagatgagctctaggccatgtgctgtttgacggtggggctccagtgccctcctgagtcctgccctgagctgtatttagcgcgatatgttatctgaatgcccgattgggacgctgaagctactgtattgagatttgagagtactatatagtaatcaagtggataataggcactcgttaaatcctgcggagaacatgtgtatgtgtcgaccaaatttgcgcgggtagagcatctacctcaaggaattgcccttccctgtgcatgtctaactgaaatctttgaataaataaacacactgtataatttttcacagaaaaaaaaaaaaaaaaaaaaacggacgcgtgg

SEQ ID NO: 3893 - DNA, 2231 bp, Zea mays
  misc_feature (443)..(443): n is a, c, g, or t
  misc_feature (566)..(566): n is a, c, g, or t
cagacatgcttcttgccgcgtcttgaaaggggagaaagtgaagatgggtgcttgcgcttcagttcacaaggacccggggtaccccaaggagcagtttcttgactcgcccaccaaggcggaagctgcaaacgagaagggcggctgcggcggcggtgacgatgactttgctgatttcaagtccaaggtcgacgctgagcagcagcgggcagagttgaaccccaagagcccggattctggtacgcgtgatggatgggtgtttgtttttttggtctttttctgaagtgatgttccgattttatcttctataatcagttactgttgtttattgaagatctttggaggtaaagattccgtaaagagcagatgagcagtcagttctttacgttaaaaggaaaccttttggtttgtttattcatatactgggctcttgatttcaggatttngcaacgaaatcattgcattaatcgcttctggcgatcagttagttttgtaggggcgcggatgatcttgaacggaaaatgcttactgattttggtttcttgtaatggaaaaggagtttttttgtncaaaaatcaattgctacctcttgaattatcaacctgccaagtagtaaataatcgttctgtgtttctgtttttccttacttctttgattagtctcttagctgaaattcgtcaaacgcgtatacaaaaattactactattttatatggaatttaatttccaggtagcaaggatgaagtgttcttcgaatctcgagcttggttagattccgactgcgaggatgacttctacagcgtgaatggaggtaatcgaacctttacacacgtttatttactataaatgtttaaagaagtttcaatctagttttagagatagcttctcataccctggccctgcatactgagatttctttggcaccagctgtcaagttgatcgtgtcatttccttttttaggttctcctattactataccagaagcatgatcaatgtggattgttcctttaggatacagctttatctgtctctagaatctaatggacctaatttatattttgattgccaaaaagtggatgcctttgattttgtctttgggcgctatcattatggacatggacccccacctttagtttcataacctatcccatgtggtcctctatcaatcactctacactctagcaatatcttggaaacataacatattcatttattgagctttgaaccccaagtgtccacgggagttctggttgcaaggatgaagtgttcttcgaatctcgagcttggttagattccgactgcgaggatgacttctacagcgtgaatggagatttcactccatctcgtggcagcacacccatccatcagcccagagcgcagacggtgatgagcaacatctttcaaccagacacgcacggttccaaatcaccggagccttctccaactggacggaggaagctagctgagctcctgcaggaggcaatgcaaaacggccccgaagaaagcaccgaccaggagctgcagttgcggtctgttgccgcagatgggaagccggtgtctgaatccacatccagctccgcttgcagcactgtgacgactccgatcgcagtcgctaacgccaagagccggaaggagaaggcgtggtacaccggacgctgttgcctgccgagctttgttcatagcctgaccttagatgagagtgagagggcgcagaagatgagctctaggccatgtgctgtttgacagtggggctccagtgccctcacggctcatgccctgagctatactgtaaaggagaagtattaagagtactgtatgtatagagagagggtaatcaagtggataatagctactagttaaatgctctgcacaccatgtttatcaattgcccttacctgtgtatatatatctaatcgaatctcaaatgtcaacagccagctgagctgtcctcttggcacttgcatttaaaaaaaaaaaaaaaaacaaatgtgttgttcattgctccattctattccaagtggaccttttaattttctctaaaaaacaaaagggtctctagctgagttggttaggtggtatgagtagcactacttaggtcctgagtttgaatttcagtggtagtgaatttcagaccgaggttaaaaaaaacatgagattataggtgtatgttcgggtcctgatgggccggcccaaagcacgaaaaaaacacggcccagacacaacatggtccgaaat

SEQ ID NO: 3894 - DNA, 1345 bp, Zea mays
aaaacagagaaatattatgagtcgccaatagtttttgtgctcggctgtttcagaattaatagcccccaagatttttttattccacgcccgtttctaaaaaggcagtgggtgcccccccccccgccgccgtactgttcccagtaaagacggctactccttccctctccccccttctccccctccgtcttcttcccccaggggcatccgtgttttcactttttgctcccccacgttgaaccttgatcctcgtgctccctttcttgattctttctccgtaggatctcttgctaggagtagcctgccccgtgtgcgcgctcgcacggacatgcttgtttccgcgtcttgaaaggcgagaaaaagtggagatgggcgcttgcgcttcggtacacaaggacccggggcaccccaagaagcagtttcttgactctcccaccaaggcgaaggccgccaacgggaagggtggcgggggcggcggtgttgctccggttggtgatggcttcggtgatctcaagtccaaggtcgacgctgaggctgagcagctgcgggcagagtttaaccccaagaacccggattctggtagcaaggatgaagtgttcttcgaatctcgagcctggttagattccgactgcgaggatgacttctacagcgtgaatggagatttcactccgtctcgtggcagcacacccgtctaccagcccagagcgcagacggtgatgagcagcatctttcagccagacacgcgcagttccaaatcaccggagccttctccgaccggacggaggaagctcgctgagctgctgcaggaggcaatgcaagacggtcccgaagaaagcgccgacgaggaggagcagcagcagcagtcgctatctgctgccgctgatgggaagccgccggtgtctgagtccacgtccagctccgcttgcagcaccgtgccgactccggtcgcagtcgccaagagccggaaggagaaggcgtggtacaccggacgctgttgcctgccgagctttgttcatagcctgaccttagacgagagtgagagggggcagaagatgagctctaggccatgtgctgtttgactgtggggctccagtgccctcctgagtcctgccctgagctgtatttagcgcgatatgttatctgaatgcccgattgggacgctgaagctactgtattgagagtactatatagtaatcaagtggataataggcactcgttaaatccaaagaaaaaaaaaaaaaaatgtcgaccaatttgcgcgggtagagcatctacctcaaggaattgcccttccctgtgcatgtctaactgaatctttgaataaataaacacactgtataatttttcg

SEQ ID NO: 3895 - DNA, 1574 bp, Zea mays
cattggcacgagaccattacctagaacatcctagtcgcacaacaattttatccattcctcactcgtctctcaaactcaagcgaaagccatcaccccccaccccaatcccacgttcgccacgtgcgcgccacctcccccaccgcgtccgcgtcgccggccatactccatcgcgaacgagatcacgggctggtttcgcgggccgaccatggggacgctcatccggccggggcccgccgcgtcgcctctccccatcgcttccccctcctcctcatccgcccacgtggctgtcgttggcggtggtgcgaggagcttgcggcatcgggtgtcggtggcggtggcggtgttccggtccccgagtacgcaggttctggcgacgagatggcgccgccggagaggtatggttgtgcggtcggatgtcgtcgccggtggcgcagccgccgcggcagctggggattcgacgcgggcgctcccaggtcagcaattggcttcaagagtcagaggggtttgcttctatttggtgactgcagttgcagcaatctttttgtttgtagctatggttgtggttcatccacttgtgttgctatttgaccggtaccgtaggagagcgcagcactacatcgcaaagatttgggctacggtgacaatctccatgttctacaatcttgaggtcgaaggaatggagaatctgcctccaaatagctgtcctggtgtctatgttgctaaccatcagagcttcttggatatttatacccttctaactctagggaggtgcttcaaatttataagcaagaccagcatctttatgttccctattatagggtgggcaatgtatctcttgggtgtgattcctctgcggcgtatggacagcaggagccagttggattgtctcaaacggtgtgtggacttggtaggaaaaggagcttctgtatttttctttccggagggtactcgaagtagagatggcaagttaggtgtatttaagcgtggcgcattcagtgtcgccgcaaagacaggagctcctgtgatacctattactcttatcggaactgggaaattgatgccttctggaatggaaggaattctcaattcaggttcggtaaaggtgattattcaccgacctattcaaggaaatgatgcagaaacattatgttccgaagcaaggaatgtgatagcagacactcttcttctgcatggttatggagcccattaaagcaagtggggtgctttggtctgttttttcttctgaacgagtgctttggtctattctttagtggacttttcagagcacaagacttgagagttgagacaaagctcgttgcagatgtaatcctgtaaaggcaagagggaggaaaatggcgtgaattggcggttgtaacatgtggtctttaatttgttttaaaccctacttatttttgttggtttgatagtacaaagcaatgtaaaaggcagaggccatcttcattggatggaaaatgaagcccacgtgatattttgtcaaaaaaaaaaaaaaaaggaaccttataaggccagaaaaaaaactaatttttcatgaaaaaaaaaaaaaaaaaaaaaaa

SEQ ID NO: 3896 - DNA, 725 bp, Zea mays
gcacgaggtacggcccatgtgagaaggcacgcgggggctcctcacctgtgtttgcttccgccgccggcaaggaagaagagagcaaaaccctagctagagttggcgagtgggggtggaggcgcggctgctcgtcacgacatcgagtttcagcgccgcccgcgagatccccggatttcgttctctacccctgagagctgcggcaatggctgggaaaggcgggtcgaccaacttagaaaaggagcagatgtttgggatggcggagaaggagatggagtacagggttgatcttttcaacaggcttacacagacctgttttaacaagtgcattgagaaaaggtataaagaagctgagctcaatatgggcgagaacagttgcattgatcgatgtgtttcaaagtattggcaggtgactaatttagttggtcagatgcttggaaaccggcctcaaatgtgaactgagaagcactcgttccattttgtagcagaattctattgctctgtttcttctttttggttggttgtagaatgccgcacctgttctaagtacaccaatacagcaacaaacatgctactgcgtggaccgctttaaagaaaaaaaattagtgatgcgcattctctctgaatcatgaacaggggacataactgtaataatttgatacagctctagggcaattctgtttcgaaagctcgtcctgtttcgtagtaaaattctggattttgtgtcc

SEQ ID NO: 3897 - DNA, 2953 bp, Zea mays
aggccatcctcggcatgcgacgcggggctcgtatgacccagccgtcccagcggccggacggcgacaccaaccacgccccgttccgttgaacagcgtcgagtcgtcgccccatatcaaacgcccacgcagcgccggggatggagcgcggccggcaccagatgagagctgcctcccacacatggcatcgtggccagcagcgtcaaggaggcggtccagcggcggcatgaaaagcgccgagctttcgggctccggtgcttcttacggctatggccggacgtcctcctcccctgatgcctgcggctacggccggcagctctcggcctacagcgcccgctcctcccaggtcagcaggagtggctccttcagtgcggcggcgcagcgggtcgccggcgccttcaccggctgcttcgtgccgcgccggcaggtcaaagccggggaagaggaggaggaggaggagaagaagagcaagcgctccatggattcaggatcctatcatggatggaatgaagcaaacttgagtgcagcagcaggatcatggcaggaaggcagggctctcaccatcgctgacgtgtcgaaggcaacatcaaacttcagcgaaaagaacgtgataaggcagggacgctcaagcaccatgtacagaggaaagctcagggatggttctcagatcgccgtcaaatgtgtcacgaagctgaacgaccagagtccgacggctgaactctggagggagcttgagaagatccagcacaggaatctggcgaggctctttggattcttcgaacgcgcagctgatagtctcgtcgtagtcgagtatgtcggcaatggttccttgagggaacatttggatgaatcatgtggaaatggtttagagctcgcgcaacggctcaacatcgcgatcgacgttgctcaggccatcacctacctgcacgagtacaaagagcgtccgatcatccatggcggcatccggtcgtcgggcgtgctactgaccgacgcgctgacggcgaaggtggccggctttgggctggccgggactgcggcctcggggtcgggctcaggctccgacgcaacgccggcgaggagcgccgccgggtacgtggacccggagtacctgagcacgtaccagctgaccgacaagagcgacgtgtacgccttcggcgtcctcctcgtcgagctagccaccggccggccgcccgtcgagcgcacccgcggcggcgaggcccggctcaccaccaaatgggcgttgcagaggtgcagagcaggggaagccgtggtggccatggaccccaggatgcggcggagcccggcgtcggtggccgccgtggagagggcgctggcgctggcagcgcagagcgtcgcggcggccagggatgagcggccgtccatgcggcggtgcagcgagctgctgtggaccatccggagagactaccaccgccaggaggagccgcgctgcggcgccgtcgctgaggaacgtagcgacgagtgggtcatcaggtagcttagcttgccagttgaatggatatgattctgctttggattgatcggcatggaactgtaactagcctgtaagtggatgcgaagttctaggaagctgcagattttttttagcacgtacaacttctgtgattactatcaaatgatgtagtcattgcagccaatacctgcgaatttctagaaaacagtagacgttgtaaacaatcagacgactttgctgaagtagccacttgatccctcaatcaaatataaataaccatcgaaggatgaggatgttgatgcattgttttggagataggcttatatctcctatcgcatctcatatttcaactccacgccgtgaacagtgcaaaacaatgttttctatgaccatatatgttgaatgcaaattttgtctgaacgttactgctactggatcatgtttccgtggaagctcaggcccaaacaatccagctgtggggtctcttttcacatagtctctgcctgaaccaagctctggtgtcttgcaggcaagaaataatgcttttgtgctgatttcagcaagctttcattagagctatattatgggcctcgaggcccatcgccctcggaataaggcgcggacttacaggtgggccctttgtcagtaagcttgccctcgggccatgtatgatgtatcccgttcgggtgcggcccatgtgagaaggcgcgcgcctggacctcatcggtgtttgcttccgcagttccgccgtcggcaaggaaggaaaaagagagcagagaaccctagctagagtttggcgagtggtgcggaggcgcggctgctcctgctcgtcgcgacgtcgaatttcagcgccgcccgcgcgatccttggtctcttcgcccgtgaggtcctgcttcccgtgttgcttctcagctccactcctgacgtgctttctctgagtttctattctgttggttcggtctgtcctctgcaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttccattttgtagcagaatcctattgctctggttattctttttgggtggtattagaatcccgccacctgctattaagtacaccaatacagcaccagacttgttaatgcgtggatcgctctgaagaaaaatcacggggtcttgctctttccagtgatgggcattatcttttgaatcatgaacagggaacatgcctgtaataaatttatagagctcgagagtgatcctgtttcg

SEQ ID NO: 3898 - DNA, 1007 bp, Zea mays
tccggccgggaatcggtgtttgcttccgcagttccgccgtcggcaaggaaggaaaaagagagcagagaaccctagctagagtttggcgagtggtgcggaggcgcggctgctcctgctcgtcgcgacgtcgaatttcagcgccgcccgcgcgatccttggtctcttcgcccgtgaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttccattttgtagcagaatcctattgctctgtttattctttttggttggtattagaatcccgccacctgctattaagtacaccaatacagcaccagacttgttaatgcgtggatcgctctgaagaaaaatcacggtgtcttgctctttccagtgatgtgcattatctttgaatcatgaacagggaacatgcctgtaataaatttatagagctcgagagtgatcctgtttcgaaaaaaaaaaaaaaaaaacaggcaggaacataaaaaaatggatgtgtgctcctccgagatgattagagtataatatttttttttctttgcgaatcaagagtagtctatgtatatcatccacagtaaggtccctaggatcgttttttgcctgcgaacattggatgatttcagttattatatagtgtcaattggggtataatctgtgtattttatacgcagtaaggttgttagggtcgctctcttatcctgacaacagtggaatgcatcacttaagactatgttgtgtcaaggaacaagtgcacatctatgtaaagcatccag

SEQ ID NO: 3899 - DNA, 1831 bp, Zea mays
ctgacagtctctgagcgcgtacagctgttaccaaattctaatatcccactcttaaatgatcattttatgccaagtggctcacttccataatcctaaaagagcgaagggactgagtaacagagtgacgaagccaccggacaagcatgttacaatctcaattatctccctagttggagtacctaggcgagctgccgagctattgctcggcgcctccatctcgtccacaccacacagccgttgagtccaattcgctcactcaccgtcaaacccacacctcaaactccttcccttcaagaatgtcagattatccactgcggcctcttcctcctcttcctccgcccctcccaccatgattgccacccatctctccccagccctcaagcagtaccgcttcccgtccccgctccactccacctctcacaaccaccaccttcccgtgcacctcccgctcccccgccgccaccgcaacttcgctaagcccgccgcggccgcgccagacctcctcgccagcgtcgagtccgtggcctccgcggcctccgtcctggccgccatcgtgctcgtccacgagtccgggcacttcctggccgcggcctcccggggcatccacgtctcccagttctccatcggcttcggcccggcgctcgcccgcttccgcctcggccccgtggagtacgcgctccgcgccatcccgctgggcggctacgtcggcttccccgacgacgacccggagtccggcttcgcgcccgacgaccccgacctcctccgcaaccgccccgtcccggaccgcctgctcgtcgtctccgccggcgtcgccgccaacctcgccttcgccttcctcatcgtctacgcgcaggcgctcaccgtcggcgtccccgtgcaggcgcagctccccggggttctcgtgcccgaggttctcccgggctccgtggccgcgcgcgcgggcctcctccccggggacatcatcctcgctgtgcccggggccgcgccggacccgtccgtccccgtcctcgtcgacctcatcaaggccagccccagcagggaggtgcccctcaccgtctcgagagccgcgcccggggcggtggacaggcggtccgttgagctcaccgtcgtgccggacaccagcgccgatggctcggggcgcatcggcgtgcagctctcccccaacgtccgcgtcacgcgcgtgcgcccccagaacctggccgacgcgaccgtccttgccgtgcgcgagttcacgctcttgaccgggacggtgttcgacgggctcaggcagacattgctcaacttctctcagtccgccgacaaggtgtcaggccctgttgccatcattgcagtgggagcggaagtggccaggtccagcgcggatgggctgttccagtttgcggcggtgatcaatctcaacctcgcagccataaacttgttgcccttgccagcattggacggtggcaccttggcattgatccttcttgaggcagctcggggtgggcgcaagatcccccgagaagttgaacagggtattatgtcatcggggatactggtggtgctcatggttggcatgttcctcattgtacgtgacacactcaaccttgatttcatcaaggagatcttgtgatacttcgcgtgaaaaatcaattgattgcagttgtagtaaaattgccagtgtcagaacttggttggcctggaaatgtgtagttgttgtgattctttttgcctttggtgggactgctctaccactctagtttcttgctatactgatcgtagtttcttgtattgctggttttggaatgaagcttgtgatattatagttaatcgtgactgagataaaaaaaaaaaa

SEQ ID NO: 3900 - DNA, 2063 bp, Zea mays
gtggtctcgcgagcaagcctcgccatggatatctgcaccagttgcttccaagccagatattagagctgcctactacttgcgtcgcgcggagagcgggttgggaccagaaacaagagtagagcaagactcctatcttttttccacgcgccagtcttctctgaaccggtgaacccattcctcctcctcttcctactcaacgccacgatcgaagaggagactcagtcaatctcgccttgctctcctcttcgacccatcgtcggttcctgggatcagcatcgacgagcaggatttttccggctgtggaggattactgctgcttgacaaatccgagcgcaaaggttgcttcctgacgcgttcccccatggcacgagcaggagcacgagcacgagcacgagcaggagaaggcggctagaaggttcctgctcccgggcgtgacctctcacacggcatggtcgttgcttcgccggggaggcgcagcggggatggtcgataggagcagggccgtgctcatcggggtcaccgccggcgtcgcggccgcgctggtcgcggcggcgggcgtgcttctggccgtctggctctaccgccggcgggccagcgtcgccgcacggacgcgctccccggagtcgccctcggcgacgctgcgggccggcggcgccggtcgcgccagcctcgactccagcgtctccgtctcggtggtctccgagagcgccgccgactggggccacccgccaccgcacaaacgcgccgcgttctgggcctggagaggcggcgccggccacaacggcagggaggcgccaccgctgtccgtctccgggatcccaaaataccattacaaggatctgcagaaggctaccagcaactttaccacaattcttgggcaaggatcgttcggccctgtgtacaaagctgtaatggccactggtgaagtggtagctgtaaaggtgctcgcgagtgattcaaggcaaggggaaagagagttccagactgaggtagcattgcttagcaggttgcatcataggaatcttgttaatttggttgggtattgtgtagaaaaaggtcagcgcattctgatttatgagtacatgagcaatgggagtttggcaagacttttatatggcgacaataaacgaagtttgagctggcaagaaaggctgcaaattgctcacgatgtttctcatgggattgagtacctgcatgaaggggctgttccttctgttattcacagggacctaaagtctgataatatacttttggaccattcaatgagagccaaggttgcagactttggtctatcaaaggaggaagtgtatgatggaaggaagtctggccttaagggcacctatggctatatggatcctgattacatgtccacaaataagctaacaaagaagagcgacgtgtatagctttggcataatactttttgaactgataactgccataaatccacaacaaggtctgatggagtacattaatctggcagcgattggaggggaggggagggttgattgggacgagatactggacaaggacctcctagtagggaacatccctgaagaggttcggatgcttgctgatgttgcctaccgatgcgttaacaagaatccgaggaagcgcccctggatatcagaggtcacacaggccatctcaagactcagacagcaccagctgataaagcatgatgcgataactctgccgaggagtgagaccaggaccgtccttaggaggatagactaccagcacgtggagcttagtgacctcactagcatcaaagaacttacgccgataagggcatcatgaactcgtgagcttgttctagtatgtaggttgctttatagagttagatttggacttggttcggcgatgttgtagctgtttgatgaaagcatcaggtagctagatcgttgaaagatgtcttggctgcaatgagagctctccttaattggagttctgtactgacctgaggtttgaaatcgttgtaaaaaaatcaacagtagtagctgtagcatttgataaaaaaagactttataaactgcatttttatcaaaaaaaaaaaaaaaacga

SEQ ID NO: 3901 - DNA, 2579 bp, Zea mays
  misc_feature (98)..(98): n is a, c, g, or t
  misc_feature (2474)..(2474): n is a, c, g, or t
tgcatattggttatacactgaccacattgtgtcagtgcacagcaaaggaactataaagattggttcatcatttggaagacattcccctaattacttcnatatcatgtcatatcaggcgacaataaacgaagtttgagctggcaagaaaggctgcaaattgctcacgatgtttctcatgggattgagtacctgcatgaaggggtacgttaacatttgataactattaaggtatgtattctcgaataatgggaattaatgaaacctgctatgtttcatgagtgcaggctgttccttctgttattcacagggacctaaagtctgataatatacttttggaccattcaatgagagccaaggttaggcatgacatgtattgatcattgtaactgcttcatgtgcactttttaagtgctatcatgctgctttcagttgtttcagctaaaccaatacttgctcatcatgagtataaagttcaatggtcagctcaatctggatatttgcaatgcagctaagagcaagattttgttcatgagacaaaatacttagcctgaaactaatctactagtacattgtaattgtaatccatcctctttttttttcttggtgggtgcaggttgcagactttggtctatcaaaggaggaagtgtatgatggctggtaggcgggccttaagggcacctatggctatatggatcctgattacatgtccacaaataagctaacaaagaagagcgacgtgtatagctttggcataatactttttgaactgataactgccataaatccacaacaaggtctgatggagtacattaatctggtaagccattttatggtcactactacagtctaatgctctactgcactgtaaagcatgatgttaggtcacaaccgctgttactatcagataaattaggtgccataagcaaaagtgtcatcggcagtgttgtggagtaataattatactattcatgacttgtttcaggcagcgattggaggggaggggagggttgattgggacgagatactggacaaggacctcctagtagggaacatccctgaagaggttcggatgcttgctgatgttgcctaccgatgcgttaacaagaatccgaggaagcgcccctggatatcagaggtcacacaggccatctcaagactcagacagcaccagctgataaagcatgatgcgataactctgccgaggagtgagaccaggaccgtccttaggaggatagactaccagcacgtggagcttagtgacctcactagcatcaaagaacttacgccgataagggcatcatgaactcgtgagcttgttctagtatgtaggttgctttatagagttagatttggacttggttcggcgatgttgtagctgtttgatgaaagcatcaggtagctagatcgttgaaagatgtcttggctgcaatgagagctctccttaattggagttctgtactgacctgaggtttgaaatcgttgtaaaaaaatcaacagtagtagctgtagcatttgataaaaattgtctttataaactgcatttttaccatggccatgtgagtacagacactgaattcgacagtagtagctcagtgtgagtaaagacactggatttttaccattgccatgtgaataacaaaacgaattcagtcactgcaggtctgcagaaacgactaaattacaagacttgctgaacatgtcaatcgcaacacaacaaaacgattgtaatatctttagcgtttatctgccacaatgttagttacgacacgagaaactttctgctgaatgttcattcgaatgaaacttttgagtgcatatcatgagtggaagagtcgggcggccagaaacaggcagacattgaatcccaacttctttcaagcaactcatgtctagcagagcctagctaagaaaaagggggaaaatgtatttacaaagcgaggccatcatatcagcatggacatcaggttcaggcccccactcactcaaatcctgttgcaaatcacaatcctgtgaaaaatggctttattcgataactgcagagctcaacacctgcatgaaagccacagcaacggccgagcaggtgctcacctctctactcctgtgccaactcaaaactggcaagaagtgccaagcctctgcttcgccctttgctctttgacactgcacttgcgtgagcggaatgtctcaggaaggagctcctggaacttctcgaggaacaggcaccacgtctcaggtttcatgtcagccagcttgacgaagctcacacttgaagggagcatgtcgtttgcacttccccagttacaatgctgagagccgctgtcattgctgttgctcttcacaggatccacaaacttaggaccagcatacagttgacgctgggttttgtttgttagattgacacccttcagtgaggtcgacagctttgaaatgttagcaagccacttattaacaggcctaggacatgcaaattttcncagcatcactttctacctcctcagtatcatcttcctcttcttcattggcttcatctaatttggacagttggtttatggagtttattgtcttaaactcaaactgac

SEQ ID NO: 3902 - DNA, 1203 bp, Zea mays
cgattcctcgacctcaaggaaatcccggataggagaaagctcatgtgtgtgttgtgtgtgaggctcacaatttagctagatagatgtcccttatctctgcaagtgtaggccgacatgtatggctcctcgagcagctgtgcccactggtagcttttttttttattgttattatcattgtacactttatattaccatcaatcgtccgataaagcggatctcgtcccactaagacgaaaaagttgtggactgtgggagcaggcgacgcgagtccgcaatgacaggccgcagcagcccaccaaccaagccttacccaatccgcggcccggagacggagtgtggccacgggccacacggcttctgaccgagaggccgaggcgagggataagagcgtgtcccaccggccggccacccgcagcatctttaaaattcggcccggcgcgcgtcgggtgacgaaaacggaaccctggctggtggagcgcggcgcggggcatgcgtgcaagtgcaaccaatcgcctcgtcgtgtgcgctcgcctttgcttccctcgttaacgtgagtaacctcgttggctgatcaaggctttgacggcggcaccaacgttcttccctcgccgcctcgttgcgtccgcccgcccagcgccaactcctcgtcctcgtacataaccccccaccccaccgcgtacagcgttccctctcgcgccccgcggtgagctacccccgctcgccttagctagctacccaccatggccctcccgccgtcctcctcgccgtcgtcgctctccgccgcgtcagcgcagcccacgcccctgcacctgcacctcccgaccaaggcgcccggccgcctcccgctgctccccttctcgcgcgccgccctcccgccgccgctgcgcctccgcattgcgcgcaccagcctctccccgggcacgcccctcccgcgcgcgctcctgccaccaccctccgcctccgccgacgccgcagcctccgacgtcggcggcggcggcgccggcttcggcggccatgacgacgacggccacaaccaccacggcggcgagggtggcggcgacgacggcggccatggcgacgacgccggccacggcgatgacgcgcccggcggcggcgacgcccgcggggaggcgctgttcgtgctggcgcagctgggccgcaagctcgacagcctgccgtccgatctcgccgccgccgtcgcca

SEQ ID NO: 3903 - DNA, 1421 bp, Zea mays
cattgggctcctcgccggccggggagaccccagagcgaagaagccccggccctcctgtagagctggtctccctctgaccctctctcctctgcgcttccgctgcgtcggccctgctcgtagcttggaggcggcggcattctccggcaatggggtgcaaggcgtgcgataagcccaagcccaactaccgcaagggcctgtggtcgccggaggaggaccagaagctccgcgactacattctcctccacggccacggctgctggagcgcgctccccgcgaaagccgggctccagcggaacggcaagagctgcaggctgcggtggatcaactaccttcggccggggctgaagcacggcatgttctccccggaggaggaggagacggtgatgagcctccacgccacgctcggcaacaagtggtccaggatcgcacggcacttgcctggcaggaccgacaacgaggtcaagaactactggaactcgtacctcaagaagagggtcgaggccaaggaccaggggcccagcacgcccgcgccggcggcgtccaattcggacgacgactcgcactgcgtcaagcagcgcagggacgacggcgacacggcggcgggagccaacggcccggcggactccggcgcgtcggagccgcgcgagtcgtcgtcggccgacgactcgagctgcctgacggacccgcacgcctgcaggccccacgcgcccgtgccgcccaaggtcatgttcgcggactggctggacatggacatggactacgtgggcggtgccctgccgtcgacagcaccagcagcacctggtctgctcggcgctgcgggcgtggccacggccagcacgggcgaccgcgaccgcgatcagcatcaggtgatgagcatgagccaggggtccgtgcaggtggatgggccatccggtgccgatgtgtccctgcacggcttcggtgacagcggcgccggctgttgggagttccaggagcacttcgatgccatcgatcacatgcaggcggccggcttctgcgacctgctctccatgaccgactacttcggcctcgactagactccaaccctggttggtgatccatcgttggtgaaaggatttgcgtttttttttaattacactttgttagaagtctcggtgaaaggcttgcttgtggctgtaaattactgtcgtgtacgtatagatagaggaattttaaaagcagataaaagtcaaggacctacattgtaaaaatgttgtcgtgtttcttgtggttcgctttgtagagtagagcaccgacggaaggaaaaggaacagatgtagtagttatactagcaagtacacatacgttgctacctttacatttatacttgagtgtcaaatataaatataaagacatgtgtgttttattgtctaggtagaaatgattgtgggtttagagtcaac

SEQ ID NO: 3904 - DNA, 1304 bp, Zea mays
gcacgaggagctggtctccctctgaccctctctcctctgcgttgggtacctcgaggccggccctgctcgtagcttggaggcggcggcattctccggcaatggggtgcaaggcgtgcgacaagcccaagcccaactaccgcaagggcctgtggtcgccggaggaggaccagaagctccgcgactacattctcctccacggccacggctgctggagcgcgctccccgcgaaagccgggctccagcggaacggcaagagctgcaggctgcggtggatcaactaccttcggccggggctgaagcacggcatgttctccccggaggaggaggagacggtgatgagcctccacgccacgctcggcaacaagtggtccaggatcgcacggcacttgcctggcaggaccgacaacgaggtcaagaactactggaactcgtacctcaagaagagggtcgagggcaaggaccaggggcccagcacgcccgcgccggcggcgtccaattcggacgacgactcgcactgcgtcaagcagcgcagggacgacgacggcacggcggactccggcgcgtcggagccgcgcgagtcgtcgtcggccgacgactcgagctgcctgacggacccgcacgcctgcaggccccacgcgcccgtgccgcccaaggtcatgttcgcggactggctggacatggactacgtggggcggtgccctcccggcgacagcaccagcagcacctggtctgctcggcgctgcgggcgtggccacggccagcacgggcgaccgcgatcagcatcaggtgatgagcatgagccaggggtccgttcaggtggatgggccatccgggtgccgatgtgtccctgcacggcttcgatgacagcggcgccggctgctgggagttccaggagcacttcgatgccatcgatcacatgcagatgcaggcggccggcttctgcgacctgctctccatgagcgactacttcggcctcgactagactccaaccctgggtggtcatccatcgttggtgaaaggatttgcggtttttttttatttacactttgttagaagtctcggtgaaaggcttgcttgtggttgtaaattactgtcgtgtacgtatagatagaggaattttaaaaagcagataaaagtcaaggacctacgttgtaaaaatgttgtcgtgtttgttgtggttcgctttggagagtagagcaccgacggaaggaaaaaggaacagttgtagtagttatactagcaagtacacatacgttgctacttgagtgtcaaatataaacataaagacatgtgtgttttattac

SEQ ID NO: 3905 - DNA, 1683 bp, Zea mays
gttgagaccgcagagcgctcgccgaagcccgtcctgtcctgtagctagctgatctccctccgaaactctctgctcggccccgctgcctgctggaagcttggcgcggtcccggcggcggcattctccggcaatggggtgcaaggcgtgcgacaagcccaagcccagctaccgcaagggcctgtggtcgccggagaggaggaccagaagctccgcgactacatcctcctccacggccacggctgctggagcgcgctccccgccaaagccgggctccagcggaacggcaagagctgcaggctgcggtggatcaactacctccggccgggcctgaagcacggcaccttctccccggaggaggaggagacggtgatgagcctccacgccacgctcggcaacaagtggtctaggatcgccaaacacctgcctggcaggaccgacaacgaggtcaagaaccactggaactcgtacctcaagaagagggtcgagggcaaggatggacccagcacgcgccgttctctgcctgccttggcaccatcggtttcagttcagcccttgttcgccctctccctccgcccgcgcaaatgattgggggcgagacacacggttcaccacgttgccctgcctgccctctcgcttttgctccacaccgctgctatccctatccttgcattgttcccgtccctgctccgctgctcggcagtcggcaggcagcggccgccgagctggcggccgcttctggaacacgcagagacgaccgaaaacaacgcgcgcggggtatggactatggaaagagaaaccaccggtgacgatggccgccgagaccctttttcgatgctgacgtgcacgctccacgacgctgcgcattcgaatttcggaggagatttttctgcccccgctccccgctccgagtgcacgttgcgatgattagaacgggtggagacgatgtggtgggcggtgggcctctttagtggcgagttgggccggccaaataatgagaacattgaaacgctagatgccatacagtacagtggagtagagttgcgtccggcaggaaaccctcttttttcgtctccttcttcacttgttgcacgcttgaatcggtgtacagtggagttagagtatcgtttttggagggcgttggtggagtacagggaatcggattagcagcaatatgaatatcacacagggaagggaataatatatggtagcaaagcatgccgtcgtcgaccgcttccgcttggaccagtccgagtcgttggcctgcgcgagttaatgggacgaacagctgctttgacaaatcccaactggcacgtagcagcagctagttggctgatgacgacaagattctccactggggcgggcctcgcaattatgcatgcagcatgcccacccggggaaaaaaacccaacaaaaacaaaggtccggtggccccacgtgaatagactacgtgcgtgcacgcacgcttgtcgctttcaaccaaacgacagacacatttttctttaggcgcgcgccagcggcacgggcgaaaagaaggcaggcaggaggaaacgaaacttcagctcagctcgtaatgcaaaagccaaaaaaataaagcttgggtttcccactaaccccaccgacagaaacgggagcctggggtgaagaatttatattgactttggcgccgatcgactctccgctgca

SEQ ID NO: 3906 - DNA, 2371 bp, Zea mays
  misc_feature (4)..(4): n is a, c, g, or t
ctgnaaaagctcaactgcttttcaacaagaacactcttagtttctcaatcctaacatcagtcagacacaaagcgttcaaaagtttttggttttaaaatagcttttgaatttggaggcttgagctgtagcaaacacattacctgtgcgaaaactactaaggaagaattagatcccgcgactcaagatatacataaaattttatacgtccgtcaaatggagtctttccaagggtaccacttatgtgttttctttgtccttgaaacttccgatttgatttctccacaatggttgtgactcctttagttcctgtacattctgagtatatactaggagcaaacttgttagtgtccttatttgttttgttattaaatcactaaaaccctcagttagggttgattgcacttacaacactggcaccgacacaacatctcaattgaagagccgactgtcatcatcgctggttgtacagggacaaggacgaccgaaatttcatgtgactattgaaagccttaacctcccaatattccctcccagcctccctcgcggcggcccggggccagcagcaaatcccttccggaccccgaaaaccctacactccccatcgcgccggcgccggcgccgacgtcgacgccatgctccactccagcttgtccaagtgccaccctctcccgctcctcgcaaccgcgtcctcgccccgccgcaccctcgtcgccgtcctcctccgcgccggctacctttcgaagcatccagccacttcaaccgcgcctcgtccgaccacaaccgcctgtgcgagcgccagggtcgacacttccccgggcgaatcccgcttcgggctggaaggcagggtttcgttctccaccgcgccggatgggtccgcattggctggcggcgggagggcgcttccctggcttgcagctgagactggcaacagcggcgcgcccgttgctaggactagcgccggccgatcctcctcgtgggagagctccgcagagaagttcttctcgagagacgaccaatacacgcgaagagaagtgtcgggagtcaggatgtcggacaaggtagctattaaggatgacgatgacgagaatgaggggaatggcaatcctgaacggggaaggattaagggcaggtaccaacgaagagaggtgtcgggaaacaggatgccaaacaaggtggcgattagggaacaagaggatgaggatgagccaattgacaatcccaaatggggaaggattaaagacaggtaccagcgaattggggggagggatggagggtcccgtgatgagaggtttaggagggagagatttgacaagccggatgtgaggcagtggaacaagcaggagaattggggaaggaacacagggaaggaagcaggggaatcatcggtgccaaagatggtggggcaaggagtctatggtgttgggcctgtccttgcagcactcatggctcggaggagggagttttatgcgctgtatatacaggaaagtatggatttgagcgggaacaacaagaaaaggaaagataagaaggcagttgagaaagtgctgcggatggcagaggagattgggctgaaggttattgagactccaaagcatgatcttaacatggtggtggataaccgaccacaccaaggtgtggtgctcgatgcatcacccttggaaatggtcaatataaaggagttagatccagtcagggtggaaggtggaaaggcacctgtgtggatagccttggatgagattatggatcctcagaatttaggagccattattaggtccgcctactactttggtgctcagggtgttgtgttgtgtgctaagaactctgctccattaagtggagtagtgagcaaagctagtgcaggttcactcgagttgattgagctactctcctgcagaaacatgatgcagttcttgtcttcgtcagctgaaaatggttggcgagtccttggtggtaccattgctaacaaagctgtacctctctctcaagtggaattaggggtgccaactattcttgtgatgggtagtgaaggcactggattgagacccctggttgagcgatcctgcacacatcttgtcagaatacctggaaatgttgatgtatctgttgaaggagcagatgcagatgcaggggaagaaggtgacagttctagtaatcgagatttgagatcattccttgcggtcgagagtttgaatgttagtgttgcagcaggagtgttgctttatcatctggctgcaaaagatgcctgccccataagcgataagcctagtgttattctaatgtaaggatactttgtgattcgtgcatgtcatagttattacaattgcctaatttaatttctgctaatgaattatttatttctcatttcatgctt

SEQ ID NO: 3907 - DNA, 2236 bp, Zea mays
gtccgcccacgcgtccgccctaccgtccgcccacgcgtccgcactatcgtaaaggtcgctcgagacgaggacttaaaggagcaaatcggtaagaatatatattttgatctggtggaccatgaaaaagttcacagtttccgcattcagaagcagttgccttttacttcattcaaggaggaagttgcaaaggaatttggcatccctgtacagtttcagcgcttctggttgtgggctaagaggcagaaccatacataccggcccaatcgtccattgacaccccatgaggaagcacaatcagtcgggcagcttagggaagtctcaaataaggcacacaatgctgagctgaagctgtttctggaagttgaacttggaccggagttatgtccaattcgtccacctgagaagagcaaagaagacatacttcttttcttcaagctttataatgctgagaaggaagagcttcattttgttggtaggctttttgtgaaggctctgggaaagccatctgaaatattgacaaaactgaatgcaatggctggattttctccaaatgaagaaattgagctgtacgaggaaattaagtttgagccaaatgtgatgtgcgaacatattgacaagaaacttactttccgctctagtcagcttgaagacggagacattatctgtttccaaaaggctcctgttccagatggtgatgcacaagtgcgctatccagatgttccttcattcttggagtatgttcacaataggcaggttgtgcactttcggtgtctggacaaaccaaaggatgatgatttttctttggaattgtcgaagcttcatacatatgatgatgttgttgagagagttgcacatcaacttgggttggatgatccatcaaagatacggcttacgtctcacaattgttattctcagcaacctaaaccacagcctattagatataggggggtagcacatctactggatatgcttgttcattataatcagacttctgatatcttgtattatgaggttctggacattccactgccagatttgcagcgtttgaaaacgcttaaagttgcattccaccatgcaacaaaagacgaggttgttgttcatagcataagacttccaagaaatagcaccatcagtgatgtgattactgatttgaaaaccaaggttgaactatctaatcctgacgctgagctccgcttgcttgaagtattttaccacaagatttataagatctttccacctcatgagaagatagagaacataaatgatcagtactggacattacgagctgaggagatcccagaggaagagaagaatcttggcccacatgatcgattgattcatgtttaccatttcatgaaagaccctaaccagaatcaacaaattcaaaatttcggagatccttttttgatggttattcgggaaggtgagactgctgcagaggtaatggagcgcatccagagaaaacttagagttcctgatgatgagttctccaagtggaagcttgcattcatatccatgaaccggccagagtacctccaggacactgacgttgtatcagcacgttttcagcggagagatgtatatggtgcttgggaacaataccttggcttggagcacactgatacaacatcgaaacggtcttacacatccaatcagaatcggcacacctatgagaagcccgtaaaaatttataattgagaaaccttcatcaaagttcaatccattgtcaaaggcgtcgacaacagcatgcccaaggtgatacgacgcttcaaacagaaaaatctggtatagtatttgcctgtgctgaggcctgcaagcccaccaatgctgcttccaaccttcattgttccaagcaaccaagcatgtgtttggtttttcttcgtcgtgtcgagtatgacggcccctgacagggtaggtgtttgcttagtttgtagagcaaagctagcacataagaaaaaatattttggtaggggtggggggcatgtatacaggattgtagccgatactgattgctgaatttgcacctcttgtagctgtgggaacaatggcagagattgtataatgggtttggtataattctccgtgctgttgagaaacgtacgaggataacccggtcggatagtagagttttgagttccagcctctatgctgtttgttgcaacttgacatccgtatgaagatagtacctgttgccatcttgtaaagaaacatcatccctctaaaatcctgcaagctg

SEQ ID NO: 3908 - DNA, 1655 bp, Zea mays
gaccctccgggcctgccgggaattaagtttgagccaaatgtgatgtgcgaacatattgacaagaaacttactttccgttctagtcagcttgaagatggagacatcatctgtttccaaaaggctcctgttccagatggtgatccacaagtgcgctatccagatgtcccttcattcttggagtatgttcacaataggcaggttgtgcactttcggtctctggacaaaccaaaggatgatgatttttctttggaattgtcaaagcttcatacttatgatgatgttgttgagagagttgcacataaacttgggttggatgatccatcaaagattcggcttacatctcacaattgttattctcagcaacctaaaccacaacctattagatataggggagtagaacatctactggatatgcttgtgcattataaccagacttctgatatcttgtattatgaggttctggacattccactgccagaattgcagtgtttgaaaacgcttaaagttgcattccaccatgcaacaaaagatgaggtggttgttcatagcataagacttccaagaaacagcaccatcagtgacgtgatcactgatttgaaaaccaaggttgaactatcaaatcctgatactgagctccgcttgcttgaagtattttaccacaagatttataagatttttccgcctcatgagaagatagagaacataaatgatcagtactggacattacgagctgaggagattccagaggaagagaagaatcttggcccacatgaccgtttgattcatgtttatcattttatgaaagaccctaatcagaatcagcagattcagaatttcggagatccttttttgatggttatccgtgaagttgagactgctgcagaggtactggagcgcatccaaagaaaacttagagttccggatgaggacttctccaagtggaagcttgcattcatatccatgaaccggccagagtacctccaggacactgatgttgtatcagcacgttttcagaggagagatgtatatggtgcttgggaacaataccttggcttggagcacaccgatacaacatcgaaaaggtcttacacagccaatcagaatcggcacacctatgagaagcccgtgaaaatttataattgagaaaacttaaagtttcaatcgattgacggaggcctcgacaacagtatgcccaagatgatgaggcttagaacagaaaaattggcagaggaatatagttgctgcctgtgctgaggcctatacaagcccatgaatgccacgtcaaccttcagtgttgttactgctgttgtctattggttcttctcgaggctttgcttccaagcaaccaagcatgtgtgttggttttttcatcgtgtctagtatgatggcccctgctaggatagtttgcttaatttgtagagcaaagcgagtacataaaaaaagatttttggtagggggcatgtatacaggattatagccgatactgattgctgccgcttgctgctgtgggaacaatggcagagattgtataatgggtttgttattggttcctaattttcgtgatgttgagaaatgtaagaggagaaccgcgtggatagtacagttttgagttccagcctaggctgtttgttgcaacaaaaaaaatttggtataaa

SEQ ID NO: 3909 - DNA, 1661 bp, Zea mays
ctcggagggtattgtaccatatctgaaaaacactcgcaacaagctattgcgcccccagcgacaaatccacacatcagagttgatactctttctcatcaactatattatcctcagaggcctcttttcaaaacagttatagccgactgtcttggcagatcagattatgcttcttttggaagaaaaaatgatttcgcgagaccagaatattttaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaaaatagactttggaaaaacagaaagcaaaagaggacgtgttgacaatcttgatgatgatggcttaccttacgttggtgcaagtcttcagaccaatgacattgttattggcaaagtctcagaatctggagaagaccacagtattaagctgaagcatacagaaaagggaatggttcagaaagtattgctttcagcaaatgatgaagggaagaattttgctgtggttactctaagacaggttcggacaccttgccttggagataagttttccagcatgcatggccaaaaaggtgttgttggttttctagaatctcaagagaacttcccatttactcacgaaggtatagtcccggatattgtgataaatccacatgccttcccaacacgtcaaactcccggacagctgcttgaagctgctctggggaagggaatagcttgcaaaggtacaatgagatatgcaacaccattcaccacagcatcagttgacgttattgcagaacagttgcacagggctggttattcacgatggggatctgagaacgttctaaatgggcgaacaggtgaaagagtgcaatccttggttttcatgggccctaccttttaccagaggctgattcatatgtccgaagataaggtgaaattccgtaacactgggccggtgcaccccctcacgaggcagcctgttgccgacaggaaaaggtttggtggagttaagtttggagaaatggagcgtgactgcctcctcgcccatgggtcagctgccaacctgcatgaacgcctcttcctgcttagtgacttctcccagatgcacatctgccagacatgcgagcgcgtggctaatgttgtcatgaggtctgtccccggaggcaagaagatccgtggcccctactgcggcttctgcaagtcttcggagaacatagtgagaatcaatgtgccctatggcgcgaagctgctctaccaggaactcttcagcatggggatctgcctcaagtttgagacccaagtctgctagaacttgtagacctgcttgcatccagttattacatatgtacatacagctagcctatgaggatctccaagctggtgtgccggtgtgtgatgctggcatagcaaggatgggcgagctagaaaccctgttgtgttttatgtgctgttttctccctgctcatgtggtaaactatgctaaagtgaatgagcactcgtttcctgttcccgccccctatgcgctgtgttagcatgcccttttgtttaaaaaaaaaaaaaaaaaaaaaagaattt

SEQ ID NO: 3910 - DNA, 2047 bp, Zea mays
gggtaccctccggtgccggccgggacttccccagcagttggaaacctgccatatacatccatccttgcacatagctccgatccaggtccagctccaccaacccggccggaagcagcaagcctcttgtctcctgcacgtaactccagcctccagcgccacacgtacacctccgccggatcggaagaagatggtgtcgcctacggagccgcaggccgagacgacggtgttccgctcgacgcttccggacatcgccatcccggaccacctcccgctccacgactacgtcctggagcgcctggcggagcgccgcgaccgcgcgtgcctcatcgacggcgccacgggcgagacgctcaccttcggcgacgtggaccgcctgtcacgacgcgtcgcggccgggatgcgcgcctgcctcggcgtccgcagcgggggcacggtgatgctgcttctcccaaactccgtggagttcgcactcgcgttcctcgcgtgctcccgcctcggcgccgccgccaccacggccaacccgctccacaccccgcccgagatcgccaagcaggcggcggcctccggcgccaccgtcgtcatcaccgagccggcgttcgtcggcaaggtgcgggggctcgccggcgtcgccgtcgtcgccaccggcgacggcgcagagggctgtgtctcgttctccgacctcgcctcctccgccgacgatggctcggcggcgctgcctgaggcggcggcggcggccacggccatcgacgtggcgaacgacgtggtcgcgctgccgtactcgtccggcacgacggggctgcccaagggggtgatgctgtcgcaccgggggctggtgaccagcgtggcgcagctcgtcgacggcgaccacccgaacctctacttccgggaggacgacgtcgtcctctgcgtgctgcccatgttccacgtgtactcgctgcactccatcctgctgtgcgggatgcgcgccggcgcggccctcgtgatcatgaagcgcttcgacactctccgcatgttcgagctggtgaagaggcacggcatcacgatcgtgccgctcgtgctgcccatcgcggtggagatggtcaagagcgacgccatcgaccgccacgacctctcgtcggtgcgcatggtcatctcgggggccgcgcccatgcgcgcgggcctgcaggacctgctgcgcgccaagctccctcgcgccgtgctcggacaggtgtgcctgccttctgcctagcagaacacgaaagttcccctccagctcgctagtcgtggctcgtgagttgacgactaattaagccgcgttgaaacttgactaatcgtttgaacagggttatgggatgacagaggcaggcccggtgctctcgatgtgcatggcgtttgccaaggagccgttgccggtgaagtccggtgcctgcggcacggtggtgaggaatgccgagctaaagatcatcgacccggagaccgggctgtccctccaccgcaaccagcccggggagatttgcatcaggggcaagcagttgatgaaagggtacctcaacaacccggaggcaacggcgaagaccatcgactcggaggggtggctgcacaccggagacattgggtacgtcgacgacggcgacgagatcttcatcgtcgatcggctcaaggagctcatcaagtacaaggggttccaagtcgctccggcggagctcgaggccatgctcatcgcccaccccagcatcgccgacgccgccgtcgtccagtaagtggccacccacaccgtccttccccgcgcattctcgatcgagttgcacaagctctaaacgacgttcgcttggtactgctttgtccggtgcagaatgaaggatgactcctgcggcgagatcccggtggcgttcgtcgtggcgtccggccgctccgggatcaccgaggacgagatcaagcagtaccgggcgaaacaggtgagatactatgataagttatcgatccttgcgcaaggatattctcaaaatctcatcttcggggagagcacctgtcctgaaatttaaatttctgtaaatgtttctttaggtgg

SEQ ID NO: 3911 - DNA, 2402 bp, Zea mays
catatgatcacatcaactactttgcaagtccttaacctgtcctcgaatgccctttttggggatcttccattgcttgctgggagctgcactgtgttagatctttcaaacaacaagttcagaggaaatctatcagttattgccaaatgggccagcgatttggaatatgttgaccttagtcagaacaacctaaccggtccagttcctgatgcgagctcacagttccttcgcctcgagccggcgggctaccttcacctttcccgcaacgctctatccgagaccatccctgaagctattgctcagtaccccaaacttaccgtgcttgacctgagctccaatcagttacgtggtcctatgcctgctaatttgctaacttcgtccatgctgcaagaactctacatccgagataacatgctttccggcggcctatcctttcctggttcctcgtccaaaaatttgagtctccaggtgcttgatatctctgggaatcgcttcaatggaagcctccctgatgatattgcctccttatctggcctccgagttctcgacatctcaacaaacaatttctctggcccactacctgctgctgtgagtaagcttggagctctcactgatattgatatatcaacgaatcagttcacggggccattgcctgaggatcttccggataacctccaatccttcaatgcatcctataacgacctttccggtgtcgtgccagagaacctgaggaagtttccagaatcttctttccatcctgggaactcaaagttagaatatcctgctagctcgtctggatctggcagttccccatctgggtcagcaggtggaaaatcactcagtacaggtgctaaagcagcaatcgtagcagctagcattgttcttcttgtcatcctcatacttattgccattgtatgccactacaagaggatctcacggcagttttctagctctgaaaaggtttcagacaagagcctccacagggccactaaagacagtgctgtcatgcaaggaaaggacaacaaaggtggtttggtgtcagcagatgagcttgccactcctcgaaaagggtctacatctgaagcactcagccaggaagagaagtcagccgcggggggcttctcgccgtccaagggcagccggttctcgtggtcaccggactctggagaggcatatgagcaggaagggctggcgcggctggacgtgaggtcgcctgacaggctagcgggggagctgcatttcctggacgagacgatcacgctgacgccagaggagctttcgagggcgccggctgaagtcctaggcaggagcagccacgggacttcgtaccgggcgacgctggagaatggcgtgttcctgaccgtgaagtggctgagggaaggcgtcgcgaggcccaagaaggagttcgcgaaggaggccaagaagctcgcaaacatccggcatccgaacgtggtcggcttgcgcgggtactactggggccccgaccccgcatgagaagctcatcttggcggactacgtcgctccggggagtcttgcaagcttcttatacggtaatgccatcatcatcttcttcttctactactactgctgattagttgtttctgcagatgccttgatgtcactagcggttctgattgtgcagatcgaccaggaagaagaggtcctccactgacctgggcgcagcggctgaagatcgcggtggacgtggcgcgcggcctcaactacctccacttcgaccgcgcgatgccccacgggaacctcaaggccaccaacgtcctgctggacgggctggacctgaacgcccgcgtggccgactactgcctgcaccgcctgatgacgcagtcgggcgtggcggagcagatcctggacctaggcgtgctgggctaccgcgccccggagctggccgcgtccaagaagccggcgccctcgttcaaggccgacgtgtacgccttcggcgtcgcgctgctggagctcctgacgggccggtgcgccggggacgtcgtctcggggcccgagggcgccgcaggcgtcgacctcaccgactgggtccggctgcgcgtggcggaagggcgggggtccgactgcttcgacgccgccatggcctcggactctgagagcaacccgcaggctgtgaagggcatgaaggaggccctgggcattgcgctgcggtgcatcaggccggtctccgagaggccggggatcaaatctgtgtacgaggatctttcgtcgatctagctagtcggtagcgctagcctcgtcgcgtaggcgtagcttttagattaacactgcgtgttaaaattgtgtgcgtgttcgtcttgaactcgtagaactgcgtagcgaatccaagtgttattatggcctcaccttgatgccagcaatttgaaatgaagaatgtgttgcattct

SEQ ID NO: 3912 - DNA, 1943 bp, Zea mays
cattgggtacctcgaggccggccgggtaatcctagaaaatgctttttggtggcctatcctttcctggttcctcatccaaaaatttgagtctccaggtgcttgatatctctgggaatcgcttcaatggaagcctccctgatgatattgcctccttatctggcctccgagttctcgacatctcaacaaacaatttctctggcccactacctgctgctgtgagtaagcttggagctctcactgatattgatatatcaacgaatcagttcacggggccattgcctgaggatcttccggataacctccaatccttcaatgcatcctataacgacctttccggtgtcgtgccagagaacctgaggaagtttccagaatcttctttccatcctgggaactcaaagttagaatatcctgctagctcgtctgggatctggcagttccccatctgggtcagcaggtggaaaatcactcagtacaggtgctaaagcagcaatcgtagcagctagcattgttcttcttgtcatcctcatacttattgccattgtatgccactacaagaggatctcacggcagttttctagctctgaaaaggtttcagacaagagcctccacaggaccactaaaagacagtgctgtcatgcaaggaaaggacaacaaaggtggggtttggtgtcagcagatgagcttgccactcctcgaaaagggtctacatctgaagcactcagccaggaagagaagtcagccgcgggggggcttctccccgtccaagggcagccgggttctcgtggtcaccggactctggagaggcatatgggcaggaagggctggcgcggctggacgtgaggtcgcctgacaggctagcgggggagctgcatttcctggacgagacgatcacgctgacgccagaggagctttcgagggcgccggctgaagtcctaggcaggagcagccacgggacttcgtaccgggcgacactggagaatggcgtgttcctgaccgtgaagtggctgagggaaggcgtcgcgaggcccaagaaggagttcgcgaaggaggccaagaagttcgcaaacatccggcatccgaacgtggttggcttgcgcgggtactactgggggccgaccccgcatgagaagctcatcttgtcggactacgtcgcgccggggagtcttgcaagcttcttatacgatcgaccaggaagaagaggtcctccactgacctgggcgcagcggctgaagatcgcggtggacgtggcgcgcggcctcaactacctccacttcgaccgcgccatgccccacgggaacctcaaggccaccaacgtcctgctggacgggctggacctgaacgcccgcgtggccgactactgcctgcaccgcctgatgacgcagtcgggcgtggcggagcagatcctggacctgggcgtgctgggctaccgcgccccggagctggccgcgtccaagaagccggcgccctcgttcaaggccgacgtgtacgccttcggcgtcgcgctgctggagctcctgacgggccggtgcgccggggacgtcgtctcggggcccgagggcgccgccggcgtcgacctcaccgactgggtccggctgcgcgtggcggaagggcgggggtccgactgcttcgacgccgccatggcctcggactctgagagcaacccgcaggctgtgaagggcatgaaggaggccctgggcattgcgctgcggtgcatcaggccggtctccgagaggccggggatcaaatctgtgtacgaggatctttcgtcgatctagctagtcggtagcgctagcctcgtcgcgtaggcgtagcttttagattaacactgcgtgttaaaattgtgtgcgtgttcgtcttgaactcgtagaactgcgtagcgaatccaagtgttattatggcctcaccttgatgccagcaatttgaaatgaagaatgtgttgcatt

SEQ ID NO: 3913 - DNA, 1281 bp, Zea mays
atgagcttgccactcctcgaaaagggtctacatctgaagcactcagccaggaagagaagtcagccgcggggggcttctcgccgtccaagggcagccgcttctcgtggtcaccggattccggagaggcatatggccaggaagggctggcgcgactggacgtgagatcacctgacaggctagcgggggagctgcatttcctggacgagacgatcacgctgacgccagaggagctttcgagggcgccggctgaagtcctaggcaggagcagccacgggacctcgtaccgggcgacgctggagaatggtgtgttcctgaccgtgaagtggctgagggaaggcgtcgcgaggcccaagaaggagttcgcgaaggaggccaagaagttcgcaaacatccggcatccgaacgtggtcggcttgcgcgggtactactgggggcccgaccccgcatgagaagctcatcttgtcggactacgtcgcgccggggagtcttgcaagcttcttatacgatcgaccaggaagaagaggtcctccactgacctgggcgcagcggctgaagatcgcggtggacgtggcgcgcggcctcaactacctccacttcgaccgcgccatgccccacgggaacctcaaggccaccaacgtcctgctggacgggctggacctgaacgcccgcgtggccgactactgcctgcaccgcctgatgacgcagtcgggcgtggcggagcagatcctggacctggggcgtgctgggctaccgcgccccggagctggccgcgtccaagaagccggcgccctcgttcaaggccgacgtgtacgccttcggcgtcgcgctgctggagctcctgacgggccggtgcgccggggacgtcgtctcggggcccgagggcgccgccggcgtcgacctcaccgactgggtccggctgcgcgtggcggaagggcgggggtccgactgcttcgacgccgccatggcctcggactctgagagcaacccgcaggctgtgaagggcatgaaggaggccctgggcattgcgctgcggtgcatcaggccggtctccgagaggccggggatcaaatctgtgtacgaggatctttcgtcgatctagtcggtagctagcctcgtcgcgtagcttttagattaacactgcgtgttaaaattgtgtgcgtgttcgtcttgaactcgtagaactgcgtagcgaatccaagtgttattatggcctcaccttgatgccagcaatttgaaatgaagaatgtgttgtattattcaaaaaaaaaaaaaaaaaaaaaa

SEQ ID NO: 3914 - DNA, 2523 bp, Zea mays
taggcgactttcagcaaccaaacacacggtaacgccgctgtccacgtggtccgaatgcccgctctaccgtagaaactgacacgaatagataaatagaaatcgagcgctggctggccggctggccgtgcccgccgaggcccgaggccgtcggcgacaagccacagtgctacacaccacaccgctggacccaggccacacacaatacacgcacaccaaccctggcagggaaaacgcaacgcgccaacgcccgtccggtagcggctgccagatgcgccccagctatctgccgcattcgttagccggtccccatcccgcaccacccccaaaagaaaagcgaagctcactcccctcgcctcctctgcactccacaccgacacgcgaccggcacggcctttaactacaccttcctaccacacaccacgggctactagctcacccaccccacacccccagagcagcagccctgcccagccgcgcgagctagaggccgaccagaccgaccgacaggagctcgctcgctcgcaactccgcaatggcgtccatcatcgtgcaagcggtggtgatcctcctggacgtgatcgccttcggcctgggcgtcgccgccgagcagcgccggagccgggccaccgtcaccccggacgccgccaaggagtacgactactgcgtctacgactccgacatcgccacggggtacggcgtcggcgcgctgctcctcctcgccgccgcgcaggtggtgctcatggtcgccagccgctgcttctgctgcggccgcgggctcaagccggggggctcccgcgcctgcgccctcatcctcttcctcttcacatggtaaacgagcaaatctccagcccctctctctctctctctctctgtctctctctctctccctgttcacagtcatgcatggaaatagccagatccacgctcgggtgggttggattctgctctttaccccccatcgctcgtctacttcttacctacgactacgagcagattgtagtgagatctgcgcgtcgttttcagctaagggtccgttttccttgggctggtcttggcctggatctttgtgctttccaactgaatctacacttcttaatttctaagaaaaagatgacggaatggtatgctttgatatttgtttacacacgaattgacttatgttgagttgttccgatggactgttaaagcacattgttattttctttatactctgtcagtgatttctttatctgtttctctcgagatcaccaggtgacagtagtaaaactgaaagttcataaattactcttattccagtacctacagattcgagatacactatatttttctggtacatgctggaactaaaactgaaagttcatttaatatcgactgcactgcaaacttcccatccaaatgtttgccaatgacacatatgtcttcatccccaatggcagggtggcattcctcatcgcggaggcgtgcctgctggcaggatcagtgcgcaacgcgtaccacacccggtacaggggcatattctacggcgactcgctctcatgtgagacggtgcggaagggcgtcttcgcggctggtgcggccttcaccttcttcacggccatcctgggcgaggtgtactacctcagctactccaagtcccgggacgccgccggtggtgccccctacggcggctccagcattggcatgggcccttacaactaactaaaggccggccccggtcgcttcatgctggaggaatgcagcagtgttctttttgacgttaccttagtagggacacggtgtaattggttattggatccgctgctttttgtttaggttcttgtatgaagttactacttggttgggctgtatactgtttggattgttgggttggaccctggacatggatatacacgtatcgtagtatgctatgttttcgctcaaaaaaaaaaaaaaaccccgccccccgccattcaccattttactgatggtggacatgtctcggcattcaccacttaaaaatggcggtcatgtcatttttttttttaaaaaaacagcattatattaacaagtgttgcaaaggatggcacggattacatctggagtatcattctgtatcagagaactgatcagctaagctaacctagccgagctgcctcatagccaaaacctaaaggtatgcatggaagaacgggactttcacctcactaagtttttggcatcgcaaatgatgatggctctaatgtaaggtctatcaagttttggggattgtaacttcttgataatggtttgacaatctgaaactacaataatattatatctaagttttttatatcgcgaattatggttctaatgtaagatctaccaagtttttggggattgtaacttcttcataatggtttgataatccgaaactacaatgatattatatctattttttacatcgcaaatgatggttctaatgtaaggtctatcaagttttggggattgtaacttcttgataatggtttgacaatccgaaactacaatgatattacatctcaaatg

SEQ ID NO: 3915 - DNA, 1135 bp, Zea mays
  misc_feature (1132)..(1132): n is a, c, g, or t
gcacgaggcgaccggcacggcctttaactacaccttcctaccacacaccacgggcgacttcgaggccggccgggccgcgactagctcacccaccccacaccccacagagcagcagccctgcccagccgcgcgagctagaggccgaccagaccgaccgacaggagctcgctcgctcgcaactccgcaatggcgtccatcatcgtgcaagcggtggtgatcctcctggacgtgatcgccttcggcctgggcgtcgccgccgagcagcgccggagccgggccaccgtcaccccggacgccgccaaggagtacgactactgcgtctacgactccgacatcgccacggggtacggcgtcggcgcgctgctcctcctcgccgccgcgcaggtggtgctcatggtcgccagccgctgcttctgctgcggccgcgggctcaagccggggggctcccgcgcctgcgcccttatcctcttcctcttcacatgggtggcattcctcatcgcggaggcgtgcctgctggcaggatcagtgcgcaacgcgtaccacacccggtacaggggcatattctacggcgactcgctctcatgtgagacggtgcggaagggcgtcttcgcggctggtgcggccttcaccttcttcacggccatcctgggcgaggtgtactacctcagctactccaagtcccgggacgccgccggtggtgccccctacggcggctccagcattggcatgggcccttacaactaactaatggccgcccccggtcgcttcatgctggaggaatgcagcagcagtgttctttttgacgttaccttagtagggacacggtgtaattggttattggatccgctgctttttgtttaggttcttgtatgaagttactacttggttgggctgtatactgtttggattgttgggttggaccctggacatggatatacacgtatcgtagtatgctatgttttcgctcgcttcgtcctgccctggtctcgccattcaccattttactgatggtggacatgtctcggcattcaccacttaaaaatggcggtcatgtcatttttttttttaaaaaaacagcattatattaacaagtgttgcaaaggatggcacggattaaaaaaaaaaaaaaaanaaa

SEQ ID NO: 3916 - DNA, 821 bp, Zea mays
  misc_feature (799)..(799): n is a, c, g, or t
  misc_feature (805)..(805): n is a, c, g, or t
accaaaccaacgcgcgcctatttcaagccacggaacctcctagcctacgcaggccgcagctcccacgtcccaacaacttgccaattcgcaccgcgggaccggcgccgtcttgttgctccgctccggccgtgacacgagcgcacccgccaccaccgccagcccctcctcccccgtcgactcgagccacaggacaaggcatcccaaccgccgcccatctcctatcgtcatctgccgatccctcctcggttcctcacagtcacagagcctcacgtcacgtgtacctcccccaacccaacccagcccaacccagcccaaaacctagcgggcgaggggccggggaaccgaccgccggacgcggagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccagggcgaggagcaaaagaagctggatgtcctgtccaacgaggtcttcgtgaaggcgctcgtcagcagcggccgcacctgtgtcctcgtgtctgaagagaacgaggaggccatcttcgtcgacccggccctccgcgggaagtactgcgtctgtttcgacccgctggatggctcctcccacatcgactgtggtgtctccatcggaacgatctttgggatttacatggtcaaagacnaggacnacgtgaccttgggagg

SEQ ID NO: 3917 - DNA, 1348 bp, Zea mays
gggatctctcgcccacgtgtcccttgcccctgtccagctgtcccctccggagcctgcaaagaactccccacccagctatcaactatcatttccggcgctgaaaaggagagtgacactcaaccctgcagaaatcagattcggagcttcggggggaaaaggcaggcacagtatcgtcgaccatgctgccaggtcgccacccggcgcgccgggccgacaccaccgggacggggccgctcctgccggacgccactcgcgcggtggtggcggagttcgtcgccacagccatgttcgtgttcgccgccgaaggctccgtctacggcctctgtacgcgcgcgcgaaaaccttagcacacatccaaacaaaacaccttcaggattcacatgcacgcagcgcatgcattcggtgctgttctgaactgcggtgcttgaagatcttttcgttcgtctgattaattttgcagggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggccctgctcgtgggccgccgcatctccttcgggcgtgccgcggtatactggctcgcgcagatgctcggcgccgtggtcgcgtcgttgctgctaacgctcgtctccggcggcacggtaattcgccttaatttcgccacgtgtccatgtcaaatactacagtactattttacctttgattattataaataaaggttccagttaggcatacaaaggtactcggggtccgtttggcaaaatatgtctgaccataccaatggtattaggccggggcacaactcaaactttgtatgcctaactacttttttcaaactcaaattttgagaaatcacctttaccagcttaaacctcatgcatgactgggagatgtaaatgggtgagagatctagaaaaaaaactactttttttgcaacctcatctctctatttcacccgtgaagctatttatttctttacgatactatactcatcacctatgaagctgtttatttctttgtggtagtgatagcattactgtttttttttaaaaaaagagggtttggggaaaaaatagttcacaaaagagctcgtgatcgtgaagctgtttgtgaaaacagtgcctcgatcgagtgccaaacgccgaaacaccagaagatcgagcacgtcagcattgaaacgagaagtcaggatttactgcgtgcgtacgcgtaaggcaaagagtgtctctcactctttgccttgcatgcatgcctttgtcctgcaggtcgactcagaggat

SEQ ID NO: 3918 - DNA, 1440 bp, Zea mays
acggatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgtcgcatctctttcggccgtgccgcggtatactggctcgcgcagatgctcggcgccgtggtcgcgtcgttgctgctaacgctcgtctccggcggcacgcgtcccgtgggcttcgggctcgtccgcggcgtccacgagcggcacgcgctcctgctagaggccgtcatgacgttcgggctcatgtacgccgtgtacgccaccgcggtggatcaccggagccggggcggcgcggtcgcgatcgcgcccctcgccatcggcttcgtcctgggcgcgaacatcctcgccggcggcccgttcgacggcgccgcgatgaacccggcgcgggcgttcgggcccgcgctcgtcggctggagctggcgccaccactgggtctactgggtcgggccactgatcggcgccgggctggctggcggcttgtacgagtttgtcatggttgagcaggagcccgaggcgccgctagctgcagttcctcggatgccagtggcctctgaggactactgatgtaggtgtacatgtattgtatccctaccgtttgtattttcactgtgtatcgtatgggtgtaccgtgtatctaggagactaggaccgagcttggcatctgctttagaggcacgtcatagactttttggatattcccaagaacccttactactagatcaaaataaacacagacatgaatcgatttctgcgcatccacaactgaggcacacacacctgagcaccgccatggccacctcaggagtgtgaagatccgtggtttcagctctgcgaaaagcttaacatgttatattcttaagaatgcagtgtcactggaatttcttacactggacacctcttaggttatgttttgatattctagtatttacaccaggactggggtgtatattacacatgtgtattggagtgaatactagaatatgtttattggggtgaatactagagtatctaaacaagcacttataagaatcagtttagtcaaagtttgtacaaggtgtttccccagagctttggaaaggagtcgaagcctacgatgttttcaagatacag

SEQ ID NO: 3919 - DNA, 515 bp, Zea mays
tgtccccgatggcgtccttgtcgtcgacgatttcccgcattttggcggtgcgcgggtggtgcatccacatggtggagtccatgaactggacccccgcggtgtcgcaagccgcgaggatggtgtcgaggtcggcggcgcacagcgccgtgggcttctctaggagcacgtgcttgccacgtgcggcggctgcggtagcccagcgcacgtggaggctggtggggagcggcatgtagacggcgtcgatgtccgggtcgtcgaggagcgcatcgtacgagccgtggaggcgggtggtggcgacgtcgaggccgttgtcggcggcgaagaggcgggccttcacttcggagcggctcccgacggcggcgacggctgcgccgggcgcgagcagcatggcgcgtgccagctttcgcgcgatggcggcgcagcccaggataccgaagcgcacgggccgcggcgactggtctggcaccgcggcggacgacattggtggcagccggcgggtgatgtactgctgtttt

SEQ ID NO: 3920 - DNA, 564 bp, Zea mays
acaatccagcgtgaacagtacggtgttactgttcatctatttataggcacgggacgtagcctggataagattacattcatacccctgacatttactcttagttataatacaagttatcaaggactaagtagtcttttcccccttaggtcggtttcgtcttccatccaagccgaagctccttgagccacagcttcggcgtccatccacgtcaccttcgggttgcatattcttatcacacgcctttatcatgagagaactttcatcccaaagtcgaagcttcctgtaatagtctatatcatacgataatcgagatgcagacgacgttgcccacggtggcacacagatccgcgacggcgatggagtgctggtaagcaattcccagtctcccatctaccaatcccgtccaaagaggccatgctcactacccaggcgacttgaggaagctctcgggcccgactctgaggtatcaatgacgatgaatatgtgggtcgacgttggcgcgagcttcggttgacagcgccggcacttctctgttttcttcggctaactcctactcgggaccat

SEQ ID NO: 3921 - DNA, 6215 bp, Zea mays
  misc_feature (3807)..(3807): n is a, c, g, or t
ttttttttttttttttgatgttcaaatcctcacaatttatttatattcatattcacatataagaatcaacattaataatacttataattcaattgtaccttcgattcgccagaaggtgagaatgcaaagatgacacgagagagagattacaatccagcgtgaacagtacggtgttactgttcatctatttataggcacgggacgtagcctggataagattacattcatacccctgacatttactcttagttataatacaagttatcaaggactaagtagtcttttcccccttaggtcggtttcgtcttccatccaagccgaagctccttgagccacagcttcggcgtccatccacgtcaccttcgggttgcatattcttatcacacgcctttatcatgagagaactttcatcccaaagtcgaagcttcctgtaatagtctatatcatactgaaaacaaatggttagtcacatttttgaggaccttcagaagaggaaggcccccaatagtgtcgctatgaggtcgtaagttcgagaaccacaagaatcagagttaaaatgaataagttatgatttatctaagttttataattctttttatacaagaaatctatttctcagattttatttcctatttctcattaggatagggactatgggttctatttaaataaacgatatggtctaaagcgttaaaaatagggcttggttgcaatttcttttgacctgagactgactgtgagttgattcgaagaaaggataggggctcttaagcaaaattgccactatgaaggggtacagagcgttctgagccattggatcttgatccgatggtccagattagatccaacattaaagtgtattggtacgcgacactgtccatcggatcgacgatcatcggccgagatctaatgaaacgaaggggtgcactattttaatcgtgaccatccggatctggatcaacggtccatagctcaccaaggtgtgatctaatcctggccgcacactgaccgatcaacggccatcgaccctccttctcctcctaacggcggccggacgcggcggcgccctgtgtcccacggtggctcacacgccggagagcaggagtccggtgtttcggtcacttatccatgataccattaggtgctacgcgaagtagacgtcaaggctaataggttggattgggactcaccgataatcgagatgcagacgacgttgcccacggtggcacacagatccgcgacggcgatggagtgctggtaagcaattcccagtctcccatctaccaatcccgtccaaagaggccatgctcactacccaggcgacttgaggaagctctcgggcccgactctgaggtatcaatgacgatgaatatgtgggtcgacgttggcgcgagcttcggttgacagcgccggcacttctctgttttcttcggctaactcctactcgggaccatggccatgggggctgcgctacgacacttatacacggtcaccatatccaacaaccggcgcgggatcgtaactgccccaacaaatcctaacaacccgcccggcggcatcggtatgctacaacgcatgcgagcatggtttcgagaagcttttggtgaggaaacaactatcaagtggggtccacgcgtcagtgactttggcgtgcatgcggtggttgtgaggctaacagggcaggccccacccggcagcggcatgggagtgagcaggtgcacgtgcgcgtgacggctaggtgagctgctgacgcgtgggctcgacatgttggcaccaagagcaagtaaggcgcgagcgtgcgtgtgtggctggctaggtgaccccacctgtcggcgccgagatgatacgcagtgggactaagatgggcctgcgggcaattcggcccaagtgtgtgttagtcttctttttccttttttatttttgttttcttttcttatttccatcttctagtttattccaaattacaaatttacacctgattcaaatttgactttaatctacaaataaatcccaacatgaatgcaattccatagttttattgatttatttatttattatgctatttaagcaaatgttttttaaatatgcaattcatacactcaagattaggcattttaagaacatgatttctagtgtataaaatctttttttagattactccaacaaagggataactaaattcatataaggaccttttttattaaccttcattagaaaccatatttgtttttaggagatataattccaagaattattataatcaaatatattaattcaagacctttggagagctttttcctatattccaaaataagattttgagtgttacacaagctctacatatctacgatctttgattgtccttatgatataccataatttgattatgatcatatggattggtttacaaggcgttacatttctccctcgttcaagagaattcgcccttgaattcttattttgatgtttcatgaaaataattggtacattagaatattgtgaacgtaaggctttgtttgggtactctagtattgatcccaatccacgtatgttaagatggattggtgtgtaaattagtttaagttacaccacaatccacctcaatacatgtggattgaactcaatactagagtacccaaactagaccggaagagttttataacataggtattaagaaagttatatcagattgtgtgttaataactatccgatggattttattatgacgaaactctgtaaaactctctttattctaattaacacttaccaaattataaaatttactggcatgttataatattaaatgcaaacaaactcagataaaacttccactgagactcaggaataaactcctactgagactagactaacgtcacacgttcaaagtgtaaagtaaggcactctgatcaacagaattgcaatactccaaggcaatcagccaatcacgcctcgtccagtgtacttatataaatttgcgtctacctataatgttttctggtcaatcaatctaatcaagaccgaagcatgctttgctatgtcatccgcggattatagtactagagtttatttaaatacactagagctaataattagctactaaaattaattaaagacatccaaacaatctagttaatagttccgctattagttatttttagcaaattagttagtagttagttaactatttgtttgatggctaatttcactcaggcattgtttagccaactaactattacctctagtgcatttaaacacccctaaaaataccatccgtctcatacgtctcagcctgacgaaaccttctcaaattaccagaattagcggtttactgacttcatgtacaatacagaagtttagcatgtgtaaatatatcaagcaagcacaaaccacgccatggtgtaaaaactaaagctaaaaccttcagaatcggaagcgactcgtttgttgcatttagctagccacctcaactggcgcagaccctttgtcaatggaggctttcacagcatccaaaaccagctgcgtcttcctggtgatggccggccacttgccctcaggcttgcccccagcatcccggatgttctgcacaagcctcgcgaattcctggaccataagggcctcctgtggcaggtctgttgccacgacgtgcttgcttggcagaggatcccacccaacgtggagctcagcgaagttcgacttcgaagccacctggaactccgccgacttctcttcgtatgggatgacaaagtcagtgacatagacagttccgtttgtgccaactaaggtgatgtccatggtgagattggtgangaaagtcctcctgaaggtggcagtcttgccgtccgaccagtacaatgtcgcgccgcaggcaagaagcactccagcttggttctttacagggtcacgcagtgcgatcacagtcttgggcaactcgtagtcaacagcccacaggattgcacggatgcagtaccacccagcatcaccaagagcacccagggcatcaagacctggctttactctgatatcattctggaggaaatcttcgtttgctcgaaagctgaacacactgttaatctgcgtaaaaataagataaaaaacaatgatttttgttgacctacaaagctttgtagaacagtaaagatgaagtggaatcaaacaatgtattcttccacaaatatgtaaactactactatacgttaacctatagcatttcatacatgtcttgcaattcagatattaaagtgtgctagaaggtgtaatgactgcagccaatttcacagcctacttctagtgtgcatatgcataaatgaaaaatgacatacttgtgatatcacattattttctacatagctggaataatacaaccaaactcgatgcattacagatattctcatgagctggtaatttggatgcacggaaattttataggaactaaaacaaggtgtttagctttcacaatttaaatctttcagagcgctatactatcatctcaatttataaatggattggaagggtcgctgagaaagaattcaagctcaactcagcttcaacacttccagcgatgttaatatgtgataatttacatgtgattttgaaaaccttagaactttaactaaaacactatatttatataatatatgttaatatgcaagctagactcagcttcaacagttccagcaatgtccatatgtgatagtttacaggagattttgaaaactttagaactttctaaaactaaaacaccgcatttgtataaacatatgctgatctgtgtatgtgtgatgcatcactttggtaaattgtatgtcctagcaggctggcacataaaaagggcaaatgtccactggatgactatgttgatcggccagagaatctataaaacaaaagtattaggtccatttgccagagaaaaaagaagagtgttgaaccaacatgtggttaaggactttaactaaaacatctgttgatagacagcagcggctgccaagctgggtgcggataaggacattgatcgtcaggaggattaatgatgagaaggtctctgagtggcttggcgcttctggtggcctgctccgtgaagtggtttgcagtcggccttgtcgggggccttatcagtctgttgtgttttgagtgtcgtctgttctcagttggtgtttcctgggatgtttttgtgacctgaatcaggcctgtgtgcctctctggatgacaaactgtgtaataatccagtaggcttcgttcttgcggtgatcacgatcacctgcattccgctcagtcgaaagactctagatgtatccctgctatgttactctatctctctgctgtatttctattaagaaagtaatagaaatggggaatccccttgttgaaaaaaatgtggttcttgtgcctgtgtgtccatgtatgtaaaatggtgcatccttggttagacctttactaggaagacgactttttaagatttcctagaagttcaatatcccaaataatatggttattctaactgccatcaataaaatattgtagtgctagttagaagaacggatctgctaacttggtcaataacagcttatggttgtatccataccttggagacaagaacaaaataacaaagtctaaattgaaaacaggatagtagttccatgttgctaaatacaaaatgtcgccattcctttgctgtacccagcacggcaagtagacactgaaaggtacctgaaatatttttcttagtagctctatcaccatttttctttatgtccagcccatgccaattaatcatgattctgttgtcggtttgtgccagaacccacttaggccatgttccgatgttcggttctaccccaatccatatagattgagggggattgagggggattcaatccctagtaagtcaaaatcccctccaatccatatcaatcccctccaatccatatggattgaaaataaccgaacaagcccttaaggcctttttctttttggatgaatccattcactgaaatacatgtgatttggagagaccagacaaaatgcgccttaagggaatctccaatggtaggagttagctggtcgctcttagatagatcacatatgtaatgtgaatttgtcctatcatctatggaagagatatatagaggctcacaagtcacaaagtgtgtctttcatgcatttgaccacacaagagcctagtcttctcacacactaacacacaactcaatggttttgcc

SEQ ID NO: 3922 - DNA, 2475 bp, Zea mays
atggtgatgcatggaaggctctcgacacgtttgatcccgactttgcagctgatccgaggaatgttcgaatcggcctcgcgaccgatggcttcacaccttttggtcaaatggcatcatcatactcatgttggcccgtctttgttattccatacaaccttccaccttctctttgtatgaaatatgaatttatatttctttgcttaatcattcctggcccagactatcctagaaagaacctcaatgtcatgttaaaacccttgattgaagagttgaaggagctttggaaaggtgttgaagcatacgatgtttttacaaaacagatattcaaacttcgagttgcgtatttgtggtcggtgcatgacttcatggcgtatgctatttttaccggttggagtacacatggtagattgacatgtccatattgcggttcagatacagattgcttccgtcttgctcatggtggaaagatcacttacttcgattgtcatcgacgctggttgcccaggaaacacccctttaggagcgataagaaaaactttataaagaacactgtggtcaccaaaggtccgcctaaacgtcttaacgcggcagaaatatatgctcagctgaacaaccttgtcctaaatgaaaagagggacaagtacgaaggattcggagtggaccacaactggacacatatatgtggtctctgggagctcccttatatgtcgtcattgattcttgtgcacaacattgatgtcatgcaccaagaaagtaatgttgctgaagccctcatacacacctgcatgcattttgaaaaaacaaaggacaatctgaaagctcgaagagatctagcaatgctttgtgaccgaccaacccaagtgctcaatgacaacggtaagccgccacgtgccttgttctatcttacctctaaagacaagatcgaggtaatgagatggatgaaaaaaaattaaatttcccgatggttatgctgcgggcttgaaaagagctgtgaatttgaaaacgggaaaactaactgggttaaagagccatgacttccatatattaatggagaggattatccctgtcatgtttcgtggttatatgcccgacgccatgtggcaagcaatagccgagctaagttatttctacaggcagatctgtgccaaagaaataagtaaaaatatgatggagaagttggagaaacaaataccagtgttgttatgcaagctagaaaaaatattcccacctggattcttcaatccgatggagcatctacttattcacattccatatgaggcaaaggttggtggacctgtacaatataggtggatgtatcacattgaacgtgcactcaaaaacctgcgaggcatggttcgaaataaggctagagtagaaggatgcatcgctgaagcttttttgctaaaggaggtttcatacttcacgagtgtgtatttcgcagaggaacataatgtctatgctgctaccatgcgatacaatgtcgatgaggaacctcctgtcagtgatctcaacattttccaatggagaggcacaagtactagtaagggcacgttctaccaccttagcatggatgaaagaatgtccgcattgctatacatgtactcgaatatggaagagatggagccatatttcatgtaagtctttattttgccccataatttcattgccatggagccatatttaattacttcttcatcgtacactaagttcgacgaggaaaattggacttattcccatcagcctacaagcaaacaactagatacgatgcgacgacatgggaggcaaggaagacctaattttgttgacttgttttgggagcatgtaatctttttatattccttactttgatgtcatttagccttttacgtgaggtagtcattttaactgtatattatttgcagtacacaaagactcttaacatacaagaggacttgagacaactatcttatgggacgatgacttgcataacctttggttgatacgattttaatggcttccgttttcgttcagaccaatttgaaaagtctcgtcctcgtgcagccacacgtaacactagagttctgactagggcactcgatgcactcggaagagaaactaattattatggcatcattcaaaacatcctagagtttaattttgcagggaacaaaactttgaaattagtattctttctatgtgattggtttgacagcactaatgggattagacaaagtcaatatggcataactgaagtaaagcacaaggaacgacttcgaggccatgataattttatccttgcacaccagtgcgagcaggtctactatatgtcgtacccaaattaaatcttaagtttaaagcatggaaggtagttcataaggtgaaccctagggaacgtttacatactccttgcactgttggttatcaattcgaagacgaataggccgatgatgtttatcaagaagaagaattgccaaccacttttactatcgatgaggg

SEQ ID NO: 3923 - DNA, 2204 bp, Zea mays
gagctggcagctctgcttctgtcgacgacaacaccgacgaagagctcaggctggcgtgggaagcagcgctagagcaggcggcacagtgggcagccgcgcatccccatgggggcgcgcgtggcggcagcccagataggcgccgacgcgctgacagcgctccgggcgagggcgcacgcggtggcagcccagatgggcgtagacacactggcggcgcccgatggcggcgaccgagtcgacgaagatcgtggcctctacatgaggcgcggctctccctccccggatcggtaccatggtcgccgcatggcccaagccattgtcagggacatcggtcccagcggtgggtggcctaccctcaccaagaccaactacgtcgagtgggccgcgatgatgagggtacgactccaggttcgccacatgggggaagcagttcggtacgacgacgttgactaccgcgaggatcggcgggcgctggatgccctcattgctgcagtccctcccgagatgcagttttcgctttcccagaagcggactgccaaggaggcctaggacgccatcgctgcgatccgcatcggcagcgaccgtgcccgcaagaccacactgcagacacttcacaaggagtgggagaacctggccttcaagccaggtgaggatgttgatgactttgctctccgcctcaacactctgttgtagaagatggtgcagttcggcgacgacacctacgatgaggagagagctgttgagaagctcttccgttgcatccccgagaagtacaagcagattgctcgctcgatcgagtctctgctagacctctccacgatggcgatcgaagaggcgataggtcgtctcaaggtggtcgacggcgacgaaccacaggctccctctgggcctatcactatcggcgggaagctacatctcactcgagagcagtgggaggcctgccagggtgacaagaagggggagttgtcctcgacacaaggccgcaaatgcggcaaggcacgtggaggcgcccaggccggggcgcgaggacatgctgagggtggtgcccgtggaggtgcccaaaggcggcgccgtcggcaacaagaagccggcacgagacgacggctgccacaactgcggcaagcttggccactgggccagggactgtcggcagccacgacgtggccaggccaacgtcgcacaggcggaggcggaggaggaggccctgctcctggcacatgcaagcatcgagccatctccagcggcaccggccgcagcggcactcctccaccttgatgagtcgaaagcacgcgctttcctcggcgacggctccaacaaggacatgatcgaaggatggtgcctcgacaccggcgccactcatcacatgaccggccgacgggagttcttcaccgagcttgactctagcgtccgaggctccgtcaagtttggggacgcctccggcgtagagatcaagggcgccggctcagtcgtcttcaccgccgcgtctggtgagcacaggctgctcaccggagtctactacatccccgcgttgaggaactctatcatcagcttgggacagctggatgagaacggttcgcgcgtggaggtcgagcacggagtcatgaggatctgggatccctctcgtcgccttcttgccaaggtacgcaggagtccaaatcggctatacatcctcaatgtgaaggtggcacaaccttgctgccttgctgctcgtcgagacgacggggcatggcagtggcacgagcgcttcgggcaccttaacttcgaggccctgaagcggctcagtgccaaggagatggtacgaggcctgccgtgccttgaccatgtggagcaattctgcgatgtctgcgtgttgacaaagcagagacggctcccctttccccagcagtcgagcttccgagccaaggagaggctcgagctcgtgcatggggacttgtgtggcccggtgacaccagccacaccaggaggacgacgctacttcttgctgctcgtcgacgatctctcccgctacatgtgggtgatgatccttggcagcaagggagaggctgcgaacgccatcaggcgtgtgcaggtcgctgcggaggcggagtgcggccgcaagctacgcgtgctgcgcaccgacaacggcggcgaattcacggcgatggagttcgtgtcgtactgcacggatgacggcgttcagcgccactactccatgttgtacagcccgt

SEQ ID NO: 3924 - DNA, 3426 bp, Zea mays
cattgggtacctcgaggccggccgggatccctcgaaggaacaaccccaggacgccttggccgcccccccccttcgccccttcgacaaacattgtgttagccgatgtcactctgcttttagccttttgccaagtgccaacaaccaggtcgaaaggacatctgaccggcagcaggcagacatccgtcgtccgccatggagtcctcatggctcctcctgctctcgtgccttccggccgtatgggtgcttgccgcggcggcggggcggagtcccggctgcgcgacgaggtgcggcgagatcgacgtcccgtacccgttcggcctggacccgcagtgcgcgatccacgccggcttttggctcaactgcaccaccgtggatggcgccaccaagctgctcgacaagaactcggaggtgaccaagatctccgtggaggatggcaaggcctggttcaagaacttcatctcccggcagtgctacaaccaatcctcgggtgacatgttcgaaaacaacgcgtgggtcgactataccggcgagccctacgttctgtcggcagaggataataagatcatcgtcctcgggtgcaatagtatggcctacatgcagagcgactcttacataatcggctgcatgtcgacatgcgacgacccactgaagaacggctcatgctccggcaccgctggctgctgccaggcggagctcccgccgggcgtccagttttaccaaggcttcttcaactcgctgcacaacaccaccaagatatggaagcaaacaccctgcaactacatcaccgtgatggagagcgcggccttcagcttcagctccacctacctcaactcgacggtgttgtacgactccgacgacgggaggacgccggtcgtgatggagtggggaatcacacggcagacgtgcgaagaagccaaagccaacaagactgcgtacgcgtgtgtcagcaaccatagcgactgcgtctacagcgatgccgccggctaccgctgcaggtgctccggcggattcaaaggcaacccgtacgtcgtagatggatgcgcaggttcgttcctcttgcgcgcccagacatccaaatccatgcatgcacaagttacaaaccgatgcgattttttcgtgcggttttcagatattgacgagtgcttggacagtgctacctacccctgcgctgggatatgcaaaaacacactcgggaatttcacatgttcgtgcccacgaggaagaagcatgatcaatggcgtttgcgtgaaaagtcagaggtcaacttggatggtgccggttgttggtaggtcgctgcacaagttgcgtacttgcgttaggaaaattccctgccgggagcatctgttttttttccctacactttttcaatgctttccgggtgtttacagaaggagtaataagtaaccttcgttaggaaaatcgtgatgcattgcaggcgcaagtgttgggctggtgactctcgtgatcggcgttacctgcgcatacctggtccgagaacggcgaaagctgcaccgcgtcaagcagagctacttccggcggcacggcggcctgctcctgttcgaggaactgaagtcgcagcaccaccagcagggcgccgccgcgttcacgatcttctccgaggaagagctgcagcaggccacggacaggttcgacgcgcagcgggtccttggccacgggggccacgggaccgtgtacaagggagtgctgaagagcggcaccgccaccgagatagccgtgaagagatgcatgaccatcgacgagcagcagaagaaagagttcggcaaggagatgctcatcctgtcccaggtcaaccacaggaacatcgtgaagctcctcggctgctgcctcgaggtggaagtccccattctcgtctacgagttcgtcccgaacggcacgctgttcgacctcatccacggcgaccacggccagcgcgtctcgctggacacccgcctcaggatcgcctacgagtccgccgaggcgctggcctacctccactcctgcgcgtccccgccgatcctccacggcgacgtcaagtccaccaacatcctcctagacggcgactacgcggccaaggtctccgacttcggcgcctccattctggcgccgaacgacaagtcgcagttcgtcaccgttgtgcaaggcacgtgcgggtaccttgacccggagtacatgcagacgtacgagttgacggacaagagcgatgtgtacagctttggggtcgttctcctggagctgctcacgggcaagaaggcgttcgacctccaagggtctgagcaggacaggagtctctccatgaggttcttgtacgcgatgaaggagaacaggcttgaggacatcctagacgatcagatcaagaacagtgagagcatcgagtaccttgaggagatcgcagagctggcgagacagtgcttagagatgagtggtgtgaataggccgacgatgaaggaggttgcagataagcttggtaggttgaggaagatcatgaagcatccatgggcacatgaggatcctgaagaattggacaggttgcttggagagccgtctactacaactaactcgaccgctactactgggaatttcatcattgcaattggagagccgtctacagccaactccaccgctaacactgggaatttcagcattacaaagagagctgccatgggcttggaatcaggacgttagctactgtaaatgaaattatatttacctcattccatatgtatataacagatagagactgtacattttcttggcggtacaattccagttttacattaccaacatgaataaaacaaagacgcaaagctttctctgagaaactgagactttgttgctcatatgtagccatggaaaactgtggtatccagtgcaatgcatgcgcattggtgcaatttgcaagtctaaagaactggctagcacaagtatattaagcagagacaaacattcgtgaccgcagtatatatgtgggatgtttcatcatgggaacaaactcagaagttaattgagccatttacatatataacattgtccggtataaacatactacagttgccacggtgctcgggtctgtcccgttgaatgtctcctttcgcagcggtcttcagggggagaacttggggagttggtatgcgctagtaaatcggatagcggggctttctttaaacccttcgaaagatactttcagatggagcttgcatcaaaacgggaagttttcctcccagtctatgtatgctgcattgatagggagggaaatacctcggcaggaaactctcatctggaaacttaggatcccattgaaaattaagatcttctgttggttcttaacacgaggggtgattttgacaaaggataacttaatcaaaaggaaatggaatgggtcaaaaaaagtgtgttctgttcccatgatgaaaccatcccacattcctt

SEQ ID NO: 3925 - DNA, 2315 bp, Zea mays
gccggccctctgctctgctcagccagctagccatatatacggcggcattcttcttctcttcttcttccccaataacatatcgagctgcaagctgctctgcttcttttctagcatgggcatgagggtcttgttggtggtcgtgctcatctcgttcgccccccttattaccactaatgcagcagcaggtgtcaacgccacgagatctgctggtaggcagcagaagcagaagcagaagccgctggcgcctgccctcatcgtgttcggcgactccatcgtggaccccggcaacaacaacgacatccacaccatcatcaaggccgacttcccgccctacggcaccgacttccagaaccacagagccacgggaaggttctgcaacggcaggataccaaccgacttcatcgcctcccgcctcggcatcaaggagcttctgccgccctacctcacctccgagccgctcgacaagcacgacctcgtcaccggcgtcagcttcgcgtccggcggcacgggcttcgacccgctcacgccgcagctcgcctccgtgatctcgctcccggaccagctcaccatgttccacgactacctgggcaaggtgcgcgacgccgccggggacgccagggtgtcggatatcctgtcccggggcgtcttcgccatctgcgccggcagcgacgacgtggccaacacctacttcaccctgcgagcgcgcagcagctacgaccacgcctcctacgcgcgcctcctggtgcagcacgccaccgccttcgtcgaggacctcatccgcgccggcgcgcgccgcgtcgccttcatcggcatcccgcccatcggctgcgtcccgtcgcagcgcaccatgtccggcggtctcgaccggggctgctcgcagggccacaacgagatcgccgtcgcatacaacgccgggatggtgcagcagctggcggcgctgcgggccaagtaccccgacacgctgctcgtcttcatggacatctacggcttcctctacgacatgatgatgcacccgcgcagctacggcttcacgcagtccaccagaggatgctgcggcacgggcctcctcgaggtctccgtcctctgcaacggcgtcacctccgccgtctgccaagacgtcggcgactacctcttctgggacagctaccacccaacggagaaggcgtacaagatcctcgccgacttcgtcttcgacaactacgtcaagctcatcctcgtctagcttaccattattttcatttcatgagatggatttgatctgctggattatgcattaattgtttgctgctgtatttacatttgcttgtctgattaattgtttgctagctaatcttccggcctctacatctctctatctatctatatttacgtgcatttattacgactctattaattgaattattgtacgtccgtgtcataaattaattaattaatactataataatagttgtatctagtgcatgctgctcatcaccctagcactaccggaatcggtctctttgccaagtgtgtgaagcactcggcaaagcctgtaaaacactcttggtaaaggctttgccgagtgtgacatggatatcatttttgtattcatggtttttcatttttcgattgacttgtagtttaaatctgaattatccgaagaaattcaattatacgaactaaatctaatagttatagcaaacacttttataattgtgccaaaatagaacatttaagtctacatagtgtagaaacataccacaaaaaagtttgattgggaaaaaaaatattttgccgagtgtccaaggatgacactcgtaaaatacggtttgccgagtgtcggtcttgcgacactcgacaaagaagctactttgccaagtgtcaagacctggcgctcggcaacactcggcaaaggtaacggacgtcaactatagacagctactgacgaacctttaccgagtgtttaggttcgccaagagtttggcactcggcaaactgttctttgtcgagtgtttccctgtgccgagtgtcctactctcggtaaacgtggtcgttaccaagagtaggactttgtcgagtgcccgataaaaaatactcggcaaagcgccatattccgatagtgtaggtgataatcatctatcctgaaattacttaaagaatgacttctaaatatcacaaataacttaaatttgttgagtcatttcatagtagatgagcatcatctaagatgacgaataacattttacatttatatatataatatttgtaatcatagttaccggtaataactaaattatattcagtcgttatccaaaattattgtgtggtgcgcgcgc

SEQ ID NO: 3926 - DNA, 1612 bp, Zea mays
ccacgcgtccgtaatggtactagttgggtcgtgagaccaggaaaaaggaagtcagggatactttcgtcaagaccgaccggtgtcgtgtcgcctgctttgaaaaatcatacaacaaccaactaaaataacattgggtacctccaacgcggcccggacgcacacgcgcatcccggcagtcagtagcgcagctgcctctcctctctttggcccccggagccggagcaagagcgccgccaacagcccgctaccggcgccgtgtcatggcgggggcaggagacaaggtggactacgtcttcaaggtggtgctgatcggcgactcggcggttggcaagtcgcagatcctcgcgcgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagctgtgacaagtgcttattacagaggtgcactgggagctttgctggtctatgacattaccagacgccagagcttcgatcatataccccgctggctagatgaactccgagcccatgccgacaagaacattgtgataatgctggttggcaacaagagtgatctcgaggagcagcgagcggtgagcactgaagatgccaaggagtttgccgagaaggagaacctcttcttcctggagacctctgcgctccaggcaacaaacgtagagagtgcttttcaaactgtcttgacagagatattcaagatccacagcaagaagaacatggtgtcggagccgaagagcaatggagctgccccagcaatgccggggacaaaggtccttgtcccaggtccggcgcaggaaatcccaaagagcaagtgctgcagttccatgtgatgcttctacgtttggtgctgggtgggttgaaaatatattcacgcaacattgtgttggttttaaatccctgctgaaatacttgggttttggcgggattgtgttggaacaccggtgtattttagatatctgtcacaattgtgacatgagagaaggatgtgctgatgtattagttctcttgttctctaattgatacgttttatccctgctgcaaatatctgtagcaccgattgtttttgagatgcgaggtgtgaatttgccgtgtacaagaaataatccactcatctgtccggcccggtgcaatcatactttgtcgttggagctaaacggaaaagataaatgtaggccctgtgtagcatggttctaactccagatctctgctcagagttgaattggtgatccaaattctaggtatgtggaggcaagcgaaacggaggccgtcgtcgatccgacttgggcctgcgaagccagtgcacatgcagatctgtcacgtcagcttgcgttgtgaggcgcactgcaacgctgcactctctcctcccccttttctccgtgtacgaatatggtggttgcattaggtattaggggagctcttgaggggtaatctctcgcaccatttgcttgtaattgcaccgtcccgtttccgtctgtctgtctgtccaggcaagctaaagtatttaagcagatggtactgagagaactga

SEQ ID NO: 3927 - DNA, 1035 bp, Zea mays
tgctttgaaaaatcattcaacaaccaactaaaataagcgcacgcgcacacgcatcccggcagtcctgtccagtctggcggtgcagctgcctgccttcagccttccctctctttcgcgacccccccggagccggagcagagatcgccagctctaccggcgcggaggcatggcgggggccggagacaaggtggactacgtcttcaaggtggtgctgatcggagactcggcggtgggcaagtcgcagatcctcgcccgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagccgtgactagtgcttattatagaggcgcactgggagctttgctggtctacgacatcaccagacggcagagcttcgatcacataccccgctggctagatgagctccgagcccatgctgacaagaacattgtgataatgctggttggcaacaagagcgatctcgaggagcagcgggccgtgagcactgaagacgccaaggagtttgccgagaaggagaacctcttcttcttggagacctctgcgctccaggcaacaaatgtggagagttcttttcagaccgtcttgacagagatcttcaaaatccacagcaagaagaacatggtgtcagagccaaagagcaacggagccgcgccagcaatgccggggacgaaggtcctcgtcccaggtccggcgcaggaaatcccgaagagcaagtgctgcagttccatgtgacgcttctgcgtttggtgctgggtgtgtcgaaaatattcacgcaatattgtttttttttttgctgtaaatccctgctgttatgcttggatttttggcggggttgtgttggaacaccggtgtatttttagatatttgacacaactgtgacacgagggaaggatgtgctgatgtattggttctcttgttctctaattgatatgttttatccctgctgc

SEQ ID NO: 3928 - DNA, 821 bp, Zea mays
cattgggtgccccgcggccggcccccacgacggtggtctccgagtgggcgctcaagtgcgccggcccggcgctcgtctcgctcccggcgtcgtccttcttcgccggctgcctggcgggcgggttcctgctcaccacgctcgcggactcgctcctcgggcgcaggaagatgctgctcacgtccctggtgtccatgtccgtcgccggcgtgctcaccgcgttcgcgcccaacgtgtgggcgtacgccgcgctgcggttcgtgtgcgggttcggccggtccatggtgggcacctgcacgctggtcctgtccacggagctcgtcgggaagaggtggcgcgagacggtgagcatggccggcttcatcttcttcaccgtcggcttcctgtccctcccggcgctcggctacacgttacgcgaggcgtcgtggcggaacatgtacctctggacgtccgtgccttcgctctgctactccgtcctgctctacttcctcgcccaggagtcgccgcggtggctgctggtgcgcggcaggaagcaggacgccatggagacgctgcggcagatcgcctcgctcaatggcaacagcatcacgtccagcttctccatgctgcacgcgtgcaacatgcaggaggacgacggggccggcggcggggccggcggcgtgttctccacgatgcggtccatgtgggagcggccgtgggcgctgcggaggctggcgggcgatcatgaccgccagcttcggcgtcggcatggtctactacggcatgccgctccacgtcggaagcctggggaacaacctgtacctgagcgtcacgtacaacgcttt

SEQ ID NO: 3929 - DNA, 2727 bp, Zea mays
gtgatccaaacgggggacgttagcgaaagaataacaaatcaatttcttctttgctcacgcaatcgtgcacagtaacttcatgtgatgatgatttcttggcgtgagaattcctggccgtgaccacactggcacttcacctcaaatcgcaggggttatgataggacctatcacgtcagattgcaggggctccaatagcccttggcgactcgagagacccgcagaccagcgtaggtcgtgatgaagcaggacgcgggacccactggagagtggagacagccctgtatgagcgcgccacgcaggagaatggagatgaaacgatgcggagatcgatctgatctgacaagacgaataaccggcggcggcgacttccacacgcaacgaagaattggcggcggcggctgcgaggaattgaaaattgtgtctaaccacagctctctatataacaattgttataatcatggatgaaaaaaaataagacacagagtttaatatgtaaaaaactctcccaacgtggagaaaaaaaacccacattaaactctgtatctttttttctcgtctcggatcctaacatatagaaccagcaaaacaaggcgaattggcaaacccaaccctgctaggtaccaaaactacagcttaacgcccctgaacaagcaagctgcgaatctcctgctgcccatataaatactgcttccggcaccgtctctgacctgccgcgcgcgcgcatccaatagcagtagcagagacaaagcgcacacacacacacaatcgtgccaatggccgacacggccgacgccccgctcctgacaagccacgggcaggccaagcagctggccaaggcgccgtccatcgacgacaccatcgagacgtacatcggcgcgaccggttccatgcagctgctcagggccgtcctgctggcattcgcgtgggccttcgacgcgcagcaggtgttcatctccgtgttcacggacgcggagccgcagtggcactgcacgggcgcctcggcgtcctgcaagccggccgcacccccggcctcgccgtgcgcgctcccctccggcgcgtgggcgtgggaccggccggcccacacgacggtggtctccgagtgggcgctcaagtgcgccggcccggcgccggcgctcgtctcgctcccggcgtcgtccttcttcgccggctgcctggcgggcgggttcctgctcaccacgctcgcggactcgctcctcgggcgcaggaagatgctgctcccgtccctcctcgccccggccggccccggcgtgctcaccgcgttcgcgcccaacgtgtgggcgtacgccgcgctgcggttcgtgtgcgggttcggccggtccatggtgggcacgtgcacgctggtcctgtccacggagctcgtcgggaagaggtggcgcgagacggtgagcatggccggcttcatcttcttcaccgtcggcttcctgtccctcccggcgctcggctacacgttacgcgaggcgtcgtggcggagcatgtacctctggacgtccgtgccttcgctctgctactccgtcctgctctacttcctcgcccaggagtcgccgcggtggctgctggtgcgcggcaggaagcaggacgccatggagacgctgcggcagatcgcctcgctcaatggcaacagcatcacgtccagcttctccatgctgcacgcgtgcaacatgcaggaggacgacggggccgccggcggagccgccggcgtgttctccacgatgcgggcgatgtgggagcggccgtgggcgctgcggaggctggcggcgatcatgaccgccagcttcggcgtcggcatggtctactacggcatgccgctcaacgtcggcagcctgggaaccaacctgtacctgagcgtcacgtacaacgctttagccgagctgccgtcggccatcctgtcgttgatcttcatcggcagggtcaaccggcggagctctgtcgtcgcgcttactgtggcggcaggtgccttcagtctcgcgtgcgtcgtcatcccagagggctcggcggcgcgaatggcggccgagttgctctccttcttctcgaccatcacggcgttcaacctcatcctgatctactccatcgagctgttcccgacgtccgtgcgcaactctgcggtggggctggtgcggcaggcgctggtgctgggcggcgtggtggcacctgtgctcgtcgcgctcggccgcgaacggagcttctggtccttcggcgtgttcgggctctgcatcggatgtttggggctctttgccgcctgcctccccgagacgagggggcggagcatgtcggacaccatggaggaggaggagcacaaggaggccgccgccgcggcttgcaccggcgcaaccgacattgccacgaaggatgataccgacctgctcgtgtagcggtgagatgctggttcggcggcgctgctagatatgcctaggctaggcgctgtacaggtacagctagcaggtcaatcacgaagctgtcagcctccatctatccggtcttgtaccgctgccgccaagttgatgcatataattcagaaccagctgtggagtccgactgtccgagtgtctgcatatagttcaaagtctagggccacattcactgaagcagatctcgatgcatatcggcgaacattaactgctgaagtgctgaagcacatgtacattgacgaagcaatacgccaatacggaagtgtcgttggcggcaaaaaaacaaaaaaacagacagtac

SEQ ID NO: 3930 - DNA, 2073 bp, Zea mays
tgcgtacccaaacccttcatcatttacatacgagaggcgcttctttaggccttttgagtatgctctgcagcctccaccttggtacagagatgaacatatagctttggataagcctgagcttcctcctggtgtatcaaagatgactgaatatgatggaccacagtgtttcataattcctggaaatcatgactggtttgatggacttcatacttttatgagatatatatgtcataaaagctggttaggtggatggtttctgcctcagaagaagagttattttgcattgcatcttcccaagggttggtggatatttggtcttgatttatctctccatggcgatgttgatgtgtaccaattcaagttctttgctgatgtttgtcagaataaggttggagagaatgattctgtgattgtagtaacacatgagccaaactggcttcttgattggtactggaatgagactacaggcaagaatgtatcacatttaattcaggaatacctgaaaggaagatgtaaacttcgcatggcaggggatttacaccattttatgaggcactctgccactcgatcagaaaaaaataattttgtgcaacacttgcttgttaatggatgtggtggtgcctttttgcacccaacacatgttttcagaaactttgagaggttctctggaaccacctatgaatgcaaggcagcttatccatcctatgatgagtctactgggattgcattgggtaacatattgaagttccgcaaaaagaattggcagtttgacatcattggcggttttatatacttcattttggtgttttcaatgttcccacagtgtaatcttgttcgtatcttaaatgaagaaacttggtctgggcgtctgaaaagcttctcaggcacaatatggagtgctttgctttatatttttgagcactcttatgtctcttcagtaggaagtcttactttattgacggcgtcatattcattcgtaccatccaaactatcaaggaggagaagagctattataggcggcctccatgttttggcccatttaactgcagcactacttttaatgttgctgctggagttgggcattgaaatttgtattcgtaaccatttattggcaacttcaggttatcacactctgtatgaatggtatcgatccatggaaagtgagcattttccagatcctactggtcttcgtgctcgtttggagcaatggactctgggactgtatccagcatgtataaaatatcttatggcagcctttgacgtccctgaggtcatggctgtgacaagaataaatatatgcaagaacggaatgatgtctctttcgcggagtgttctgatcatgtactacacttctgtgtttatctatttctggattttctcgactccagttgtttctctcatatttggtagttacctatacatctgcgtcaattggttccacatacactttgatgaagccttctcgtcgctgcgcatcgcaaactacaaatccttcacaaggttccatgttaagaaggatggtgatctagaaatatttactcttgcagttgacaaggtcccaaaggactggaagttggatccgaggtgggaatcagagggacgagggcctcatcagctcagccatgaccggaagcatccaagcaagtggaggtcagcctcatcaactgaccctgtgagatctgtacgggttgttgatcatttcaccatcgaaagaacaagaaccccagatatggagccctcttcctgattgtgcagcccttactattacaaggagttgctactgctgctagaaaaattaacaataactagcttcaacacacagtattgtttttgtttccacatccagccaacttaggtggaccgaggtgatctgcccttgtcggcgtccccgctttactgacctcacctgcagcattgtaatctgtatagaaagaaaattcacctgctgcctattgcttgtattcaatcaaaggaactctaaaaaaagagtgttacagaagaatgttttgagaaagcaaagggatgcatcgattcatcatcatttaccaaagattgattctattctgttttacc

SEQ ID NO: 3931 - DNA, 763 bp, Zea mays
gggtttgtaaggaaaaaatcagacacatcggcggtgtccgaatccgcgtgagagccaccagtggttagggtagcggcactagggatccagccattggggcatcgaccgcagccgcagaagcttgacatgcggagcatggccgcaaggttcgcgcgctggccggctcaggcgcaagccacgttgccacgtagagcagggacctggcacgtttccccacggcatagcctctccctccatgtcctctacggcagcaccggatcaatggacctgatgcagcgacagcgaggaagggcccctgatgcagcgagaacgagaaggtcgggttcatcagcctcgtgtcacgctccctcagtgtaatcttgttcatatcttaaatgaagaaacttggtctgggcgtctgaaaagcttctcaggcacaatatggtgtgctttacctcaaattttttggcagtcttatgtctcttcagtaggaagtcttactttactgatggcgtcatattcattcaaaccatccaaactatcaaggatgagaagagccattattggtgtcctccatgttttggcacatttcactgcaactctacttttaatgttgttgctggagttgggcaccgaaatttgtattcgcgatcatttattgacaagttcaggtatgccatgccatttggtgcttcctaaattcttgtcataggtgatgtgtcaaaatccaagtgaaagctttattacagatacttttttttgtatgtcaaaaaaaaaaaaaaaa

SEQ ID NO: 3932 - DNA, 5191 bp, Zea mays
ctgcagggctgggcagcacaacagcatccacagatcagactgagcacagtaacgtccacgaacttgctgatcccttccccctgcgcaagtgacaatctcgttctcacctggagctggaggcatgtcgaacaacatggtctcttgcattgggtagcgtgcacgtttttgtaaaagatgtcatattccatttaaaaaattgagacacgcgacccaagaagcatttctttaatcgagacggtacggtgacttttggttggcccgctgaatttgatcggtcagaacctgtggctctctgctggagtgcactactagcttgatccgaagaacggaaaagtacacggcaatggcggcttctcttctgctgtattttgaccgtgctgattgctgaagaaagaaagaaagaaaagctcagctggtactctgtagtctgtactcctcccgatatgatgctcggttacaaagtacatcaaacacagagaagaccccttcggtcgaaggagaaaaatcagaggcgttggtcagcaacaatataactatttttccgatgattatagatcgcagtagatttactataaggtgtcgatctcccagcgacagacctccgctttacttgccaagttagtcgctttctttagaatttagatcacaaactcaacatgccccgaataacggaccagactcttcttcagtcgtcgcctcagctcctctccgtcttccaacttttctgctttaccgccctatataaccctcggtcggcaggccgcatgcaccaaccaacacaacacgaactagaactaggcgtggctcaccgttcgagatggccgcggcagtgactcgccgggtcggtctccacgtcgaggcgaccaatggcggcgccgacgacgagagcaggcgcaatagctcggcagctgaccactcgccagtggccaagcggatcaacgacgccgccgccaacgccaagcgcaacgacgtctgggtggccgcccaggagggagaaatgcctgcagctgcaggccgcccctgccggccgcccctgctgttccggaccatgaaggtcaagggcagcatcctgcacccttacaggttattctggccgtccagtgcaagactgtcctctccttctccttcctagcctaggtgccagtgtatggtttgcatcaatataatgaacaatgcatgctaactggacagaaagcttggcactactcatcagtcagacggtcatcacattgctattatatactataaaaactgactgcaactgaagctgtctctgacttcagaaaaatggcccacggcggcaagtttcagaaagtttgaaatgagttgacccgttttctgccaggtttgttattcttctgcggctggtcgccatcgtcgcattcttcatatggcgcatccggaaccggaaccgcgacggcgtgtggctctgggccatgtccatggtcggcgacgtctggttcggcttctcgtgggtcctcaaccagctcccgaagctgaaccccatcaagcgtgtcccggacctcgccgccatcagagaccagtacgagcagccttccgcctccggcggcgagtccaacaacaagctgcccggcatcgacgtcttcgtcaccaccgtcgaccccgtagacgagcccatactgtacacggtgaactccgtgctctccatcctcgccaccgactacccggtcgagaagtacgcctgctacctctcggacgacggcggcacgctggtccactacgaagcgatgctcgaggttgcgagtttcgccaggctatgggcgcccttctgccggaagcatagcgtcgagccgagagctccggagagctactttggagtgaagaggcgccaaccgtacacgggaagcgtgcagggagagttcacaagcgatcacaggcgcatgcgcagggaatacgaagagttcaaggtgaggatcgactctcttttcagcaccgtctgccaaagatctcaagcgtacaacagaaagcatgccaaggacgacgaagctggtatggtgatgaaggcgacgtggatggctgacggtacgcagtggcctgggacatggattgagcaagctgagaaccatagaaaaggacaccacgctggaattgttaaggcaaacattttcatcacctgactttatttttcttcattaaaatatatattcatcaaacaaaactgtgtgcatgtatgagataataataactaataacactatagtccatcaactcatgctttcgcacgagttaaaatgttagaacatataggtattatataacggcaaataatcatttcattttagattataagatattttatctcctctgtagactgatagacatattgtttctaccgtgcatctagatagatgcaggtctaagtatagcaaaaactatatatttacaaaaaaactcaaagcgtcttatattttcaaatataggaagtatacctcactaataaataattgcttatattaaatatgtttataacttttctctttgtaaaatttattacagcaagtattaagatgttgactaatggttttgttaggtgaacattttctaaatttcataagttgcaaaataaatgtttattctaatatatgtgtgtgttgtactttgtagatattgatatatttttctatacattgctacttaagtgagagattttttgattatttttttataatggctaagatatatatgtgtgtgtgtgtgttgggggggggggggtgcgcgcgcgtgtgggtgggtgtgtactatgacaatatcttacttatctttcacaatatatagcatatatggatatgttaaatgctaacatagaatggtgttgtgtattatcttttatagtggtaaagatgaacaatttgtaaaatcattaggaggtattttaaaatatatttcataattatatatgtgggtaatctagatacaaagatacactgatatttaaaattatcattcataatattaaagttggtaatctagacgcaatattagggtgctattataaattatattttataagggccaaggtaggtaatttatatgcatatttatgtagttattttttaacaataacatgtgcggctagcatatgtgggtaatttagattcaaaatcagacgttagtttttgtatttgtttggtaatgatagtgatgcttatttttttaataataaaataacaccttaaatggctattatcaattatgatggttagtctataaaattaaaggctaaatgtgtatgactattgtgagaacttataagatttatctttttccagtgcgagaatatatatagtaacgtgcacgtatgataaaaattaatgtggtatatatatttattaagttatatagttaataataataagataaggtgctctttaatttgacaggtcgtactaaaccatcccggccataaaccagagctcgggtcgccagcaagcatcgacaatccatttgacttcagcaacactgacacgcgcctccccatgctcgtctacatgtcccgcgagaagcgcaccggctacaaccaccagaagaaagccggcgccatgaacgcgatgctccgggtgtccgccttgctctccaacgcgccgttcctcatcaacttcgactgcgaccactacgtcaacaactcgcaggctttccgcgccagcatgtgcttcatgctggacccacgcgacggccggaacacggctttcgtccagttcccgcagcgcttcgacggcgtggacccgacggaccggtacgcgaaccacaaccgcgtcttcttcgacggcaccatgctctccctcaacggcctgcaggggccttcctacctcggcaccggaaccatgttccgccgtgccgcgctgtacggcatggagccaccgcggtggagagcggctggcagcgtcaaggtgatagacgacgacgacgaccacaagggcaaggagtacggcagatcgacattgttcagaaacgcagtactagacgacgccgcgaaccaagaacgatctatcacgccagtgtccctcgatgacgacgagacgacgacggtcagcagcgaggtggcgtcgctgatgacgtgcgcttacgaggacgggacaacatgggggagagacgtcgggtgggtgtacaacatcgcgacggaggacgtggtgaccgggttccgcatgcaccggcagggctggcgctccatgtactgctccgtggagccggccgcgttccgcggcaccgctccgatcaacctcaccgagcggctcctccaggtgctccgctggtccggcggctccctcgagatgttcttctcccacagcaacgcgttcctcgccggcgctcggatgcacccgctgcagcgcgtggcgtacctgaacatgtccacctacccggtcgtcaccgtcttcatcctggcctacaacctgtttcccctgatgtggctcgtctccgagcggtactacatccagagacccttcggcacgtacgtcctgtacctcgtggcgaccatcgccatgatccacgtgatcggcatgttcgaggtgaggtgggcgggcatcacgctgctggactggtgccgcaacgagcagttctacatgatcggcgcgaccggggtgtacccgacggcggtgctgtacatggcgctgaagctcgtcacggggaagggcatccacttcaggctcacgtcgaagcagacggaggcctgctccggcggtgacaagttcgccgacctgtacgtcgtgaggtgggtgccgttgctggtcccgaccatcgcggttctggccgtgaacgtcgcggcggtgggcgtggcggtaggcaaggccgcgacctgggggctgctcacgcggcaggcgcagcacgcgctgcttgggatggtgttcaacgtgtggatccttgtgcttctgtacccgtttgcgctcggcgtcatgggacggtgggggaagagacctgccatcctgttcggtgtgctggtgatggccattggtgcggtcgctgtcgtgtacatcagcttccgtgccacgtactacccaacaggatggtcagaaatggaaactacttctgctcttggtaaggcggaatcattcttttaatgcactactctatacttggtgtaataatttggatgtcttcagatcatcagatgtgatcttggcttaagggggtgctgtatccatccaatgtttgatgttgattggaaattttcgag

SEQ ID NO: 3933 - DNA, 1764 bp, Zea mays
agtctttctgcagggctctactactaaatcgggtcttattcggttattttcattatacatggattggatgatattagaaaaaaatagaagaactttaacttgtttgtgaattgtgatttaaactcacccaatctcactcaatccatatagattaagagctacccgaaccagccctgacgactatatagggggttaccctcgtatccattgtccctatactctagtagaaatgtacaagtacaactcaaatctttgagtgtatatttacatgtcgcagctcgacctatagctgttcctgtgcgcaagaaatcaccgattttttttttttttttcatccaagaagaaaaagaacaaactgtttcaatctgagtatacatcaaaaatgaaaaagaagaaactgtttcaatctgtacaccgtctactgatctagctaggcatgcatggtcaccgtggcaggccggagcaaagggtactgcagcgcaaggtgttcctctttcagtgggaagacgaggcagagcatggtgaggagcagcgccagcagcaggcaggccaggccgacgacggcgtacccgcggccgaggaagccgttcctgcctcccagcacgccggccgtggacagcaccagcgccttcttcccgccgaagctgtaggtgttgtagttattctgcgtcgtcaccgtgaccagctcgccggcgcggaggtccgcctcgatcctgccgtacagcttccggaacgtcggcagagccgcggtccgcatccacacgatcaggtcttcttgctcactcagaggtattcttggatcaagcgtgcctcctccgatcagagctcctttctggaaattcctcgggaacacctgcttcccgaagatgtgttccctctcgctcctccacgagatgcctcgcttgtggaccctcagcgccctgttgttgccccgggcgaagctgtaggtgtcgttgaacaggctccaggccacgagcccgcaggggacgacggcgctcccgtgctcggtggtagcttcgggcttgcagtactgctgcgtgctgttggcctccttgggatctctcagctgcttgtcgctgcggctcttcacgtacctcctgtggttctggtagaacttgtcaagctggtaatatacgtagattgggtgcttcatatccctaggaaccttgagaatccatgtgcatgtcttatctatagatgggttttggatataggcgactttgttgccaagcatgtgtcttggtatgcatgaagtctcatactcatagaccacttcaaccaccctgtttgaggctgcaatgcagccaaggccaatcacgataaaaactacgcccacaaacaggagtacagggatgaccgtctgaggcgcaagtataggcttgcaagctggaagctgttgctgagtaaacggatgatactgaggcctgttgctgttgcgcttcttcacgctggctgccgggtcatcctggctggagctcggtccggctgtatcgccatgcgtcggcaccattgctgtccctggcaaagactccagccctgcaagctggaagagcttggtggtgctcccaaagcggaaaatcgtcgggaccaaacagatgggggatatactagtttcagagaaaaaagcttcagcaggagagtacggaatggaggcgaggcattaatcaggtttgggtttgggagtagagacgaagcaaggaactaaaaggatgagagacatcacaacctgtccttgagagcctctaggaaaccagaaaggtaagc

SEQ ID NO: 3934 - DNA, 2493 bp, Zea mays
gcacgagaccattacctagaacatcctaatcgaaaaactcagcacacacatcagatcgccacatctccgacaccaacccacctccctcctccccctctcgccgtcggccccgcccgtcagcctcggccgagtgcgtctgcctcgcactcccgcggcccctatagacagagcagccgctctagagcgggaggaaaggcgagcagaggagacagagatggggaagggaggaggagaagaggacggcgcggcggcggccgcgcgcgcggcggagcaggcgcgggagctgcaggacgcggcggctgcgctgctgacgcagacgcgggcggaggaggaggcgctgcgccgccgcgccgccgcgctgcagggggagctgcggcggctacgcgaggccgccgcggcgcacgcggacagcgacaaggttgaggaggacttggatcgagcagcgtgcctcatcgctgaaggtgacgttgcgtcgctgctcccgagcaagacgcaaggcgcttttctgaaaatgttcttgggaccagtaaatttgcgggcaacaaggaaggaggtgcagctcaaggtgaaggaggagtacaatagctacagggacagaactgccttgctgtttctttgttttccggtgattttgttgtttcttcgacaatggttatggaatggatgttttccagtattgccagttcagctataccaggcttggttattattcctgtataccagtttagctttgcgtgagaacatactgcgagttaatggaagtgatattcgtccttggtggatacttcatcactactgtgccatgctgatgtctcttgtaagtctcacatgggagataaaggggcaacctaattgtgcacgcaagcagagaggcgtggaacttttcctttgctgggccataatgcaaggatttgtcatgatgctgcagaatagatatcagcgtcaaagattatatactaggattgctttggggaaggctaaaagaatggatgttgtatggggagagactgctggtgttgaaggtcaattgttgctgttgtgccctctccttttcctcctgcagggattcgagggttatgttgggtttttacttctgcgcacagctcatactggcgttgtccctgagtggcaggttgtggtatgcgggatcctgctgatcgcgatggcaatcggtaactttgcaaacacagtggacaccctggtaaccaagtcccggttcaaggcgaagatgaagaaatccaagggcagacgggacctcgacacatgcccctcgccaacaggttcatcatcgccgatagattcagcgaccaccaaagcatgaacaaggccaagaggaaaaggtgcccgtgtttaacccgggtgtgttaccactgtaaagcattttagtgtttttttttcttggccgtcagctcgtaatcctgtccgtcgtctgtgtcgaagctcatactcgtgtaatcaatcatcaggcaagtaggctgctgatggttctaggctggaggtggccgagaataaacttgtggtgtttgtttatatacctgtaccctgaatgaacatcgagtgggctagggtggtgggcttaggactatgtaaggcttagcaaaattttccaagtatagttgtgagacaggcaggcatttgtcacaatgaatgaaacatgcgaagttgtatacacgttgtggcaatgtgttgctttgtatgttggttggtgcatgcttacgttgctctgaaataaaaaaaaaaaaaaaaattaaatgatggtgaagaaaaccagtagcaggttagaagatgcatggtactagcagcaggatgaggggtgacaatagggctagatgggtggatgccatggcagggaaggacgctgtggttgatcaccggctaacggctgacgagttagcatgggagaaagtttgggggataggataacatcacaaatacggcagctggaggaaggcaggtgtcacacccgaatttgccctttgccctgatttaagagtaaatctcatatgtgcgataattaaagattcgcacatacaatgacttacattcacatatacaatgactcaatacgctaattaaagattcacacattcaatgactaagaaatagataattcatcctcaatttaagttataacttgattagaggttgtttttagtcagagtataattatagaatcaaaatattacatcaattatatttagaaaagctaatcccataaccataggctatataaatatctacttataagaatatgtgttatcctatagataatgttgttactgcgtaataaatatatttatgaagtcaaatcggagttaaaacgtaggagttatgaatttcctaatgttctagaattatttttatattataaatgattatcaaccctatttacctatttcttttatctgtaaatggacgacggtgctgcagtgttttcacgtcgccggtgagcaaatcgccgcaccacggtcaccctcttagctcggctaacaa

SEQ ID NO: 3935 - DNA, 685 bp, Zea mays
  misc_feature (683)..(683): n is a, c, g, or t
aattcccataccatactggaactggaaggcagaagcgcccgcacaggcacagcactactcgaagcaagaactatagcagctgctgctcctcctgtacaccaagcgtacgtgcaaatacaatggccaccaaaagcatcgcctcgctgctcgccgtggccctgctgctgctgctgctctcctccccggccgccgtcgtcgtcgtccgcgcgcagcagcagcagcggggcaacccgtgcccgacgaacgcggtggcggacctcaaggtgtgcgccgacgtgctggtcctgctcaagctcaagatcaacgtgccgccgagccagcggtgctgcccgctgctgggcagcctcgtcaacctcgacctggccgcctgcctgtgcgccaccatcaggctcaacgtgctcggcatccccgtcaacctgccgctcgacgtgcccctcgtgctcaactactgcggccggaacgcgtccgccgtgccgggctccaactgttccttctgaggcatgttcgatcgatcgatcggcaaccccgctccaattgtaggttggttggttggttatatgcgggccgggtactgtaacagcagctgcttggaaataaaaagcgtgtaatgaccttactcaacatcatggcaagtacaatttctgaatgctaccaacgagaaaaaaaaaaaagggccctagggncc

SEQ ID NO: 3936 - DNA, 4449 bp, Zea mays
tgcagaccctcttaccactagcgttaggtatgaaacaggagagcatgccatatagagtagtacattggctcatcacatcacagctaacgaattagatgggttggttttgtttgtatgcagctagcgaatgaattaacacacacgcataacagagacgagcctgctgccttctggtggatgggtcgtcggtgacgatcagcgccacggaaaaagagcgggggaaaagcagcaggaggagcacaaaaaataaggctacacacacagagagacagacagacagaacagcgcaggcccacttttccatgctttattgccctctctccttccttcactgggctccctggctgaggcagtgtgggtcccacctgagctgagccctcactcatcatcatcatcactcactgatatcatccctgtctccgtctcagcttcactttctctttctctcccacgccggcccacaccctcccctcccctcctctcctctcctcgccgccgtctcctccttcgccttcgctagctgattcccgtcaccatcaagcctcagctccccggcctcccactatctccgcgtcgccgtcccagtcactgtcccacgcgcccagcaccatccatccgtccgcaagggggaaagcacgctagctgagctgagctgctgagagagagagaggcaaaccctagcacgcacaagcacagcgacgtatacgcttccttccccccgccgattcatccatccatcgcagcgcgcaccgggcggggcgggccgggacgacgacagctaagctagcacatcgcaatagcatagcatctatctccgccgcagtacccaccaccaccaccaccaccatgatcttcccccctgccttcctgcaggcttcctcgagctggaacgattaccaggtaatccttcctcaaacatctctctatcgcgatttgcatcttcggtcttttctttcttccttccttcctttctttctttccccaaagatctctcttttgaacaagctagcagcacacgaataatcaaaaggcggccggatcgaagaaagttgcagtgcatcctgctgcgcgagacgtatatattatctatctgcgacaggactaatatagctcaaaagaagagaatactctctacctagggcttgcttgctatcctgatccaacgtcacactgatactatatactcatcgactgctgctagtatatactagctgcgcagtttgaacgacgaattgaaatcttcagctttttatttattattgattgactcgatcgtatatcttcctgttccacccatctcctatctattgatgctttattcatttccttttctcatctttaccctggttcgattttgcagcaccagcagcagcagcaccaccaccagcagcaaggccacggccacctgcagattgccgtcagcggcagcggcgacgccaatcatgagctcctccagcaaccaatcatggggggagcgcttcccgatggaggaggaggaggtggtggcggggggcaggttgggggccccgccaagcccatgtccatggcggagcgcgcgcgcctcgcgaggatcccgctgccggagccggggctcaagtgcccgcgctgcgactcaaccaacaccaagttctgctacttcaacaactactccctcacccagccgcgccacttctgccgggcctgccgccgctactggacgcgcggcggcgcgctccgcaacgtgccggtcggcggcggataccgccgccacgccaagcgcgccaagcccaagcagcagcagcagcagcacgcggccgccgggaccggggctgccaccgccgcgttgcagcagcctcccgctgggtccatggcgtcgtcggccgccgcgtgcaccgcgaccacgacggatggcgaccaacgcgctccacgccgggcccggcggcggcatgctgcccatgctgccgccgctgctgcgcctagccgacttcgacgcaatgagcctcggctccagcttctccggcatatcgtccatggggaagcccggctccatcggcgcggcctgctacccgcactcggtcggcgggctggagcagtggagggtgcagcagatgcagagcttcccgttcttgcatgcgatggaccagggcccgctggggccacctctggccatggcgatggcggcgccaggagggatgttccagctaggtctagacaccaccagtgataacagccgtggcggtggcggcggcggagaagacgggtcgtctgccggagaggcgctccatatgatgcaagccaccaagagggagagctaccccgcggcaccaagagccatgtacggcgaccaacaacacaatcacctggctgctgctggtggctacacttcctattccaccaatgctgctgcaggtaaccatctcttgtaatggccggccgatcgatcgatcgagagctcaacaattcaagtgtcctgctatagctagctactacgacgtcgtgctacgatcgtatcggttcgtttcctacaaatatagcctagagatagagtgtctctgtctgtgtgatcgatggtattgttatgatcatatagaaaagaccagtagcatgcatgcacttgttgcaatgtttgctttcaagaagaaactctggagggaggagaggctcggtttggatgctgatcatgcgcaaatattactagtgtctacagctgctacttcattatagctgctagcatggtcacttgttttatgtttcttcttctgctgcttttttatctgatccctttgttagggtttactactactatcgatcatttgtggtcaagtaatgtgtactggtgtacgttcatcattttgttaacgaaaacacctatcatatatatgtcaattattcaaccccaccctaactttatatttatatataattatctctctatgcatattcacgtgcatggacagagttgttattcatttgactgtaaatgggaggagttttgcatgatgggtgaatctgagcaatggtgcaactgtgcatggattagctaatcatgacaaataaatcacttagatgcgtatgctcattaatctgaccatcatgtactatatggaggtatcataggccggcggagaaatatatatttaggcctagttatggtaacccctttttccgagtgattttcattttctcgagaaaaattagtttagaaaatcccttaagaaattgagttgtcaatctagcccttagtgagaagaaatgaagcgcgcatataatcatcaatttcatgcgtgcacatgatgtcagtatatatagaatttaattaggtgtttgacgagcatgcaatatactactagtgcctgtcagtaatttacggacattttagccttttagcgtgcattgctcttgttttttttaccttttactttaacatctttttactgtgctggcatgcacgtcctaaagcaagctcgacgaaatccaaggtcttttgtgttcaacgaagaccatctagcttgatgagctctgcagtcagcactgcacacatctaggtagagagagagaaaagaggaatgagtcagagatcctcatgcatctgactagacatagccttgtagcagctgttcttacttgcaaataattacatatatatgcacaaaatgctgacaataataaatgaatctatacacatacgatatatagctaggcatgtagaattaagctagcagagtagaccggtgcccccgcccgcgcatatttaagtagtgtcatgaactagtataattactctaatcgccacgcatataattagcatcttatactatatagcttatgcatgtaaagacaagatagatgctcatgatgcatggcactgctggcatagaataaagcaaaggggaaggggggtactgaaaaagaaggagaattgttcatgagtttgggatggatctggtagcagataccatatgatatgatatgatatgacacgtaagccacagccaggtagctaggggcgcgcatgtatcgatgcgtgtggatgatcttggaatgattcgagggcatatatctattcctatatctatatatggaggagcgagaaggacgacgatggatgccgacgacggccggccggtgaactgaaaatgcttgcatgctgcatgcccagcaggatagatcgatcatgatagatgatcagtgtgtgtgtgtggtttacaagttgcatagaagtttgagatggaacaaacacagagatagcagtagcaggaagattgtgcttagatcgaagcaatatatgcagagtgtgcaaacggtgttcccgagagcacgaggccggccgtccggcagaggtgcaggtacggacgtagaggaaagcgaaaggaagcgaggcagcaaagcaataagcagggtacggcatagaggggagagagagagagagacggccgggactagctaggagcatcatcagctattcagggg

SEQ ID NO: 3937 - DNA, 1514 bp, Zea mays
gatactctctacctagggcttgcttgctatcctgatccaacgtcacactgatactatatactcatcgactgctgctagtatatactagctgcgcagtttgaacgacgaattgaaatcttcagctttttatttattattgattgactcgatccaccagcagcagcagcaccaccaccagcagcaaggccacggccacctgcagattgccgtcagcggcagcggcgacgccaatcatgagctcctccagcaaccaatcatggggggagcgcttcccgatggaggaggaggaggtggtggcggggggcaggttgggggccccgccaagcccatgtccatggcggagcgcgcgcgcctcgcgaggatcccgctgccggagccggggctcaagtgcccgcgctgcgactcaaccaacaccaagttctgctacttcaacaactactccctcacccagccgcgccacttctgccgggcctgccgccgctactggacgcgcggcggcgcgctccgcaacgtgccggtcggcggcggataccgccgccacgccaagcgcgccaagcccaagcagcagcagcagcagcacgcggccgccgggaccggagctgccaacggcgcgatgcagcagcctcccgctgggtctatggcgtcgtcggccgccgcctgcaccgcgaccacgacgatgacgaccaacgcgctggacgccgggcccggcggcatgctgcccatgctgccgccgctcgtccgcctagcagacttcgacgcaatgagcctcggctccagcttctccgggatatcgtccatggggaagcccggatccatcggcgcggcctgctacccgcactctgtcggcgggctggagcagtggagggtgcagcagatgcagagcttcccgttcttgcatgcgatggaccagggcccgctggggccacctctggccatggcgatggcggcgccaggagggatgttccagctaggtctagacaccaccagtgataacagccgtggcggtggcggcggcggctgcggcgaagacgggtcgtctgcgggagaggcgctccatatgatgcaagcagccaccaagagggagagctacccggcaccaccaagagccatgtacggcgaccaacaccacaatcacctcgctgctgctggtggctacacttcctattccaccaatgctgctgcaggtaaccatctcttgtaatggccggccgatcgatcgatcgagagctcaacaattcaagtgtcctgctatagctagctactacgacgtcgtgctacgatcgtatcggtttcggttcgttcctacaaatatagcctagagatagagtgtctctgtctgtgtgatcgatggtattgttatgatcatatagaaaagaccagtgtagcatgcatgcacttgttgcaatgtttgctttcaagaagaaactggagggaggagaggctcggtttggatgctgatcatgcacaaatattactagtgtctacagctgctacttcattataaaaaaaaaaaa

SEQ ID NO: 3938 - DNA, 1021 bp, Zea mays
gcgcaagatagtagtacactgaaaaacaacgaagagcgagagcctctccgccatggcgtcgaacaacctcctcgtcgacttgaagcgctgcttctcggcgccgtcgctccgttcctacctcgccgagttcatctccaccttcctcttcgtgttcaccgccgtcggctcagccatctccgcccggatgctggcgacgccggacgttaccagcagcgccgggcccctggtggccaccgccgtcgcgcaggcgttcgggctcttcgccgcggtgctcatcgccgccgacgtctccggcggccacgtcaaccctgccgtcacgttcgcgtacgccatcggcggccgcatcggcgtcccgagcgccatgttctactgggcgtcgcaactgctcggcgccaccttcgcctgcctctccctcaacctcttctccgccggcgaggaggtgccgacgacgaggatcgcggtggcgatgaccgggttcggcggcgcggtgctggagggcgtgctcacgttcctgctggtgtacacggtgcacgtggtcggcgagcgcgagcctcggtcgcgcggcggcgacggcaagcgggagttcgcggccacggcgctgggcgcgctggcggttgggctcacgcagggcgcgttcgtgctggccgcgggcgcgctgacgggcgcgtccatgaacccggcccgctcgttcggcccggccgtcgtcagcggccacttcaagaaccaggccgtgtactgggccggcccgatggtcggcgccgccgtcgccgcgctggtgtaccagatcatggcgtgcccgagcgtgacggggaacgtggaggcggtggtcgtttgacaagctagtgtgcaactgtgctgtgcatccattcgttgtggttgtgaatgagtcgagggatctaaatgtgtgtgtgtgtgtgagagagagagagagagagatcatgatgacattgtgtgtgtaattagtttgtccagtgggctttcagttccgtcgcgttgctgtacttaaatagcttgttgtacg

SEQ ID NO: 3939 - DNA, 876 bp, Zea mays
tcgagtcacattcggcccccccgtcccccccctcaccaagaaagaaaaacagacacacgtcactgttcgccttgtccggtcgtttctgctccattcctcctcctgcaagccgcaaaggaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgtagtgtgcctgtccttgctgccaacaatatttttgagagtgagatggccaagtttcagggaatgttgaaccggtcattgagggtctgtcaagataagtttgaagctgccaatctccagaagttgaaatcagatgcaactcgggaactggaatcctgtgtcaacagatctattgatgacagcctcagggtccttccgcatgtggtggatcagatcaagtccaccctcaaaatcaattagaggcactattacttttagcaaatgaaccagatatagttgagaatgtttcatattcacattcgctgcataactccacattttcagagctcttaccgatattgatagaacatgatcaccctatcgtagttttttggattctgctcttaccacctagtcctggcatgtcaacagcgtcgacattttgaactctactgagaacacagcttaggcattgaaaggctggatgaacttgttgtgctacatgtacaagaatactcttacgtcttgtgattttttgaaaaaaaaaaaaaaaaaataaataaaaaaaaaa

SEQ ID NO: 3940 - DNA, 972 bp, Zea mays
gtccggtcgtttctgctccattcctcctcctgcaagccgcaaagtaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgtagtgtgcctgtccttgctgccaacaatatttttgagagtgagatggccaagtttcaggtacttctaacttctaatttcctgcgttacaagtatcatttttcccaaatagaacgtagtatcaggcttttctttgttcgtttttttagtaacttaatccctttgtggctttgtgcttgtgttgaaattatgattgactatcttttgatgcagtgaagttaattgtttcttagctgtaactttttactacagaatctttctgactttaagttactaaaatttgatttatgtcctccattttgctctgattttattgatgtttgcagcaactctaatgctgtgtgtaaatggactattttccaagtgtatgcatgatagtttcaatgttgttcagtcaccagccctaatacctcaacaatcatgatgtatgttgttggttcgctgtgatggtgtacttgtttcatgcaatcaaccatgtatgcaatcacttgtcatatggaagtcctattcctagaagataatttaggattaataagcagcatatttgttgctatagttatttttgttcgatgaatatgctttaatggtctcaatggtacaagtaggagttttataaggttctcccctgcagcaatttagtttttgcttcatccttatgtacattgtacttctgacatacaatctgagaaccttccttcactacaaaaaaaaaaaaaaaa

SEQ ID NO: 3941 - DNA, 915 bp, Zea mays
cgctcccccagtaagtttttttttctgctccgtttgtcctccaactatttggccgctggggcccgggtgccccgccgccatttgtcctccaactatttcgccgcaaaggcctctagaagcaatcaggcgagcggcggctgcggcgcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaattgtggtatgcctgtccttgctgtcaacaatgtttttgagagtgagatggccaagtttcaggaacggttgaaccggtcattgatggtctgtcaagataagtttgaagctgccaagctccagaagatgaaaacagatgcaactcaggaactggaatcctgtgtcaacagatctatcgatgacagcatcagggccctcccatatgtggtgcagcagatgaagtccaccctcaatatcaattagaggcattattacctttagcatatgaaccagatatagtttgataatgtttcatattcacattcaaggcataagtctacattttcagtggaaaaacccttagaactatgcagagctcttaccgatatcgattgtttcgtagttttttgaattctgctcttaccagcgtcgacattttgaattctgctgagatcacagcttaggcattggaaggctggatgaacttgttctgctacatgtaccacaatatcttttatgtctcgtgatttttcacgttaaaaaaaaaaaaaagcgccctagcttttgccgtagaagaataaactgtgcggggagcatttggtg

SEQ ID NO: 3942 - DNA, 1578 bp, Zea mays
ttggggtaccccccggagggcccgccgcccaggttattcattccctttcctcccgtctcccactcgagcgagccaccgccgccaacgttcccgccttctatcccttaaccctagccgccgccgccgccgcttaaaccctcgctgcggaaactacagcaacccccgccggcgatggtgaaggagaataagcggaagcagcctcctgccgacgcggcgccgcctccgggcgacgagggtgaggggaggagcgggcggaagggcaagaaggccaggaaggagaaggcggaggcgatactgccgtcgcagatcaagaacaaggacaagcgccgcgaggtgcacgccaagcttaagcgagagaagaaggcccagaagcgcgcgctcgcccgcgagcgcggccaggccgcccgccgcgccgaagagctcggcgagcagccgccggagaggcaggtgccccgcacgatcgagaacaccagggagcccgatgagactgtgtgccggcccgacgaccaggagctgtttgcaggaaatgatgcggatgaattcagtgcagttctaaagcagcacataaccccgaaaatattgattacgacatgccgcttcaattcagggaggggacctgcatttattgatgagttaatgcaagtgataccgaattctcagtatgtgaaaagaggaacatatgaactcaagaaaattgtggaatatgcaaataacagggatttcacgtcacttgttgttgtccacacaaatcgaagggaacctgatgctctacttatcatcgggttacctgatggccctactgcacatttcaaactctccaaacttgttcttcggaaggacatcaagaaccacggcaatcctacgagccataaaccagagctagtactgaacaatttcactacacgccttggtcatcgtgttggaaggatgatccagtctctcttccctcaagatcccaatttccgcgggcgccgtgttgtgaccttccacaaccagcgagactacatatttttccgccatcacaggtacatcttcgagacaaaagaaaagaaggttgcttcgaaggaaaagacatctggaagcaaaagcggatctgagaagcagcaagtgatttgtcggcttcaggaatgtgggcctcgcttcaccctcaagctgctcaccttgcagcatgggaccttcgacacgaggagcggggagtacgagtgggttcacaagccggatatggatacgagcaggcggagattcttcttgtgatgccccaactccatcctgcggaacttcttttcttaaaaaaaaactttgacccctgttttgctgaagcagttttgtggaaccatcagtgagcagcaagtgatacggacttttatttttattttttattgttctggtttcggcgccagtgcgttgaacaccaaaaccaaaagtgccggatgctccgatcctaaggcctgaacagtctatgcctccgtgatcagattaactcagatgattatccttatcttgtatgtggttatatatctaattgtggttatccatttaattatgtggatttgttaaaaaaaaaaaaaaaaagcggcc

SEQ ID NO: 3943 - DNA, 1932 bp, Zea mays
ttttggcagcacttatcaaacagtacagttcatatacattatattgaacataagaagattggctagaatcttctaattctttacatggagtgaaaagcccgtcaaacgggcttagtcattgggagagaaactaatgataaattgtacataattctgttaaacagaaagtaaatggacataaggcagaaagtatggcactatctatcagctccagaagccccaggaaatatgaaggcaggtagatatagcactagcatttcaggtacacacatgtccatgtaatgatgcacacacaacctagctaaagggttcctcctcgaaattgttgtccctttgttcgtcttatgaataaatgcatcttgtttccaacatcatcaattcacctattttcaactagcatctttctctttccaacaacattgaatatctatctgcaaatgacatcctcagcgatcaaaagaattgttacttcatggcccaagcatacatgataagctgatttttacttggaaagaatcttcagaacaactaatttgatgtgaaagaactgtttaagttctttttgccaaatttacgccaacctattctaccatccaaaatcaaaattattgagtgattctgctgctccagccaatatttccacagatctcaatatttctctccctacaagttaactgtgggcaacgaaactacccttctcgcctttatacttgatgaatttcaacatataaaccaccattgggctaaagttctaggtggtagatgctaagagtgacactggtccaccttttccagtcctcaaaatgatatgaaggtagcagcaattggctcttctaaaaactcacaattgaaggggccccctcttcgagagttaaaaggctgctacaatcttgtaagagaagccaccatctcaatctaagggcaacacatgtccaacagtgatgttgaacatatattcttattgaggacaaaatagtcctcacaaggcatatagatccactggatcagctctcccatttaccacagtagattcaccacttaacactgaataaactaatcaaagagcccaaattttgcccattggtttgacctttaacgagagcttgattttggcacatcaagatgtcaaataagaaaagaaactcccaatttttagttcagtgttcaaatagtacctgcaatgtcattaatagaacaattcaaatttttgaagtaataaatgcaaatatctgaaaaaaactgagagctagataattctctagaagaacttccaaagttcagttggacaatggaagagctacagagaaggaaataggcatatcaggctatggactctaagggaagaaagaaaaacataaatgtatattttttctaaaaaaggagtaaatgtagtacccaatgaattaaggttctcatcatgagttaagacttaagagcttactcaccgccacaatgtaactacaatattctgaaactatcactaacctgagtacctgaattcattgaaacaacaatacctcacccaacctaaagcccgtgattgccccaaactggagtcaaacaaataacagaatcaattcatgtccccaaagattgaactccaactataataatccttatatctgctttcaaggaagtgactattgcagaggccagatctcactaaacctgcattcccataagaaatattggtttttgtgccatttataataaaacataatattgtatatatagtctttaaataccaataaagatacctgaagatgcagaagacatgtcggtgttcgaatttcatgcattaccatcaaagcaaaggacaacagtgttgtaccatttaacagattcagtacttctgcttctaaagcaaaaccgagtgtagaacttatgtgttctttgtccaaggaatttagatattttcaaacagatgccggc

SEQ ID NO: 3944 - DNA, 4213 bp, Zea mays
tgtccccggcagcccggactgctggcctccactctttctttctttctatcacacttttccccacctagcaatcaactcccacgcgcacaaagtgccgaacgcccaacccccattatattatataatatctatctagcactacgagcgagccaaacattcgctcaattccttccttcctcgtcgcctcacactcgtctcgccaccaaacacgcagcggcagcttgctcaccccgctggttcggccgccctccaccacttctcaagcttgctggaagcgtccgtcctgcctgcgtattggctaggctaggtaactggttctatctcctcgtgttcctccctatttctcggccctgctctctttgcccgggctctgtggtgctgctcttggatttcaaggtttccacaagttccttccttgccgccatattcggccgtggcccgtgggcgggggatccccagacttgggttacttgtctctatggatcttgcggtgtccggttatttttttttagttcgggatttaggttactgtttatgcagaggtacgtggtcttcttactttaggcaaaaacaaaattctaatctgcggctgatatagcgctaggctttacgcactttgtatacctgaacggcttaatttagccctttctttctttctttcgtcggagcaagtgatcgatctggagcgtcagttgctgctctttttccttccccttgctctgatttctttctttttcttctgcaaatttactacttcctcctgacacaaaatgttgctactttactatcttacttttgcgagtcgtgaggaaatagatgctacctgataattacgtatcttggaaggattattagtgttctttctcctagtcattccagtacatgtgttatatttccctttgaggtgtcagggtttacatatccgccctgagtcagcctatagctgtccacctttatttatgtatatatactgatccttttctctgaaggataggaactaacttggatttcttctctgttcttacggcaggatctgcatacgcctttttcagtgaagaaccaagactgaaagaccgctgtcccgaccacccagcaatttgccagattctttcttgccccaaaacccccagagagaaaacagaaaagacccaatgttctgctaagctggagatgttcctagagccaggcagccatcttctcgcgtagcaaagctgctgtgaattagagtagagggccttttgagacaccaacaaccagatggcacacccagcctcgtcaggcatcctcggatgcgtcacactgctctgcatcttctcatccgccgctgcggttggcagcaacgccaccggctctggccagatacgcttggactgtggggcatcaagctcgacgagcacagacgctgatggccggagttgggacagcgacgccagctccaagttcgcgccttcactgaatggagtcgcagccactgcttcatcccaggacccttcgctgccatcccctacgccttacatgactgctcgcgtcttcacctcaaactacacctactcctttcctgttactcctggccgcatgttcgtgcgcctctacttctatcccaccatctatggcggtaaccatgctcctgcagatgcttacttcggcgtcacagcagccaacctgacccttttacagagcttcaacgcctcccaaacctctctatcacttggtgttgccttctttgtccgtgagtactccgtaaacgtcactgaaggcagcctagacctcactttctctccatccacacaccacaatggctcgtacgcgttcatcaacgggatcgagatcgtgcccacgcctgacctcttcacgacaccgacaccaacactatccaatgggggcaacccggatccgttccctattcttgctggaacggggttcgaaacaatgtaccggcttaacgttggaggccaggccatctcaccaggaggagatactggcttctatcgttcatgggttactgacgtcccttacatatatgctgctggttttggggtggcttttgggaaagacaacaatcttaccatcagctacacacccactgtgccaaactacactgcaccggttgatgtctatgcaactgctcgctctatgggaccaaatgcccagatcaacctgaactacaatctcacatggattctacccgttgatgccgggttctactacctcctgaggttccatttctgtgagatccagtatccgatcacaaaggtcaaccagaggtcgttcttcatctacatcaacaaccagacagcgcagcaggagatggatgtcatcgcgttcagcggaggaatcggcaggacggtgtacacggactacgtcaccgtcacggctggttctggtcagacgtccctatgggttgccctccacccggatcttacgacgaggcccgagtacttcgacgcaatactcaacggcctggaggtcttcaagctgcagaattacggaaacaacagtcttaatgggctcaaccctccccttccatctgttcagcctaacaacgggaatggggagcctagtgtgagacggaaaggtgctgcgccggcaccggcagccattgctggagctgttggtggttttgctgtgctactcattgctgcctttggtgcgtgcatcgtctgcagaagaaagaaggcagcaaataaggagtctaggaaacccgatgacggccactggactcctctcactgactacagcaagtcacggtcgaacacctcagcgaagacagcgaccacagggagccgtacatcaacgttgccatccaatctgtgccgccatttctcgtttggcgagatccaggcggccaccaagaacttcgaccaagcctctctcctcggtaaaggcggctttggaaacgtgtaccttggagagatagacagtggcacgatggtggcgatcaagcgcgggaacccgacgtctgagcagggcgtccacgagttccagacggagatcgagatgctgtcgaagctccggcaccggcacctcgtgtcgctgatcgggtactgcgacgacatgaatgagctgattctagtgtacgactacatggcgaacgggactctgagggagcacctgtacaacaccaagagggcggcgctgtcctggaagaagcggctggagatatgcatcggcgcggcgcgggggctgcactacctgcacacaggcgcgaagcacaccatcatacacagggacgtgaagaccaccaacatcctgctggacgacaagctggtcgccaaggtttccgacttcgggctgtccaagacgggtcccaacaacgtcgacaacacccacgtgagcacggtcgtgaagggcagcttcgggtacctcgacccggagtacttccggcggcagcagctgacggagaagtcggacgtctactcgttcggggtcgtgctgttggaggtcctgtgcgcgcggcccgccctgagcccctcgctccccaaggagcaggtgagcctggccgactgggcgctgcactgccagaggaagggcgtgctcgggcagatcatcgacccgcacctgcaggggcaggtctccccgcagtgcttcctcaagttcgcggagaccgcggagaagtgcgtggcggaccgcagcgtcgacaggccgtccatggccgacgtgctctggaacctcgagttcgcgctgcagctgcaggggagcgcggaggacagcggcagcgtcgtcgtcgtcaccgacggaacgacgtcgtcgtcctcgaacaggtcgtcgccgcttatcgtctccgggcttcactcggacgagccgccgacggacagtacgaccaccaccaccaccacgtcgtcgacgacgactttgagcatgatgggacggagcctcgccagcgtggagtcggacgagctgaccccgagcagcgtcttctcgcagctcatgcatccaggtggcagatgaaaacggaaagtacaactggagtagatatcgtctgatcgatgtgctatatatatgtttctagttcatgctatatatatatatgtgggcaactagtatagttatgctccatacatattcatcatatagttcatcctatatattagtatgtattgtgctagagccctctgaattatatatcttaaacatgtacctgagctatgttctcacttcttcaaggccgatctgtaatgtttgcgtctacaagcaatgagaatgaggtgtcact

SEQ ID NO: 3945 - DNA, 1108 bp, Zea mays
  misc_feature (1063)..(1064): n is a, c, g, or t
  misc_feature (1067)..(1067): n is a, c, g, or t
  misc_feature (1069)..(1074): n is a, c, g, or t
  misc_feature (1076)..(1076): n is a, c, g, or t
  misc_feature (1083)..(1084): n is a, c, g, or t
  misc_feature (1089)..(1089): n is a, c, g, or t
cattgggacctcgaggccggccggggacagagcgccacgaggcgagcagtcgagtgttccctagagtccccgttcctccgccgccgcctgcaaccgcttcacgtgccctgatccatcgcaggtcccctttctgaccccaaatggagccgaagaagtcctctgctcagcaccagccccacgccatggaacccaagaagtcctctccacgcggcgccggggccgtcgccgccaccgccactgaagccgagtccccgttgagcagcttgttctacccgccggcgcccgcggcaaatgggaaagatcaggagttgtacagcattatttacaaagggcagagcgggagcgcacaagctggcgcgacaggtaatggtaaaccgcaatgggctccttccaaaagtcataccgcgtacgcaaaggacggtaaacattcaccaccttatgatacgtcatgttttgggtcatctgtgcattatggtggtcgagattatttctacggcagctctacaaccaagaaagcgacagaatcctccactgactacaaaggggacaagaaagatccagtcgcagattctcatggcgactggtggcaaggctcattttattactaagagaacctggtggcctctccttggagaacaaggaacagaaggagggcagtgaagctcggtttccttgattgctagcagtattatcttgtgtcatagtggacccgctttcgtccagcggtggtgccaatatttagaagcatcacctggcctgggcagatgtagtgtgcgtcttatagtctctgctttagatgtgcaatgtaacgaagctttagcacagtatgaactagaccgcataaaagaatccatgtccattccgccagtaatacgagcgggttggtatctgactccttagagtcaaaagtctgtacaattgtatcgtcgctccaaagcaaaaaaaaaacaataataatgtgctggagaagcggcgatgacttcacattgtacacctttaccagctggaatttgacagaagtttggaaactgttcttgtcaattgcaccgtacagtgttatcannaanannnnnnanaggaaannaaaanggaaaaaaaaaaaaaaaaa

SEQ ID NO: 3946 - DNA, 1946 bp, Zea mays
gcacgagaccattacctagaacatcctaatcgcgggaggagcttcatccaacagcccaagtgtccctgctacccccactggatcagcaagctagctacccagtggagagccacagccgaagccgaagccgaagctagagctagcaagcaatggctgcggcggctcctcctgcgcgtcctactagcagcatcagcagctgctgctgctgcatctcgcggcgcgccgccgccgtcgtgccggcgctgctgctgctggcggcgatggccgcctcctccggcgacgcgcagccttccccggggtactacccgagctccaggttcaggccggtgccgttcaaccgggcgtacaccaacaagtggggcccgcagcaccagacgctctccggcgaccattccgccctcaccatctggctcgacaagacctgcgggagtggtttcaagtcgaagcacgcgtacaggaacggctacttctccactcgcatcaagctccccgccggatacaccgcgggcaccaacaccgccttctatctctccaacaacgaggcgcaccctggtttccacgacgagatcgacatggagttcctgggcaccatcccgggggagccctacacgctgcagacgaacgtgtacgtgcgcggcagcggcgacgggcgcatcgtggggcgggagatgcggttccacctgtggttcgaccccacggcggcctaccacacctacgccatcctgtggaaccccgacgccatcaccttcttcgtggacgacgtgcccgtccgccgctacgagcgccgcaccgagctcaccttcccggaccgccccatgtgggtctacggctccatctgggacgcctccgactgggccaccgacgacggccgccaccgcgccgactaccgctaccagcccttcgtcgcgcgcctcgaccgcttcgtcgtcgccggctgctccgccagcgccccgcccgcgtgcaggcccgtgccggcgtcccccgcgggggccgggctcacgccgcggcagtacgcggccatgcgctgggcgcagcagggccacatggtctactactactgcaacgacttccgcagggaccactcgctcacgcccgagtgctagcgagcgtgcctgtctgctgtgttgcgtcgtcgtcgtcgtccttgttgctttgtgctttgtttcgttgttgatgaaaaggtcgctaggcgtggctgccctactaccgcccgcgcccgccgctgctctctctgcttgcggtgactgaggcgcccgcgcgagccggtggttgaggcgttggtcgttggcttatcgccagcaaactcgtgtcgtcgctcgtctacgtacgcgtacggcgtacccattgcatttcttccggttgttgctttccatttggtctcgcatgcatcacacgaggcgccccaaaggggcaagcttccatgattcatacggatacactatgtataccatatatacatattatatatatatttaatacatgtttcctgtcggtgaggatatacatggttgttgtaatgcaatttttaccttacaatcgatttgctgctgcttttactttgctgccggtcggttgccaacagagtacagacactttcatatggctggagctgttgattttctccagctagactattgtcaccatctccgtgggccaggggtgaaaaggaaaaacaacaaggctgcgtttacgtgcagacattgacaataccagtgtccagtgccactagctgcaggacactcgggtcgatgtagggcctatcctctaggactgccatgatgcaaccatgacatcacaagagaagacaactaaatacaggggcggatgcacgcccagggacacccgggcatcggctcggggcctggcccaactagctacattaggcccatataggaaatgaatagtttttttcctgtgaactccattctctccgtgttctgtccgca

SEQ ID NO: 3947 - DNA, 3537 bp, Zea mays
ctgcaggccctgctccactgttgctttgcagacaagcttcgcctcgggcaccgcgtgctttatcgcctggccacaaagcaaggaatccaaagcaaaggcaacggccaagttcgcagccagggttacagccaaaccacacggcgatccgccgatactattatcccaaaaccacaacacaagaacgggaagcgtgcatgcacacgcacgagcacgaacctgagctgtagcgccctctcgctcgctccccgcgcgcaatggccagcgtagccccaggtcccatgcaaaccagccatgcctcacggcggccgatccctacagctacaggccccgtgcccgtggccgtgcttctcgccgccgccgccgtcggcctcctcgcgctgctgccgtcgctggccgaggccgtgtgggaggtgccgcacctcttcctcctcggcgccgtcatctccttcggcgtcttcacgcagaggaacagcgacgccgacggccgcgccaaggacagctcacaggcgtggagcgcggtgtgccaccccgatgcccccctcgtcgtgatcgcggatcacacggcgccgagcgacgacgacgacaacgacgactacgggctggaactggaagaaggcgcacgagagacgccgctttcgttgccggtgcggaggctgaagcctgcgcctgcgcctgtggcgcaggagtccgaaaccgccggcggccatgccagcgatggtttcggtgaggagacgacggatagccgtgctgcgtctccgtcttcggggtttagggccggcacgcgcgccgtcccttcgccgccgccctctgctcttgacgacgacgacgaccggggcgtttctcagcctgcacggccgctcttcagaaaggccagcaccgactgggatgtggacgccgccgccgacgacgggtcgtccgacgagatgacacccgtgtcgtcagaaaggtcgtcggtccgtgccgacttcgccgcttgtgccagtggctatagcgatagcgacagcgatggcgacggcacgcctgtggatttgaagctggcggagaaggcggaggcgggcggggaggaggaagtggaccggaaggccgacgagttcatcgccaagttcaggcagcagatcaggctccagaggcactagctgggcggccatgcatggcgtggcgtgtgcatgctctgctgagtcctgagctgagcatgcaccgacacacaaattacaaataccactgctggtgctggtccagcacgaagggagaacgcagcagtagtttgttcatctacgtctatgacaccagcatgtttcctgtatcattttgctgtttttttttttggttgttgctccggtttcaacaaggagccggaaacatgttttctgtatcgttttaggtctttgttcggttaatcctattacctatgaattggatgagattggaaaaattaagaaagaactttgacttgtttggaatttaaaaacactcaatctcactcctcccacatggattgagagctaaccaaacaagttcctactgttttttttcttcgacagggagtcggaccggaaacatggtctagaattctagatgaatgcatattgagcactgctcttttgttttcccagtgcatttctatagatttctctcatgtctggcagttggccacttgggatcgagttgggaggagaggagttaggatgaacagcattcctgtcgtcctgcaggaagggaaaaaaaaactttgcgatttcgctggagacgacggtccgcacgacatgcacaagcacaaaacacggctcgtcggagttttctgatgcttgcatgcatgcagcgatgcaggagatcaaatgaaatgaataaagtttccgaggaaaatcccagcaaacgctacgcaccaaccaaacacagaaaatgacctgtccaggccaggcgtggtggctccaaggcttgttgtgtaccggcaagcatcgtcgctgtgcatggacgcacgtacgtacgtattctcgagcaacgcacgcggtggctgtgtgtatccacttgtgtatgctcgtgtagccgtcgtgctttagaagagcgtgaccttccaacagcagcgtgcctaacacatggagctagcgcttaccgagaaacagctgggacacatccatactttcgtcacactgagcatggaagtggtggttacgaatgcggggatggagcctgttccacgagattagacgtacgtacgtacgtatgcaatcaccgaatcacccatgacccatctgcgcagaccagacccccccccccccgacgtagtacgccgcgatgggaataggataccttccgtccgcccgtcccgtcccgacccggcacgcacgccctacccccaaccccaactgccggtgcgccaccagccaccgtgtcggtcccccgggctgccaaatttctaacggaagaaaagcggcaaaaaagctcagcgagatgtgtggccactgcacacctgctctagtccttaagcagttaagctaatctccaaagggaaaaggccaagcccctcgaaaagaaaaggtggccaacaaagaacaataggaagcaggaagctaccctctctctctctctccccgcacgtcagtctcatcagtcgcacccacagcagtgataaaaggctcgagacgaggcgacaagaatctctcgaggccggccgggctctcacaagaacacctctgctctgcccgtatcctccttgctagctccttgccttgccttgcctttgccttccctccgcgcgaggagaagagccagcggacggacggagcacaggaaagccggacggacggacggagccggacgcgcgagatggagatggcgggggcggccgaagcggacacgccgtcgcaggagccggtgcgcacgggccggagcaacaccatcctgctccccatcggcggcatcctcctggcctacctgctctaccgcttcctccgcccgcgcctccgcggcctgcgcctcgacctgcccgcctggctgcgctgccgccgcgcgccgaccggcgggggcgccgtgctgccctacttcgcgcccatcgccgaccgcctcggcgccgtcgcgctgccgtacctcggcgccttcgccggcccgcaggcggcgctcctcaggttccccggcggggaggcgctgtcggtggccgccatcctcgaggcgcccggggaggtcgtcgccaagtccgcgcacagcacgctgtaccgcgccgccgtgcgctccggggaggccgccgtgctgctgaggttcgtgcgccccgcgtgcgccgacgaggccttcgccgccgccgccgcgcggcggatcggcgccgtccgccaccccaacctcgtgccgctccgcgcggtgtacgtcggccccaggggcgagaagctgctcgtctaccccttctacgccgccggctcgctccaacgcttcttgcaaggtcggttgattttgcacattattcttggcttcttcttttttagttcaagcgttgcatttcaaagcgttgccctctctctcgcctgcatttgcagttcaagcgcttcttct

SEQ ID NO: 3948 - DNA, 1790 bp, Zea mays
  misc_feature (1717)..(1717): n is a, c, g, or t
  misc_feature (1768)..(1768): n is a, c, g, or t
gagcccggtaccctgaagcgcttgttcgagcaaactaatatccaagcatttagcggggctgcgtggtacgcggacgccccccattttagactatacttgagctccaattgcccaactgatattagttttgcagtattgttttgcagattcctgagatacctaccaacccctgatctccaattgcccaattgatccccatttgagttattactagttgttgattccaattccattacatgtttgccctaactagatattcccttttccgtgcagttttccacttgcctggcaaaagaacatttgacttggaagagcaaacactggaagctttgtggtttgtcctaagtgatcctatcaagttctcataggctgcatactggtacagcattttctcctgtgttttgggccacagaagaggggggagccaaggatttttctatctcgtaagccgcggccttggtgctcatagttaccctagtctgtaagctggagattgtaaaaagccatatctgttcctctatcactgtatatagagatctacataatggacgagcggtcgactggtctgttggtccgcctccgaatcgggaggcagttaggccaaggaaacttcgccaaggtatactttgctcggaacctgaccgacgggcagtccgttgcgataaagatgatcgataaggacaagatcacgagggttgggctaatagtgcagataaagagggagatctctataatgaggctggtgaagcatccgaatgtcctgcagctcttcgaggtaatggctagcaagagcaagatctacttcgtattggagtacgctaaaggcggcgagctgttcaacaaagtatcaaaggcgaagctcagcgaggatgccgcgaggaggtatttccaccagctggttaatgccgtggactactgccacagccgaggcgtctaccatcgcgacttgaagccggaaaacctactcctggacgagaacgagaaccttagagtctcggacttcggtctgagcgccctgtctgaatccagaaggcacgacggcctcctacataccacgtgtggaacccctgcctatgttgctcctgaagtgcttggtaggagaggctacgatggcaccaaggcggacatatggtcctgcggagtgattctcttcgtgctcgtggctggttacctgccgttccacgacccgaatctcatcgagatgtacaggaagatctccagagctgaatacagatgccctcgctccttctccggtgagctgaaggacctgcttttcagaatgctcgatccagatcccagtaccaggatatccatttcaaggatcaagagaagcacttggtacagaaaacctatcgaggcaaacgcggcaaagatcaagcacggcacagcaagagacaccaccgtgcgcgacggtgaagccgccacggcctcgagctcgatagagtgcagtaaccggccagaggaagaccaagggtcgtcaagcctccctaacctgaacgcattcgacatcatttctctctcgaccgggtttgacctatctaacctgttcgaagaaagacacgggcggagggaggagaggttcaccaccaggcagccagtgggagcggtgtttggtaggctgaaggagctggctgaagcggttgaagctgaaaaattccagaaagaaagagaagcggggtctttaaacttggcttgcgcagaaggaaagggattgaanggggttccttggaagctcgacgccgaagttttcgagcttgccccttcgttncttctggtcgagctgaagaaag

SEQ ID NO: 3949 - DNA, 2673 bp, Zea mays
ggtacccttggtttcttgcccgagggtagggtgctaaattagtcaagcaagtaagtaatatggtgatgctggtattatgaaaatggaaagaaaaaccgctctattgctttgtcttcgtcctgccgtttgttaggtacccactagtgatttggctgctctctctccgcgcgcttaaggcttttatccctttatttttggaatgcgccagttttgagtgtggtacgtggggtatcactcttatctctactcctgccgtttctcttcccttcaattaaaatatcaaagtcatacagctataatactgccctacttgaataagtttctgcaagtcgtggtagtgggatcgtgtgcttccttcagagcattttcgcagcggtggatcctgtaatgccttttggtctacgatgcacctgtgcgttactgagacccgtccttgttttgagctcaagtcaatccttatacacacgcaactgcaaatttctaacatgcagtatattcgtatatgaaactctgtttctctagaagaaaggttaagagaaagaggtggcatgaacgttgtatacttgaccacattttggttgtctttagggtgactccagcttggaaggaagtcacaagcaagacatcaattttggttttaagattatatactgtataccataccagataccaccaatcaattttgcagtaacatttctttgtatcctatggtttgcttgtttcaggacgaaaagcttcaagacatacttggccattttcagaaggacttcgaaggaggcgtttctgcagataatctaggtgtggatatgtgaacagttgctgtaccagcttgattttgtttcattctagataagcattaagcagaacttaaatctttgacagggtcaaaatttggtgcatatggttcatttttgcctacgtaccagcgctctcctcttcctcaaactagaagtccccctaaggcaggaaatattacctcaaaatctccctttcaccagtcgaatgaggtgcctaagtttcttttggctgtgatcatttactgtcgtagagcagtgttatcatgaacatgcgctcgtttggcattgatgatgtaatggtttgtaatgtaggacttgtctcagaaacctccagctgtggcagtttcatctaccccccaaagtaatggtcctgtggtgcctttttctggtgattcaattaaaaaggaaatacgcccatccacaaagtctgaaaggggttccgtctcccatgattcatatgggccatcaaaatgtagtgaccaaaacagacttaaagtccggataaaggttggctctgataatgttttggcaagaaataatgcagctatctacagtggcctgggccttgatatttcttcaccttcatcaaacgaggatagccctgatggccgtgggagcctgtcccctgaagttaacaatgtgccacatgaatctccacaaaccattcttcaggtaaaatattcatggtacaacacaactacacaaggtctttatacttccattcaactgtccatagtaaagaggtttgatggcaagtttcatttcaatggccgaacagatcatgacatgcttttcagttcctggaggcttcctgttatcccctctaccagccaatatcttgcagttgacaaaaaaggtcgtgtcttcatcaaagaagtgggaatcaaatgtggatgtagaaaatgtacaagaatcatatgaaggccatgtggctaaaaaggtgaaatctgatggtaacaaaaagaggctgatagacgcaaaaaattcaaagaacaaaaatgatattagtgcagttatgaaaaaggagattgatatggaattagttgctggtcaaaagatagtatctgaagctctcaaaatatcattgctgtctgaccccagagctatggatgcaaaaggtgagaatcgtcttgaagaggagccagcagaaaacaacttggttggaattagagatgctcgattgaaagagcggtgcaccaagactgactccatgacagtcaaagtggaacctgccaaagcagaggcgatggaatgtttagagaacagtagttttggcagttcggaaatggatctttcagcagtgaaagggaaatcaaaacccaagacagaaaagggtgaggcaactttagaagataggaatacaactaatgacaaagacctaatatcagataggaagcaaaaaaagaaaataaaatctgggagtaaatataatgcctctaactttgaaggtagcattagcaatgttataaacgaaggagcttcagctgttttccacatgggaaaaatttctggtctagaagctttgccttatgacacaaatggggaaaataattccaagagtgaggtcaaaaaaatgcagagagaacaaaaggccaatgtttcgacgtcttctgatttcctggaggaggagaaacacattcattcttctgctgcagttaaggagagaagtgacatgcaatcaaaacctatccatactggaaagaaacccaaagcaaaatcacatagagatgttagggacaacaattttcctgaaggatcttatggaagcaaggaacaggattcattgggagaataaagtgcctttggagatccccggccaaaggaaaaaccatggaagtttgacagcgaggactctgatgcacctgggatctcgaga

SEQ ID NO: 3950 - DNA, 1680 bp, Zea mays
ccggcccgatagtaacataccactcggagtcgcgcagccagatatagctcgctctgggagaggttaatggcggctagtcttcagctcgccattttcatgtccgccgccatcgcgctcgggttcgccggcgtccaggccggcgcggcgcagctgtgcagcgagtactacgaccggacgtgccccgtcgtgcaccgggtcgtgcggcgggtgctgaagaaggcgcacgagtccgacgtccgcatctacgccagcctcacccgcctccacttccacgactgcttcgtgcaaggctgcgacggctccatcctgctggacaacagctccagcatcgtgtcggagaagttcgccacgcccaacaacaactcggcgcgcgggtaccccgttgtcgacgccgtcaaggcggcgctggaggaggtctgtccaggcgtcgtctctgtgctgacatactggccatcgccgctaagatctcggtccagctgtccggcgggccacggtggcgcatgcccctcggccggcgcgacggcaccaccgccaacatcaccgccgccaacaacctcccaagccccttcgacaacctcaccacgctccagcagaagttcggagccgtcggcctggacgacaccgaccttgtcgccctctcaggggcgcatacgttcgggcgcgtgcagtgccggttcgtgacggcgcggctgtacaacttcagcggcacgaaccggccagacccgacgctggacagggggtaccgggcgttcctctccctgcggtgcccgagggccggcggcaacgcgtcggcgctcaacgacctcgacccggccacgccggacaccttcgacagcgactactacaccagcatcgaggcgcgccgcgggacgctgcagtccgaccaggagctgctgtcgacgccctccgcgcccacggcgccgatcgtccaccgcttcgccggcagccagaaggagttcttcaggagcttcgccaggtccatgatcagcatggggagcatccaggtgctgacggggagccagggtgagatcaggaagaactgtagagtggtcaatggaagctagactcgtcgaagacgcaagtagtagcttttgtaatgtggtgtgtgcctaagttactggtgaattgaaattgaaagcacttctgctatgtacgatgctgcaaacatgtacgtgtagacgtgtagtttgagtgcatgatgcaccgatgcatttgtttatgtcaaaaggtgattcaataaagtggtgtctgaatttttgtacaaaaaaaaaaaaaaaacactaatctcactacattggctgcagcctgcaggttgagggcgaagatctcatgcagcaagccctgctgccagttagtcctgcaagatgggccgtgccgtgctggcccggcacgagcccgtcgtgcttcgggcttcaaagtgtcgggccgggtcggcacgaattacttccgggccgggccttatcgtgcctatacactaaaatggaggcccagcacggcactaaagcccgccgtgcttgaatcgggccgtgcttttttaggcccggcacgcaattaaaaataaaaacagttcatattacattaaaagctcacagtccatattaacagcaatgaacacaaatatgaacaacttgtagagtggagactggaactggaactgcgcacagctctgtgtagcagtgt

SEQ ID NO: 3951 - DNA, 1327 bp, Zea mays
cattgggtacctcgagtcggggccggccgggagtcacatgctagcgtgcgtgtgcgtgtgcaacggctataccacctgcgcgacccaccgcgagcgcccgcagctaagctagctctcgctcgcgcgctctgggagaggagagatcaatggcgtcccgtggcagcatgacctgtagtcttcagctcgccgtcctcgtttccgccgccatcgcgctcgggttcggcgtccgggccggcgaggcgcagctgtccagcgagtactacggccagacgtgccccgtcgtgcaccgggtcgcgcggcgggtgctgaagaaggcgcacgaggccgacgtccgcatctacgccagcctcacccgcctccatttccacgactgcttcgtgcaaggctgcgacggctccatcctgctggacaacagctcgagcatcgtgtcggagaagttcgccacgcccaacaacaactcggcgcgcgggtaccccgtggtcgacgccgtcaaggcggcgctggaggaggcttgcccaggcgttgtctcctgcgctgacatactggccatcgccgccaagatctcggtcgaactgtccggcgggccaaggtggcgcgtgcctctcggccggcgcgacggcaccacggccaacatcaccgccgccaacaacctcccgagccccttcgacaacctcactacgctccagcagaagttcggcgccgtcggcctcgacgacaccgacctcgtcgcgctctcaggggcgcacacgttcgggcgcgtgcagtgccagttcgtgacggcgcggctgtacaacttcagcgggacgaaccggccggacccgacgctggacagggggtaccgggcgttcctctccctgcggtgcccgagggccggcaacgcgtcggcgctcaacgacctcgacccgaccacgccggacaccttcgacaacaattactacaccaacatcgaggcgcgccgtgggacgctgcagtccgaccaggagctgctgtcgacgcccggcgcgcccacggcgccgatcgtcggacggttcgccgccagccagaaggagttcttcaggagcttcgccaggtccatggtcaacatggggaacatccaggtgctgacggggagtcagggtgagatcaggaagaactgtaggatggtcaacggaagctagacccgtcgacggcacaagttactggtgaactgaaagcagttctgctgtatgtacgatgcctcaaacatgttgatgggataatggtgcgccgatcgatttatttgtcaaggagatccaataaattggttttttgcatttttttccccaaaaaaaaaaaaaaaaaagcggcc

SEQ ID NO: 3952 - DNA, 1999 bp, Zea mays
  misc_feature (1205)..(1205): n is a, c, g, or t
aatctaacttgttttgtagcaaaagtgcctccgacagcctcgtacacacccgtcggagataaggcggcagtcggatgtttgttagtttactgtagtgaatctaacttgttttgtagcaaaagtgcggatcctgtttacagaaaaagctgagaaaaggagatagaggtgagttcctgaattggattgcaatacctgataagctagccaggcggtacatggatgggctgatggatccaatcagacaaacagaacagtagacagaactagacaacaaaaaggacacggaacaagttggtcgattaaaacaacgaaacatacacagactgacagacaggtacatcaaactacattagctaattaagttggtctagctagctgctacccggcctgattacactatcaactacatacgtacagtaactactagctagtctagttggcatgcatgaaaatacatcagctgcagtacgcactacttccaaggtacagaaaacatgtacggtagctacctaggcggcataggacatgtacttggagatggctttggtgccctcagagatggcgtgcctgcccagctccccggggagcacgagcctgacggcgctctgcacctcgcgggaggtgagcgtcgccctgcccgtggccttggacaggcgcgccgcctcctccgcgaggcgctcgaacatgtcggccatcatcatgtccagcacctgcatggcgtgccccgacacgcccaggtccgggtgcacctgcttcagcacgcgccacacgtaccgcctgtaccctcccacgccgcccatcccggcgtcgcctccggagctggcctgccccagccgctgccgccgccgccgcggctgctgcgtcttcgtcttctttgttggtgttgctgctttcttcctcttctccgacgccacgcgcggagtctccggctgcttctcctcctcgtcctccagctcaaactccagctcctcgttggggtcctgcgtctcctggctctgcggcacgggtactgctgcagaatcctcctccggcggcggcttcccctcgttcccccccccgcccccgccaccaccaccaccaccaccacggcctcttttggcagtgacctcgacgacatgcaccaccgtggagccagagacgtccacggtggggtgcgccagggccagagcctccgggacctgctgcttctccgcctgcaacccatngtcgtcgtcggcgacgatgacctccacggtctcctgcactagtttggtcttcaccacggagcccaccaccttgtttccgcgccgcttgggagccatgcctacttgcctagcgtacctagctaccaatcagctcttgcaactactgcacagcacagttggcagcagtgaagaaacgagagaaacacggagagcttgcgacgatatgaagctgaggctccccgccagccgcacccttttatgcagaggacgggagggacacgtcagaggcggaccggtcgacacgttgctgcccgcagccctggaggggggcgacgtggtaatagcttggaccggccgcctggggctcagtgaacaggcagacgcgcgcggttgcgcagcactgcatggtcgtcgtgtcgtcctctcatgacgccttccctcgtggaggagacacacaggataaaagagcagggcgcgcgcagagggatcgagaagaccaccaggcttgaattttgactagaacaaggcagcgctctatcggtcgctacagtctgtcagtcaccttagtgcatttgtgcgactggcagatgttaccgagatgtaaatacgtatctgcggtagttaatagtataggtacaaaacataatatacatcaaagtctccaagtcgtatgaatagtttattcaacaacagttagttacagtagtaatggttaaagatcagccttcaaacaacaagtcggttggtgtacagtggttatctcaaaagcatagagtgtattatcgtctatgcaatttgccagtcaacttaatcac

SEQ ID NO: 3953 - DNA, 758 bp, Zea mays
cggccgggccggggatggagctgtgagctgagctgagctgagctcaccaccaccacacacgggagatagctatagctagcatagccagtcagcgacttagcagcagctagctagctagccatgctgccgtccttcgtgtcgccgacggcgagcgccgcggcctcggtgacgcctccgccgcggccgataccaggcagctacgggccgccggtgctgggcccgctgcgggaccggctcgactacttctggttccagagccaggacgagttcttccggaagcgcgcggcggcgcaccgcagcaccgtgttccgcaccaacatcccgcccaccttccccttcttcgtgggcgtcgacccgcgcgtggtcgccatcgtggacgccgccgccttcaccgcgctcttcgacccggacctcgtcgacaagcgcgacatcctcatcgggccctacaacccgggcgccggcttcaccggcgggacgcgcgtcggcgtgtacctcgacacgcaggaggaggagcacgcgcgcgtgaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctgggggaaacttc

SEQ ID NO: 3954 - DNA, 4348 bp, Zea mays
acgagccgcgttttccccttatgttccgtctcgcgccaacccatctgggctggaacacgcagcgacaattttactcgtcgatccagggacccccggggtcgaaacgtcgacatgggggtacccctaattacggtatccggcaaaggggttaagaaaacaacgatagatttttttgttttttaaataagacaagtgatcaaatttattaaaaaataaacgaatttttttttttttttttattacaacttaaatatgtgccgttttttcctagcaagtacaccttatcttgcagcattgtgataccactattttttaaaatgaaaacaaatatgaaaggtgtggaccaatgacatggctgcctagcatggtggcgctgtcctcgtcggcagaatatggcaacgtgccggctccttgttgcttgtgtatgctgcctagcttggatgtcccacacgttccacacgctggacacttgttgtagtcgctgtcacgctcttgcctcgctccttcccggctacattacataacggatcggaaggtgatgatccatcgatggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactcgttcccgctgccctccttcctcatctggccgggctactacgtgctctaccgcttcatcgagaagcacggcgccgaggccgtggcctacgccgaggcgcagcacggcatcggcaagaaggacgccatcaacaacatgctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaaggcaaagacggcgagttcgggttcgccaccgtccgcgagggcatgccgctggtgcggtcgacggtgtacgagatgctgcggatgcagccgcccgtgccgctgcagttcgggcgcgcgcgcagggacttcgtgctgcgctcccacggcggcgccgcgtaccaggtgtccgcgggcgaggtgctgtgcgggtaccagccgctggcgatgcgggaccccgaggtgttcgagcggcccgaggagttcgtgccggaacgcttcctcggcgacgacggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcacctccttcaccaagctcgtcaagcgccaggcgtcgccgagcgtggcgcaggcagcagccgccgccggagcgcagcagtgagtgcgctgtataggatccatcggtggcgtgcgacgtcgccggcgccggcgccggccaagcaataaagtaatgagtaggccctcctcgtcatccacatgctcgtctgtgttcgacttcgatcggtgtctcttcctcccggccggccgctggccgccaaacagccgttgtggtaataaaaaaatcacttgtggaattgcagagtgtaccgtggtcacacacacttgtacattgaattctttagtgatgctgcaatcaaattgaattaacatgtactcgctcctcgattgtcttgttgcttaattacctccgatcaaactaagaaaaactctgaacccttgacttaatttttcatggcttgtttcatttcttgttacgctaaggatagatcatgaagaaccaacaaaacccaatatttacagataaatcatagaaaccaccaaaatgacaggaagtcacacccaacgttcccgtctcagataaactgaatttttttaactcatacatttcttgacattttagctaagataaagtgatatattaaatatatttttatgagtattttgtgtcatatactagtactcatttacagtacacacagatagaaaatatctgaagcaagacacacgaggccgagtaagaacaaaaagaagaagagtatccatgcagcagctgattggatggcgctcgttcgtcgtctcttgcgattattggccacgtcaacactgggagggatggaggaacgcgtcgtcatgccattgccatgcgcacggacagtgactcagacgcgcgcgggaacacatgcatttatccgtctctgagcgaaatattagctccatttttttttgttcgtccacgaactgttagcagctggagtaaagttcttcgccatagcatcatcacccctaaacttcagtcttacagccatgcatgtgctaaacatcatgccggggattttgaaataatcggttcgctcactgatctatttttatgcatggatgcatgtgattgaagtgaactgtagagagagagagagagagagagagagggccgggatatgctagctcagcgacacacacacatactcgacaggggccatgtgtggagggggcccatttcagcggtgcctcacaaatatctcgcgatgcgaggtccaagttcacttggcacaacgctagctccctgtctccgtcgcaggcaacgcacatgcacatgtgaatagctcgtgctcatgcaagtgtccagaggcagccaaaaccatagggcaaaaaattttaaaaaaaggagaacagatgtatacatacatacagataactatgtgaaatcagaggagaacatcctcattttagagagagagaaaaaaaagggtaaaaatggctaggaatgggacagaagccatcctgccccccatatacctgattcagatttcgattgaaacgaacgttcggtctctgaagtcatcctgattcagatgttcactctctgaaacttggcagtcaaacactcaaacagatgcagaactcggacagttcttgcgcggctgtggaccaaaccactgaccagtgaggcagtgaccacatgctgctgcaagcggagaagccacggtctcgttgatcatggcactgcaaccgggcgcccttgctggttggcctccggatccggaccaccacccgccaccgccagtggctgacaccaacgccgctgtggtggctacgggccagtaatgggctccgctaaggaaggcccaacaataataaataggcttcgggccacgaccgaccgaacacgtagccgacacgcttcactttgtcactaccatccatctaggcatgcagatgcctcgagggagcgagctcaaaaaaaaaatatgtgtgcacattaaaataatagaattatttgaatatttaactgtttgcagtacaaagggtagttcagtctccggttataatagcatgttactttgatgctgcttatcaggggcggagcacccattatggcttactatggcttgagccatacctaaaatacatgtttggtgtagtggtaagttcatactacttgttattaacaggttctaggatcaagtcccatgtggtgcatcatgttttttctcttttttgttttttttcagcccatacctcgttattattttgtcctccgccactgctgcttatagt

SEQ ID NO: 3955 - DNA, 3390 bp, Zea mays
tttgccaagtgtaaaaaaagaaactctttgccaagtgtataaaataaaacattcggcaaagagtttttttgccgagtgttttttacccaggtctttgccgagtgttgaaaaaaaaacactcggcaaagaaactctttgccaagtgtaaaaaataaaacattcggcaaagagtttctttgccgagtgtttttttacccaggtctttgtcgagtgctgaaaaaaacacccgtaaaatcatttgacacttggtgaagagccaaatttcggttgtgggtaggtatgaacaatggtggtggtcattggtcaagcatgcagcaacaccgaatctcatcatgttaaaccgcgcaccgaggcaaaccatgctacttgtaggtaaataggcacagcatcatgcatggcttcatgaggtagctagctagctaggttttacaacttaaaagctactactgcttattactaatgagctagctatatagtatatatatgccggtgcatgtgcattgcatgcgaggggtcgtagcatgcagtctccagcagcagcgcctgtgcgcgccactgcccacggaagaatagaaaaaaaaaatttaccgcaccatcactctagtctcacctttattacgcagagttaattatgctgcgcgcatgctatacgattacgctgtacggctgtccgcagcaaccaggaatcgaatcatgcatgcatgtagatgtagccgagaatctctgcacgcacgcacgcacccgccggcggccgggccgggagctcgatcgatctcaccttcctgtagcatgcaccagtagtatctctagcagctagtctagtcgatcacccacctttgtaaagcagaccagaccagaccagagcaaagcaaagcatgcagcatatatgcagtggtcgttgtggtcagcaaaccaaaggctctctgttcgtttgcttcttcgcaatcgcaaaaggtgatcagtgtgagagctctgttgctcgagcagttgcccgtttggccgcctctggcctttggctgccatcgttttgttttaccgtggattgtcagggattaataattgtttagggatctagctaggatctttcatcacatgttcactacagtagtcagtactataggcttctatagcactagttttaatttccctcccctcctactagtactattgtactaacctctgctctgcagctttacctgcgtttttttttctcttattttttagctaggggggtgatgtagacttgtagagacaagcagttagacctgcagtgcttgtccaggaatcctgttctgcttttctgcgtcgctctgaaaaaaaacgctataaagatctcgcgcgatcacgtccggaactgtttacttctggctcttccgttgtcctactacactccgcctagcttgttgtgttgacagacacgcgcggttacatgataatataaaaaatatatactagatggcccgggaactccttaaggcccagtttgtttgggcttcccatctgggcttttgaaaagccgacacgcctcctcactttttactgcgacaaaacaaagcccacacaagcaacaaaagcaggccgcggcatgctttttgggcttttgcgggaagtagaacgacgaatccactctcaggccaccgtaggtccgtatcgctcctctccgattcccgcaccgcgttccccgccggacgcatttccgccgttccccaatctcctcccagcgatttcccttgccgaggtcgccttgccttgccgctgttcccgagcgcgacgccgcgccgcccctgccctgctaggctgctacagaggaggagaaccccagattttcccacccccccaatggcaacgcgcgcgccgccgcagtcttcttcgaccggatccgtgacggtgacgatcgacccgtccccctcgtcgtcgtcctcctccgccccgcccgcgtcggcgccggccccggccccggctcctgagtcggtggtgctgcgcctcaagcgccgggccaagaagaaggtgtcgtggaaggaggggacggtggacaacgagggcctcggccgcaagagctctaagaagtgctgcatattccacaaggaggtccccttcgacgaggactgcagcgacgacgaggcccccggcggcggcggcggccaccggtgccctcgccctcatggtgacgccggcgaggggaccagcggatgctcgtcttcttcccacgaccatggccaccactgatctccgtgcgtgttactcgttcttctctatcctccttaggtatcggaccacaatagatgcttatatgtttaattaatctggcatcatgtaattagttgagtgaatacaccaaatccgtgctctatggttgggagacacatgtttttatgggtacaattgttgtattggtgcttggcgagcaaacatggcaatcgttttgctgaattcaatgttgacacctatgttttgcttaatacgatttgaactttgaaaaaaaaaagcggcctggttgttattgctgccagtcattgtgcagacaatttttttgctgtagatcggagattcaatatttccgtagtttctgatgctaacttcttatcgtgtaagcttctttttatgcatgtttaatacccgtgttatgtcgttttgtaatttatgcagttttcagacttaattgctgaattttaggcattatattacttagtacctgtttactggaggtggggagcgcaatttctacgattgtttaccgagttgttcaatggatttttctgaattgcatgtaagaacattggtccagcatacccctaggcaaaagcctggttctgccactgccttccatgcccagcttggtccctttgccataccggcagaagggttcgttcaccacacagactgaaacacctgtgatgtggattatttaggttctaattattgatcaataaggcacaacaatgtgcacaggttactatcggctccctcaattctaaattataagacgttttagttttttagatacatactttttttaggttacactatgtctagatacgtagaaaaacaatatatttagaaaagccaaaaacttataatttggaacggagtgggtatttgatattggaactaattaattatagaacattagatggctatgatatgcttgctattctatttctagtactttttttggtctagtactccagtcacttttagttggttagcagcagtactgtgatatcctggaccaaggcttaataggattaataaaatacttataccaacatggtgtatcttctattccgaaagcttatcttgaaagaacctctgggttaagcgtgtagtgtgtttgacctagaacaatcttgtgatggatgaccgactgtgaagtcctctcatagtgcgcac

SEQ ID NO: 3956 - DNA, 2017 bp, Zea mays
cattgggtccattgggtacctcgaggccggccgggataacagcagtcagcagcagggttctttcttgtcacctggagctggacctgacgatggcataccatctcatctcttcaccactgttccttctcgcacaattgctcgccgtcgccgtccctctccttctgctcctgcttcaccaccgctcatcaattcgccgccgtcgtcgcagcagcagcagcagatcggccaagcagggaggacagctcctgccgccttcgcccccggcgctgcccatcatcggccaccttcacctcgtcagcgacctcccgcacgtctccctccgtgacctcgccgccaagcatggtggggacgacggcctgatgctgctccgtctcggcgctgttcccaccctcgtcgtgtcatcgccgcgggccgcggaggcgatcacgcgcacgcacgaccacgtgttcgcgtcgcggcccacgtccactctcagcgacgagatcctgtacgggtcctccgacatcgccttctccccctacggcgagcactggcggcaggccagaaagctggtcaccgcgcacctcttcaccgtcaagagagtgcactcgtaccgccgcgcccgcaaggaggaggtgcgcctggtggtagccaaggtgcgggaggcggcggtggcgggcacggccacggacatgagccttgccatgaacacgttcgccaacgatatcatcagccgcgccgtgtccggcaagttcttccgggcggagggccggaacaagctcttccgggagctggtggaggccaactctgctctgttcggagggttcaacctggaagactacttcccggggctggcgagggcgttaggtttccttagcagaaggctgttgtttctgcgcaacaggcggcgggtccaggagacgcacaggagatgggacgagctgctcgaaaccatactgagcgaccacgagggaagaaggggttctgtctctgtggacggtggtggtgacttcaccgacgtgttgctctcggttcagacagagtacggaatgaccagagatcatctcaaggccatcttggtggacatgttcggtgcgggcactgacacgtcatccttggtcctagagctcgccatggccgagctgatgcgcaacccacagcagatggccaagctacaagctcaagttcggaggcacacaccggaggggcaggaaacggtggaggaagagaacctatccgacatgccctacctgagagccgtggtgaaggagacgctgaggctgcacccacctgccccgctcctcgtccctcacctgtccctggcggactgcgtcgtcgatggctaccacgtcccctccggcacccgggtcatcgtcaacgcctgggctcttggcagagacccgggctcgtgggagaagccagaggagttcctgccggagaggttcatggacggcggcagcgctgctggcgtcgacatcaaggggaaccacttccacttcttgccgtttggagctggacgaaggatttgccctggcctcaactttgggatggctacggtcgagatcatgctagcaaacctcgtgtactgcttcgactggcagctgcccatgggcatggaggagaaggacgttgacatgacggaggtgtttggactcacggtgcatccaaaggagaagctcatgcttgttcccaagcttcctgctactgctgcacctactgcaactgctcgtcaactccatcctccaagctgctgacgatcgaaggaaaactgcatgcagcgggtgtagaggacgagcacgtacgtacgtacaatgcacatgccaatggtgaagtgaactacactctacagagatatagatggtttggagtttggattccatgtatatatatatctattattatactaggaaaagatgtccgagtgttgctatcgtacgggtcatgtaaactatgttaatcttatgtgtgtgtttacttatatagtaataaaaaaagctattttgtaaaaaaaaaaaaaaaaaaaggccgccaagcggcc

SEQ ID NO: 3957 - DNA, 3042 bp, Zea mays
cgggcgcggggcaagacgggagcgggcagagcatcgcggcgcgatcacaacaccactcggacgcggacgggggagtagcatggaggggacagcacggtggggtcccgcggaaatcgcacatgagccagcgcacgccggacgcggctcgcacaccagccgccacacgcgcggcatgcgcgaactgtggagggcggcggcaaaatgtgggcgcaacccggctgggactgaacgcggagcgggaagggataagcgacgaggggagggccaccgccccacgttgggggagagtcgcgcgcgtcgccccctgcgcgaggcgcgctaaccgggggggaaaaggaccccccccccccctctttccatcccggtaaatgataagcaaccttatccactaacggaatcaagtcatttttccttagtttcctgattgaaagaggcatgcccaagtatttgtaggggaaattctccactttacatgccataacttcttgtacctccgctaactcctcttccccacattggataggagtgaccgagctcttactaatgttagttaccaaccctgtagcatttctgaaaatacgcaaaagatcctttctcaaggccaattcatccgtcctagattgtagaaaaataacaacatcatcgacatataaggagatcctttggccatgacctctcctcaacaaaggttgcagataaccattcccactaccttacacaccatcgagtttagggcattcataaccataatgaatagcataggcgatagagggtcccctagcgtaatcctctctgatgtgaaataaggtcacctggctcgccgttaaccaacaccctagttgacgaactccttagcagcttggacaaaataccgcaccaaacagggcaaacccaaaaatctcaacacttcaagcaagaaaggccaagacagagtcaaaagccttcgtgatgtccagcttaagaagtatcctaggctccttctgcctgtgcaaagtcttagcagtctgctgcacaagaataaagttgtcatgaatgcaccgaccttttataaaagcactttgactgttggacactaaagaagggagctttccagccaatctgttagctaagagcttggacacaatctttgtgaagctatgtatcagacttatcggcctaaaatccttaatttccagagcatcaggagacttaggtaacaaggtaatgtaagctgaattgtgaaggaacagtctattaacatctccctgcataacccggcagacagcggccataaactccaccttaataaagtgccaaacagagttaaagaaccgcccagtaaatccatcagggcctggtgccttgtcaaaaggctgggattcgatagctgcccaaacctcttcttctgtaatgaactgctctaggttaagttgtcaatgaaatttcattcaggttgaggagttggagcaggaaaagcaggagctggagtttattgcagatatgtacgtgaaagaaagttctgagtctaggacaattgctgatattgaagaatcagaaacccgagctcgcaatcaggctgaatatttgaggagcaatctagaggagcatagtcttgagcttcgggttaaagcagcaaatgaagctgaagctgcatgccagcaaaggctttcctttgctgaagtggaactagaggagttaaggaccaaagtagatgcatctgaaagagatgttgtggaacttaaggaggcaataagaattaaagaggctgaaggagacgcctatatttctgatatcgaggttcgtttttttatttgtcagtactgtttttgggtatgagtaaaatgtatagtatttgcaatacagacagttggtcaagcatatgaagacatgcaaacgcaaaatcagcatcttcttcaacagcttactgatagagatgactttaacataaagctagtatcagatagtgtgaagatgaaacaagcttgtagttcccttctctctgacaagcttatgctagagaagcaactccagcaagttaacacttcactggagtcatctaaactgaaaattgcccgtggcgaagagcagatgaagacttgtgtagcgcaagctataaaaacttcagctgaaaacagacatcttactattagcctggaaaggattgcgctggaggtatccaacacagataaggaactcaagtggcttcggtcctccgttggatcctctgagaaagaatacgagcaaactcagcaaaagatatctgagctgagagcgttactggagcacgagaggagtgagaggcggcggcttgaagaacaatatgaagaggtgaaaaatgaagttatggagctgacctctgagactgaagagactactgtccggaaacttgaggatgaaataaaagaatgcaagggtattctcaagtgtggtgtatgctttgaccggcctaaagaggttgtgatcaccaaatgtttccacctattctgctctctatgcatccagagaaacctcgagattcgccaccgaaaatgtcctggctgtggaaccccattcggacaaaacgacgttagggaggtgaagatatgaacctcaccaaagtgacagtgacaaccgacttgcgtgtgaacagcagcaacaaactcccttgtgaatatcgtctgttatgttggcgaacatctagatctaacttcctttattactggaattaaaattaggataagaactggaagaagtgaagttcctaatttatttgctatcgtgtgtgctatgtatgattaccctttgggtagagtacccttggcagcgagtggtgtatctgctgggtgtcaatatgctcgaattctagctcctccctgctagcgggtgcatgccagttttattaaggctattccatgtacatggtgtcacactctttaatacataccacataggatgaaaaaaaaaaaaaaaaaaactcgagggggggcccggtacccaaaaaaaaaaaaaaaaaaaaggggggggccgttttaagggtccaaagtttacttccccgggcttgcaaggtaatagtttttttttggg

SEQ ID NO: 3958 - DNA, 1596 bp, Zea mays
gcacgagaccattacctagaacatcctaatcaaaacaagaatgagattcatgttatggctgcagcactctccaatgaactgggtatgatggagaatcagttgagtcgatcaaaggatgcagcttctgaagcacttgcattgcgtgagcaagctgaatcattaagatcattggtagctaaaaagattgaggaacacaagaagatttcggataaatacaactcacaagtaattgagatcaagtccctcaaggcattggacaattgctgatattgaagaatcagaaacccgagctcgcaatcaggctgaatatttgaggagcaatctagaggagcatagtcttgagcttcgggttaaagcagcaaatgaagctgaagctgcatgccagcaaaggctttcctttgctgaagtggaactagaagagttaaggaccaattagatgcatctgaaagagatgttgtggaacttaaggaggcaataagaattaaagaggctgaaggagacgcctatatttctgatatcgagacagttggtcaagcatatgaagacatgcaaacgcaaaatcagcatcttcttcaacagcttactgatagagatgactttaacataaagctagtatcagatagtgtgaagatgaaacaagcttgtagttcccttctctctgacaagcttatgctagagaagcaactccagcaagttaacacttcactggagtcatctaaactgaaaattgcccgtggcgaagagcagatgaagacttgtgtagcgcaagctataaaaacttcagctgaaaacagacatcttactattagcctggaaaggattgcgctggagttatccaacacagataaggaactcaagtggcttcggtcctccgttggatcctctgagaaagaatacgagcaaactcagcaaaagatatctgagctgagagcgttactggagcacgagaggagtgagaggcggcggcttgaagaacaatatgaagaggtgaaaaatgaagttatggagctgacctctgagactgaagagactactgtccggaaacttgaggatgaaataaaagaatgcaagggtattctcaagtgtggtgtatgctttgaccggcctaaagaggttgtgatcaccaaatgtttccacctattctgctcgctatgcatccagagaaacctcgagattcgccaccgaaaatgtcctggctgtggaaccccattcggacaaaacgacgttagggaggtgaagatatgaacctcaccaaagtgacagtgacaaaaccgacttgcgtgtgaacagcagcaacaaactcccttgtgaatatcgtctgttatgttggcgaacatctagatctaacttgctttattactgggattaaaattaggataagaactggaagaagtgaagttcctaatttatttgctatcgtgtgtgctatgtatgattacccttggcagcgagtggtgtatctgctgggtgtcaatatgctcgaattctagctcctccctgctagcgggtgcatgccagttttattaaggctattccatgtacatggtgtcacactctttaatacataccacataggatgaaaaaaaaaaaaaaaaa

SEQ ID NO: 3959 - DNA, 2694 bp, Zea mays
  misc_feature (1180)..(1180): n is a, c, g, or t
atatgaaagttatgatacaattttggtggttgttgatcgattaacaaaatatgctcacttcctggctttaaaacacccattcacggctgttcaagtggctcaactcctgttagatcatgtgattaagcttcatgggttgccctagtccatggtcagtgatcgtgataagatttttactagtactttttggactcatctgttcaagcttttaggcaccaagttgaatctgggtacgtcctatcacccacaaacggatggtcagagtgaaagagtaaaccagtgtgttgaaatgtatctacgctgctcaaccaaaaaaatggaaagcctggcttccgttggcagagttctggtacaacacattctttcacactactttggggtgttctcctttcaaagctttatatggatatgagcctccttttgctgcagcaccagtgctctctgcggatacaaaccaagatgtggctcagttgcttgatgacaggaatgccttttctagcatgctgcaagagcagttggctgctgcccgaaacatgatgaaaatgcaagctgatcgtgcacgcaatgaacgacaattctaggtgggggagatggttttactcagacttcaaccgtgtgcccggtcttcggttgtgaatcgaccgtgccctaagttagccttcaatttttttgggtcttacaaggttttggagaaggtgggcgaggtcgcatattgtctggagttacctactgatgcccagatacacccagtgttccacgtctcttccccactatgatgatttgtcctatcgcaatgtggttccactagaagtcttggatcgcacattggtgaagaaaggtaatcgtgccatttctcaagtgctcattcgttggagtcatctgtcgcacgattccacaacttgggaggacctacatgtggtgaagacttgttttcctcaagttgttgcttggggacaagcaacttctcgggaggaggcaactgtcatgcctggtgaccaaggaggagcagcatctatcgctgatggagcaaggactaaagtctgaaaatgggccatgtgcgttcgggtgtattccgaggaggatatcaaaattctgaatataaacatctaccaaatattctctcgttgtccatcctagcaacggtgaatactactgctcatgacccggcgatcgtgtcggnggccacaggctgtaacagcgcggggcgggcttcaaacactagttttattctaatccatcaggattggctgaattcttggaaattgcaaattgcaaattgccgaggacagatatcaccgtttctgcaaattttctgcccttaatgctcagctacctaggtggactcatgtttttaacccctgccaaatattgaaacataggttgttctgtcatctacagaagtggctttctcaatctttactcgctcgtgaaaaaaaaactggagggagccggcgtcggctggatgtgcacggaaatgtgctcgaacgacgacgtaaggaagaagaggatcatccgtcgatgttaaaacaattacgtggcagtgtataacaaattaaccgctagctgaaaatagaactcttttagaccctctctgtaacgcacgatttctaattgaaaataaaactcttcgaccctctctctgaaacgcacgatttcttctttttaggctctaaaataataattcatcgaaattaaattgaaacgcataagaatacatctattttctataaaaaaacaagaaaaacgggaaaaaatcatgcgttcttatatatggattttttttaaaaaaaactaacggcagagacgcgtacacggcgttcgatgaatggatggacgcccgccgcccagcaagcattgccattctagcttctctaccctggtaaatatctataactttggtcctacttgtcagctgtcagcgagtcagcgtatcccatgttgtaggctcattccattagctttctttccgctcccccagcccacgcgtccgcgccgccaccaactcacgcagcgtgcttcccttcagaaactcgatggcctgccacctcgccatcgccggcgccaccgccgccgccgcccgcgctcctcgtatctccgtgctcgccgccgcctctgcttcctccgcaggggaacccgcgcgccgcatcatccgccgccgcgcgccgccgggtcagcagggctctgccacagcggcccccgcgcctcccgcccagccgtccgtggcggaggtgcgccgcgccatcggcgtctccgacgacgctgcgtcggccgccgcatccatggagaagaagaacaccgcgttcatggacctcatctctaccacgcccatcggccagccggagagcgagcccgagcgccgcctccgcgaggccgccgagtgggtagtcgacaccactgagacgcgcgcttgcgaaggacagaagtctttcttagtgctatgcatgatgacatttcctgcttggttcttgctcctgttattcttgcccttggactcccacaatatttaagctaaagctgtaccatttgatattccggttctggataatctcctaatgtaaggtgttagctattatcatttttcccttttattttccaaatatacgagcttcacacactgaatatgaaaagaaatatatgccactactgaagtcacttcctccccttttttctaaaaaaaaaaaaaaaaaagcggcc

SEQ ID NO: 3960 - DNA, 787 bp, Zea mays
  misc_feature (21)..(21): n is a, c, g, or t
  misc_feature (785)..(785): n is a, c, g, or t
gactcctatagggcgattggngtcctcgaggccggccggggagtcagcgtatcccatgttgtaggctcattccattagctttttgtccccgccctcgggccccgccccgggaccgccaccaactcacgctgcgtgcttcccttcagaaactcgatggcctgccacctcgccatcgccggcgccaccgccgccgccgcccgcgctcctcgtctctccgtgctcgccgccgcctctgcttcctccgcaggggaacccgcgcgccgcatcatccgccgccgcgcgccgccgggtcagcagggctctgccacagcggcccccgcgcctcccgcccagccgtccgtggcggaggtgcgccgcgccatcggcgtctccgacgacgctgcgtcggccgccgcatccatggagaagaagaacaccgcgttcatggacctcatctctaccacgcccatcggccagccggagagcgagcccgagcgccgcctccgcgaggccgccgagtgggtagtcgacaccactgagacgcgcgcttgcgaaggacagaagtctttcttagtgctatgcatgatgacatttcctgcttggttcttgctcctgtttcttgcccttggactctttaagttaccatttgatattccggttctggataatctcctaatgtaaggtgttagctattatcatttttcccttttcttttccaaatatacgagcttcacacactgaatatgaaaagaaatatatgccactactgaagtcaaaaaaaaccaaaaaaataaaaaaaaaaaaanaa

SEQ ID NO: 3961 - DNA, 1817 bp, Zea mays
gccaccagtaccccctgtcatccctggcctttggttatgtacatgaaaggatcttttttttttctcttctctctgttcctttgctgccccaacgccatttttttgtaccaggaagaggaaacccttcgcccttacacttgcaccctgcatttcttcgcactctacaacactccatttttacataacgcccgagctagtggtgatttacagagataccatgctggccactgcatgttgctcgcttatcagcattcagcagcaggggaagcttgagaacaagccgccctttcgtcctgctcccggaaccggagtcgcctccgggttgctgctcgtctgcggctgcgcctctgccgtctgccctcgcttcagcttctgccggtgttggcacggccttgttggccgcctccgccgatgccgctgctggctccggctggaggtcctgctgagacggctccttggagtagttcatcttgtcctctaccaagtttgggaaggcgaaggagtagcttcccactttcccttcatggcgccctcgtggagctccgggatgctctcgaagggcggcgagatgacaggggcgtccttggcctttgcgtcggcgtcggtgttggcgccggctgccagaatggctgcaccgacggcgatcggcgactgccggcgaactcgctctctctttctctcctcaggtacgcgaatactgaaaaagcagaaagcgctggagacagagaactctggaaacagagagctattttgtgccgtgcaaaagtcacagcgttttctggcttttcccttctctttattaactggtgcttacacgatctcgcgatccgctttccccgccacgccgtgcacgctgcgacgcgcccgcctaaagcgcagggccgttttccttcatccggtcatggcggaggacctagtcaccgccttgtgaacgcagcacaagtcatggcgcatgcaccgttcattacatcatgcaacagctacctaataatagaagtaaacatgctcatgcaactaatactgcacgggattaagttcaacatttcaccccctaatcccgctgcacctcgacaacgcccagctgctgacgaagctccagaaatctgacacgcccaagcgcctttgttagaatgtccgcaagctggtccctggtactcacatgatcaatatccacttcacccttgtcaacacaatctctgatgaaatggaaccttgtgtctatatgcttgcttctgtcatggtgaactggattcttgctcagagctatggctgatttgttgtccactagaagtttgactgtcggagcctggatgttcaatagttctcccagaagccggctaagccagatgccttgacatgctgcattcgcacttgcaatatattcagcctcacatgatgatagggccaccacccgttgtttctgtgatgcccatgtcactaagcttgatcccaacagaaacacacacccactggtgctcttcctgtcgtcaacatcgccggccagatcactgtcactgtaacctacaagttcagttgagccctgtctcttgtacatacacccaaactgtatggtgcctgcaagatatctcaatatttgtttgacagcagcccaatgacttgctctaggctcttccatatacctgctaacaatgcccactgcatatgctatatctggccttgtattaaccaaataccgaaggcttccaatgatactcctatacttggttttgtcaacagcaggtgtcttgtcattcttgctcaacttcagtctattctccatgggcacagcacaaggattacaccccttcatgccggct

SEQ ID NO: 3962 - DNA, 7307 bp, Zea mays
  misc_feature (3465)..(3465): n is a, c, g, or t
aaattcggcacgagggtggggggtgactgggtcccacgcgtccggcagcggtgactgttgcggtgttgccgcatccacgccctagtcgaccacgccgcccccagcagcccgctgctgccgcggctcgcgcccccaggagcccccgccgtcgcggctcgcgcctcgtatccgtaacagctacaccgcgccgcctacccccgcttcctgctggctgcatcgtcctcaggtcttccgaaggcgagctccaatccccaaccactattcacaagatgactacaaaacttgagcaatcttctgcggagcatcgcccagcaaaattcgcagcaccatcgtctttgacccccaagatctcaatgtttggggcaaaagctggattcatcatacctaagaacaagctggccggctcactcgtaatccggagcaccagtgacaagaatgaaacaccaactgcatccaacgaagatagcagcaggcatgttcacagaaagacaaagtgggggcctgaccttgctttggaccctgtcgtgtgcaaaggaagggctttggcctaccagactcgagtggagcaaatttccaagcagctgaagtctggagctttggacacgtccgaaattgatggttcagtgtctgctggaaatgaattgaattctattggtcctgacatcttgaaagagaacgagctgggaaatgttgaactattggaacttgaaagacgagagcttatcggtgaaatactccgtttgaatccgggatataagacacctgagaactacaaaccagtacttagggagacaaaaatccctgttccggcagaagcacacccaggaaataatattattggagttcttctaggatctgagagcaatacccagaagagactacatgaagaaactggtgctgtcattcgagtgtatgggactaagaaaatcaatggagagaagagtgagattcgtcatcaagacataaatgaaacacaagatgcttatgaagacctatacatcaatgtatcggctgactcttatgataaagtagatgctgcagttgtgttgattgagctgcttcttgctcctgtttccgtaaagtcgacagctacttcaacagctgctactgtttcttcagcagatacatccaaggatgcagtttcagctaatgtgcaactggagcagaataccacgtcacagccagatctacttcattaccaatcacacaacgcaccttggctgcccacaccccagaccaatgctccatcaattccttccacggggcctgttttgagtacattacctaacaatccatcgcagccacaaccgcctgctggttctttcagtatgcctccatatactggtcaacctcctcacatgaatagcatgccagcaaatccatttcctgttcctgggcctcagcaaccagtaccaagcaatcaacaacatccacctcaatttcgagctaactcctcgattgggccttttttcggtcaaccacctggtattgtaagccaacaaatgccaccatcttcctcaatgccaccgccagttagaccccttcaaataccccatgcctctggtggctggccccctttctctcctgttacatcacaatctcataggcctctgcaagctccaccgacttttatggcagtgagacctcctatttccgtctctcctcttggtgcaactccaccgcaaggtcccattgcattgacaccaccaaatatgcccaccatgtaccgcggccagcatccaccagtaccaaatttcactggttcagcgccattggtttccaggcctcctggtggtggggctcagtcttttcctacagctgcgcctcaaggcccttcctcagtagcatttcccggtggaccatcgctgcggccaccttaccctccggcgcctgatcaagcgagggggccacctccagctttctctccagttggatcaactcctggcatggtgcctccacctattgcatcttccggcctgcctgccccgcgtcctgcgaacacgagctgcatccagacacaagtagtagcccctttgagacctccgctcccagccgcgggcgattttactttccggcctgccataccaccggcgcatgctccagagttcgcagcaccaggcagtcaaatgggagcaatacatggcagaactcaccaccctggaccattctcctcccatcctggtgaccagaagaaccccagccaaggtttccaagggccgtttgatggcagcaggcccatgtacacgacgaatcaggctcggatgcacgctccacctcctccacacttccacggagccttccccaggaacgcatctcctcttgagttcccagcggggttccggggagcctggccgtccgtgcaggcacctccgatgccggcaccgtcacatccatcgtctttcccgccgtttcagttgaggccaccgccaccgccgcagcaggatatgtctggcgcaggcggcaccaggtggcccggtggcaatcaaatctacaacccttttgcaccaacggctgcggcggcggctcagagagcggaggctgaccctgagtacgaggatctcatggcatcagttggcatgaagtagcgaagactgctggctggcccctgatctgtctgtggcacaaacacagaggcttcttcctattgcttgccaagatgtgcgggttactaatctcctccaatgtatctctagatggtactgaattccgttccatcatagacaggtgccatgcttgaacgaaaaacaaaaataaaaaataaactagtggaccttgtttgagacatgctgttgggtgccgaggttgtgtttgtgcctatctcgaaatctcatgcatgtgttgctcccggcgtcagctgatgttgtttattttatggagaggaatttgtgagcctgttctgagaaagaagaacatctgttggcattatcacgtgtgtgtatatatacatgaaggatggggtggaatatggtaggtatgcggtatgatgtcaggatgtctccagcagatcgtgtatatacggttgtgtaaaacactttcacgaagtttgaaataggggagacagtctcagtgcttgtgacttttatgcaaaacttattgtgtcgtacgctgacgctagaacgggaactgccaacgaaacgtcaagagatcttcctggagttggtggcgacaaggccatttcgctggaaaccagtcacggaaaatggcgacgtctcctgaatgcctttcaccttctagaggaggaagaggaattgaagcaagcacaggtggacatgagaggcaggtccttgtcagctctccggccgctggcatttcttctagactagaaaaaacatgtgctacgacttccacgcccgcctgctcgctctaacaagtactatatggtattgccgtgccagcaccaacaaacaactgttgtcgtccactgcttttgcttctgggtctttcgttcgtagatataaaacgganggaacgcagagccgggcgcctgtctggattcattctgcgagagatctgctggggcattgattcgtcatcaggctcaggtatcacttcctcgctctgtcttttgttgttcaaggttcaagcatgatgatcccctcctctccatgactccgtcgccatgggcacgtatagctctgatcagcttcaaccatcatggggagtcaagagtcggagcaggccaaggtacataccttctccatttgtttggttggtggtgcccccacagttcgtgttcttggattccttcttttcttttcttcttttttttcttcttccccaagtcgctttctttcattctcatctcctctccacaacttcgatccatgcatcatgagatgagatctctgcttcatctcctcccacgccgatccaaaccaccacttgtatcccatcctcggggaggtctgacatggctggtccttcctaggtgctcccgggaaccgactgcccgcagcagccaccggcgagcaggacctggcagaggaggttcgacgatgaaggcaagaacgtcgccatgttcagcatgaccatgagcgacctggtggaacttgtaagttacataattaacactgcgtttggcttcttcagtttttttatatatataatataaggtgaccgcgtctgtggtggcattgcgttgcagatgcccttgatggtcaaaatactcaagctgcaggtggaagaaaacgccgaaggccgagtgggttaccaaactctatctaggattattgtgtttctttctctctctctctctctcttttgccaacaccagttccatgatcatgtttcagtgagtgctgaaacatgactaaggcatgactaaattccaaaaaaaaaaacttttatttttttgacaaaaaggttgcggtctatgatcttctgaggaaatggatggacaactgctaccgtggcgtaccggtcggtgggatagggtcagttccctcagccccctccctcctgttctgtctgtgtatagtatactaaaccaatcctagagagtagagaagctaaatgctatatctttcatcagttcaggaagcatagggaggagctacagagggtacttccagcagttccagatattccccgtgaccaacgaagagaaacctgtcctagcaaaccagttctcggtagctccctccgtctccattcacggtttctttcttctgcacgcctgcactcgctcaaactgccagcagcttctgaactgacagcagccattgttttttctcacaccctaggcatttgtttcgcgcccgaacgggaacaagtactccacggtgctgtcggcgccaaccgctgaccttctcaagtgagcaccggaactcttgaccactgtatgcacctgatcagtaggcaggacgtgtgatggaaaactgaattcgcaggggagtcggcaaagccggcattggatcttgggactggaggttgaaggaggacaggtgcacttaccacgccctgttcccaaggtcatggacggtatatgatggtgagttagcggcagcacttggactttttaacaaaggctccttccaagattatataatccagcttacggattatataataacctatgttgtttgtttgtctcttaacttaatttaagctggatcatgtcggttcgatgaaggcattttggaaatcacactgcaggtgaacctgaccctgagatcaagatcacctgccgtcagatatcgcccttcataccgcacaactacagagagagcagcttcccggctgcagttttcacattcacggtacagtccgttttgtctgttcttttcaaggcaggttcagtggctgaaatcgggatgcagcatgtgtatcgagtaacgctgacgccccgtttcaggtgaacaactctgggagctcacctgcagatgtgacgctgctcttcacctgggcagtaagtgcaggccaccgcctttgcgttgcgaatttttcgtctgggagaagacactggcttttgatcttatcttatcttgtagaattcagttggcgggaagtcggaactgacaggaaaccacgtgaattccaaaatgacgtaaagaccaccatctctcacctcctgctaaagaagctcagtgtaccaggaatcttatttgcttgctccaaatgtgttcttggtcgtttgcagggagcacgacggcgtccgtggcgttctcctccatcacaggtgggtctggtctgatcttccgtggggcacggtgctaccgtccctgccgctggctcgtgtatacgccggtgcttgagactgacgctgacagacgccaatgcaggacggcgggagggcagcctccggtgacgttcgcgatcgcgtcccgagagaccgacggtgtccgcgtcagcgtctgcccgtccttcacgatcgcgtcgggcggcccgtccagctccggcgagcccacggcggcggccatgtgggacgagatcaagaaggtagacgcctcacgtccggtccagtccgtccatcggtggatccaaacacccgggactccctgttctctctgctgagtgctggcacgcgtttgtttgctgatgcagcacggcgcgttcgggcacgccggcgccggcaacggcaacgcggcgagggcggcggcttccaaggccgggtcgtccgtgggcgcggcagtggcggcgtcgacggccgtgccggcgggggcgacgcgggtggtgtccttctcgctggcctgggcgtgccccgaagttaagttccccgccgggagcacgtactacaggtgagtcctcgctgactgacccctggcaatggcacggtggcttgtcactgacatggcgtccatgctgtggtccggatggagcaggaggtacaccaggttctacggcactgatgccgacgcagctgcagagcacctagctcatgatgcccttcttggttagaactaaaacctctctctttctctctcatcactggacgaaatgattatcttcaagagattgaattcattcactgtatgaaatgattagagcatatgaactgggagtcccagatcgaggagtggcagaagccaatcttgcatgaccaaaggctgcctgaatggtaagaagaacttgagtcagatccatttcatgacaccatgcacaacgagctctactaccatcttcgttcatcgtcaattcgtcatgctcaggtatccagttgctctgttcaacgagctctactacctcaacgctggaggcaccatctggacaggtaatcaaatcatcctgctggacaaacgatttgctcagccactcaagaaagggaaagatgactaatagtagaagagatgctcacagacgggcaggctccgaagagggccggcttcgcttcgtcgttgacgggcaccgagccgttctccatcgacacgttcctcccagtcgcagcgggcggcagcgcggtggacggcgtcgtgcgcgcggtggcgtcggcgacggagcggtcccactccgcggcggcgttcggcgcggcgctgctgcgcggcggcgaggacaacgtggggcagttcctgtacctggaaggcatggagtacaacatgtacaacacctacgacgtgcacttctacgcctccttcgcgctgctgtccctcttcccccggctggagctgagcctgcagcgggacttcgcgcgcgccgtgctcctccacgaccctcgcccccggcgcaccctggacggcaggaccgtggcgcgcaaggtgctgggcaccgtctcgcacgacgtcgggctcaacgacccatgggtggagctgaacgcgtacatgctgcacgacgcggcgcggtggaaggacctcaaccccaagttcgtcctgcag

SEQ ID NO: 3963 - DNA, 3070 bp, Zea mays
  misc_feature (24)..(24): n is a, c, g, or t
  misc_feature (35)..(35): n is a, c, g, or t
  misc_feature (46)..(46): n is a, c, g, or t
  misc_feature (56)..(56): n is a, c, g, or t
gcgtccgctgcttttgcttctggntctttcgtagnatataaacggngggggccggncgcctgtctggattcattctgcgagagatctgctggggcattgattcgtcatcaggctcagctctgatcagcttcaaccatcatggggagtcaggagtcggagcaggccaaggtgctcccggcaaccgactgcccgcagcagccaccggcgagcaggacctggcagaggaggttcgacgatgaaggcaagaaggtcgccatgttcagcatgaccatgaccgacctggtggaccttatgcccttgatggtcaaaatactcaagctgcaggtggaagaacacgccgaaggccgagttgcggtctatgatcttctgaggaaatggatggacaactgctaccgtggcgtaccggtgggtgggatagggaagcatagggagaagctacagagggtacttccagcagttccagatattccccgtgaccaacgaagagaaacctgtcctagcaaaccagttctcggcatttgtttcgcgcccgaacgggaacaagtactccacggtgctgtcggcgccaaccactgaccttctcaagggagtcggcaaagccggcattggatcttgggactggaggttgaaggaggacaaatgcacttaccacgccctgttcccaaggtcatggacggtatatgatggtgaacctgaccctgagatcaagatcacctgccgtcagatatcgcccttcataccgcacaactacagagagagcagcttcccggctgcagttttcacattcacggtgaacaactctgggagctcacctgcagatgtgaccctgctcttcacctgggcaaattcagttggcgggaagtcggaactgacaggaaaccacgtgaattccaaaatgacggagcacgacggcgtccgtggcgttctcctccatcacaggacggcgggagggcaccctccggtgacgttcgcgatcgcgtcccgagagaccgaccgtgtccgcgtcagcgtctgcccgtccttcacgatcgcgtcgggcggcccgtccagctccggcgagcccacggcggcggccatgtgggacgagatcaagaagcacggcgcgttcgggcacgccggcaacggcaacggcaacggcaacgcggcgagggcggcggcttctaaggccgggtcgtccgtgggcgcggcggtggcggcgtcgacggccgtgccggcgggggcgacgcgggtggtgtccttctcgctggcctgggcgtgccccgaagttaagttccccgccgggagcacgtaccacaggaggtacaccaggttctacggcactgatgccgacgcagctgcagagcacctagctcatgatgcccttcttgagcatatgaactgggagtcccagatcgaggagtggcagaagccaatcttgcatgaccaaaggctgcctgaatggtatccagttgctctgttcaacgagctctactacctcaacgctggaggcaccatctggacagacgggcaggctccgaagagggccggcttcgcttcgtcgttgacgggcaccgagccgttctccatcgacacgctcctcccagtcgcagcgggcggcagcgcggtagacggcgtcgtgcgcgcggtggcgtcggcgacggagcggtcccactccgcggcggcgttcggcgcggcgctgctgtgcggcggcgaggacaacgtggggcagttcctgtacctggaaggcatggagtacaacatgtacaacacctacgacgtgcacttctacgcctccttcgcgctgctgtccctcttcccccggctggagctgagcctgcagcgggacttcgcgcgcgccgtgctcctccacgaccctcgcccccggcgcaccctggacggcaggaccgtggcgcgcaaggtgctgggcgccgtgccgcacgacgtcgggctcaacgacccatgggtggagctgaacgcgtacatgctgcacgacgcggcgcggtggaaggacctcaaccccaagttcgtcctgcaggtgtaccgcgacgcggtggccacgggcgacgccgcgttcgcggaggcggtgtggcccgccgtgtacgtggccatggcgtacatggaccagttcgaccgcgacggcgacgggatggtggagaacgagggggtacccgaccagacgtacgacatgtggtcggtctccggtgtcagcgcctacacgggcggggtttgggtggcggcgctgcaggcggcggcgggcatggcgcgcgtcgtcggggaccgccccgccgaggcctacttcctcgcgaggcgggacagggcggcgcgcgtgtacgatgccgagctctggaccggcgcctacttccgctacgacaacagcggcggcggcggcgccagcgagtccatcatggcggaccaactggcggggcagtggtacgcgcgggcgtgcgggctggagccggtggtggaggacgccaaggcacggagcgcgctggcgaccgtgctggactacaacgtcatgcgggtcaagggcggcgccatcggggccgtgaacgggatgcgccccgacggcgccgtcgacgcatcgtccacgcagtccaaggaggtgtggcccggggtcacgtacgccgttgcggcggccatggtccacgagggcatgacggaggccgcgttccggacggccaagggcgcccacgacgccgcctggggcaacgacggcttcgggtacgcgttccagacgcccgaggcttggacggaggacggcggctatcggtcgctgcactacatgcggccgctcggcatctgggcgatgcagtgggcgctgtcgccacccgagctccacagggatctcaggacacccgaggcgcgatcctcggaggagccgtcgccggcggacgctgccctcgggcaggcgcagttcgacaaggtggcgagcatgttgaggctgccggaggagcagcagcccaagggatacctttgggccatctacaacctcgttaggcaaattgtgctccccgcatgaggattctcttgctccaagcagccgcactcatgaatgcaaattgagcccgttattacaaaaaaaaaaaaaaaa

SEQ ID NO: 3964 - DNA, 1608 bp, Zea mays
tgcaggtcgttatcaacttgaagaccgccaacgttcattgacagcgactccaacgcgtgaactgataaaaaaaaaatcttgcatccattgcactcaaacacccgccctgctacggaggttatcatccgaacacacgtttaagagacgaaaacgaaacgaagccaagtctgcgttcccggccggtcaatacgcttgcgcgtgcactcgtcccctcggccctcctgtgcagggccgcctccattttccatcccaaccgttccaactcccccacccaaaaagcccacgaactttcgacggttccttcctccctccctcccgctccaaccaaggccttccggcccattgggtgccccggggccggccgggataacccacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacaggggcgccggcgaggccgtctccggccgcggatacaaggagtaccgcctcggggactactccaactggctgcagaagcgcgtcgagaacaccaggaactgggaccggatcaggagctgcctccaggactccaaggtctgcaagagcctgcaggacaagaacgagaccgtcgcccagttcatgagttccagcctctcccccatcgagtctggctgctgcaagccccccaccagctgcggctacacctacgtcggcggcacggactggacgccggtgaccaccaactcgacggacccggactgcaagacctggagcaacgacgcctcggcgctctgctacaactgccagtcgtgcaaggccggcgtggtggccacgttccagcggaactggaagcgcgtcgccgtcgtctgcatcgtcttcctcgtcttcatcatcatcgtctactccgtcggctgctgcgccttcaggaacaaccgcagagacaacgcctaccgcggcgggtggaagggcgggtacgcttgatccaccatcgcgtcgtttaggagcggagccatgcacgcgcgctcggtgctctgctctgctccctgcccgccgctgtcgtcgtacgtacatgtttagtaggctcgttgtagctctgtacaggtgatggagatcgttgttgcggattcttatcgtcttcctggttacatacttacattattgttatgatctgatcagcggtaggttttgtatacgctgctcattgattcgtctgcctgctattttcgtatatcgatgcacttgttttaccaaaaaaaaaaaaaaaaaagcggcc

SEQ ID NO: 3965 - DNA, 1280 bp, Zea mays
caccattgggtacctccggggccgccgggaaaacccaacacggccgtccccgtcccgagtcaccaactcaccaccgaccctagcaaaaccgcacgcaccctgccagcggccccccaactcccaacccaacccctactccagctagctcgcggcggcggccagcggccatggcgttccggctgagcaacaacctgatcggggtcctcaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacaggggcgccggcgaggccgtctccggccgcggatacaaggagtaccgcctcggggactactccaactggctgcagaagcgcgtcgagaacaccaggaactgggaccggatcaggagctgcctccaggactccaaggtctgcaagagcctgcaggacaagaacgagaccgtcgcccagttcatgagttccagcctctcccccatcgagtctggctgctgcaagccccccaccagctgcggctacacctacgtcggcggcacggactggacgccggtgaccaccaactcgacggacccggactgcaagacctggagcaacgacgcctcggcgctctgctacaactgccagtcgtgcaaggccggcgtggtggccacgttccagcggaactggaagcgcgtcgccgtcgtctgcatcgtcttcctcgtcttcatcatcatcgtctactccgtcggctgctgcgccttcaggaacaaccgcagagacaacgcctaccgcggcgggtggaagggcgggtacgcttgatccaccatcgcgtcgtttaggagcggagccatgcacgcgcgctcggtgctctgctgtctgctccctgcccgccactgtcgtcgtacgtacatgtttagtaggctcgatgttagctctgtacaggtgatggagatcgttgttgcggattcttatcgtcttcctggttacattattgttatgatctgatcagcggtaggttttgtatacgctgctcattgattcgtccgcctgctattttcgtatatcgatgcacttgttttaccagttgcccccgttcaaaaaaaaaaaaaa

SEQ ID NO: 3966 - DNA, 1748 bp, Zea mays
ttgggaccctcccggccgggccgggatcaacccaacacggcgtccccgtcccgagtcaccaccgacccaagcaaaaccgcacgcaccctgccagcggcccccccaactcccaacccaacccctactccagctagctcgcggcggcggccagcggccatggccttccggctgagcaacaacctgatcggggtcctcaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccggccgcggatacaaggagtaccgcctcggggactactccaactggctgcagaagcgcgtcgagaacaccaggaactgggaccggatcaggagctgcctccaggactccaaggtctgcaagagcctgcaggacaagaacgagaccgtcgcccagttcatgagttccagcctctcccccatcgagtctggctgctgcaagccccccaccagctgcggctacacctacgtcggcggcacggactggacgccggtgaccaccaactcgacggacccggactgcaagacctggagcaacgacgcctcggcgctctgctacaactgccagtcgtgcaaggccggcgtggtggccacgttccagcggaactggaagcgcgtcgccgtcgtctgcatcgtcttcctcgtcttcatcatcatcgtctactccgtcggctgctgcgccttcaggaacaaccgcagagacaacgcctaccgcggcgggtggaagggcgggtacgcttgatccaccatcgcgtcgtttaggagcggagccatgcacgcgcgctcggtgctctgctctgctccctgcccgccgctgtcgtcgtacgtacatgtttagtaggctcgttgtagctctgtacaggtgatggagatcgttgttgcggattcttatcgtcttcctggttacatacttacattattgttatgatctgatcagcggtaggttttgtatacgctgctcattgattcgtctgcctgctattttcgtatatcgatgcacttgttttaccaattgctttagttaaaaaccttactcgagtgacctgcacctttcattattcagttcttttactttattttcgaaagttcgcctgatatgaaacaacgacgaaggatatttatcatcgacactaactagataatacagcacgacattatcagatcagctaatttctacagtcaagagcatcttcaacaatgtctcaaactggtgtcttaaattaaaactagttagttgctcgtgcgttacgacggctcacaacaatacccacgtaaactattcaccaaaaaggtctcaagattttttattaattgtctacgctcttcatataatattttttatttgactaactgatgttctgtttactccatccaatatgtcttggtacaattccggactagcacgattatattttttattttacaaaaaatcgtatatacatatgtacaatttatataaaatattaaaaatatctgagcattatgttctactgattagacgacttcaattggtgtctttcatccttcttttattagggtgtgggttcgaaccccacctcccgcaccacttttttatgttgatttaaccaaatggtccgactggctaacggaccggcccggtacggtcagcaggctggtgcctaggcaggagttgcggcc

SEQ ID NO: 3967 - DNA, 4375 bp, Zea mays
  misc_feature (988)..(988): n is a, c, g, or t
  misc_feature (2133)..(2133): n is a, c, g, or t
ataggaaactaatgccctcttggatatgttttgtcgaaacaatgaagtgtgtaggcttttctcggccaaaaaacgaatgtttcagctgataacatgatatcttactattgggtttcatttttttattgtagtttttatttacatgcatctttggtttgtagggctgggcctgtctgctgatagttcagctactatcaatgtgcctaaaaatcatcccagaggtattgattgcttctcaggtgtcctctgctccctcctagagattgtcgagctgcatgttatcccatgcttgtgttttttcatggttggacaaagtaggcatgttatggtctcctttctcttttcttggattaaagctaagctaagcaatttttagtggtactggatagacaatgttctaatcatttcactatttcagtgacatgggctccatccactcgctactttttttctttggctcaattgaacttcaagtgaaagggtattttgaaaggtttcctttaactgaggatgaaaggttctctgatatattgcatctcagtgacaagaaaaaaacaaaataaatggtttccttataaaattgtttgtttttgcttactgagtcaaggttaatttttacactcagtttgtctgtgatggaaccttgcttgcatagttctagtattctatccagttgatgggagtaaagtcagtaaccatagaataagaagggaggaactcccagaaaattacttttgcctatccaattaagatttaatgtttaaagttggtccataacggaaccttcacggcatgtctatgcagcattatcggaaggcttaccttcactccttcagtgttctcctttttctacctgagacttaatttggatgttcatccaatttcccaaatgttgcattcacatgaggataatatatcttgttcaattttcattgcgctgtaccctcttaactgtatagtgttttgatttctatttaatttatatcanatgcgccagttcctcttgcaacaaaaatgtatcattcacagggcaactaccgtcttcgatttgagcttggccagctttatcgcgaatcatgtgtgcagcatttgagtggccacacaactccaaacgtgtcacatgagaatggattgatggcatcatcacggttttcttcttgtggcaactcagcattgcctactcagaagagccttgttcctcaaacaaaggtttgatgccaccctcagctcattggcaggatagtttttcatgttctcttactgatgatgcattctgctatgatgcttctcatcagcctctcgcagaccctcagcaattagcagcaagcaggcctaaccagtcacaaggaacaaaaactgatagagcaagtgcacaagcatctgcaattaaaaatgaaggttcacgatccagatgcaataaagctaccattccccattcgagaaacaaaggttggaaatgatcttttgctcttccgcttcatgtagtatgtgacttcattcattgagaattgttaagttgctattcagttgtgttagttatctataactgggccagggaacttatgtaaagttaaagaatattccagtgaaactatgttaactatatatcaactggaagttcaaaatacagctctatgagagaaaatttacagtccatacttttgttctgttctaagcaaagtatattacagttttcagctttgcaagagtccgattgaccctgtagttacatagcttcaggcatgcaaaaatggtatctcatcttttttagtttactgaggccctgtttgaatacactatagctaatagttagctgctaaaaatagctttagacatccaaacagcccaactaataattcagctaatagttaaccaactactatttgttagctaggtaattctactagtaactttttagcagctaactattagctctagttcattcaaatatagcttggatggctcctgcaccactctgatgcctaggaaccatctaacgtaaaaaggatgtgttggagtattatcttactagtaattatgtgaaatttgttctccaggcagcaagaagacgcaacagcaacctaatggacgtgttcatgcgatcaagttcccagtagagtagcccattcgtangtatgccccctattggctttactttcttgaactcggatcctgacataatgaacttacgctgattgatttcacaggtaatttattggttaagtggaagtgtctcttctggtgaacagtctcttcttttctcctttccaaatgaaattggttattgtcaggattgttctaatttggactgtcccgatccgaggttttggtaagtcaggatatctaaaattcgtggcatatgtttttttgttttttgaccggcaattcacggcatatgttatactgtcgcataattaacatggtttcgtctgtttccgcctaggttcgccggccattggtactagaagctaacagcactagttgtagcactgacgatgaacttacctgtaaatatggccacagaggccttggcttcttcctgccgaaggtcgtggacctgatgaacattttgaatgtagccttcatcttttgggcattgagttctagttgattgatgttttgtgtttgattcttgccctaagtttagctttctagccggcgattgaaccgttttacgggctaccgctgccagctgccggtggatgagcccttccgtattcaccttgccggaaagctgtcgctgttgctgggcgtatcgagggatgtagttgtcggttgagggcgattgcgcggcggagtggttcactttcaatttataattcgtttaacttttttatattaaatttgactgaccgatcttacttaaaaaaattcataattagtattactgtgatattgtttagtatataatatactttaaatatggttttgaagtttcattattttcaaaacaaattggacaagtcaaatttggcaaaaaagacaaacgagttataaattgagacgggggaattttgttggggaatgttttgctatcctttcaccctttggtgagcaactagcagcagcattgccccatctcattgtcagctacagttagagaacgagttctatcaaatttgctcatttttttaagaaatggtattcgttagatcagtcatactctatcatcatcaagatagcttgtagcagacggacctgttcttctaaccatgagatcggagttcaaaatccttgctaatatcaacttgtttttttttttttcgttaaatgcaaataaaagatgccaaaagatacggaaacaagaacatctctatcgttggataacgctggcgccgcagattgaagctacagaatcggaaatgtctgcttttgccggtgttattacagcactagccatttcacctatctagctgatttcgtaccaaaaaaaaaagttggaggccatggccgtcggatgagaggtagcaaaaggtgcaatcgccgcgagcagcagaagccattgattacccatggatcagcagatgccggtgatgtcggccctgatcatctgcaggacctcgggcggcgcggcggcagcggtgaccgtgaccacggcggcgccgccgttggccgtgaggccccaccgtggccacgaggacctccaccccgcggcggtggaacgcctccagcacgcgcgtcagcgagccggggctccgcgccggcagccgcgcgcagaagcacaccgcgccgacggccacggacacctcgggccgccgggcagcagcggcgccggcgccggcgccggccccgtggagggggctgcgcaccgagtggtacgtctccagcacggccaccgtgtcctccaggaccttcacgcgcgccgccgcggcgtccacgatctcctccttgctcgccggccggtcgatggggaggttggggagcatcgcgcccagctcggcatagagcgaggacagggtgcgccggttcggccgcgccctcggccgccgctcgccagccgacggccccgcggtggccagggacaggtcgagcggaagccgtcctcctcctcctccagccatggcggaacgacgggtgggtttctgcttctgcacgacacgagagggaagggaacgcgtgggttcgtttgatctttgtcttggcccgcgagagagaagagaagacaagacaagaagcgggtcgtggtggtggcgtgacatggcggccatgttggtgtcaggtgtgcagtgggcacgtgaccaaagtgccgcagcagctgctttgggttggtggtggttagccaggaatggaagctgcagctgggctgttggggggcagctgcagaggtgggagaccagaggagtcgcctgcttgggaaactccgaacccggccggc

SEQ ID NO: 3968 - DNA, 1693 bp, Zea mays
ccccaaatctgcaacgcttggcgctcgctcggctccgccctccgcccccctgctccgtccgatcgccgcgccccctcgccgccggtgatcgctggggagccgacgaggccggacgccggaggttctcgctccctcctctgtgtctcccttcctcccgcgcgtcccgcctgctcgtcgcgtggcctcctgctcggggcttcctctcgccgcggaatttggcatgtgacgtggggcgaggccaacgaggcgcagccggcggcggcgtggggttgattggttaactggatttcgagattgttttgtctggattttttttccgagggaagcgcgcgctccaggttcatttccaaaatggtttgcatggtggggaattttaaaatgtcttctgtgttgaagcttgtaatgatggaaaatcacgcaacaccagatgacgtgatccatgagatgactgctgcacaggtcctacagaagcaactgtttgatgcacacgaaccaaatttactggatgaaaatgatatgcatatatttggatcaaaaccgatggccgacccattggacttggtctgctgtagtacttgcaagaagccagtcaaagccagccaatatgcaattcatacagggcaatgtagttcagggaaggtaaacacaaatggttcagtgggtgtggatcatgccaatcctacaaagcccctgaagaaaggcagaaaaataaagttgataagtaatggaaatcaaaaagtgcacataaaagtgaaagcaaaatctcaaactgaaagcaataacattgccaatagtttcgagttggacaatggacatgtcactaaagtacaacctatagattccacagggctgggcctgtctgctgatagttcagctactatcaatgtgcctaaaaatcatcccagagatgcgccagttcctcttgcaacaaaaatgtatcattcacagggcaactaccgtcttcgatttgagcttggccagctttatcgcgaatcatgtgtgcagcatttgagtggccacacaactccaaacgtgtcacatgagaatggattgatggcatcatcacggttttcttcttgtggcaactcagcattgcctactcagaagagccttgttcctcaaacaaagcctctcgcagaccctcagcaattagcagcaagcaggcctaaccagtcacaaggaacaaaaactgatagagcaagtgcacaagcatctgcaattaaaaatgaaggttcacgatccagatgcaataaagctaccattccccattcgagaaacaaaggcagcaagaagacgcaacagcaacctaatggacgtgttcatgcgatcaagttcccagtagagtagcccattcgtaggtaatttattggttaagtggaagtgtctcttctggtgaacagtctcttcttttctcctttccaaatgaaattggttattgtcaggattgttctaatttggactgtcccgatccgaggttttggttcgccggccattggtactagaagctaacagcactagttgtagcactgacgatgaacttacctgtaaatatggccacagaggccttggcttcttcctgccgaaggtcgtggacctgatgaacattttgaatgtagccttcatcttttgggcattgagttctagttgattgatgttttgtgtttgattcttgccctcaaaaaaaaaaaaaaaa

SEQ ID NO: 3969 - DNA, 1814 bp, Zea mays
atgacattctttcgaagttgaagaggtcagttgagttagatcacaggcaagcagctgtttggaatatcctaggtttagttcttcttcggggtggtcagatacagagtgctatctcagttctatcttctctcacggctgttgctccagactacttggactcccttgcaaatcttggcgttgcatacattcaaagtggggatctagagctgtctgcaaagtgctttcaagaacttcttctaaaagatcaaaaccaccccgctgctctggtgaactatgcagttcttcttctgtgtagatatggatctttgtctgcaggggcagggggcaatgtcagcacaggtccttacgtgcatcagaaagaagccttagttgttgcaaaagagtgcttgcttgcagcagtgaaggctgatcctagagctgcatcagtttgggttaatcttgcaaatgcatattacatggatggtgagcataagaactcaaagaggtgcttggagcaggcagcaaaattggaacccaatcatatgcctgctcggtatgctattgcagttcaccgtatcagagatgctgtaaggtcacaatgttctgatgatcaacttctttgggctgcaaatgaaatggcaacagttctaaaagaaggagacccttccgcagttgacgccccaattgcatgggctgggttggcaatggctcacagggcacaacatgaaattgcagccgtctatgatactgaaaacatcaatcttaatgatgcagaagagcgagctcaatatacactaaaacaggcaatccaagaggacccagatgatgctgttcaatggcatcaacttggcctgtacaatatttgcatgacccggttcagcaggtctgtaaattttcttaaagcagccttagcccgttccccagattgcagttatgcttggtcaaatcttggtattgcgttgcaactatcagacgatccatcctctgaaactgtatataagcgggcactggtactatcatcaactcagcagctgcacgcaatcttctctaatcttggaattctttatcggcaacataggaactatgaatttgcaaggaagatgttattaaggtcgttggaactgtgtcctggatttgcaccagctagcaacaacctgggtcttgtatttgtcgctgagggccgttgggaggatgctaaaagctggtttgagaaagctctgcaatctgatcccctgcttgatgcggccaaatcgaacttgttaaaagtcctcacattgtctacgaaacagtagaacaagagaagacctaactcctaaggaaattgccactggagcctcagagttcagacacggaagcgcggtcaccaaatctctgttctgaagtgtctcaactgccagctcaaaattgatgcttggtgcctctagtctactgctcattgctcacagagtcacaggtgtaggaagtttcagaagtgcggcttcgaagactgcatttgattttgactgagttgctgcctatatgacaatcaaagctgcacaggctccgaagtggctgtgatgtgttcttaaagagtcgcatcagcgcaggaagagcccagattttgaagttcatgtgtagctaaatttcgatataagcttgaacggcttcccttagctgatgtatatacataaatatactccaacttgaggtgtactccaagttgagcatgtgcaagttataggttcagtgttccagagcaacttatggttctgtgcggtgaaactaacagcatctaaacctcaaatttggcagcaattccactttggaatcaaaagggcgtcctacgagtgtaaaaa

SEQ ID NO: 3970 - DNA, 858 bp, Zea mays
tatggtgcttgttccagctccaggagatccaagaataagaagcttttgtatccttttatgatctaagtagtcaggtacagtttttgatgaataaggggcttcatcttttgtcgcatcaaagtttgtaggaggcaccggtagtgaaaccaaggcgcacgcaaaacgtgtcaaaggtgactcccatattttccctttgatattgttttgtccttcttcctcgtagccaccatcatggtaaacccagaagtgagtatcacgggggcattggacttttgcaatctttagaattctcagttcaatctttgtaatttcccgcccgttaatgaaaacctgagcggtgccgttactagcatcaggctgaagctttccgttaaagttgaggttagtgctaatgatgctgtctggcttttcaccttcctttccccacaatcctgactccttatcataccaatatcttccaggcttgaggttcccaggaggtcgttggcagctaagcaaatcggtcatctcctcgtcgtcaagagggaaaccattgaccaggagctgctcaggccggagctggttcgcctggcactccttctcgaccttgaggatctgcctgacctccagggggctgagcaggcgcgacagtatcctggagcccttcccgagcctggagcgcttggcctcgtcgatgggctggccaatgcaggtgacacacttgcggccctcgggcatggagcccatggcgcggagcaggcagtggccgcagtagcgcgcgtcgcagacgatgcacgactccttgctctcccacttgctcttcccgcagcggcggcagcaggtccgccctttcctctcggccggcctcggggccccgac

SEQ ID NO: 3971 - DNA, 5022 bp, Zea mays
  misc_feature (754)..(754): n is a, c, g, or t
ttggtgtattttttgcggtcgtttttaagctatgtaactcgtctcgtgttgatgagtacccaaggccgcaaggtgaccccaattgcctatcctggaacaggaaaaacagcaatagctaaggggccccgcctgtatctaccatctatgagggcgcctccacatgaatcagtattacacatctgtatctgaaacatgtcagacactgtgccgcaaggttaatcccagatgacgaaaagaaactgcgtacaccatgtccatcagaaatactagttccaattccgacacatgcgctgggcatcaaggtcaacaccgggagtttttattattattattccagaatgcgcacggtaatttgaaaatgaaattgtggtggaaactgtggaatccgctaatccggtgcggatctgcacagagaaactctggtggctgctgtgactaatgaaaagtggttattctggctttggccgttgtccatcgagggagatgtaatacctgatcagccctgaaatcttaaagggctcccttctttcctcatgctgggacaacatttatttacatcgggtgtgttcttggagttctctccatcaccgaatatatgtcggcgtgattgctggtatctactccgtatgttatccgataggggggtgtcgcgatcctccctgacgacgcactcgaggttgatggcatttgtcagcagcggccagcagatgatgaaagttgaaatgcctcccatgagtgagccgtgaaggttacntctcgcaggtaaagcggacctgtaccatgataggggggagctctcgagtcccatgctctgccctctatcgccggatcgggctgcgaattgtgggtgtgctttttgcctttgcgctgctggctgctgcgcaaggcacggggaaagcaggtgttggcatggcaccaatcatagagtgttgccatccgcgcctctcttttctacggagtacggggttttctgaatgtgctacaatttatctaacttttctactcaatgttagtttttttgtggtgtcttatgtagaaaaccaaacagcccttacatctaccgtctatatgtggatgtggttacaggcttgcagccatcggtattcagagagcatctaaaataacccctaatatccctaatcccaaaacatattttaggagaaactagaaaaaataacttacaacagttccctatacaccctcttaatcctttcgcatgcggagaatgcatccgtcggcgaaaatatatgtcggctaatcttctcccaatcccttccttttttcaagtttcccgcggcaaaatccatcactttggcatttgtctagatatgtctgctagtcttcggagaagaggatgatattcccttcccacactttggcatttgtcggcctgaaggcgagacaattgccatttccatcatgcatgtcgaaggcttagctcactagattcttggcatatctctgagaaggactacatcgctcaagttgttgtagtaagacgcagttggctgaactgggtgttcgaagagcttagagtgaaacatgattcttgagaggtcttgcagaaacttgtgaaattgatgacttatctgttgtggctagagatatcgcgttgccgatggtgaatttttccaccaatgttcagcatgggcaatttggagtttataatggtggaagatggtggtggtggtggtggagaatttgttcatccttagaccatcatggaagaaagtgatctcgaagttgatgattaggctcggtctggaaatgtcatgtctctgaaggtcaaactttaggttagggagactaagaagtgttctatcgaacaaggtagtggatcatcaagctcgataagttgttgtagcggtttttcgtgtgggcaaagtctaactcggtcaatgtttatgatttcaaataaacacttttagataaattatgaaatgtatttttcgtaataaattgatttggaaccatagatatgaatgttgctgcacttattctacagttcagatgcgtgattgttttagatgatttcagacaacacacttgtgccaacaaagtgtaaataaactgttgcttttatactttgtgatttatgttgtatcataacaaatcgatttttttttctttatctaattattataggaataattgttaattgtctatgtgccaacacgtatcaaaatctgttgggtttatgattttgtctaatatgtttttctccccgagaaccgaaaaaattaaagattatgtctatatacattacaataaactgaatcctttgattgtacttgagaatatgaaacaatcagcactaaaaaagataaaatttacatacctgattttttaatttattttaccaaatcctaaattgttcactagactgcactgtgattttcgggacagaggaacttttggctagcaggtaacccgtgcttccgtcttttgtacctattcctggactgccactgcgaccaaagtttcctcggcacattcgaggtattattattatggaccttttcacaagaccgaaaagtttccttttttcaaccaataaaaaccaataaaaaccgaaaagtttcctttttcaaccctcgtttcctttttcaaccaataaaaaccgaaaactttgtgctctgttactcctcttcccatagacaagatcttggactggaaacgaattccatatgattagagtagagtgtgtgtgcctactagtaaaagttcacggatcaacgaccaagaggagatggataccccatgcccggaccggccggacgccggttgagcacttgcaggcaatgccgtgcaggggacagagtttctgcccgtctgaatcgacatgtgcagcagccggcccgccgccgcctgcaccaccgaactgacgatctcgtggctgccgccgtcatcctcccatgcccccaggccccggctggtgcaggcgcgcggtcagagagaccagacaccagagcagacagatgtcagcacgcacacagcctcccctcccggacgccgacgcccactgccaaatgcccaaatgccaaaccggcgcccactcgcccaggggtgcggcgcgacaattattggggacctcgcggcggcgccaaccacgccgttaaaggacccgcagaatcgaaaggtaaagggcaaagccgttttggtgtgcactgtgcagtaccaaagttacggggtgtgctaccactaggctacagacctacagtggtgctattctcttggcatgcattcggatggtcaggtctccccgaccccgactctacaacgtttacttttcgttttgttctcgatacatatgaattatatgtgattggataagttttaatactaaacaagttaaaatctttcgtatttttttctaatatcatttaatccacctaggatagaaataattcaacaagctcttatttggctacggtatcacacgagcgaagtcatgttataactgtttgctccgtaagacggcacgaaacagtgactagagttatgctttttcctatggatttagtatcaacattgatttaatgagtcccaacgagattattaaatgtatggatgaaacttggttttgtacatagtttgtaaatttagggatattttttatatattgttggagaaaagttttttttgaaaactttttaaatttatgtttagagagttgtttacataattactctatatttttggctctctatttgactctctatttgcaatttcataaaaattacactctatatgtagcatttcactccaacacactatctatctagttttgctagtcaggtggctagccaaatttggctagtgagagagccaatttggagagtcggatggcttgacgagtcagatagatagtctgttggagagttattttactgttgaatagttaaaatttagcttggcgagccatttaactagtcttttggagatgctcttatacatgcagaaaatgaaacgctttcacccctccgaatgttgacgtgtcaggtgaataatgactattcttcctaaaccaatgtatcgtcaattcgtcatacatgtatcactcctgcaaacaaaaatgagaaccctgttgatttttctatcagtttggtctcactcgctggcaccggccggtacacgtctactcatgtcagtataacgtgtacagtatggagtatacgtgttgaataggtagagattttctagattaaatttttaaatataaactgtgaacaataataaacaaactagtaggttgttttctaacatgctaccaaatagtacacaaaatagatctaaaacaacaaagacgagattagatcagatgaaacgtattgtttagacatactatatgacgacgtggaaacgacagggacgacgatattggaacagccgtcgagaagagcgtgagcagtctcgtgaatatgcttcccgaaaaatcttattcgtcctctctcgatgtaggatctcgaaggcgacaggttctagagacctactctccagatcgcggatgcacgtcagtgcttgggatgaagaagactacgatggtggcgcagcagcaagcagagactaaaacctaactcgtgttggatgactctggcgacgactattgggctctattgatagctgtctgcacgaaccgataagcacccacgtcgcaatcaatcatggttcgatatcaggtcaagtccagataagcactcgaaacttcacatctaagtaaccaaaaaataaacgacaaaaggaagtcgcacctcgcaaggcgaggggtcggattttggtgaacctttcacacgcacgtcgcgtggccttcgcctcgcctcgccccggccaggcaaggcgagtgcgtgtgtggttccccaaactctttcactccacccatgactttttatgagagagtgtaccctcctcgtataaaactagtcccaccccacctagactaccaatgtgggactattggttccaccgtccccttgtcgtacccatacattagcttttgatattttcttaggatttatttaaatt

SEQ ID NO: 3972 - DNA, 1610 bp, Zea mays
cggacgcgtgggcggacgcgtgggcgcacggggtacctcgaggccgggctccactcttcttctgcggtcggatcccccggcgggtcggactgcggagcacgggctccggcgagccgctgacgagggcctgtgcggcgaccgagctcgtggcgggagaagatggacgaagcgagcacctccgcgtccggcgccgcgacgaggcgcggcttcgtgcctgcgagatcgggagttttctataggttcacccagcagaacctcccagcttggaagccagcaatgacacctggatgtataatagcaatgttcttgattatcggaataattttcatacctttcgggcttctttgtctccaaacttcaaatcatattgcagaaatcatctaccgctatgatgttgactgtgtgcctgatgcttacagaggaaataggcaagcttatattaaggacagctcgatttctaagaactgtactctggaagcgaaggttctggaatacatgagagcaccaatttatgtttattatgaacttgagaatttctatcagaatcaccgcaggtatgtcaaaagtagaagcgataaacagctgcgttttggggcaaaatacacggccgactcgtgcagtcctgttgagtgggataataatggttccccaattgttccctgcggcttgattgcctggagcttattcaatgatacatatggttttactcgtgggtccaaggaaataaaggtcaacaggaaaaacatttcatggaagagcgaccgggagcataagtttggcaaacatgtgtttccttccaactttcagaacggaaccttgattggaggggggaaactcgaccctactgtcccactgagtgaacaggaagaccttattgtgtggatgaggacatccgctctccccaaatttcgaaagctctatggtgtgattgaagacgacctgcatgccgatgagaccatagctattttcgtaggaaacaattacaacacctacacttttggtggaaagaagagcatagtcctgtcgactgcgtcctggctaggcggcaagaacgacttccttggacacgcttatattgtcactggttcgttgagcatcatcatatcgattctctttgctctgatccatgtgaagtacccaaggccgcaaggtgaccccaattgcctatcctggaacaggaaaaacagcaatagctaaggggccccgcctgtatctaccatctatgagggcgcctccacatgaatcagtattacacatctgtatctgaaacatgtcagacactgtgccgcaaggttaatcccagatgatgaaaagaaactgcgtacaccatgtccatcagaaatactagttccaattccgacacatgcgctgggcatcaaggtcaacaccgggagtttttattattattattccagaatgcgcacggtaatttgaaaatgaaattgtggtggaaactgtggaatccgctaatccggtgcggatctgcacagagaaactctggtggctgctgtgactaatgaaaagtggttattctggcaaaaaaaaaaaaaaaacgagggagatgtaatacctgatcagccctgaaatcttaaaaggctcccttctttcac

SEQ ID NO: 3973 - DNA, 2001 bp, Zea mays
gccggccgggtccggtgtttgtttttgctgcatccgccggactctcgccgccgcgctcgacttcctgccgccgcctgggccgactcctccgtccgcgcgaaacaccggccggccgaggcgcaactcagtaagccggcgcgatggatgatgcggcacttctctccggagcaggggtggctgccgccgcggcgccccatgcggcggctgccggagccgccgtgatgggcgtcttcaagtacaacttcgcggcgcagttcctctcgaggattatccctttcgtatttaacatctggttcgtgcgccagctcggcgcggacgatggcgctgtttcggcatttgcactgcagcttcctctatttatgaactgcatcttatttttaagccgggaggggtttcgacgtgcatgtttgcgtaatgattcccagagtgatgtgttgacttctgaagcgatactaatggtcgcttggatggtaattccagtgtccatcttaattacttctgttggcagcatacttgtgttgagtttaaagagagtgaagctatctgacccctatgcgaaagctgtattgatcatcggatttgcttgtattctggaattactggcggaaccattatacattatttcccagaaaaagaaatactataatataagagtgtacgttgaaccgacagctacactcttccgttgtttaacaactttcatcctcataaaaggacatattaaagtgaacaagctggttctagtttctctgtcccaggttgtctatggggcctgcattctctttggatattggtcatattttcttatgtatactgatactaaaccttcagatctttttccgttaaggttatcaaacctgatggactacgataaacagttattgcacatgtgcatgttgtttacaggccaggctttcaggaagttgatactccaagaaggcgagaaatttgtccttgtgttatttgatactccatacaaccaggccgcatatggtattgtggataaactagggagtctggttgttaggatagttttcttgccatttgaagagagttcatatgccacttttgcccgattggcaggagagagtccccgaaatatatccaatattgaagactctttgcttggtgcgcttaagcttattatgctaataggtttggtgatcatttcatttggtccaagttattcatatacccttctaaaattactctatggggaaagacacagtgatggagaggctccagttattcttcgttactattgtttatatatcatcagtttagcaatgaatggcacatctgaagcctttcttcatgctgttgcaaatgaaaaccagcttaagcagtcaaatgatatgttgcttctgttctcggtgatttacatcattctaaatgttgttcttattaaatcttctggagctgttgggttaattgctgctaatgccattaatatgttgcttcgaatatcatattctgcagtatttataaaagactatttcaagggctcattctctttccggcgctgtgtgcctgcgggctggggcattttactcatttctggtctgaccactgttttctctgagagggttttcttgaacaaaacgaggttcaagcagactgttcccattcacatagcgattggcatcatgtgcttgagcatcgcgttacttgagatataccgtggcgaaaagcagttcttgatgcaaataatcagaactttgaagcataatgacaaaagccagtgatttgaagacacagcgcatttcatagcgtattctctctggaacgcctgatgaaagagagctggtagtatagtgggtgggtaatttggtgtgtatgcaggagatcgggagttaacataagaggggggattaatcggtcagatagataaatcggttgcgtatgggaattgctggatttcttgttgacccaatatttatattacaggtttatcgagccaaaaaaaaaaaaatttataattaaatgaagaagtttaggttc

SEQ ID NO: 3974 - DNA, 1260 bp, Zea mays
acgccgcctctgacggacattttggctatcgcaggccgcatagcaggccagacaaattcggtcccttcgtcctctactcctctagtcctctcggctcctcgcagtcgctcactgcgtgcgccaaaagcagcagcagctccagccgtcgccgtctccactctccagtctccaccactgctccgcgcgcgccggatcgagggagggcaggcggacgaggaggagggatgagtctcttcgggcttggacgaaaccagaagacattccgccccaagaagagcgctccatcaggtagcaagggagcacagctccgaaagcacatagatgccactctcggcagtggaaaccttagggaagctgtgaggttgcctcctggagaggatatcaatgaatggcttgcggtgaatactgtggatttctttaaccaagttaatatgctgtatggcacactcacagaattttgcacacctgagagctgtccgacaatgacagctggcccaaagtacgagtacagatgggctgatggtgtgcagataaagaaacccatagaggtatcagcaccaaaatatgtggagtatctgatggattggattgaaggccagcttgacgatgaatccatatttcctcaaaaacttggcacgccatttccaccgaacttcaaggaagtagtaaagacaatattcaagcgcttgtttcgggtctatgcccatacttaccactcccatttccagaagattgttagccttaaagaggaggcccatctcaatacctgttttaagcacttcattctgtttacaaatgagtttggcctgattgacaagaaggagctggctccacttcaggagctcatcgaatccatcatcgttccttactgagaacacggtttgctaaacatggatacagagctcttaatgctgatgctgtgaaattcagtctgtttatgacagcactttactgcatagagcttattgttcccgttattaggcacaaggacatgtcacatatgcgtgtatctgtgttgtttcttcctgatcatgctgaccatgtaagtactgtcatatcagctatagaacggcgatgataatgtactgcagaaagaaaaaaacacgagaaagctgagttggggctacccattgcatattggcactcatcgagtatagaacagatctgcttctctttcttcttacaaacagaattaacttgttgtttttaatggaatggaataaatattcacgctttctgacataaaaaaaaaaaaaaaaa

SEQ ID NO: 3975 - DNA, 6057 bp, Zea mays
  misc_feature (951)..(951): n is a, c, g, or t
tctccgcgaacaccatgttgacttgttccttttggtccgggtttgatgatgagtgattgtcaacgagtaacaatctggaggtagtcagtggactggccaaagtgtgagagtatgtttgtgcaaccatatcggtcggctttgtggtgtgcatgtgtggagcacattaacaatggtcgatgattgaggtaaaggtcatgcaagctcgtgctaatagaccaagagctgtgaatgacgagtgctaggtcttggatgacggaccggagcagccatggtggttgatacccggtcattcacagagcggcccgtattggcggcgctgtcgagcactagcaacccatcctcggtggacgacaaccagcgagccctagcttcgtgccggagaggccgcttgtcatcgcctccatcctggtgccccggcattcaaggagatagacacttgacaggtaagtacggcttcaattcggtcaacaagaatttagcgacatgttcgattcttttgtttatatagttttctttttttcctttttaattagtatcgtgtattgatatgaaactcagattatatgcataaaatggtcaacccaagaatccgtgttaccgtgtaccataagatgcatgcgaacagatgagatgcgaaatggtttcgacgtcggtataactagacgacgtaatctagctggtaatctggacccgtcgtcgttgtcaggtcgtcgccttcgtcccccacttctcctctccggtggaccagctgaacgggagtgccgtaatcgttactgcaatccgatccgttggctgctgcgaatcatcagtaatagaaagcaggcttccactagctaaccgcctgtcgctggcagtattagttaacgctaacggagaagggcaagatcgatcctaccatacacgaacgagtccttctccttcctcagataaacgacgcttgtcttgcaaggnttttttttttttttttttttttttttttttttttttttttacgtgcggttcggtgtgctgcgacgaagcacagtacacctgcctgcgtgtggtcgggagtcgggactggcaagtgctccacggccttggattgggattggatccagcagcaagcgacaagcatgtgactgtccatgcccatgcctcatttcctcggctgtagagtaccctcacaaatcacaatacaatctagccgagattctctcgcctagctgccacatgctttctttctttctttctttctttcttcctgctggagcctgaagatcagacaagcagatgctatagctgctcgatcactgtttcccccttctatcccaggtccagtcgcatgcatgtccaagtaggaacgtggaaagagcatgataataaattaaaaaaaaaaagcagagatcttgatttcctccttcctgtccctcaaactcaaccaaaaaaaaaggaagagaaaaggaaagagagatagaaagaatattcctccctttggtggatgtcgatcgatcgatcggtcagaaaaggcaagggatgaactagctagtgtcttctgccgaataaccacaggtttctttcccctcccgccctttggaagaaggtcgcggaggcaaaggatcgcgagaggattggttgccggccgaggagatgttcttcccttgtgtacgagaggattccttgtccacatttgatagcagagcagcactgcaatgatcgcgcacgtccctgtccggagagtccagaccagccctatcgccgccggagccgcacgcagccacaggaagctgatggccgcgccgaaaagcagtccaatcagccagccattcaattcaatacaagtggcctgaatcgaaaacaggacaggcgcgcacctctggagactggactcatccgttcgggtcgtcatgaaaagccagtccacgccactgccacaaactccgacgccgacggcggccccaggaggaggaggaggaggacatgagcagcccgtggctccgggcggccggctcgccgcgctcctgccaaggttcgtcgtctgcctcccgtccttccagttcgttcacccgtgcacggacggacacggacgcgccgaaagcaagcaatcagtaactagagggagtacgtgaaactgccaatgatgatcagtgagtgagtccccctgctctgctgctagtattactgtgtggtttggtttatgctggcaggcggccgcgcgcgtccagccaatccatgcagatgcagtgcaggtgcatgcggttgcggcccatccgtcgtccatggcagaaccggcagacggcagtaaccgcccaccattaaaagaagaagcagcagcagcagacagagagagagagagagagagagatcgcatgacacggccacgggctgggcagcagagcgcgctacatatacccaccacgccacgcgcttcctagtcagtaatagtcagtcgagtcctcctccctccgccgcggccccgccgcccgtcacaccaaaccttccctccacctctttctccggcctctcaccggcaccacacgcacctaccctcagtcacctcacctctccgcgttttatcggcgttccggcagggggacgatggcgaggcggcgagccgcgctggcggcgctgctagtgctgctgctgctggcggcgtgcacggcggcggcggccgccgtgaccgtgtcgcggaagcagcggcagcggcaccaccccggcggggcgtcggcgtcggcggcgcggtcctgcgaccccttcgcggcggcgggcgcgtgggtggaggacgggtcgtacccgctctacgactcggcgcgctgccccttcgtccgcgacgagttcgcgtgcgcgcgcttcggccgccccgacacggcgtacctccggtaccggtggcggctggacgcgccgtgcgcgcagcccgccttcgacggggccgcgctgctccggatgtggcgcggcaagacggccatgttcgtcggcgactcgctggcgctcaaccagtacgagtcgctgctctgcatgctccacgccgccgcgggccccgccgcgcggaccaccctgtcgccgccgtccgggaagatcgacccctcctccaccgtccgcttcgaggtactggactggactgcactacaaacgtcctttacatacatactccatgatacgtgcatgcatgctccattgttccgttcgtccgttcgttcatgccgtgcccgtgcgtgccgactaccggctcggtgcgtagtttgttcggtcctggcctgggcctgctgggtcggcgcggcggttgccggctgcgttgggcagacgtgacgtgacaacggggagcgcaaccggtgcctctgccggtcgacggggccccggcggcgcgtgcgtttgccgtgtgcgcctgcgcctggctggtggtggtggcgaggccacggtccacgggaacgggaccatcaatcaattcccttggtgcgcgggcgggcgggcggggccgggggtttgctggcacgggcggcgggcgatctcgcctggtctggacgggagcccagactagtggtgtggtgactggtggccgcttcgccgccgccgcagtggcacaaaagtcaacgggaaagaaggtgaagggtccccgtgacgcgaggtcgtcgccacacgactcttgtctgttgtctcgtgcctgcctcgcagtgccagtggccagccgcccgcgcctgctgaaacccagcacgtctagatgattggtctgcgtgtgtctgtaccggcctgaattgtttatcggtgtaagctttcgactagtacgggagatcgatcctatactatatgctggatcaggcagagcagagcagtcgggcagagcaaatggccaagctcaggtgagctgggctgcagtggcgggatctaccataccatctctgtgggatccagtccagcgcgcgtgacatgcctatactgccttgcccctgtccactgacgtcccttcgggtctcgtctcatctcgtttcgtttcgatgtgtggccgtgtcaaggcattggccgttccctaatctcgtttcgagctatcgtcaaaacgacacgactgctcggtgattgagtgtccattgacggcccttgtctgttttctggacggcggtgcgagcaggactacaacgtgaccgtcgtgtactacctgacgcactacctggtggacctcgtgacggagccgcacaccggccggcgcgtcctcaagctggacgccatcgaccaggcccgcgactggctcgccgccgacgtgctcgtcttcgactcctggcactggtggccgcgcaccggcgccacgcagccgtgagtgacatcactgttatttccttccttccttctctgtctatggtaggctgctggcgtcagtctgaaactgggtccgaggctgaaactgggtttgttcatggcctgtgcttccccctgggactacatccaggtgggcgacacggtggtgaaggacatggaccgcacgcaggccttcgccaaggcgctgcacacctgggccaggtgggtcgacgccaaccttgtccagaccgacaccaaggtcttcttccaggggatctcgccttcccactacaggtaaacacactacgccacccacagtctctgtcccattcattcaccctgctcacaacaagcggccccatgtccgtcctcgctcctcctctccgctgcaacgagcacaacctcagccacccaccagcccagctcgtcgatcgtcctgaccgcctgagacacttcacatgctcgcgtcgcaaccacgtccgtccagccggatttatgaaccgcgcgcgtgcataattgcatttgcaccgatggcaacagcacgcacgcactgaccgactgacacacggcggttgcgttgcgtcccccctgctgctgtcggtgcggtgccatgcatggccatcgccatcatcgatcagcagcatcagctcactgctcacctcagcccgtccgtgtcggtgcaggggccaggactggggcgcgtcgccgaagaagacgtgcatgggggagacgcggccgctcaacgccacggggccctacccgggcggcccgatcccgcagcaggcgatcctgcgcggcgtgctggcggccatggccaagcccgtctacctgctcgacttcacctacctctcgcagcggcgcctcgacgcgcccccccccaagtacgacggcggcatcttcggcggcgactgcacgcactggtgcgtcgccggcctccccgacacctggaacgtcctcttctacgccgcgctcaccgccgggcaggggcacaactgatggatgagtactacgttttttctttctttcctttttctttttaccgacacgcagtgttacgtagctcaataagtaaaggaaaagaaaaagatagcagattgatttcgtatagttacgagggggccttcaaaagatttttcaacctaaatgagttgatagaagaatatcaaaagagaatattgtaattcattcccgaattcagttggcatttttcctgggggtgctggcatttaatttcctgaattcaattgcaaatttatccagttttcttggatggctcattttcgttcaaacgaaggatttatattttgtatgaaaaaataaagttctttttatccagctatgtatgttcactaggtcgccatttcaagtgaagctgggccgcgtgccctctcgtgggaaacggcgtttttttaattgcgggtttcattgactggctatcaaaaatccatgttcaagatttgtcaaaaaaaaacttttcaaaactgggataaaaatatttttccataaatttggtgtaccatctgcaagatattggtaaactctgataccaaactatgactcccaaaattttagcttgcctaagatttgacaaccaaattttggccatcaaacaataataaggctctgcgttcgtagcgttccacgaaatgggccaaaagctaactgacatgcaaactgggccgcatgctgggtactaggcatggtacgcttacagtttctaggagaccagaggggaaatattttccaatccagctttcacctgactaaacgaaacgcatttgaaaaagtgacaaacac

SEQ ID NO: 3976 - DNA, 1384 bp, Zea mays
cattgggtacctcgaggccggccggggcctctgatgagtgagcccatcagctcgcgtctggctctcgcaggcggcaggtcgcagagcagcccagccccagacccacctcgtccgcttcgtcctctcgtctcctcgcactcgctagctgacgctgcgtgcgccaaaagcagcactgcagcagcaggtccagccgtcgccgttcccacttcccaccactgccacgcgcgccccggatcgagggagggcacgcagacgcggaggagggaggatgagtctcttcgggcttggacggaaccagaagacattccgccccaagaagagcgctccatcaggcagcaagggagcacagctccgtaagcacatagatgccactctcggcagtggaaaccttagggaagctgtgaggttgcctcctggagaggatatcaatgaatggcttgctgtcaataccgtggatttctttaaccaagttaatatgctgtatggcacgctcacagaattctgcacacctgagagctgcccgacaatgacagctggcccaaagtatgagtacagatgggctgatggtgtgcagataaagaaacccatagaggtatcagcaccaaaatatatggagtatctgatggattggattgaaggccagcttgacgatgaatccatatttcctcaaaaacttggcacaccattcccaccaaacttcaaggaagtagtgaagacaatattcaagcgcttgtttcgtgtttatgcccacatctaccactctcatttccagaagattgttagccttaaagaggaggcccatctcaatacctgtttcaagcacttcattctgtttacaaatgagtttggcctgattgacaagaaggagctggctccactccaggagctcattgaatccatcatcgttccttactgagactacggtgtagtaaacgtggatatagagctctcagtgcagatggctgtgaagtgtccatccgtgacagaacttcactgcatagagctatatgtgcatgtacctgtgtgtttctaaatgatcatgtattggccatgtaagtgtgcctgttatcagttatagaagggtgatgatgatcatgtactgcaaaaagagaaagcacaagaatgtgttggattgatgtatgcagtgtttattttcctcctggttgtggaaccgtcagtttgtctgcttattgctagacattctctccgttctataaattgtaggtcgttttaattttgctccaactttgatcaagtttacatgcaaatatttcgacatgcaaaaccaaataaatgtattgtcaatgctcccacgatttaatgtaactactctcatgtactaaaaaaaaaaaaaaaaaattcgagactagttctctcctcgtgc

SEQ ID NO: 3977 - DNA, 892 bp, Zea mays
ccgtcctcttatcttcccctaaaaccaatttgattaccagaagaaccatttgaggcagtctcgtcatcctgatgctttcgtttgtgcttctttgacttcctatcatgttccctttctctgctgttcctcttcgtatcttctgacccaacattttcatcagcatcgagtatctgcttctggccaatagtttcaacctctttatctttcctccttttcttcctgtgtttcttcgcagagcttttgctcgtaacagcctctgcatgctccaagcaggagtcttcagccatcttggctgacacatcagcttgctccatctcaatgctatggttcctggcacatgagctatcagaattgctgccctgacccttgtccttatgcttcttccccttcttccgtttcttctcttcttcggttacttggcagtctttctcctccttgttgctcataacagccttaccctcataatcgccgctctgacccatgtccttatgtttctccctcttcttccgcctcttctcttctttggtcatttggcattctttctcctccttgttgctcatagcagccttgccctctgtatactctgttctggaaaccctctccgttgcctctttggcaggaccaccggccggtgtgcggaggacgaggcgactggcgagaggggaagccgctgacgccgtcgctgagagcccgaggctgagcgctgccaccgtcgcctacgtgccgagcgcgagcaagtgagggagcggaagatggagcgtcggcgctgcaaggaagaatgaagaaacggcggcggctgtatgcctcgctggagcagcgaaaaggttagggtaaagaaacgtgtttttcgattaggatgctctaggtaatggtctcgtgcgaattcctgcag

SEQ ID NO: 3978 - DNA, 4771 bp, Zea mays
tttcgagaagaaaatttcgaaaaggactttgtttgtggccatgctttttatagtgctaagcatttaacaagttagtgttttgtcatataacttcatctgttataaattggtgcccataatcctgtgatgcatatttttggaaattagtttatatttagatcatatcatgacagaacaatcatgaggtttatgcaggtatgagtacagatgggctgatggtgtgcagataaagaaacccatagaggtatcagcaccaaaatatatggagtatctgatggattggattgaaggccagcttgacgatgaatccatatttcctcaaaaacttggtatgttgcttttttgtggatttatggagctctctcggtttcttgagaacacctggtatctgatgcaatcgagcatgttatctgattcggattttgtttcccctttgtcaaggcacaccattcccaccaaacttcaaggaagtagtgaagacgatattcaagcgcttgtttcgtgtttatgcccacatataccactcgcatttccagaagattgttagccttaaagaggaggcccatctcaatacctgtttcaagcacttcattctgtttacaaatgtaggtcccatcaatcatggcaattgcttttcatacaacacaattacatatttgcattcttggccaagaaaaaaagaaaatggcagcagttaacgtcctttggtatttttgtgctgcaggagtttggcctgattgacaagaaggagctggctccactccaggagctcattgaatccatcatcgttccttactgagactacggtgtagtaaacgtggatatagagctctcagtgcagatggctgtgaagtgtccatccgtgacagaacttcactgcatagagctatatgtgcatgtacctgtgtgtttctaaatgatcatgtattggccatgtaagtgtgcctgttatcagttatagaagggtgatgatgatcatgtactgcaaaaagagaaagcacaagaatgtgttggattgatgtatgcagtgtttattttcctcctggttgtggaaccgtcagtttgtctgcttattgctagacattctctccgttctataaattgtaggtcgttttaattttgctccaactttgatcaagtttacatgcaaatatttcgacatgcaaaaccaaataaatgtattgtcaatgctcaaacgatttaatgtaactactctcatgtactagatgtttgatcgaatcctttataaatttagtcaaagttaaactagtttatttgtgttttattaaaaatctggtatgtaccaagagctcagcgatttccttagtatataaagccctgtgctgtgatattcattgacgatatggacctatgtacattattcttaatgtatataatttgaatctaatccaactattccttgaaccccgggggtaataggttccgttttttaacagcagcggggaaggttgaaagccaagaaggcaacggcattttccaagtccaaggtaaaagtgcaagtgcacagctgctaagttcacattgcattttcaacagtcatccaacacttaatcagactattagttctaactggacggcctgattcctagtcgttctctaatcgagccccaaatcatgattagttgggcgataaaacatccgtgatttcaaatccagaagatacataagccctcaacaataccaaagtttgttgagatcagagtgctgacgacacccttggcagctctagaaccatatgctgctaacgtttctaaagatcccatattacaagtcagaggctccagcaggttcgtcggccgaggatccacctgcgactggtttcctgtacgcaagcatctctgggcagtaccgccttgcaagcacttccacttgctcaatgaaaggcctatatctgtggtcacccatcaggcgaatcatctggttccatctatgacggcaaagctccccagacctgtgctcgagaaggttctcccagtccacatcttcagcacaaacagcatcgacattttgaagcgcttccactaacatgtagtcatctgtatctgcccagattccttgtttaaccagcggcgatgccaattgcccgtaccatttcgtgcagcattcttcggctctacgagtggttaatttttcactgatagcctcccaagaaatgttatctcttatatgacggtgaccagtattgatgttttgatgggctttcacacgcatgtccagatttaccaaatcaaacaagttttggtactcatcctgactccaagtccctcttttcaaatttttgaactttattcgtctccaagtatcttttacatggatttcactctttccaagttcttttgctaataccttccaatttcggccgttcttttcaacaaaccgtcgaattatctcatactcctcagcggtccatttacgttcagcactcctttgaagtaaaacctttccacgcgcgtatttggctttcttgggtctatgaggtaatgcttttcctatttcagcccaacaacccctggtctctggatggttattactttccccaatcatctgtaaccctttctctcctaattgcttcaactctgcatatttcaatatcgcttccattagctttgcatcttcctcagggctaaaccgtcgtccatgcacaagttcagtttcaccactcccatcaccctctacatcatcactaccacctatattaaacacctccacatgatcagtgaagctcactcgtctacacttatccttctgctttcccatgttttctttctctctttcaccgccaccattctcatcctcacacatttttttctctttgttattcttaccattcttgccctctccaactagtgtattttgtcttaggtcaacaccatcatttctctcttttctcctcttcttcttgctatctgtcttcttcccaatctttgacatatcagatttattgtcctcttccaaatccaaggtaactaaatactctttttccatcctcttatcttcccctaaaacaatttgattaccagaagaaccatttgaggcagtctcgtcatcctgatgctttcgtttgtgcttctttgacttcctatcatgttccctttctctgctgttcctcttcgtatcttctgacccaacattttcatcagcatcgagtatctgcttctggccaatagtttcaacctctttatctttcctctttttcttcctgtgtttcttcgcagagcttttgctcgtaacagcctctgcatgctccaagcaggagtcttcagccatcttggctgacacatcagcttgctccatctcaatgctatggttcctggcacatgagctatcagaattgctgccctgacccttgtccttatgcttcttccccttcttccgtttcttctcttcttcggttacttggcagtctttctcctccttgttgctcataacagccttaccctcataatcgccgctctgacccatgtccttatgtttctccctcttcttccgcctcttctcttctttggtcatttggcattctttctcctccctgttgctcatagcagccttgccctctgtatactctgttctggaaaccctctccgttgcctctttggcaggaccaccggccggtgtcccgacattagtatttagtgaggtttcacttaagtcctatatctagcaccagtggtggacctccggaacggatcagactatgggctgactactcaataactatcatggtcgataattatcagggttctaaaaagtggcactaagcgcacgcttcaacgctaagatgacgggtaacgcttcgctttggggcgtaagattccatatcacactccctatttcaaacttcactctgcaaatactgcaatttacatgcaatttacagtgctggagatgcctaagcgctcccaaagcggcgcggcgcgaccgccttggtgcagcggcggctgctggctgccgctgccctcagaccgcgcgcggctgtccgccggggccgggcgccgttggcgatcggaggggggtagagagagagaggggggggggggggcacgcacgcagggccaccggccggtgtgcggaggacgaggcgactggcgagaggggaagccgctgacgccgtcgctgagagcccgaggctgagcgctgccaccgtcgcctacgtgccgagcgcgagcaagggagggagcggaagatggagcgtcggcgctgcaaggaagaatgaagaaacggcggcggctgtatgcctcgctggagcagcgaaaaggttagggtaaagaaacgtgtggtggaacttgggtttgggctgaattcaggctgtgtccaacgaggtcagtgctgaaaaatccaattcctctcctataccaaaccgtttgaaatccaaaaaccggtcaccgaaaacggtttaccaccggtgaatcgacggttttcaccaaaatcgaacggtttttaatttaaaaactttcgaaaaccggtaaactttcagccggttttttaaatccttgctctccacttctcgaggaacgtccaggacgagtcggcggtcaattgacacctcagtcctcacatgagcttccaaagcagttttcgagggattgtctctctcacataagccaatctcatggatttgggcttttcaggcattggtctagcatttattagcacatgtacagcctaaatattatattatatatgattctctaagcattagatatatctaaaaaatattcatacaactcaatgtatctaaaatttatatttg

SEQ ID NO: 3979 - DNA, 804 bp, Zea mays
  misc_feature (157)..(157): n is a, c, g, or t
cgggaagcaatgggaacctgtttttgttgacgaagtatattaggtgctgatgtctcagcagaggtcccgagcatgctggaacgattcgaaatcgaatccatcctataacgcactaccgaaatcaaattccatgtttagaggctgacaccaatccgantggacagcaaagagagattgagttgcactttagagaggcaaacctagaataacaactgatagctcgcgtcaggaagcacgcgcgcgacactattcaccttgtggtcaacgaaggcgaggatgtcgagggcaggccgcagacggggccaacgacgcccttgacggcagactcggcggcatcgacgccggggcgaagtgggtcggtgtggtcctttggcaaggtcgcaaagcgcgaacgtggcacactccttcgtggctcacgtccaggcctccgccttcgccttgacctgccgttgccgcacctgtcgatgctgcgcgcgctacggacggagggcgggagcaccgggagatagagtgttaccaccgacaggggtgtacgaacggcgagtggtggcgaagcgacgaacgccatgggcgacagtggcaacacgtagagccaccggtgctgcgccctccacgcccgcggtggcggcacacgctcggagtcaccggtgatataccctctgtgcctgctcccgctgcctctccatgcttctccagctcgagttgcagttctagagtagagctttacggcagcagccagagcgcgctggcaatggaacctatccagttggtgatggacgcttcgcgaaatcctatcgggttggt

SEQ ID NO: 3980 - DNA, 5273 bp, Zea mays
  misc_feature (1637)..(1637): n is a, c, g, or t
atagtataccttatatgacgacatatgtgtagttgcacgatcaactagatcctgcagcacacgtacgtacacagacacactctacatgattggttgctagcacctgcggcgtgtggctcgcgcgagcctaggcagccagaaacgcccctcgctcacttgtgtgcatatgcgggtatgtgagtgaaaaaacatttacggtgtcttcacgcatggaggatggaaccctatcgtacaggaaaccaatcacgctgaagactagtcaacgcctccagtccgcatggacactggcctggcaaccacagggactgtttttattcccgacaatctatgtgttacgtgtagagacgatcgatcgatctgtgcacgcactgccacagcaaagtccatagctaggcgcatttgaatccggcgggcacacggcggccgcagtagttgacgaggagggagaggtcgacggcgacgtcgaggttgacgccgaggacgttggcgttgatggcgaggcagacgcagacagcggcgtccaggtcggccaggccggagatgagggagcagcagggcttcttgggcgggccgcccaccacggcgtggatcagcccgtccagcacgtcggcgcacacgcccagcttcaccgcgttcaccgggcacttgccgtccgggatcgggcacgggtggccgccgcacgccgccgccggcgccacgcccgacgacagcaggatgaatagcagcaaggccgaggcgcacagtaatggtaccgcggtggtggaagaagaactggaacgcctcgccgccattgtggtcgtcgatacgatacgaggtggattgtgctgtgcggttgatgatgcccgccccgcgggcctcgaggtaccctttatacccaaggatttttggagcttacttactcaagttgctcctaattaatatatatacgaccatgcattttctagcttagctgatggtatatgtgtcgtctgcttacgaccaagctatgtataatacaatacgtgttgtatgtatgtatgtatgtgcagccggccggccatgatgcatgagcattatattcagttgcattgcctactactagctagctactgtcaattgtgatgagtgtgtgtgtgtgtgtaaacggaattaaaacaccatgcatgtccaaataaattcattttctttcattggccgcccatcaatttgtcttaagctcgaaacgtgtttgtgccattggctttagcgaatgtccattcttttctaagcaattttgttcttttttttaaaaaaaaggtagccaataagcgaatgaagaagcacacgtacgttacagtatttgaaagtggcagacaatcttgttatatattatttggaagtcgggcgccatctatatatctatcttgacaagaacgttcaaacagttgcccgtgaacctcatctcggccggccaatatataacgacatccaagcaagacatgcaatttgtagttatctattctgtacaaaattcttgacagatttttcttccactgccacatcactcgccaacagcaaatcaggcagctttcgtcgcgcgaacagatttttcttgtcaaattcttggcaccaatcaggcagcttgctgactgcctcctcgagtttcttgctctgtttcnccccaatggatgccagagaatcagctgctacagaagctagcagaacctcctccatcctcctcaaacacttgggccgctcgtcccaggccgttcaaagctagagtatcacttgtggtacccgaaatgaatgccctctgcatcgatgaggtttgtcagttcattatactgtcgtgagaagcgtctctcacagtttcctctaccttctgtcctaaacccagtttcctctggtatacgtatgtgctctgaaaatttccgaaaaaaaaatctttgtgatcggcccagctctagatacatccttaagttttctagccacgctagggctgagtctaccaaatatagaggaaggtttcgaattataaagttgttgtggtccgcctctctcgtttggcatgccaacctataatccccaaatatagagggaggtttcgaattataaagttgtcgtggtccgcctctctcgtttagcatgccaaccggataatcccccaaccgtaggctagggtttgagtttgcgatattcgtgggtgccctataccgttacagcactagcgctcggaggatgtggcagtcgaaagtccgagggcctagcgaatgcgggctttggcttcggtccttgttagggtcaaaacgtcctccacgacgcaagttgtaccgacgaccgatggctggttctttaggtcggggacgctccgcctgttcctgcctgacctagagcgtcgacgaggtggggactgtgccacaccttgctcatcacactcgagcagctagctcgccaatgtttcatcttctgggggcgtggtcacagtatgctgatcgacctctggctctgcaactttgttttggtacgacagatggattcataatcaaagaattgctgatatggtccccttgctctttttctaaggttaacaaaagaacgaccaagaaaaagacagtcttggaagctcttgatggctattcttaggtagttgatattcaaggtgctctaactgcaggggttatttcagaatttctctcactttgggatctcatctcagaagttgtcccccaaccaaatattgaagacactcatttttttagataaacgaaactgatccccgcctttgcgaagccacatacaacgtattattacatgtgtttcatctattggctgatctcttagggaacaaagtatattacgagagacaaagcctattattatatttccatccatatctagcaaaaacctccatggcaataatatccaggatacggctcaccgcctggatgttctcctttgtcacgttctcatgctgcagcaatgctcaacaccacagccaatatgttcccctgaaaatagtctacataaaagatgtatatatgacattgtcaaaaattaaatcattccgacaccaccggatagcccagcaaagggcagtcaccccaacaagaataatactctttccttttgtagcaactcctgaaagccagttcccagcatgtgaataatcgacgtaggtgctgttaaacccatagctatattaaccaccctccaaatcgttttagcgtggtgacagtcaaacaataagtgtttaattgtttcattacaattacataaacaacacttttgactatctttccgactgcgtttcgccaaattctcctttgtgaggatcatcccatgttgaaggtatcaaaggaaaatcttaatttttagcggaactttcaaacttcaaatgattttgtgagtaaaatgagggttgtggttcattaggtaaagatacatcgaacaaactgtaaattgaccgttgcgacataagttccatgagaaagtgtctctctcatttgataaaccaatatgagctattttggctactaaattataccattggtttaggttgattcctactgaggctcttcgaaaagagatgtgtagtggcgtagtcctcataacattcacaactgtttcatgtggatagtgtgtgatgttataaggacatgggtattgttctttgaaaggctgtctgcctacccatttgtcctcccagaaccttatttgcgacccatccttaatattgaatgtgccacatcaaggactattttcttaacttttaaaagacctttccaaaagtgagaatcatttggtttctcttgaacatgagagagggttttggtggttagatatttatttctaagcaaagattgccatggcccatctccgttaagcaagttgaagatccatttgcttaacaaaattatattttttgttgccaaatctgcaattcctagacctccttggtctttgggtctgcaaaggatgttccatttatcaagtctatattttttcttatctttgttcccttgccaaaaaaaatctagatctatattgatctagtttttttaaaacctctttagggatctcaaaaacagacatcataaacatgggaagacccctaagcaccgggtttaaaaggactaatctacctccataagaaaggtgttttgctttccaggaggctaattttttctcgaaccttttttctatgaccctcctatcactatttcggagtttcctatgatgcatcagtatactcaaatatttaaaaggatattcacctgaattgcatccaaaagttcagtatactggttttcaaataattttgcttttatggaaatttatctttaggccagaaagttcttcaaaacacttagtaacaatttcatgcttttgacctgatctaaatcatgatctaagaatagaatagtatcatctgtatattgcaaaattgataaaccatcctctaccaaattaggaatgaccccactaaattgtccatcatatttagctcttttaattaagagtgccagcatatctgcagctatgttgaacaaaataggtgacatagggtctccttgacgcaaccctttctttgtctggaaataatggccgatatcatcattgactttgattgcaacactacctcctgcaatgaagttctctacccatttgcaccattttggagagaaccctttcattctcaaggtttgttgaaggaatggccacttaactttgtcataggcccctttcaaaatcaattttgaaaattaccccattaagtttttttgtgtgtaatttatgaatggtgtcgtgtaatataaccactccttccattatattccttccaagcatgaagagggtctatgagggtctcacaactgtttctacaaccttgtttattctattggtggcaattttagtaaaaattttaaaactaacatttaacagacatgttggcctgtattgttggatttttattgcctctttagttttgggtagaagagtaattacccgaaaatttagactaaaaaggggaagtttatcttcatgaaaattatcgaagagagccattaaatcttgttttaaaatttcccagaagacttgatagaattcaatagggaatccaacgggacctggagcttttttgtgttccatttggaaaatagcttctttaacctcatcctccgtaaatgttgaggttagtaagttattttcagccatgctaacatgggggatatcttcaatataatcttccaccaaggttatattggtattctctggcggtccaaacaaccctttatagtagtttggtgatatat

SEQ ID NO: 3981 - DNA, 2018 bp, Zea mays
  misc_feature (33)..(33): n is a, c, g, or t
tgttatgctgtgatttctctccacttgagtttngacttaggacaaaattacaacatgatagccttcatcaatcaaagttttggtaggcaactaatgcatcacaaaagtactctctagaaaaggagtttccccaaaatcacttgttcttctcgacagtggactatcttaaaactcactttttaaaagttccacttggtgggattggttttatttatgttgactggaagggaataggtcattaagaagttagtattaattttttgtgagacaatgtgtgttattattgcgaaagttttcctgggagctgtacttttgtgagagtttggtcaaaacatgtgttgtcgtccaaaatatatttactcattaaggatctttatgtatgaatttcaggtattggtgatacaacagattgattttatgacatcaaaggcatggatgtctgcagataaacaagtggagagaaaggttgggcatttgatcagacaaatgattgcactagggtgtgtttagtttatggtagtgcagtttaagcaaaaaaatgaccatgccaagtaaacttggccttcgtttggttggatgccgaagtgttgatggccagccaagccaaattctgttcaacaacaaaaaaaacttaagtgaactcaggtgaccaaaatggccttcccaatttttggcttataaccaccaaaaaggacaaattttgaccggccaaagcatgactgttttttgctttgtctgcacggacctagatttcattggcagatttgatctcagtgttatgttatggtatgaattgaagggcaaagtaacagaactgaaaacgcactgctatgtagtgtgagagaaactatgaatgaataagtttatttttgctttgatttcctctcctgtgcattttttgaatcagagattcttctcaatcttgcaggtgattaaattaagtacacaaaatggtgttccgtcggagtacacagatatgatctttcttcaaacaaatctggataaagtagaaggaacacaaaaggtaggtctaacatgttattcttcgaggatattcactatcttctggtgcaggggttttcatgaaataacttcggatcacttatgttcattttctaaatataaatcagttaaaaaagggggtcttttcatatatggaggcaataattaattagctcataattatttactgttgttggcccctgcaattataaatagtttgatgtgaagggacttcttcctgagctttgtgtacttgaacacaaaaggtcaagcaaaaactgaaaggacacaaaggcagagatgagcaacagatttatggcctgaaactgggattcggtaacaaagatgctacacgggaaaatctcatcacaggatttggggacatgaatccggcagagaaatctgtgatgctccaaaagggatcgggctgttgcagccgcgtcgcagactgcctctgctgcatgtgctgcatcaaggcgtgcaacaggatgaacgaccagtgcgccgttctgatggcacagatctgcgcggctctagcgtgcctcggctgctacgagtgttgtgcagaggtgtgctgtggagggtcggagtcgtagtaggaagtgttttgtatatttgtatggaagattggagaattggagtgtacataatagagttcgcggaagcccggttctggcccggctcttggttgtatccgtccaaacgttctataatttgctcgttacatgcaatgcaaaagagggatggcacccttcagtagtattttgctgttgtgcagtgcaaacgagggatgtatctgctggcagttcgtgtgcttggagtcggaggtgatataaaataacagttatcattaaatctagatcggatgtaccagatcgtttgattgcatgcttgcatcaggataagtgattgcataggatattttcccgacttgttatgctattaagtagctaaaattagggtacaggacccgctaaatttagaggacgtagatctggagggagtagaggacgtcc

SEQ ID NO: 3982 - DNA, 2177 bp, Zea mays
gtaccctcgggtcttccgggaagcttttcttcaattcattaagtggagggataaaatttggtttctatatttttatactacaatttataataacgctccaactaagggcctatgtggttcttggtgttaaaatttagcactacatttttaacacttagattgaaatatgagtgttaaaaggtgctacaagtgaagtgctaaattttagcatctaatagaactttagctccaagtgtgctaacctttagtacttgttaaagtttagcatataacatccaagcatgtcttcagtatttcctctatatagccaacaatagtataaagtagtttctctatattgccaacaacagtacaatatgtatattctgcataaaactattgtcttgattgataagtgcttaaattatgtttaactcacttggaagccaaaaaaagagtatcccagttcttaattttgtgctagagttttttttgtatatataagaatgatatgcactggatattataggctcggaatttgctgtcagattttatattactcatcaaagaagacatgacaactctatgcaaaataaacgtctcaaataaactgatttctgcaaaaaaaaatgaacattaaaatgacctagttttccaaagctaaacgtcattttgctggatgttgtagtgtagatctcagagtctgcttgttgagatgtggatctttcctcatcacggtgaggtcctccgttgactagtagcgtatgcgttgctgcgtgctgtctcggatggatggtggttcatttccaccaagattctttacttaaaatttctgctcagtagagatcctaccatgcaatcgattgcttcaagatgtttttcttttttcttagagacattattcgttttagtattttagtagattatttaacggatgatatatttggtgcacatagaagtttagtgcatatggtgtatatattaaatcatccgttaaataatctgctaaaaaaaaaaaaaaaaattatttcaatttataaataacaaccttccactactacatcccaccacgtcgaagggtgttcttagtaaaatatatcaacgttagatctaaaatgagtgatgctgatttaatatgtgcatcatgtgcaatagatatgttttctatttaacgtatgtcatggttgtgtcactttattcagcatattataatgcagggtaggtacgttcaaccgtagtgacagataaagaagtatgcaattaggtagaatgtagttggtatatgatatagctatttgtaatttataatgcttgcgtgtacatctgtatgtttaggtatggctacatgaatagtggctttgggtgtgtttgtggctttagatgtcgtgacactgcatccttttgactgtaatgtcatctatcacatttagtatgattaacaaaagcattatcttgattgtcctatatcatgtggtcatcctaatcagagacacgtgacactgaggccatacgctttgggtcgtcacacgctaggctgggaccattccatctgaagggcgtcttcattcggggtcgttccaccttgagagtgttcggagaaaacaactagagagacatcttgatttgattgagctagagatttcttcctagctaggaggcccacgaagtatggagaaccttgaaggtgagggatctagaggcctggagagccacaagattaggtcgagcaacaaggggcttctaccccaatcctagagcggagacccagagggtcataggatctgattgtaatatatcatgattttttagggcatggggccttgggtgcatggatctacacaatcgggtccattatggtttccttctactaaatggaccttagaaggcatactgccaatatccaggagaatacacatcctagacgttgataacaatatatatataaagaaattaatatatcttataatttataaatttttatagtttagaatagggaacttattttataataaattcacatgtttctttcatttatataagtggcttttcaatttataagtaaacgtatttgttccttttctaatctaagttgttttttatttagtgggtcttttatcaaatgataacttacactaaatttttgtctttatctcaggaattgattttttcatataatctagttatctttaaaagtagaa

SEQ ID NO: 3983 - DNA, 1264 bp, Zea mays
  misc_feature (501)..(501): n is a, c, g, or t
acgaaaatctgacatctcatcttgatccatccagctttgcctcgatcgccggccggtagccatgtcccccacggaagaagccgctggtggtggtcgcgacgactatgaccgcttgagcgagctgaaggcgttcgacgacagcaaggccggcgtcaagggcctcgtggacgctggcgtcacgaccatccctgccatcttccgcggccatctccttcaggaagggccgaagtcgcacgggaggaggtggtcgcccagttgaaggctgcagccgagacggtggggttcttccagctggtgaaccacggcgttcccagcgagctcctgtccgagatgctgccgtcggtgaggcggttcaacgaggagccccacgaggtgaagcggccctactacacgcgggacgcacgtcgcaaggtgcggttcaactccaacttcgatctgttccagtcgccggcggccaactggcgcgacacgctcttctgcgaggcagcgccggagccgccngcgggcggaggagctgccggtcgccgtcaggcacgtgatgctggagtacggcggcgcggtgcgggaggtggcggcgcgcgtgctggggctgctctcggaggccctggggctgagccccgggcacctcgcagggatggggtgcgcggagggcctcagcctggtgtgcaactactacccgccgtgcccggaaccggacctcaccctgggctgcagcaggcactcggaccccagcttcctgaccgtgctgctgcaggactcgcatgcgcagggcggcctgcaggcgctcctcgcatccagggggctggacgtgcctccggtggccggcgcgctcctggtgaacgtcggagaccttctccagctggtcagcaacgggcggttcaagagcgtggagcaccgggtggtggctaaccggagcagggacacggcgagagtgtcagtggcgtgcttctgcaacgcggacatcgcgagatccacgaggctgtatggacccatcgcggagctcatcgccgcggacgacagcgacggcgcgggaagggcgctgtacaggaacgtgacggtcccggagttcctagcgcactacgacaagaaaggcctcgacggtcgcccggcgctccaccgcttccagctgcttcaataattttacatcacatcagtcctgactctggtgatatcatgtcagtatgtcactgtgggctactccggtactctaatacagttatggatggatcagatcaatactaatctctggtaattttttttaagg

SEQ ID NO: 3984 - DNA, 4771 bp, Zea mays
ctgcagcaaccccttcccaccaatcttcaaaggaggagcacgcagggttaggagcaaggtgctgcaacccaacagatttcataatctgaaaccagacagcctgtgaaaaaacgcaggaaactacctagtccccccccccccccccctcttgatcacaaagtgtacaaaattgagggtgaggcagtcctctttttgctagtcggtctgctgtccagcagcgatcgtgggccacgagccacatgaagaacttgcatttactaggagcccatgatttccaaatcctttcccaaggtttaaattaaaagttgttgctccaagaaagaaatcggtatatgccgatttggccgaatataaacctgagcttgaaagcctccaactatgcttatcctcctgatctggtgttaagacccagtctgtagtgaggtcccaaaccttgaggaagtcagacaaaacatttacagtgataactcctctaatatcatgaacccggctccttgaaatgagggcatcgtggacattcctcattttagccctagaagagaccatctggaccaaatgaggggccagctgacatagactttggccatcgatccaattatctgtccaaaacaaagtgtttttaccgttgcccaccaccgaagagattgctaccgagaagaaggccttaactgaaggatgagcatttattttaaaggatgcccaaggtctgccagtatcggttttttccagccagagccagcgtaatctaagagcccaattcatcaaacgcagatttaagatacccaatcctccaaattcttttggccttgtaaccttgttccaagctaccaagcaatgtcctcccaaagcttctttcctccctctccacaggaaattccttctgatcttgtcaattgctttgaaaacccaagaaggaaggtccatggccatcattaagtagatattcattgaagacaggacagtctggacaataatcagtcttccagctctagtcaacagatcagctttccagcagggaagacgatgtgcaattttatcaatgaatggctgaaagtgttgtctgccgagcttctttaaggatagaggcacccccaaatatttgcaggggaagttggcaacaacgcatggcagcagattatgaatggtatccagattttcagcagtacagtggatggggaaaacgctgctctttgccatattcactttgagcccagctgcctccccaaaattcctgataatgtccatggtgattactaaatcaagtgccaccgggtggaggaagatcaccacatcatcagcataaatagaaatacagttatgaactgaattttctatcagaggcaccatcaaaccatcattagcagcctccttaattaaatagcctagcacatccataaccagtatgaacaacatgggggagagagggtccccctgccgaagacctcgtctatgaataattctcctacctggtttaccattaagcattacttgggaagaggcagaagcaagaagaatgctaacaatatcacaccaaatttgcccgaaacccaaatgctttaagacctccaggaggaagggccacgagacagagtcaaaagctttggtgatatccaacttaaggaggatccttgcacactttttctggtgaaacaactttgctgtctgttgcacaagcatgaaattatccagaatggatctgcctttaataaaagcactttgattctgcgaaaccatattatccaggtgttgggccagcctatttgccaaaagctttgtaataagcttagcaaaggagtggaccaagcttataggccgaaaatctttgacatgacatgcatcatcttttttgggtagaagaataatgtatgctgaattgagaagttctagatttccccgatttctgttccaaacagccatagcagctgccataatatctcctttaataatatgccagcacgacttataaaatttcccagtaaaaccatccgggtcaggagccttgtttgaaggtagagaaaggactgttttccagacttcatcttccgtgaaagggctgtccagcgaagagagatcatgagaaggaatttggagatgatccaaatcaatagtatgagctcgatcagacgaacaacccagcagattgtggaaaaaatcacttatagtttcctccttgtcctcatgccttgactttattaaaccatcgtcggataacagattaccaataaaattcttgcctttgcggtatttagcgtggaggtggaagaaggcagtgttagcatccccctcagccaaccaggtaatcctagaacggctccgagccatagaacgttgcaaggttgaaagggccacaacatgaccatcaagctgcttcaacagccaattttctagcactgacaagggtctgatatcttgagcagactgcagcttgtgcataatttctcgtgccatcccaagctgagaggagatatggcccacccttttttgagaccagctttggagacgcctgacggtggctccaaacttcttggaaagggtttcaaaagggcaaggggaggagggaacagaattccaagcagcctccactgttgtaataaaatcaggcaattttgtccagtgagattcaaagtgaaatctgctgcgaccatgtgttaaaacctggagcccaaggagcaaagggcaatgatccgaaccatcggtgctagcactttgcagaaggcaattaggaaacagctgctcccaatctgatgagcaaaacattctgtcaagcttgacgagagtaggcgtatcttggcgattagaccaagtgaatttccgaccatgcagagccaattcttttaaacccagatcattaataaaccttctgaatctctccataagctgtctgttaaaattgccagagctcttgtcttcatctctgtagatgagattaaaatcccccataagaatccaggggccaggacacgcagatctcacatcccgaagttcttgcataaactgaattttgttactgtcgccttgaggtccatacacgcaagtcagccaccaaggaggatgatcacttggactaaactgaattgacacgctgtgctgatccacccgagaagcgctggctgaaccaatttcattcctccaggccacaagaatcccaccactatttccaactgagggaagacacaatttgtgcacaaaattactcccaagagcagacagggaggtatgcatagaaatttcagccatcttggtttcttggatacacaccacattagcattaaaggagtttaccaaattacgaacagagtcttgccgagctctagaatttaggcctcgtacattccaacacacaatatttgaaggattcatgataacaaatataagaagaacccgaccaacaggatagaggcatgaacagccgctcaacacaccgccaatccagggggtgtccatccgaaaagggcagcaagggcctggacatgagatggagggaggggctgctcaaaaagcctacaataattatccagggcctcctgactgatgccttcgttttcatcaatcacctgcagcgctctcattattttcttcttaaatttgaattgactatcactgaaggcagactggaattcaacaccaatcccagcaatgcgcctactacgacgtggaggcacagctggagaaattgggttcccaggtctgacttccagaggagcaggtaaaatgtgggcagctgccttcacgaccttgttactgaaagaggatctgagcgtgccaggggaatgcagttccgaagacatggaattaacaacatcacagacattgacattaccactggtaggggcagacttatcagccaatgaatcaaaatcatgttgcagactctggtccctcctagaataaaccagaatgggcttgcagtatcgagggcaagagggtccaggaaggatatcaggccgaaccaatggcgcagcagaccccatgcgggagcaattcatcatggccgaacaatccaaacgtgaataatccgcagaatccagaccaacatccgaccctgcccccgaggccacagggagtgttggcacagcagctgacaatccctcagcaggaaacgaggtagtcccaggcgccaccagctctacaaccgaagcatcagggagagctggcgcatcaactggtccccccaacctcgaaaacgagtcatccaccgtcattaaggaagaaaccgaggatttagcaggtgccaccaacgcattaaccccaacatcaattgggacaatatctggtctgccagccgccgagcataaatggccgcacttctcttgaataggcgcagaagcagattcttgggactccgaacagtcttcatggggataatccgcagcattaacagcaacgagaacagggccagacgccgctggcacaacacccgaagcatccaatagcattgacacattagctggcccctccatcgcaggaaacgaggcaggtccaggcgccgccagccctacaaccgaagtaacagggagagctggcgcatcaactggagcactcagcgtcggaaacgaggcatcatcagctgggtcaatccgcgtcggaagcgaggcatcaactgccattaaggaagagaccgactggattgcaggcgtcaccagagcagtaaccgtatcagcagggaaaacgcggccagccgccgagcagtgttggacgcgcggccccaggcgagcgtgaaccggtgcgcggtccgatgaagactgggaattgaaacgccgcttctgcaggc

SEQ ID NO: 3985 - DNA, 1687 bp, Zea mays
cacagcaattaatgctctttagtccggtttagtcattgaaaacaaacggaacactttagcgactaaactttagtcactaaaatttatagtctaatgactaaaggaaccaaacagaacaggtcattagtccgaggctccaagctgtgccgacaaagtgatgaatcacccaaacaaccaatctgacatctcatcttgatccatccagctttgcctcgatcgccggccggtagccatgtcccccacggaagaagccgctggtggtggtctcgacgactatgaccgcttgagcgagctgaaggcgttcgacgacagcaaggccggcgtcaagggcctcgtggacgctggcgtcacgaccatccctgccatcttccgcggccatctccttcaggaagggccgaaggtatcgtcctctagcagtagcagcagtactagtcttagcattatcccggtcatcgacctctcggcggcggacgcagtcgcacgggaggaggtggtcgcccagttgaaggctgcagccgagacggtggggttcttccagctggtgaaccacggcgttcccagcgagctcctgtccgagatgctggcgtcggtgaggcggttcaacgaggagccccacgaggtgaagcggccctactacacgcgggacgcacgtcgcaaggtgcggttcaactccaacttcgatctgttccagtcgccggcggccaactggcgcgacacgctcttctgcgaggcagcgccggagccgccgcgggcggaggagctgccggtcgccgtcaggcacgtgatgctggagtacggcggcgcggtgcgggaggtggcggcgcgcgtgctggggctgctctcggaggccctggggctgagccccgggcacctcgcagggatggggtgcgcggagggcctcagcctggtgtgcaagtgtgcaactactacccgccgtgcccggaaccggacctcaccctgggctgcagcaggcactcggaccccagcttcctgaccgtgctgctgcaggactcgcatgcgcagggcggcctgcaggcgctcctcgcatccaggtggctggacgtgcctccggtggccggcgcgctcctggtgaacgtcggagaccttctccagctggtcagcaacgggcggttcaagagcgtggagcaccgggtggtggctaaccggagcagggacacggcgagagtgtcagtggcgtgcttctgcaacgcggacatcgcgagatccacgaggctgtatggacccatcgcggagctcatcgccgcggacgacagcgacggcgcgggaagggcgctgtacaggaacgtgacggtcccggagttcctagcgcactacgacaagaaaggcctcgacggtcgcccggcgctccaccgcttccagctgcttcaataattttacatcacatcagtcctgactctggtgatatcatgtcagtatgtcactgtgggctactccggtactctaataaagttatggatggatcagatcaataccaaaaaaaaaaaaaaaattttaaggatctagaggagtcgaagcccctatagcttaaattaagaacttaaagaaagagttaaggtcttaaggatatacagattcaagaaacaaaaaaaaaagctccaggcagtaaactagaacagattgtttttagtcataaatcaaaagaggttgaaagccttggcttcatagt

SEQ ID NO: 3986 - DNA, 1907 bp, Zea mays
tttgaatttataaccagcagatatttgctataagacattcatggaaaccaactttccatttgatcggcacagatgtattgtattgtccaatttaaaaatcaattaggcctaccggtatgggcctgcacttctattgtgggctcactgatgagctttaaacttcagttttcctgttacttttatgatgctaacattggatacgcacggcaggaatgccgccgctagagatggcaacgggtaaatatccaccgggtattttttcgaaaacgcaggagagctacgtatcaatatattaagaagaaagggtgaggcaaggaaacctcgtacaactccacccgaacccacaaacactaggctatagggagaaggagagaattaacatcgacaacaacaaaagacatctactcccgtgaccatggagactcaaattaaaggatacccactgaaattactggagcataaggatgttagataaatccctggctccagccctataccagagatgagcctcctccttgacccaattgatgaccatgctttgactaggctgcacaccattaaaaacacagctattgcggtgattccagatggcccaagcaccaataatgatcaaagagttcaagcccttgtgcagccctgtgtttactagaccagcagaaaatgcagcaaccccttcccaccaatcttcaaaggaggagcacgcagggttaggagcaagatgctgcaacccaacagatttcatcatctgaaaccagacagcccgagagaaaacgcaggaaaccagcaagtggtttatcgtttcttcctcttgatcacaaagtatacaaaattgagggtgaggcagtcctctttttgctagtcggtctgctgtccagcagcgatcgtgggccacgagccacatgaagaacttgcatttacttggagcccatgatttccaaatcctttcccagggtttaaaagttgttgctccaagaaagaaaccggtatatgccgatttggccgaatataaacctgagcttgaaagcctccagctatgcttatcctcctgatctggtgttaagacccagtctgtagtgaggtcccaaaccttgaggaagtcagacaaaacatttacagtgatagctcctctaatatcatggacccagctccttgagatgagggcatcgtggacattcctcattctagccctagaagagaccatctggaccaaatgaggggccagctgacatagactttggccatcgatccaattatctgtcccaaacaaagtgtttctgccgttgcccaccaccgaggagattgctaccgagaagaaggcctttactgaaggatgagcatttattttaaaggatgcccaaggtctgtcagtatcggttttttccagccagagccagcgtaatctaagagcccaattcatcaatcgcagatttaatatacccaagcctccaaattcttttggccttgtaaccttgttccaagctaccaagcaatgtcctcccaaagcttctttcctccctctccacaagaaattccttctgatcttgtcaattgctttgaaaacccaagaaggaaggtccatggccatcattaagtagatattcattgaagacaggacagtctggacaataatcagtcttccagctctagtcaacaggtcagctttccagcagggaagacgatctgcaattttatcaatgaatggctgaaagtgttgtctgccgagcttctttaaggatagaggcacccccaaatatttgcaggggaagttggcaacaacgcatggcagcagattatgaatggtatccagattttcagcagtacagtggatggggaaaacgctgctctttgccaaattcactttgagcccagctgcctccccaaaaatcctgataatgtccatggtgatt

SEQ ID NO: 3987 - DNA, 2621 bp, Zea mays
aatcgattgcgagtggctaataattaacgggcaaataattagtcgtgatatgtttgaagtcttatctaatagatgactaaacatactaaatagttagtttttaccttgcacggcaaacaattggtcatgagaaaaaacaaataaactggcaagagtatggatcgtattcttctttttattatggtctattagcatatattaacaagattaaatgtctatttagcttgctatctaatttgccatactttgtctagtttttttgactaagtttagttcttaaatttgaatgactaaccttaggcaaagagaggtatggttagccataaatcaattagatcttaaatgactaatagataaacaatttgttagatctctagctaataatttatttatttattagctagtctgtttggagggagatgctaaaactaatcggcaaattgtttgtgtcaaggacgaagctacctggttagttgtggatacacatgcatcctccacagtccaaaattcagttacaataatcaaaatttcactatataagcattccacatatcttatgcacccataagagagttgcactctctgctctagcttcgccgctgatttgtgtgatgcatccaaactatagtttcctttggagcgaagcaaaccgacgtctcccgcagggccaagttgtctgcgatagcaaacagcgaaacccgtcgtcagcgcaaaccgcgacgttaaccaacccctaagtatccctgtcagccgtacacgtgtcccaatcgaacggctgggctccctcgtcagcgtagcaggtgccgcccgtcccgtcgaccgacctgacggacgtcgccgcaagcgcccggctgggcttcacctctccaccccatcgctcaccactccccccttcgtctccaaccagatcgccccccgccgcataaatcccccgctgacacccgatcgagcaaaccctcgcttacctcccgtcacgtcgcgtccgaacggcgacgctgcgccgtgatggacgccttcttcggcaagggcggcggcggcggcggcttccgcggcgccaagtggtacgcgcgggcgtttctttttttttccggggatgttctcggaaggggcgggaagctttggtccgcgttggttagttctggtttctgatgtcgtgtgtcggtgtgtgcgtgcgtgcccagcaagacgctgctgaagctgtcgatcccgcggataaagctgctgcggaaccggcgggagctgcagctgcgccagatgcgccgggacatcgccaagcttctcgaggccggccaggaggccaccgcgcggatcagggtacgtacgctcctcgctgtcaggggatatgcatatgcttagatcagggtagagctggccgggtgggcgaggtgaggactgggtcgggggctttttttttggcttggctgattggaagctgcggctgcggcggatgcaggtggagcacatcatccgggaggagaacatgatggccgcgcaggagatcctcgagctcttctgcgagctcatcgctgtgcgcctgcccatcatcgagacccaaaggttcgcccctctggccctctatctgacttcaattttacagcctgtaattgcgatcactgtttgcttgttcatgaggccacggcccacgggtgtgctttgttgcccctggatatggcaaactgtgctggaccaccagctcccttgaggccttgagatttccagtaactggtttttatagcgaacataaccttgcttgactgctatagtggactatggctgtgtttgttccattccaatgtgttcttagcagagacttggaccctaaagataaccattactttaagggtgtttcgttccagcgactaaagttcagtatatgtcatatcgaatgttaaatatgagtattaaatatagtctaattataaaaataactatatagatgaagactaaataataagacacaaattttaatcctaattaatctatgattagcaaatgtttactgtagcatcacattagcgaatcattgactaattaggtttaatagatttgtcttgtcgttaagtttttatctatataattagttttttgattaaattatatttaatacttataactagcatctaaacattcgatgtgataggtgctaaaatttagcatagggaaacgaacgggcccaatatgtccatttggcaacagggacaagttatcttcgttcttataccctctgcattcttacattccttatttgtttgaagacataaccattgtaatcccaactccaaggatgttactgatgatattttctttgctgctgccttttttatagggcgtattatcttgaagtataaagcagggatcctgaatcctgctcgtgaatacaaatgggctatagttgataaaattgattaactgttttgtgactaaaaattctgcaagagatgcagataagtctgactgaattgtgtttccttgttttgttggcttcagggagtgtcctattgatctcaaagaagcaatatcaagtatctgtttcgctgctccaagatgtgcagatctacctgaactgatacaagttcaaatgatgtttgcaactaaatatgggaaggaatttgtcgctgcag

SEQ ID NO: 3988 - DNA, 752 bp, Zea mays
  misc_feature (732)..(732): n is a, c, g, or t
  misc_feature (736)..(736): n is a, c, g, or t
  misc_feature (745)..(746): n is a, c, g, or t
agatcgaaccccacacgccgcataaatcccccgctgacacccaatcaagcaaatcctcgcttccctcccccacgtcgcgtccgatcggcgacggtgcgccatgtcgatgctggacaccttcttcagcaagggcggcggcggcggcggcggcggcttccgcggcgccaagtgcaagacgctgctgaagctgtcgatcccgcggataaagctgctgcggaaccggcgggagctgcagctgcgccagatgcgccgggacatcgccaagctcctagaggccggccaggaggccactgcccggatcagggtggagcacatcatccgggaggagaacatgatggccgcgcaggagatcctcgagctcttctgcgagctcatcgcggttcgcctgcccatcatcgaggcccaaaaggagtgtcctattgatctcaaagaagcaatatcaagtgtctgttttgccgctccaagatgtgcagatctacctgaactgatgcaagttcaaatgatgtttgcaactaaatatgggaaggaatttgtcgctgcagcttcagagttgatgcctgattgtggggtcaatcgtcaggttatatgacacttctaaatcaaattagtttagccatgttatctggtggtttggttattcataacatattagaattaatgcttctgcagataattgaattgctttctattcgtcctcctcctgttgatgcaaagttgaaactgctgaagganatanctgaggaanntgaagt

SEQ ID NO: 3989 - DNA, 2049 bp, Zea mays
gtaggcctagggtttccttcctcctccagtgctgtcatcgccgccgccgccgccccggtttccttcgtaagcccgccgtcctccgtccgcgactctgcgcgagaagcggccgcatggaccccccgctgacacccaatcaagcaaatcctcgcttccctcccccacgtcgcgtccgatcggcgacggtgcgccatgtcgatgctggacaccttcttcagcaagggcggcggcggcggcttccgcggcgccaagtgcaagacgctgctgaagctgtcgatcccgcggataaagctgctgcggaaccggcgggagctgcagctgcgccagatgcgccgggacatcgccaagctcctagaggccggccaggaggccactgcccggatcagggtggagcacatcatccgggaggagaacatgatggccgcgcaggagatcctcgagctcttctgcgagctcatcgcggttcgcctgcccatcatcgaggcccaaaaggagtgtcctattgatctcaaagaagcaatatcaagtgtctgttttgccgctccaagatgtgcagatctacctgaactgatgcaagttcaaatgatgtttgcaactaaatatgggaaggaatttgtcgctgcagcttcagagttgatgcctgattgtggggtcaatcgtcagataattgaattgctttctattcgtcctcctcctgttgatgcaaagttgaaactgctgaaggagatagctgaggaacatgaagttgattgggatccatcagagacagagacagaatttctcaaacctcatgaagatctattgaatggaccgacctacttcaatgggtccacactacctcttcccaaggagaaacatgaggaaacagtagttgcaagtgctgccgagcagcctgatgaagactatgagtcagataccggtcttgactcactggatttgcctgaagtcccaaaagctgcaattcgtccaccttctgacgcaccattgaccccagatatttgcccacatgttcagggctctcagtcacttcctcatgagttctcagatcctggtaacttggaggagaatccaacagctggtggtgcttttaatgttattcagatgaaaagcttggagcatcttgtttatgcaccatctgatcagtcaaacataccggatttgccaaatgaaaagaagcagtttattccttttgcatctccaccgcccgttctttctccttcggtgggaaaagccgagacagttccctcaccttctctgtctcctccagtgaagccgacagagccagaaccagaaatcctcacaaagaaaattgatgaagtgaccacacctccagtacttccctcagattatattttcacaaaacagccagaacaagtgcggacaatctctccttctgagagtggggcaaatattgacttggacgacgttttatctgctgcgcagacagctgctgaatcagctgagcgagctgcatcagcagcccgtgctgctgcaaaccttgcacaactgcgcatttcagacctgaagaagaattccaaggtttatagcaattacggtgatagcgtccaaaaggaaagccatcatcagactgaggcgacacaggaaccggtatttgatcaccaggactccttcaccaatgatacacaggactatgtgtcatcccatgtgccgcagaggtcgtcatctttggaggacgatccatatttctcgtatcccaacttgttctcagcgccaaagccctgaaggcggaaactagtggtctgcaagtagttgttcagaatagtctgaaacatgagatatcactttttcagctctgtccggtcctcttatgtttggtcttttctgatgcctccgaaaattctgtgtatgttgagttggtacatagcggacaaaagggagactatgaaacctctgtctagttttgtctctgtaaattgtacatgtgcggtgtttgtatcagttgtctgaaacatttctgcagtctactggtaataacagaaattgaatctcaaaaaaaaaaaaaaaaaaaaagagggcggccccggtacc

SEQ ID NO: 3990 - DNA, 1505 bp, Zea mays
cttgcatgcctgcagataattgaattgctttctattcgtcctcctcctgttgatgcaaagttgaaactgctgaaggagatagctgaggaacatgaagttgattgggatccatcagagacagagacagaatttctcaaacctcatgaagatctattggtaaatatatatcgacttgtgactaacatggttagttcaatgattcaaatcttacttgatactgtgtttcccttctcagaatggaccgacctacttcaatgggtccacactacctcttcccaaggagaaacatgaggaaacagtagttgcaagtgctgccgagcagcctgatgaagactatgagtcagataccggtcttgactcactggatttgcctgaagtcccaaaagctgcaattcgtccaccttctgacgcaccattgaccccagatatttgcccacatgttcagggctctcagtcacttcctcatgagttctcagatcctggtaacttggaggagaatccaacagctggtggtgcttttaatgttattcagatgaaaagcttggagcatcttgtttatgcaccatctgatcagtcaaacataccggatttgccaaatgaaaagaagcagtttattccttttgcatctccaccgcccgttctttctccttcggtgggaaaagccgagacagttccctcaccttctctgtctcctccagtgaagccgacagagccagaaccagaaatcctcacaaagaaaattgatgaagtgaccacacctccagtacttccctcagattatattttcacaaaacagccagaacaagtgcggacaatctctccttctgagagtggggcaaatattgacttggacgccgcgcagacagctgctgaatcagctgagcgagctgcatcagcagcccgtgctgctgcaaaccttgcacaactgcgcatttcagacctgaagaagaattccaaggtttatagcaattacggtgatagcgtccaaaaggaaagccatcatcagactgaggcgacacaggaaccggtatttgatcaccaggactccttcaccaatgatacacaggactatgtgtcatcccatgtgccgcagaggtcgtcatctttggaggacgatccatatttctcgtatcccaacttgttctcagcgccaaagccctgaaggcggaaactagtggtctgcaagtagttgttcagaatagtctgaaacatgagatatcactttttcagctctgtccggtcctcttatgtttggtcttttctgatgcctccgaaaattctgtgtatgttgagttggtacatagcggacaaaagggagactatgaaacctctgtctagttttgtctctgtaaattgtacatgtgcggtgtttgtatcagttgtctgaaacatttctgcagtctactggtaataacagaaattgaatctcaaaaaaaaaaaaaaaaaaaaaaaaaaaaaaaaaaaattcaaaaaaaaaaaaaaaaaaactcgagggggcggggggg

SEQ ID NO: 3991 - DNA, 2074 bp, Zea mays
gacgattggcgcccttgggacattcgggtccctcccttatcctattccctcgtgtcatggcgcttctcctgcgcctcgctgctccgtcggtgccgccccggcggagctccggcctcagagcattgccgcgcgtcgtccttccggaggtcgtttccaaacaatcatttcttcgtttactagttgacagcactgcaagtatgccctgtcctattaagtgttctgcggctcggtgtgccccatcattgactgaacacaacgattctaggaataatggcatccatgcatctagtgtatatggacatgatctcatgaagtccatgtctgatctccaggaagttgtattttcctcctttagcaaagcatgtcttctcagtagttgtatcatatatggtctaccacccagttgtatagcagaaccatgtgagcaagaatactttctccctaacatgcctttgctgttcgcaatagccatggttggtgctactgttggagggctccttgcgagacagaggagaggggagcttgcacgtctaaatgatcaattgcgtcagataaatgctgcattgagaagacaagccaagattgaatcttatgctcctgccttgagctatgccccagttggtagcaagataccagaatcagaagttattgttgatcctcagaaacagcgcctaattgcatatctcaggaccggaaagaactatctgagaaaccaagctcctgacaaggcatttcctgagtttaaggcagctcttgatcttgcacgatctttaggtgatcatgttgaagagaagaaggcagcacgaggattaggggcatccttgcaaagacaaggcaagtacaaggaagccataaattatcattccatggtgctaaacatctccaaggtgaccggagaggatgcgggtgtcactgaagcatacggagcaatagcggattgctacaccgagcttggtgagctcgagaaggcaggcaagttctacgacaagtacatagcaagattggagaacgaatgagaaaacagtgctgattggcaaatctgtgagagcagaaacaaagacaaggctaatcatatctctactcttgtcgtcatgtattctactatagatgtgcagttcccagctggaactgatgtttgttatcatgattcaagtttctttttggcagaattatcccagatgtttaggtacagatcagtatcatgctgtgcacgtagttgttttgttaattagggtctcaatggtccgtacaggcattcatgtcaatctgctagttgcgccggcttaattttatagttttgctatatcgtgcctaggtgaaaatctttcctccacatgtttttttttagtttttgttttcatgttttctttctaagtaacacgcatagaagggatttaaactaagattctcctcaattttatgatttattgtaagctgttttatttgccaaatgagtcttttaaaaatgggaacctatcctacacaatcagtcatgttggtgcaatcaaataatatggtgcataatcaaaatcggtaacagttaaatgtaaaatagctactatgttttagttggaagaggttttgttactgaaatataattttatcttttctgtttggttttggaccttgctcatgtcttgtaagaccatctcctctgatatatataaagatgtgtatttctccttcgcgtcctagaaaaaaattagttgaaagaggttaaatataaaatgttagtcaccattaaattttgattagatgtatcagatagtttaattgcatggttgcactaacatgactgatacgtgacgttgtctagattctacttgttctagatacatagatagagttccacaacaagccactattatttgtttaaaaatcacgctccaactcatggtcgcaccagagactatctcttgcacacatgcaagtaaataaacaagaattacattctagagacagtgcaagcttatcagcagtgtatggcctaggcaaaccaagtttagagcaacttaggtcgggaccaacctggttggggtgactaggtcatggcttcttaaggtgtctgaggtcg

SEQ ID NO: 3992 - DNA, 836 bp, Zea mays
gtaccctgcggagctgccgggttgtgcgcacataccataaatatggctcaaacaggttgattaagctcctttcttggtttatggctgtaattcagagtcttcttataattgcttctcgcaagcactacactgtcgatgttgttgttgcttggtacacggttatttttttttttttttttgccgataacaagctgccagaaatggcagaccgtacaaatggattgtctctgcttccagtaagcacaaaggataaagacggcaggatgaaggaagaactccataaacttgagaaggacgggaggatgatggatgagttccataaattgttaaatggaaactctatcgatgctacagattggcgacaacgagtgcagatgaatggaaagcacggagaagacacgagccacactgtcgctgatgccacctctgctgggacatgaccagcagcatttctctgtcaatatcgtcttcaatatccacagatggaatctgcgagcaaaaagaaaattgtgtggtgtgctgcctctatcattgtgtgatgaaaggcttctcaggtacccgcgaggttgcgacattcataacagagcgttttgttgtgctttccatggcacgatgacagtctgttgaagtagtaacggaatcaggaccttttcggcttttctatgaggccgcagctacagttttgcatccttcagacgtttcagtgtcgatgatgttagagagggagattgatgtttgatgtaaatattgattagattcagctgtggcaatgggtaatgaacgactaacttatgctgattggtaatttaacgtgagcagctgctcgtgccgaattc

SEQ ID NO: 3993 - DNA, 1975 bp, Zea mays
atcccagcccggcagatcgcccgcccagtccaccggctcctgcagtcctgctcctcccctaccctcggaatcaacgcgagagcaaccgcccctatcgaactggccggctgactaggagcgagcccactgctttggtacgaaaacgcccacacccccggctatttttctcccgaacggccgaacccgaacccaccctcactctccgattcaaaccgtcgccgccgtcgccgagagagttgtgactcccccagcggcggcctgcgaccacccgttccccagtcgtctcttctctccagaccgcatttgcgcccgtcccgtcccctcccctctccctcggcgaggtccgagagcagagctgcctcgggagggtcgtagtccagtccacccgtccgctgcggcggcggttacgaggcggggaattccggcgcgggttgccgcgatccccgcagtgatgtgcggatcgggtcatgggtgtgacccagccgggaagtagtggaggctgctggaggactagggccgggacctgcggccacgacgatgtacgtcgcccgggagtctaccaagctgtggaggagggtgtgcgcggagacgacagcggagctgcagcttctgttcgagaagtggcaattgctccttgcagggttggtgtttcagtacatccatggattggctgctcgaggagtgcattacttgcatcggcccggaccactgctccaggacttgggatttatggcccttccagagcttggccaagagaaaggttatcttagtgagagcttattcactttcatcttcatttccttttttctgtggagttttcacccttttgtttatcacagcaaacgcttttacactgttctactatggcgtagggtgctggcatttctagtggcttcacagtttttaaggattatgacattctattccactcaacttcctggtcccaattatcactgtcgtgagggctcaaaactggccactctcccaccaccaaataatgcacttgaagtgctcctgattaactttcctcgtggagtgctttttggttgtggcgatctgatattttcatctcacatgatcttcaccctagttttcgtgcgcacgtaccataaatatggctcaaacagattaattaagctcctttcttggctgatggctataattcagagtcttcttataattgcttctcgcaagcactacactgtggatgttgttgttgcttggtacactgttaatttggttgtgttctttgttgataagaagctgcctgaaatgccagatcgtacaaatggattatctttgcttccagtaagcacaaaggataaagacgggaggatgaaggaagaactccataagcttgagaaggacgggaggatgatggatgagttccataaattattaaatggaaacactgtcgatgctacagattggcgacaacgagtgcagatgaatggaaagcatggagaagacacgaaccacactgtctctgatgccacccctactggaacatgatcagtagcttttctttgttatatcgtttttaacatccacaggggagtctgcgatgaaaaaggaaattgcgtgttgtgcctctgtatctgaaaggcttctcaggtacccgcaaggctgcaacatcatatcagaatgttttgttgtgctctccatggcacgatgacaggaaaaaacgaggtgttgaagtagtggtagaaactaaatcaggatctcttcgcttttctaagaggccgcagctacagttttgcatccttcagacatttcaaaaacgacggtactagagagaaatttatgtttgatgtaaatgttgattagattcagctagtcctcactacaaaaaaaaaatccatttgtgccaatgagtaatgactaacttatgctgattggtaatttaacgtgagcagctgtaatgatcgcttttgttaccaaaaaaaaaaaaaaaaaaaaaaaaaaaaaaaaaaaa

SEQ ID NO: 3994 - DNA, 1347 bp, Zea mays
gttcggttatttgcatctcggttttgatctaaatcttagaacacggatgtatacatgtttttttttgcatcagaagaaatattttctcagatatttttagccaaccctatcctcccacctagccttatctctgtgttcagattttttttgacgccacacaatctcgtacggcacagaaaaatctggccgtcttcatctacttcacggccgcgtcgctcagcctggaaaaatcccaccgccgaagaccctgtcttctccacaagccgcgcgccgtcttcccagcaagccccagccgcgtctctctctctctccctcgtcttcttccccacgaccgcgcgcgcccctggtccaagctccctgcttccctgctgcgctcccccggcagcgctccatctctccctcacggtgctccggctcggcctccatctccagctcgcttctccccagttcctccatggccgcgcacctggcatccgctcgccgtggagctcccgcgcgcgccccattttccatggcgctcggccgcacagagtcttcatcggccatggcgcctcatcgtcgctgctcccagccctatgtatgacgcctcccctccagcttcagcacggcgcacctcctcatggccgcacctctccctgctcggcatcaacgtcgaccgtgccttgccaacggggctcacccacgttggccatgcctcccaactccgttcttggatcggctcagctcctaggcaccacctcgctgccgctctagatgttgtgcttggccctcctgacgttcacccagtgagcagcaacagcgccgcgaactagtcctccccatgtcgttagggtctgctacaccttccctgtcgccgtggagaccgtgtctccctgctccacagtgcccttcaccatctgtcatcgcaacagcagcccccttgctccacgtcgtcgcgccgtcattgctcaccttgtcgggacaccttccctcacactcagacgctcgtcagggaccctatcgtcgaccacttttgttctatgtcgccgggtccgtgtttcagatagcaggtgtggtgttcaaatgttaacttatgatcggtattgttttgatctatgtgtagtgatctgtgttttccctatgatggtatgtgtgaatcgtagtatacgattggcatataaagctagatggtgtacgcagtgaagtgagtaagtgacgcttgttaggtgtttggtgttatgcttgaacccgtgatcgtcgtggttcttgtagaatctggcctaaggtgtggtgagctaggttgttattttgttagttggtttgggtcggtaagctggtctattattcttgttaaaaaaaaaaaaaaaa

SEQ ID NO: 3995 - DNA, 1576 bp, Zea mays
tgccatctctcaatacttataatgctgtatggtgcatagttcaaagtgctttctgtgctactgttgaacagaagggtggtctaagtatgatccatgcttctgtttaaaccgaatcttctcatcacgtttttgcgtcaagaccattgtgcactggcagcactgtttatttgcttgtcatgcatgcctctgtatgaaatgtaaccctttacattgtgatatataatgttcatagttttcaggatagtttctcttctgccatgtttagctatcattatctgtccgacaaggaattactttctggtgtttattgcaatattgcttgctgccgcgcccgcccacgccggctaccatccccactaagctcaccgtcaacttcgtcctcccctacaagtccgagatcgccaacaaggaggtggacatggtaattgtaccagctacaactggtcagatgggcgttttgccaggccatgttgccacgattgcagagctcaagcctggtgttctctcagtacatgaggggaacgatgtgaccaagtactttgtgagcagtggatttgctttcgtccatgcaaactccattgctgatattgtggctgttgaggctgtccctgtggatcagatcgacccagcttttgttcagaagggtctcgctgaattcactgccaagcttggttcggcctctactgacctggagaaggctgaggctcagatcggtgtcgatgttcacagtgcgctcaatgctgcattgaccggttaattggtgtcatcttaaattgtctgtcttttagattgagtttaactttgcaaatcctaaataaattatagtccatctaaaacatggacatatgtttcttgttacctgaatcctgcatggatttatttttgtactcgtgaatattttaactctggagctcaaaacccggagttgctttctttttccgttgagttgcggccttggatcagatgaaatcgatgttcctccatagctccagtaaattgttaaatattgttaagtctattttaagagaaatataaaccacatttgattactgcaaaaaaaaaaaaaaaacttgtgtcagcattttcagattttgaaattccatcttctgtactaaaaaggttgtatttttagatctggtcgaagtaaaggacaagcctgatatatatagaggtgagaagccttcctagtaagccaaaggtttggcagtttctgttaaaaaaatgtaagggtaaagttattccttctctatacctttgtatattctattcatgtgggagctgctaacactgaatctctcccaagtgaatctgttttaggtttggctaaatccacagaaaaaatataataattatggtttcagatagttacactatggaattctactccgtcccatatataagacaagaaacgtgtttaattctctatcaacactaaggcctagtttggaagtgcaaaaaccagagaggctaaaattccgttattcaaaattgaataaagaggggattttaggctcttcaatctcctctggttttgtggcttcccaaactagccataagagttatcaacactaagcgc

SEQ ID NO: 3996 - DNA, 1143 bp, Zea mays
  misc_feature (1141)..(1141): n is a, c, g, or t
cattgggtacctcgaggccggccgggagtcgtcggaaccccaaccgagttccccagtactccgcagtccgcacggccgcatccgtcaagatccgcgaagagcaacgaggcgaggcgaggggagggaaaacaagtgagtgagagagagagagagaggagggaaaatgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccaggccatgttgccacaattgcagagctcaagcctggtgttctctcagtacatgaaggaaacgatgtgagcaagtactttgtgagcagtgggtttgctttcgtccatgcaaactccattgctgatattgtggctgttgaggctatccctgtggatcagatcgacccagcattggttcagaagggtctcgctgaattcactgccaagcttggttcggcctctactgacctggagaaggctgaggcccagatcggagtcgatgttcacagtgccctcaatgctgcattgaccggttaattggtggcattttaaattgtcttgtctttttcatctacagttttagagtgagtttaagtttgcaaactcatgggcatgggatggagggaatgatcctaaataaattatactccatctaaaacatggacatatgtttcttgtttcctgaatcctgcatggatttctttttgtactggtgaacattttaactctgagctcaagacctggagctgctttctgcccccgttgagtttgggccatggatcagatgaaattgatgttcgtccgtaggttatgttaattgttaaatgttattatgtctatttttaagagaaatataaagtactgctcgggttactgcatcgtactttgggttgttaccactgntt

SEQ ID NO: 3997 - DNA, 1674 bp, Zea mays
tgtgaatctgcgatctatgaagtcgagtgtcgtgcccgtgagtggcgaccgccagccggctatgctgtgtggtacgctacgatagaaagtagatagtaaagatcatatatgggtcttagggtttcatttgttttggacttttgggctagcggctggcccaagtacccaacagacaagtatgcaacaactctggatattttataccctcgggttaacatgtatgagtgatgacagaacgttctaatacccgtttaccattaggtgaaagtttttgcccaataaaatacctatggatagaatatttagttcatatacatactctaatgaagtaaatatccattaggtatcgggtcgtgagtacccattgttatctctatttatgactcagtttatagaaattagattgccagtttattaaaataagaaactagcctcttctagctaaaagataaaaactggtttcttaaaaattggattgcttccaaatatgaacatgcgatcaaggcttaccttcaatactactgctcggcttccatgttaaagcaaaaaaaaaaaaaggccgaacaaaatttggcccactaaggctgccggctactccagccgggctcctcgtcgcctcccgggaaccccagacggccagccgagctccccgctacgtactttgcacggaggcatccgtcaaaatacacgaagggcaacgaggcgaggcctagtatagaggaaaacgagtgagaggggggaaatgctgcgccacgccgcccgccgtctcgtctcccgcaccgccgcggcgcccaccgcccgccgggcgctcgtcacggcagaggtgcctgcggaggccgccgaggactccacgtttgtggaggcgtggaagaaggtcgcccccaacatcgagcccccaacgacgcccctcttcctcatgcagccgcgcccgcccacgccggctaccatccccactaagctcaccgtcaacttcgtcctcccctacaagtccgagatcgccaacaaggaggtggacatggtaattgtaccagctacaactggtcagatgggcgttttgccaggccatgttgccacgattgcagagctcaagcctggtgttctctcagtacatgaggggaacgatgtgaccaagtactttgtgagcagtggatttgctttcgtccatgcaaactccattgctgatattgtggctgttgaggctgtccctgtggatcagatcgacccagcttttgttcagaagggtctcgctgaattcactgccaagcttggttcggcctctactgacctggagaaggctgaggctcagatcggtgtcgatgttcacagtgcgctcaatgctgcattgaccggttaattggtgtcatcttaaattgtctgtcttttagattgagtttaactttgcaaatcctaaataaattatagtccatctaaaacatggacatatgtttcttgttacctgaatcctgcatggatttatttttgtactcgtgaatattttaactctggagctcaaaacccggagttgctttctttttccgttgagttgcggccttggatcagatgaaatcgatgttcctccatagctccagtaaattgttaaatattgttaagtctattttaagagaaatataaaccacatttgattactgcaaaaaaaaaaaaaaaaaaaaaaaa

SEQ ID NO: 3998 - DNA, 2526 bp, Zea mays
ccggccggacagtagtttatgttactcatcagattgaatttctaccggcagctgatctcattttggtcatgaaagatggtaaactagcacaggcaggacaatacaatgaaattcttggttcaggagacgagttcatggagttagttggtgcacacaaggatgctctcgcagaattggacacaataggtgctgcaaacagaagcaacgagggatccccttccagaggtacagcaaaacttaccagatctctatcatcagctgaaaagaaagataaacaggacgaagggaacaatcagagtgggcagctggtgcaggacggagaaagagagcaaggcaaggttgggttttgggtctactggaaatacctcaccttagcttataagggtgcacccgtaccgctagtgttgcttgcacagctacttttccaagtcctacaaattgggagcaattactggatggcttgggctgctcccgtttcaaaggacgttgagcctccagtgagcatgtcaacactgatatatgtctatatcgcgttggctgttggaagctccttctgcgtcctcctaagagcgttgtttcttgtaacagcctcatataagacagcgactctattattcgacaagatgcacctcgccgccggccgggccgctatgtctttctttgattccactccgagtggacgcatcctgaacagagcttccactgaccaaagtgaggtggacaccggcatcgcataccagatgggttctgttgcatttgctgtcatacaacttgttggaatcattgccgtgatgtctcaggttgcatggcaggtgttcgttgttttcattcccgtggctgctacgtgtttctggtatcagcgatactacattgataccgccagggagatgcaaaggctagtaggtgtctgcaaagctcctatcatacagcattttgccgaatcaataacaggatcgactaccatcagaagttttggcaaggaagatcagtttgtatcagcaaacagccatctaatggatgcctactccagaccgaaattctacaacgctggagcgatggaatggctttgctttcgcctggatgtgctgtcatcccttacatttgcgttctctttgatattcttgatcaatctacccccgggtttcatcgatccagggattgctggtcttgcagtcacatatgggcttaacctgaacatgctgcaagcatgggttgtctggagcatgtgcaatttggagaacaagattatatcagtagagagaatcctgcaatacataagcattcctgcagagccccctctttccattccagaagataggctggctctggctcagaactggccatccgaaggagagattcagctccttgacctccatgtaaaatatgccccgcagctgccatttgttctgaagggacttacagtcaccttcccgggaggcctcaagaccggtattgtcggaagaacaggaagcggcaaatcaaccctcatacaggccctcttccgtatcgtggacccgagtatcggccagatactaatagacggcgtcgacatctgcaccatcggtctgcacgatctgagatctaggctgagcatcattccacaagagccaaccatgttcgagggtaccgtgaggagcaacctcgaccctcttggggagtacactgacagtcaaatctgggaggccttggattgctgtcagttgggtgaggaggtgaggaggaaggagcacaagcttgactcaccagtgatagagaacggcgagaactggagcgtgggtcagcgtcagctcgtatgcctcggcagggtgatcctgaagcggagcaagatcctcgtcctggacgaagccaccgcttcggtggacacggccacggacaacctgatccagaagacgcttcggcagcagttctcggaggcgacggtcatcaccatcgcgcacaggatcacgtccgtcctcgacagcgacatggtcctgctcctcgacaacggtgtggccgtggagcgcgacgcgccggccaggctgctggaggacaagtcgtcgctgttctccaagctcgtcgcggaatacacgatgaggtcgacgcacacgtagccacactactaggcagcccgcaactgagaaaggttgctttgctccacgccgtttgggggccgcggcaggctgactcgtcgaccacgccggcagatttttatgggtcgccggtgaggcaggcagcaggcttacttgtcgatgatgccgaaaagtgaaatattagaaagctagcgctattctgaacgtttgaggagttgagggggtacagggaatgagtcaagggcattaaggagttggtggaagtggttttgtgttagcatactatactagtgtagttctctgagcatgcatagcatgcatcaagaatatcttgagcttttagccacgtaccaggaatgtctcaaagtttttttttgggtaataatacctgtattcgatgggtggtaacactcctatactacgtctgaagaaatagtgaagcgtttgcacgttagct

SEQ ID NO: 3999 - DNA, 991 bp, Zea mays
cttcaccggcttccttatctcccacgtggtgcaggcttctccagccgctcctccactttctcccctcagcgctcggtgcccagggctccagtgccgcggcgcccctgcttggaggtccctggtgccgcgcccctctctgctcgcatctccctggtgctccagtttgggagctcggccgctttttcctctctgctgcttgctgattccctttcccccaagctccctgccatggccgccatctcccatggaagctgcgcccagccgagctccctctccgacggtcgtcctcgcctcaagttccctcggcgctgtccctgctcgcctgcgcacctttccccggcgggagctcgcgctctgcggagcccggtccttccctaccacgtgccgagccctttgccgcgccaagctcctaaccatggcgctactgctcccagccgcgagctcgctgagctctgccctcttccatggcgcccaacccgctgcttcgcgaccccagtcctctcccatggcggcgcgcccatcctctgctccctcttcccggatctcgcgcgcccctgattcctacttctgctccagcgcgcgcgttcttccctgtcgcgtctggccgtcgtcaagctccatggtgtctggccccgcttggatctcgtccgtgccgtgcagctccctctgccgatttcgctgtgcgccgaggtcgcgtgcagctcgtccagctcataagggtgaatcacagtttgagattgaaaaaggagcttagaaggtgtagataatgaagccctagattgacgtttgccgttgtcgtttgtgcgaacatcgaatcaaattgtgatgcggtaaactaattcattgtaaaaaaaaaaaaaaaaatgaaaaaaaaaaaaaaaaaaagactcagcacacagcattcattcagctagcgagcgagagagaggggacaaaaaggaagggcgaggagacagggagccgagcgcaagagctgaggcttcgccgcgaa

SEQ ID NO: 4000 - DNA, 2559 bp, Zea mays
  misc_feature (1773)..(1773): n is a, c, g, or t
  misc_feature (2144)..(2144): n is a, c, g, or t
  misc_feature (2179)..(2179): n is a, c, g, or t
ctgcagtcattgatgataattgttcgatctttgatgtgagcctagagaccaacgagcagcgaatagttttcatcgtccgtgtctagagtgcttagccagacctcatcataggatcaacggagcttttgattgaggagcctcagggcaatgccagggggcagagctacgcactcttgtacctcatcatgttctcgatgtttgttccaccgccgtcaacgaattctttggatgacctccagcggcaaacgatatggcggcgacggcgatcttctgtggacgacgcctcagcgcccgagcctagcaacagacttgtctaacgaagagatagacgcgatcttctgtgtacctcatcatgttctcgaggtgcagtgttttgtcgaccgggcccattgttcaaagggatagacgtgtctaacgaagagatagacacgcttgctcagggcttcgtgcttcccggttcttccttcgctaacgacgattcagcgttcatgacagtcttcaatgcgtcgaccgaggcttgcttcgggagtgcccccccttgtaacctgcaacagacttcactgctacggcggcagccacttcttccagaccacatctaccgtggcagccctttttacctcggtccccctgaattttagagttttcaccccactttggagcactataacttttgatccatgaatttttgacctagggtttctgtagcaagtttgtagagttatgttttatgaacaggttttattaactgaggtcggcctgttattatttggaatcatgagatttaagggggttagcagagaggcacggtgcaatcggactcaattcagtttgctgaatttcagaaaggcagtgagttcctctcggctttagcgctgtttagcttctaatccttgcgcctttgatctgtgggtattatggcaaacttggagatctattgtaggggaacaattcctagtaaacattatattcctatcatcgcttaaaaccggaagcaaatcgtgctccaaaccgcgctgtcagacatatggtaactgaaatttgtttaaggttggggaatttggtgttggggctctctaattcatcacgtagtagactttgaactttgaaaatttcacaacttttgcttttgggaatttaaaggtggttattcaaatttgaaaataattttgaaagattagttgggagagaagatcagcaacagttcactgaattcagctttctgaactgaaattcagttcatgcactttattttcatcccctccatcttgctgctccttacccctctacagggggcccctccagctcgggtgcgggtaatccttaacaatcaatcgttaaaaaagaaaatcccaaaagaaaaatctgcttcggttcttatctctcgccgccctcttccctggatatttctacgcgcagcccagctcctctgtttattcccagcgcgcgtgtctactccctctgctcctccctgccgcgtcgccctctctctctctcatccccaagccgcgccaagctccctgctcctcctccctccccgagctcccagcgccgcggcctcccactcctcccagccgagctctgctcgtcggccgcgccctgctcgcccagccatcttcttcttccccacctctggctcgacggcacgccccccagctcggccatggccaccgcgccgtggagccctgcgcgccgcggtacttcttccctgcccctctcctcccctgtgctctgctggtcggcgtcattccctgctcttagccatggccgccgacntccgcagcgcccccatcgccatggagcaccgcctcgagcacccgttgccgcacgctctgttcgcctggcgagtcgcgcccaggctgcactgagccattcccctggtcgccgtctctgagcccggtcccaagctgtcctgcgcctctgctcatctcccatgactgcacaccactgcttcccatggcgcgccctcacttgcttctctgcgtgacgccaggaggcaggagcgagacgagtttggtttggataggctgttcggtttgcagtttgggtccgattgatgttgagagttcgtcgtgatggtgctgtggcgtggcaacgtcgtgcgcgtcgcggtagccgtccaggccacggtgcagtccgcgccatanagttcgcccggctgcgacctggccttgctccctgncgcgctcacctcggcatcgttcccgtcgtcgtcttccaatttcagcagctctgccccagccctatgtcgacctcgctgaccacccatggttgatcctgtgttcatgagggtgaatcacagtttgagattgaaaaaggagcttagaaagtgtagataatgaagcctcagattgacgtttgccagatgttcggtggaacgcctgaatcgaagttcgtcgtcgttcttgtggattttggatcgatttggcttggtaagctgaatttttatttgtattagttggattgatgaatggtctggctgtgtatagtaatcatgatgatgattcttttggtagttgcacatgtgcgttgtagtaatattaaagacttattaaaaatgca

SEQ ID NO: 4001 - DNA, 1013 bp, Zea mays
  misc_feature (1006)..(1012): n is a, c, g, or t
cggacgcgtgggcggacgcgtggggggcttaattaggcggaaagattataattgacaacattgacatctctgcaattggccggcatgatctgcgctcacggttgagcatcattccccatgaccctacattatttgagggtactatcagaatgaaccttgatcctcttgaagagtgcactgatcaagaaatttgggaggcactagaaaagtgtcagctaggagaggtcattcgttccaaggaagagaaacttgacagtccagtgctagaaaacggggataactggagcgtgggacagcgccaacttattgcactgggtagggcgctgctcaagcaggcaaaaattttggtactcgatgaggcgacagcatctgttgacacagcaacagacaatcttatccaaaagatcatccgcagtgaattcaaggactgcacagtctgtaccattgctcaccgtattcccaccgttattgacagtgaccttgttctggtccttagtgatggtaaaatcgcagagttcgacacgccccagaggcttttagaggacaagtcatctatgttcatacagctagtatcggaatactccactcggtcgagctgtatatagagaggcttagcttaaaaccccgccccaaacctggcaacagaggctgggaggcaaatagcccgtatctgccagtgtacttgcttgcgccatagaggtccctgcgaacaccggagggcggcgtagaagacgaggtgtacatgagtgggaggaacactgggcgttccctgacctgaataccgtggaatcggcgagggagcgcggttggtattggtaggcaccaggggaggagttggtgacactagtacattacccgaagctgatgcttcagtatgtatgtataacaacaatgcatactgcttctccctttgcagagtggagaaccaagggaataactcgtgcgtaataagaggagaaagatttgttttttggcatcaaaaaaaaaaaaaaaactcgagaaaaannnnnnna

SEQ ID NO: 4002 - DNA, 3095 bp, Zea mays
  misc_feature (1230)..(1230): n is a, c, g, or t
tcaatgatgccaattataatcttccctccagtggtttcaattaggcggaaaagggcctgaataagagtagatttaccgcttccagtacgccctacaatcccaatctttttcccgccaggaaacatacaacttacaccatgacggactttcggtagatcaaagtgttgtggaccttgatatagcgttcagacttggtggatttgcatcaacgacaattcaactccttggaattgttgctgtcatgagcaaagtcacatggcaagttctgattcttatagtccccatggctgttgcatgcatgtggatgcagaggtattatattgcttcatcaagggaactaactaggattttgagtgttcagaagtctccagtgatccatttgtttagtgaatcaattgctggtgctgctacaataaggggttttggtcaagagaagcggtttatgaaaaggaatctttatcttcttgactgttttgctcgccctttattttccagccttgctgctattgaatggctctgcctgcgaatggaattgctttcgactttcgtctttgctttttgcatggcaatacttgtgagctttcctcctggcacaatcgaaccaagtatgtttatgttccacatgctgctccagttctctactatgtttggtcgctttctccaatgccttattctgtgcagtagaaaacctgcatcttcttgtctgttaaaatttattcagcatctaaatggattttcaaattgataggtatggctggcctcgctgtaacatatggacttaatttaaatgctcgcatgtcaagatggatattgagcttctgtaaattagagaacaggataatctctgttgagcgcatttatcaatattgcaggcttcctagtgaagcaccattgattattgagaactgccgtccaccatcatcatggcctcagaatggaaacattgaactgattgatctcaaggtatgctttatcattggggggcagttaaggatacgattttcattagcattgctatagagctgattgtcatttccagcatgcaaatattatattctaacataatctatttacatttttctctttactatgtataattaccatacatatctaatttatgatctatttagttttggcttctgagtttgctttttcatgattatgaaaggtccgctacaaggacgatctaccattagttcttcatggtgtaagttgtatgtttcctggcgngaaaaagattgggattgtagggcgtactggaagcggtaaatctactcttattcaggcccttttccgcctaattgagcccactggagggaagattataattgacaacattgacatctctgcaattggccttcatgatctgcggtcacggttgagcatcattccccaagaccctacattgtttgagggtactatcagaatgaaccttgatcctcttgaggagtgcactgatcaagaaatttgggaggtacatcctggtcactttgacgctatactcatgttgagtctgtgtgattcttatcttaaggaacacaatctgttgcaggcactagaaaagtgtcagctaggagaggtcattcgttccaaggaagagaaacttgacagtccaggttagcctgacattttgctgccaagcctcctttgaagagtgggaatgtggtttcttaatgcgtaaacttattgctcctggacctttttttttgcttttgcagtgctagaaaacggggataactggagcgtgggacagcgccaacttattgcactgggtagggcgctgctcaagcaggcaaaaattttggtactcgatgaggcgacagcatctgtcgacacagcaacagacaatcttatccaaaagatcatccgcagtgaattcaaggactgcacagtctgtaccattgctcaccgtattcccaccgttattgacagtgaccttgttctggtccttagtgatggtatgagttctttgactaaactaaccacgcctcctttacctgttctccgcccggcgtccgccccgcggccccttttccaactcgtgcatccgattcttggataaacatttagaaagtagaaaccgtagcaaactgacagtttttcttctgcacagaatttggaaacaagccttcgctgaacttttctcatcgtcttgatttccaggtaaaatcgcagagttcgacacgccccagaggcttttagaggacaagtcatctatgttcatacagctagtatcggaatactccactcggtcgagctgtatatagagaggcttagcttaaaaccccgccccaaacctggcaacagaggctgggaggcaaatagcccgtatctgccatgcttgcgccatagaggtccctgcgaacaccggagggcggcgtagaagacgaggtgtacatgagtgggaggaacactgggcgttccctgacctgaataccgtggaatcggcgagggagcgcggttggtattggtaggcaccaggggaggagttggtgacactagtacattacccgaagctgatgcttcagtatgtatgtataacaacaatgcatactgcttctccctttgcagagtggagaaccaagggaataactcgtgcgtaataagaggagaaagatttgttttttggcatcagactggtgtgtgtgcgcttttgtttgctgtgtccattagaccattactgtatttctctgccaaattttactgtagccggtgccagtttctgcttcagaaattcagcatctcaaatcgccaggtgaaaaaggttcagcaaccagcagtttgctcgatggccgaggctagtaactcatcctgtgctgaatacagagtatcaccacgtcaggttcactgccctgacctgaaaacaatactccctgtggagatgacggctggattacgcagatactgtagtgtaaaataagagatttacattgtagattatactttttacagattaaagctttaaataggagatgaatagactgtgtagtgtaaaataagatatttacattgtagattatactgtttacagattaaagctatgaatagattgctgtttttagagagagagaggctgtagggtaaaccctacatca

SEQ ID NO: 4003 - DNA, 2192 bp, Zea mays
aaaaatgaagaaagaagagcgtaagaagaagcgtactgttcaagaggaggaaagggaacgtggaaaagtgagctccaaagtttatttgtcatacatgggggaagcttacaaaggtacactgataccactaattatcttggctcaaaccatgttccaagttcttcagattgcgagcaactggtggatggcatgggcaaacccacaaacagaaggagatgctcccaagacagatagtgtggtccttctggttgtttatatgtcccttgcctttggaagttcactatttgtgttcatgagaagccttcttgtggctacgtttggtttagcagctgcccagaagctttttataaaaatgcttaggtgtgtctttcgagctccaatgtcattctttgacaccacaccatctggtcggattttgaacagagtttctgtagatcaaagtgttgtggaccttgatatagcgttcagacttggtggatttgcatcaacgacaattcaactccttggaattgttgctgtcatgagcaaagtcacatggcaagttctgattcttatagtccccatggctgttgcatgcatgtggatgcagaggtattatattgcttcatcaagggaactaactaggattttgagtgttcagaagtctccagtgatccatttgtttagtgaatcaattgctggtgctgctacaataaggggttttggtcaagagaagcggtttatgaaaaggaatctttatcttcttgactgttttgctcgccctttattttccagccttgctgctattgaatggctctgcctgcgaatggaattgctttcgactttcgtctttgctttttgcatggcaatacttgtgagctttcctcctggcacaatcgaaccaagtatggctggcctcgctgtaacatatggacttaatttaaatgctcgcatgtcaagatggatattgagcttctgtaaattagagaacaggataatctctgttgagcgcatttatcaatattgcaggcttcctagtgaagcaccattgattattgagaactgccgtccaccatcatcatggcctcagaatggaaacattgaactgattgatctcaaggtccgctacaaggacgatctaccattagttcttcatggtgtaagttgtatgtttcctggcgggaaaaagattgggattgtagggcgtactggaagcggtaaatctactcttattcaggcccttttccgcctaattgagcccactggagggaagattataattgacaacattgacatctctgcaattggccttcatgatctgcggtcacggttgagcatcattccccaagaccctacattgtttgagggtactatcagaatgaaccttgatcctcttgaggagtgcactgatcaagaaatttgggaggcactagaaaagtgtcagctaggagaggtcattcgttccaaggaagagaaacttgacagtccagtgctagaaaacggggataactggagcgtgggacagcgccaacttattgcactgggtagggcgctgctcaagcaggcaaaaattttggtactcgatgaggcgacagcatctgtcgacacagcaacagacaatcttatccaaaagatcatccgcagtgaattcaaggactgcacagtctgtaccattgctcaccgtattcccaccgttattgacagtgaccttgttctggtccttagtgatggtaaaatcgcagagttcgacacgccccagaggcttttagaggacaagtcatctatgttcatacagctagtatcggaatactccactcggtcgagctgtatatagagaggcttagcttaaaaccccgccccaaacctggcaacagaggctgggaggcaaatagcccgtatctgccatgcttgcgccatagaggtccctgcgaacaccggagggcggcgtagaagacgaggtgtacatgagtgggaggaacactgggcgttccctgacctgaataccgtggaatcggcgagggagcgcggttggtattggtaggcaccaggggaggagttggtgacactagtacattacccgaagctgatgcttcagtatgtatgtataacaacaatgcatactgcttctccctttgcagagtggagaaccaagggaataactcgtgcgtaataagaggagaaagatttgttttttggcatcatttttttaaagg

SEQ ID NO: 4004 - DNA, 942 bp, Zea mays
  misc_feature (882)..(882): n is a, c, g, or t
  misc_feature (903)..(903): n is a, c, g, or t
ggactgtttataattgttgttgttcttgtacttctttgccggaggaaaaagaccctggaaaagcagcattcaaagacctggatgcctttctctatcaatgggctcacctctctcagcacaggaagcagaacgtcttatggtactactctcacatcagggctgaatggaagctatggataccgttttgccttcagtgtgctccaagaagcaacaaacaatttcgacgagaactgggtcattggagttggaggctttggaaaggtctacaagggggtgatgagggatgagagcaaggttgcagtgaagcgtggaaacccaaagtctcagcaaggtctcaacgagttccgtacagagattgagctcctctcacgtctgcgccaccgccatttggtgtctctgattgggtactgtgatgaaaggaacgaaatgatcctggtctacgagtacatggagaaaggcactctcaagagccatctctatggctccgataacccctcgctcaattggaagcagaggctggaggtttgcatcggagcagcaagggggttgcactaccttcacactggatctgcgaaggccatcatccatcgtgatgtcaagtccgcaaacatcttgctcgacgagaacctcctcgccaaggtcgctgactttgggctatccaagactgggcctgagctcgaccaaactcatgtcagcactgcagtgaagggcagcttcgggtacctcgatcctgaatatttccggaggcagcagctgaccgagaagtcggatgtctactctttcggtgttgttttgcttgaggttctttgtgcaaggccagtgatcgaccccacgctgccgagggagatggtgaacctggccgagtgggggatgaagtggcanaaaaaaagagagctgcaccanatcatcgatcagaggatctcgggcacaatcaggccggac

SEQ ID NO: 4005 - DNA, 3627 bp, Zea mays
cagcaaacttagcatcagcattggcccggcgggcttgaacaatgtattggccgacgggattctgaatgggcttgaggttatgaagataagtaccggaggttctgctttcactgtcgggtctggcagtggaaacaaaaaatggggtgtgattcttggcgcagccctcggaggtgttggactgtttataattgttgttgttcttgtacttctttgccggaggaaaaagaccctggaaaagcagcattcaaagacctggatgcctttctctatcaatgggctcacctctctcagcacaggaagcagaacgtcttatggtactactctcacatcagggctgaatggaagctatggataccgttttgccttcagtgtgctccaagaagcaacaaacaatttcgacgagaactgggtcattggagttggaggctttggaaaggtctacaagggggtgatgagggatgagagcaaggttgcagtgaagcgtggaaacccaaagtctcagcaaggtctcaacgagttccgtacagagattgagctcctctcacgtctgcgccaccgccatttggtgtctctgattgggggctgcctcgaggccggcgaaatgatcctggtctacgagtacatgggagaaaggcactctcaagagccatctctatggctccgataacccctcgctcaattggaagcagaggctggaggtttgcatcggagcagcaagggggttgcactaccttcacactggatctgcgaaggccatcatccatcgtgatgtcaagtccgcaaacatcttgctcgacgagaacctcctcgccaaggtcgctgactttgggctatccaagactgggcctgagctcgaccaaactcatgtcagcactgcagtgaagggcagcttcgggtacctcgatcctgaatatttccggaggcagcagctgaccgagaagtcggatgtctactctttcggtgttgttttgcttgaggttctttgtgcaaggccagtgatcgaccccacgctgccgagggagatggtgaacctggccgagtgggggatgaagtggcagaagagaggagagctgcaccagatcatcgatcagaggatctcgggcacaatcaggccggactctctgaggaagtttggcgagaccgtggagaagtgcctggcagactacggcgtggagcggccgtcgatgggagacgtcctctggaacctggagtacgttctgcagcttcaggacgccgattcgacggtctcggatgtgaacagcatgaaccgtatcgtggaactcccgtcacaggtccagaacgtcggggccctcgagagcatcagcgtgacgatggcagaagccggagcgtcaaacgagcctgaccacgacctctccgatgtgtccatgagccgcgtcttctctcagctgatcaaggccgaggggaggtaaatgtgcgtgacgcagcctgtagggtgtgggtggtggggaggaagccttcaaagtcatctcttgctgaagtttacgtgagagagatcatgtgtgattttttttcttcttttcgtctacaaatgtactactgaagtgaactatggtttcgagttacagttttagccattgtgagcctgtgcggctacaaatttcgtagatagcacatttcgagtttgaatttgttactgggcgttgaataatattcccctaaccgtagaagcctctcactatcctcgaaacaggaggagcacacactcacaatcgtagttgctactgttgtatccacagggaacaactactatgcaaacagccattagcattataagatccgcccttccctttctcgtctcattcatttgtctagaccgacatcacatgtgcagcgatgagaaatttacaattttggctttatggttattatattatctcgcgtgtatgactgatgatgaggcggctgcatgctggtgatgcctcctagctggatctggacgcttcgtcgggttatctggggaggtcatccgtcccattgcgctgtcgccggtgcagggaaagagtgtgctgccgacggttggcgcaccatcgcggcacgagccattgacaattttgtcattattattgatggactttgctggtatgttatcggatctatcctagatgacacctgattgtaaaaaagcgtggttatggcctgtgatagttctgatgaatatatcgtggacgatttttggaccaaaatagttcgatgcatgcatgcacgattcttgaaaaaaaacatatgagcctttgttggtttattctcattcaatgaatgttggggagattgtgaggaaccagaagagagatatctttaccgaataggccaacgattttttcgattttttttttcaaaccgtagaagttgtttatggcagatgcaagattgaccctaaacattccagcaaactcttcgctgtgccctttctgatgagcaaaccaccatcaaaggctgacactatgggtaccttgctcgattataggggtaagcgtgtgcagcgacagcaaggcgcacctggacgtcggactcggcgacggcgacggcggcagcatgtgcagcgagcggctcgggccggaggacaggacagcagcgtgttctggcagctttcggttgtagcatgtgcatgtccatcccccccaactcatcatcttctcgaatataatggttacaggtaactgttggtgcatctttttttttggtttccctatcacaaaaattgacattggaatgctcaacaataatggatgaactttggaatttgggatgctgctggacaagcgaggtaaatcggtgctgtagaccagtgctagtgttttgctggctttgcagcgcgcgtagccagaaaatttatgaagtatccttatgtatgtacgtgtgatccatctttctttgctagcatgtgcatgtttttgcccaaatcaacaagtggtgagaattgagagccaatttcgaattttttatccttttgccattattttgggacgggtgataaataaaatgtttaaaaaaatgaaaaagaaatcgagagtctccgtcaatttcgggcgattgccttgaagacaggcgattgcgttgaagggctttctcaatttcaactatcattagtcggttgggctgggctgggtcacggtggtattccgtgggcctgtggataagcccaagcaccgaaacgacgtggtcttcttgggggtggaggtggagctcaacaagtctcccacgtctcctcatatgcgtgccgagagctaaaaaaatctactttgagtgacgccatcaacaggcagcaatcccagccacagagcgacagcgccgccgctggctgcaggcacgccggtgtttgttctattgtgatgatcggctgtaaaacaaaatgtagtatacaaacataaatgatcatggtcttatcttttgttctcctattgcaacatacatacagacaggcaattaaaaaggcatgaaactagaaaccgaaggcttctttacattacactgatgagtggggccactcttgtgtaaccatgcctcaacatcacaactctctactctatccgtccgctcgagccgccactgtcgctctatgcaggtatcatcatcctctccggcgaggttatgagctagcggataggt

SEQ ID NO: 4006 - DNA, 582 bp, Zea mays
agactcagagcacgctcctgcgtagtgcgtactagtgcgctgccctgcgcccgcgcggcatggcattcgcattgctggtggcagcagcgagagcggagagtgctggaagcactcgcagcccagccgcagccgcaggcggaggccgagcaatgggaggaggatggccgcgtccccgcggggccttggcggcgccgcgcttgctcctccgagcgctgctgctctgctccctcctcgcgcagccgcatccgtcgcgcgccttcttcttcttcggcggcgtgcgcaccagcttgcacgtcccccagcaccgcggtggtggacgcgaggagaaggtgcccatgaccgtcgtcgtcccggactactcgccgcggcccgcgccgctcggcctctcgccctcagccgcgcccgcgcccgcgccggtgcccggctcggacggcgacgaagacggcacgccgaggctgccgtcagagcggcggggcacgggcgcgccctcgtcgaccatcctggagcttcagcagtcaccacggcgcagggtgaggaactgaggaagcagatcggcgctgcggcctacatcgagtgcagttc

SEQ ID NO: 4007 - DNA, 1036 bp, Zea mays
  misc_feature (805)..(805): n is a, c, g, or t
  misc_feature (967)..(967): n is a, c, g, or t
cggtgaccgagcggatgcagagctggcagcggttctggcctggcgctcaggggaagggcacttgcggcaagtgtcattcttgaccagccggcccgccgccctccctgtcctgcggcctcgcatttacaccgcgcctccctaggccagctgcgagcggcgagttctttaaggaggcgggcgacaggccggtaccggcgcggtgcctttgccttgcctgtcttggcgtggagtggcctgcattctcttctcggagaagacaagcaaagcaaagcaaggcaaccattcccgttcttgtcccgttgtctttgtctctcttgttgtcccttgctgctcgctcgccgccgtttctcggagcgctagctgctgtgctgctgctgctgggagtgtgagagtgaggcgaagggccgacctgagccggggagaagaagggggcctgccggccggggctgggagacatgagcgtgaccaagttcatcaagtgcgtcacggtgggcgacggcgcggtgggcaagacctgcatgctcatctgctacaccagcaacaagttccccacggactacatccccacggtgttcgacaacttcagcgccaacgtctccgtggacggcagcatcgtcaacctgggcctctgggacaccgcggggcaagaggactacagcaggctgcggccgctgagctacaggggcgcggacgtgttcgtgctggccttctccctgatcagcagggcgagctacgagaacgttcttaagaagtgggtgccagagcttcgcagattcgcgcccaacgtcccggtcgttcttgttgngaccaagttagatctccgcgaccacagagcctacctcgccgaccatcctggagcttcagcagtcaccacggcgcaggtctgctctcttctacctacttcctcccaacgccggtaatcatcagaagcgtgatgcaacttgtcttgattcctcttcgcctttgntcttgcagggtgaggaactgagggagcagatcggcgctgcggcctacatcgagtgcagtccaaaaccca

SEQ ID NO: 4008 - DNA, 1078 bp, Zea mays
gctttttgccttgcctgcctgccttccttctcgtagaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacaggggcgcggacgtgttcgtgctggccttctccttgatcagcagggcgagctatgagaacgtccttaagaagtgggtgccagagcttcgcagattcgcgcccgacgtcccggtcgttcttgtcgggaccaagttagatctccgtgaccacagggcctaccttgctgaccatcctggagcgtcgacgatcacgacggcacagggcgaagaactgaggaggcagatcggcgctgcggcttacatcgagtgcagttccaaaacgcagcagaatgtcaagtcggtcttcgacacagccatcaaagtggtccttcagcccccgcggaggagggaggcgacgcctgccaggaggaagaacaggcgtggctccgggtgctctatcatgaacctcatgtgtggcagcacgtgcgctgcttaggagtctagaacactgatctggaaggaggtgaaggtgaaggcatggtgtctatgtgctatggcgactggcaagttaatggggccgcatggatgactgctgctcttgtttttttaagctcgtctgccgtatgctttgtttttttaggcttcaaggactgacaattgcaagaatgcagtgtttatgtaagaggttgtttgctggaataggattgctgtaactgtaatgttgttctccgagagcaaaaaaaaaaaaaaaaa

SEQ ID NO: 4009 - DNA, 1390 bp, Zea mays
cggagacggagcggatgcagagctgtcagctcttctggcctggcctcaggagaagggcacttgcggctagtgtcattcttgaccagccggcccgccgccctccctgtcctgcggcctcgcatttacaccgcgcctccctaggccagctgcgagcggcgagttctttaaggaggcgggcgacaggccggtaccggcgcggtgcctttgccttgcctgtcttggcgtggagtggcctgcattctcttctcggagaagacaagcaaagctaagcaaagcaaggcaacccattcccgttcttgtcccgttgtctttgtctctcttgtcccttgctgctcgctcgccgccgtttctcggagcgctagctgctgctgctgctgctgggagtgtgagagtgaggcgaagggccgacctgagccggggagaagaagggggcctgccggccggggctgggagacatgagcgtgaccaagttcatcaagtgcgtcacggtgggcgacggcgcggtgggcaagacctgcatgctcatctgctacaccagcaacaagttccccacggactacatccccacggtgttcgacaacttcagcgccaacgtctccgtggacggcagcatcgtcaacctgggcctctgggacaccgcggggcaagaggactacagcaggctgcggccgctgagctacaggggcgcggacgtgttcgtgctggccttctccctgatcagcagggcgagctacgagaacgttcttaagaagtgggtgccagagcttcgcagattcgcgcccaacgtcccggtcgttcttgttgggaccaagttagatctccgcgaccacagagcctacctcgccgaccatcctggagcttcagcagtcaccacggcgcagggtgaggaactgaggaagcagatcggcgctgcggcctacatcgagtgcagttccaaaacccagcagaacgtcaagtctgtcttcgatacggccatcaaagtggtccttcagcccccacggaggagggaggcagtgcctgccaggaagaagaacaggcgtggctccggatgctctataatgaaccttgtgtgtggcagcacatgtgctgcttagggagtctactagaacactgaaccggaagggaggtgaaggcgtgattcatggtgtgtaatgtgctgtggcaactggcaagttagtttgctatagatgaggatgactgctgcttttgttttccttggcccatctgctgtagtgcgtcaggctcttcaagggctgactttttaccagactgcagtgttgtgtaagaagtttgctagacgctgtaactgtaatgttctccgctgatgtggtataactaagatacgagtaagcttgagcgtgttctgggcaaaaaaaaaaaaaaaaaaaaa

SEQ ID NO: 4010 - DNA, 1891 bp, Zea mays
  misc_feature (22)..(22): n is a, c, g, or t
  misc_feature (24)..(24): n is a, c, g, or t
ctacatcttacgtgctcaaaananacgaaggccgggcccgggcccggccgggcgcgggcaatactataaataatggaccggagcgaggtgtggtgaggtggaactgaatactacaatggagctcacgtgggacgaatgggatgtcattatactggctgcctgcagcttcctcatccctctcgtgttcctctgcaatgctacgaagcggcggcggcggcgcgcgccccctggcccggccaccgtacccatcatcgggaacctggcgtggctaacgttgcgcgacgggttgggtgagctggacatcctgcgacgactgcactcgcgctttggcccgctgctgtcggtccgcttgggttcatcggagcaggtgaacgtggcggaccgccgtctcgcacacgccttgctcgtggagcgtggcgccgctgtggctgaccgctcgccgctgctggtgtccaccgagaggttcggggccttcggctctttcagcatacacgtgtccagctacggcccacgctggagtgttctccgccgcaacttcgcggcggaggtcgtgagcccagcgcggttccggcagatggcggcctcgcgggagctggcgcttgccgacctcatccggaagctgaagctgcaggagggcgtcgtcgtctgcagggacgcgttccagcacgccatgtccagcctcttcatcgccatgtgcttcggcaaggtcctcgacgactcgtccgtggacagcatcggcgtcgcgctgcgcgacttcgtcctccacggcggcgcgtcggggatggggatggcgctattcttgttcctccctgctctcaccacgcgactcttccgtggcctcctgcggtctaaggaggccaagcgccagaagctcgaaaacgtgtactgcctgccattgatccatgagcggagagagcgcaggaagacgaagcagctgacgcaggagcacccgcactgctacgttgacacgttgctcgacctcaggctcgacgaggaacaggatggtggccgccttctcacagaccacgagatagcaagcctgtgcatcgagatcctcatcgttggctcggagctaccggcgacggcgctggagtggatcatggcggagctagtaaagaacccaggcgtgcaggacaagctctacgaggagatgatggtgaaagccaaagccaccactgacgcttctgctggcgtgctcccgttctcggaggatgacttgcccaagataccctacctgagagcggtggtgctggagggtctccggcgccatccgccggggcaccagatgccgccacgcagggtgagggaggacgtggaggtgggtgactacgtggtgcccaagggctcagcgatcaacttcatgctgtacgacctgggcatggacgacgccacgtgggaccgcccagcagtgttcatgccggagaggttcctgcccggcggggaagccgaggcgctggacatcaccggcaccaaggagatgaagatgataccgtttggggcgggcagaaggatctgcccgggcctcaggatcgctctcctgctcctcgagtacttcgtcgccaacctcgtagcgaccttccactggaaagaggtggaagagggcgacgtcgatgtcaccaccgaggacgctcagctcaccgtcctcatggggaagccgctccgggcgcgcctgcttccaagactgcattcgtctgcttaattttcttcatcatcatggtgtatgtcagtgtgtcaccgaataattaattaatgcgaataaagatcaagcttcaaagactcttcaccgttcaaaaaaaaagaaaaaaagcgccaacacgctaatgtgcccaatcggacccaaagatatatatataaataaggcacggtgcctacacggctatctctagccgtg

SEQ ID NO: 4011 - DNA, 1926 bp, Zea mays
cagagcgtccagactagtgggtgaaatgtaaatgtccctaataggtacactcctcgccgccgggcgggccgggatactacaatggagctcacgtgggatgtcattgttgtactggctgcctgcagcttcctcattcctctcgtcttcctccgcaacgctaagaagcaccggcggcggcgcgcgccccctgggccggccaccgtacccatcatcgggaacctggcatggctagagttgcgccacgggtggatggatgagatgaacatcctgcgacggatgcactcgcgctttggcccgctgctgaaggtccgcctgggttcctcggagcaggtgaacgtgatggaccgccgtctcgcacatgccttgctcgtggagcgtggcgccgcggtggctgaccgctcgccgctgctggtgtccaccgacaggttcggagtcttcgactctttcagcatacacgtgtccagctacggcccgcggtggagtgttctccgccgcaacttcgcggcggagatcgtgagcccagcgcgcttccggcagatggcggcctcgcgggagctggcgctttccggcctcatccggaagctgcagctggaggagggcggcgtcgtctgcagggacgcgttccagcacgccatgtccagcctcttcatcgccatgtgcttcggcaaggtcctcgacgacttgtctgtggacagcatcgccgtcgcagtgcgcgacttcgtcctccacgacgacgggtcggagacggggatggcgaaattcttgttcctccctgctctcaccacgcgactcttccgtggcttcgtgcgggagagggaagccaagctccaaaagctggaaaccgtgtattgcctgccattgatccatgagcggagagagcgcaggaagaagcagcagacgcaggagctggagcacccgcactgctacgttgacacgttgctcgatctcaggctcgacgagggacgacaagacggtggccgccgtcctctcacagaccacgagatagctagtctgtgcatcgagatcctcatcgttggctcagatctacctgggacggcgctggagtggaccatggcggagctagtaaagaacccaggcgtgcaggacaagctctacgaggagatgatgaaagccaaaggcactggtggtgttgttgctgcaggtggcgtgccgttctcggaggatgacttgcccaagataccctacctgagagcggtggtgctggagggtctccggcgccacccgccggcgcagcagatgccgccacgcagggtgagggaggacgtggaggtgggtgactacgtggtgcccaagggctcagcgatcaacttcatgctgtacgacctaggcatggacgacgccacgtgggaccgcccagcgctcttcatgccagagaggttcctgcccggcggggaagccgaggagttggacatcaccggcgccaaggagatgaagatgataccgtttggggccggcagaaggatctgcccgggcctcaggatcgctctcctactcctcgagtacttcgtcgccaacctcgtagcggccttccactggaaagaggtggaaccgggcgacgttgatgtcacctccgaggacgttcgggtcagcatcctcatggggaagccgctccgggcgcgcctgcttgcaagactgcctgctgcaccgtgatgatgatgggtgacagtagtgtgacactgctccatctatggatccacgcaccgacatgaacggacgagacgacgacgacgatgcttttaatttcttcttttcctcatcaccgtcatcatggtctgtcctttttctttgtatgcatgcatgtacacgacagagtgtatgtatatatgcatgtatctcagtgtctcaccaaataattaatgcgaataaagatcaagaacataacatatttgttcttgcttgatagac

SEQ ID NO: 4012 - DNA, 1569 bp, Zea mays
  misc_feature (913)..(913): n is a, c, g, or t
  misc_feature (968)..(968): n is a, c, g, or t
  misc_feature (1018)..(1018): n is a, c, g, or t
  misc_feature (1023)..(1023): n is a, c, g, or t
  misc_feature (1040)..(1040): n is a, c, g, or t
  misc_feature (1059)..(1059): n is a, c, g, or t
  misc_feature (1257)..(1257): n is a, c, g, or t
  misc_feature (1269)..(1269): n is a, c, g, or t
  misc_feature (1387)..(1387): n is a, c, g, or t
  misc_feature (1433)..(1433): n is a, c, g, or t
  misc_feature (1483)..(1483): n is a, c, g, or t
cgcggggccgcccccggcccgggacgcaatactataaataatggaccggagcgaggtgtggtgaggtggaactgaatactacaatggagctcacgtgggacgaatgggatgtcattatactggctgcctgcagcttcctcatccctctcgtgttcctctgcaatgctacgaagcggcggcggcggcgcgcgccccctggcccggccaccgtacccatcatcgggaacctggcgtggctaacgttgcgcgacgggttgggtgagctggacatcctgcgacgactgcactcgcgctttggcccgctgctgtcggtccgcttgggttcatcggagcaggtgaacgtggcggaccgccgtctcgcacacgccttgctcgtggagcgtggcgccgctgtggctgaccgctcgccgctgctggtgtccaccgagaggttcggggccttcggctctttcagcatacacgtgtccagctaccggcccacgctggagtgttctccgccgcaacttcgcggcggaggtcgtgggcccccagcgcgggttccggcagatggcgggcctcggcgggaagctgggcgcttgccgacctcatccggaagctgaagctgcaggaggggcgtcgtcgtctgcagggacgcgttccagcacgccatgtccagcctcttcatcgccatgtgcttcggcaaggtcctcgacgactcgtccgtgaaccagcatcggcgtcgcgctgcgcgacttcgtcctccacggcggcgccgtcggggaatggggatggcgctattcttgttcctccctgctctcaccacgcgactcttccgtggcctcctgcggtctaaggaggccaagcgccagaagctcgaaaacgtgtactgcctgccattgatccatgagcgcggagagagcgcaggaagacgaangcagctgacgcaggagcacccgcactgctacgttgacacgttgctcgacctcagngctcgacgaggaacaggatggtggccgccttctcacagaccacgagatangcaangcctgtgcatcgagatncctcatcgttggctcggangctaccggcgacggcgctggagtggatcatggcggagctagtaaagaacccaggcgtgcaggacaagctctacgaggagatgatggtgaaagccaaagccaccactgacgcttctgctggcgtgctcccgttctcggaggatgacttgcccaagataccctacctgagagcggtggtgctggagggtctccggcgccnatccgccggggngcaccagatgccgccacgcagggtgagggaggacgtggaggtgggtgactacgtggtgcccaagggctcagcgatcaacttcatgctgtacgacctgggcatggacgacgccacgtgngaccgcccagcagtgttcatgcccggagaggttcctgcccggcggngaagccgaggcgctggacatcaccggcaccaaggagatgaaatgaacgcnttttgggcggggccagaaagatctgccccggccctcagatcgctctcctgctcctcgagtacttcgtcgccaacctcgtagcgact

SEQ ID NO: 4013 - DNA, 3538 bp, Zea mays
agctgaaatctttactattcttagttcagaatataggattgtaagttaattaggttgcatagcttattttgcggtagagatagcaacacttatataaaacctaggttgtacattattgcttacttatttgcatagattttatttataaaattatttgtggtctaaattagcgagaaacatagaagttatattttacctcctcttaagcgtccactatcctttcatacacgctccattggaaatgaccttacgttcattcatgtgacctgaacatcttaactccgactagtctggctgcatgagccagaccggcgagagcctgactccagagatgcgaccaatttgctcgcgtctgcagagcctggctcatggtgctttaaatatcgtgcgagtctggctccacatctgcacgcaggtaaccaaacacacacctcgcacgcgtatagacaacaaccaaacaccagctcattacatcccgcgatgcaagcaccagcaaatacaggcaaccaaacacacagtatatgtatatatacttattgtcacaaaaagttttatgaattaaaattacatatactcaaaatttcctaaatctataaccgtttagacgagagaaggaacctaccaaaatattaataaatactccctccgcttacaaattaaaattcgttttagttaattaataggttcatataatacaatacttaatgtatgtattatatatgtgtctaggtttatcttcatatattaaaatataaacataaaccaagatctaaaacggacggaggaagtaactaccaaaatcaaggtgacgtgaccccaacaagaaaagggaattgaagagactatcgtgaccacatttctggtacgtatatatctttattatgcttagggactaagcatatgtatgcatcaacattcacctgtgcatgggcatatatagatatagcgaaagcaaaggcaacaaattaaaaaaggattcttgcgacgaatccactaataattaggtaataaagacagagaacatagcatcaagtgcaatacatgcatgccaaacattggtcagttcgtctaaaacatccaaaaggcaataaatgacaacgaacacgcagcgcaggtttaatctcagggccgggggaatcttctatgcaagctgcagctagggcaaaaagaatgcagtccaattcgtccgttcctcccacttgctgcatgagctacacatgcacgatgggaatgtaataaattactgtattaccgaagcgacgttgcgcgcggtatccatgcatctttcttcagccagggcttttctacgcgtagactgccacaagctagcttgcgcatatgctttacaccttttctttcagtttcttattctatattatatgtttatgtagacagctcgacagcaagaagcacgtgcctctcactctctttgtgcggtagcctgctgcgtgcctatagtattatatatacgttgctctcatcactgtgcttgtgcggtatgcagactactgcagaaagtatagctaagcgaaacaaactcagcgatcgacaagctaagctagcagactacacatccaggatcggagccgctgctcaccgaccaatatggcgacggagtacttgtccgggtggccgctgtcgtcctggatcagccccggcgcggcgttcttcctcttcgtcaacgtgctcatcggcgccatcgtggtcacgtcccgcgggcaccaagctggcggtggccgcgcggcggcgtccacgcggaggctctgccgcagcgcgtcgtccatggtcctcgatcggctccgctccttctccttgttctccgtccatcccgaccccacggaaacggaagagcgctgtagcacgtcgtcccccctcgagctggaagcagaggaggaggagcagccccaaccccaaccagccgtcgcggagcccgcaaggtcacttgttgcggcagtagcagctcctgcagacggtgcatcgtctgagatcgccaaggaagaggcggcggaagcgggaaaagacctgcccaccagctcgaacgaggcccacggtctggtgttgcagttgcagcagggtcacggcggccggcagcagccaccgtcgtcagtaaatgtcgtcacagccgccgatgcaactgcggcggtggagataaaggaggaggagaagaagaagaaggcagagcaggaagcaaccatgcagcgcgcacctgcgtgcaggcggggaacgacggaggaagcagcggaggagaaggcggcgctgaacgcgcgggcagagtccttcatccggaagttccgggaggatctcaagctggagcgtctcaactccattatcaactacacccgcacgctccgccgcggcgttggcgcaccacagcccactgcgcagtagctctccgctcatcggtggtccatcgttttttattgtttgcttaatgtatagagtacttgaatttgtttgctcatcacaatggtgccaaacccagatagtttaatttaaatgtgattgtgtaccactgtggcttccttatatatggacactagtccacatgattaatatatatccataattatcaaaaacattcataaaaccttggtacaattcaaatgcgaaaacaaatttagtaaacgataaacttgtttagagttcttaattagcattgtggtgccacctatggttctaaatatcttccgttctcaattaatctgtcatccttcacactataagactatcttcaaccatatcttgtacatccttcctctttaatccacttttcagacttctctagaaggttttcacatctatatctcatttctctcgagcaacgtttttatatcccgtcctccatacattaaatacccatattaaagacatatgtagctctagattttgtacatatgtattcttcactactctcaaatggcttatacatattttagtttattttagttttgcttaatttgtatctgaagtataaaaatccatacataaaagaggagctagagtacatatacaggacgaaggagtgtcctctatatttagaggacactttagaacaccctattagagcatatagagaagagatgcttctttaaatataggataggagattcaatctcattattctcattttgattttttaagctgccaaacctttattaacaccttatttgattcaggttagaaaaacccaattaaataaaacaaaagctagcttactattatcgggattactttagcatcaagtaacaaattatggaggaacctccaatttgcacttggttaaaatgaatcgtcaatcactccatagtgatgagagatagcatatgcacaatccacggctcgctacataccaaaccacatcagggggcacatgatcgaacaataagttcatttaaaacgaaagcaaattcgatcgtcccactacatttcatgcccaagttcaacataggtagcttacaagtcgaacatcacatatgattccaagagagcattttaacttacaagttgaagataaatttaatttacaatcatatgccca

SEQ ID NO: 4014 - DNA, 1102 bp, Zea mays
gctaagcgaaacaaactcagcgatcgacaagctaagctagcagactacacatccaggagccgctgcttgatcaccgaccaatatggccacggagtacttgtccgggtggccgctgtcgtcctggatcagccccggcgcggcgttcttcctcttcgtcaacgtgctcatcggcgccatcgtggtcacgtcccgcgggcaccaagctggcggtggccgcgcggcggcgtccacgcggaggctctgccgcagcgcgtcgtccatggtcctcgaccggctccgctccttttccttgttctccgtccatcccgaccccacggaaatggaagagcgctgtagcacgtcgtcccccctcgagctggaagcagaggaggagcagcagccccaaccccatccagccgtcgcggagcccgcaaggtcacctcttgcggcagtagcagctcctgcagacggtgcatcgtccgagatcgccaaggaagaggcggcggaagcgggaaaagacctgcccaccagctcgaacgaggcccacggtctgctgttgcagttgcagcagggtcacggcggccggcagcagccaccgtcgtcagtacatgtcgtcgtcacagccgccgatgcaactgcggcggtggagataaaggaggaggaagagaagaaggcagagcaggaagcaaccatgcagcgcgcacctgcgagtaggcggggaacgacggaggaagcagcggaggggaaggcggcgctgaacgcgcgggcagagtccttcatccggaagttccgggaggatctcaagctggagcgtctcaactccattatcaactacacccgcacgctccgccgcggcgttggcgcgccacagcccactgcgcagtagctctccgctcatcggtggtccatcgttttttattgtttgcttaatgtatagagtacttgaatttgtttgctcatcacaatggtgccaaaaccagatagtttagtttaaatgtgattgtgtaccactgtggcttccttatatatggacactagtccaaatgattaatatatatccataattatcgaaaaaaaaaaaaaaaattcaagtactctatacattaaaaaaaaaaaaaaaaaa

SEQ ID NO: 4015 - DNA, 1305 bp, Zea mays
actgttgtgttgtcattgcaagaagcaaagatggcagtgttgagaggccgcttaacactagtgctcatcctcagcctcagctgctgcttctccttccccacagtactatcctcagttacctccgatggcttcctccaatgcctgtccgacaacatacctgtcgggctcatctacacccagggctcgaccaacttcaccgacgtgctggtgtcctccgtccggaacccccggctgttcaccagcgccacggtgaggccgctctgcatcgtcacgcccgtcgacgcatcccacgtgcaggctgccgtgcggtgcggtcgcgccagtggcgtgcgcctccgcgtgcgcagcggcgggcacgactacgagggcctctcgtaccggtcggagcggcccgaggtgttcggcgtcgtcgacctgtccaacctccgcgccatcaccgtgagcgccgacgacgacgagcggccggtgccccccacggcgccatcggcatgggtcgactccggcgccacgctcggggagctctactacaccgtcgccaagaacaacccggagctggcgttcccggccggcatctgcccgaccataggcgtcggcgggcacttgagcggcggcggcatcggcatgatgatgcgcaggttcggcctgtccgtagacaacgtcctcgacgccaagctcgtcaacgccagcggcgacctcgtcgacagggccgccatgggggaggaccacttctgggccatcccgggaggcggcggcgagagcttcggcgtcgtggtgtcgtggaaggtgggcctcgtcaaggtcccgtccacagtgacggcgttcaacatcgtcaagacggtggcggatcagggagccgtagacgccctgacaaagtggcaggacgtcgcgcctggcctcccgaccgacatcactatcagggtcatcatccagggacagcgcgcgacgttccagtccctgtacctaggcagcggcaccgacctcgtgccagtgcttaacagctccttcccggagctaggcatgacgagcgccgactgcctcgagatgacctggctggagtcggccgccttcttccagttctggaaccgccgcacgccggtggaggcgctgctggaccggaagaccagcctgagcaccttcaccaagaacaagtccgactacgtccggcgtgccatcgccaaggaagcgtgggagagcattttctcttggctcaccatggatggtgccgggatgatcatcctcgagccccacggcgggttcatcggcaccgtccccgatggggccacgccgtacccgcaccggagcggc

SEQ ID NO: 4016 - DNA, 2818 bp, Zea mays
tcctctagagcggccgcgctcatggcgggcctcgcgcccaaaaccaaggtgctcagggacggcaagtggaaggaagaggaggcgtccatcctcgtgcccggggacatcatcagcatcaagctgggtgacatcattcccgccgacgccaggctgctggagggcgacccgcttaaggtcgaccaggcggcgctcacgggcgagtcgctgcccgtgaacaagcacccgggccagggggtcttctcgggctccacggtcaagcagggcgagatcgaggccgtcgtcatcgccaccggcgtgcacaccttcttcggcaaggcggcgcacctggtggacagcaccaacaacgtgggccacttccagctcgtgctcacggccatcggcaacttctgcatcatctccattgccgtcgggatggtcatcgagatcatcgtcatgtacccgattcagcaccgcgcgtaccgcgatggcatcgacaacctcctcgtcctgctcatcggcggcatccccatcgccatgcccaccgtgctctccgtcaccatggccatcggctcccaccgcctgtcccagcagggcgccatcaccaagcgcatgaccgccatcgaggagatggccggcatggacgtgctctgcagcgacaagaccggcaccctcaccctcaacaagctcaccgtcgacaagaccctcatcgaggtgtgcggcaagggcgtcgacaaggacatggtgctcctctacgccgccagggcctcccgcgtcgagaaccaggacgccatcgacacctgcatcgtcggcatgctcgccgaccccaaggaggcccgcgccggcatcaaggaggtccacttcctccccttcaacccggtggagaagcgcacggccatcacctacatcgacggcaacggcgactggcacagggtcagcaagggcgcccccgagcagatcatcgagctgtgccggatgagcaaggatgccgagaagaagatccacgccctcatcgacggctacgccgaccgcggcctccgctccctgggcgtgtcgtaccagctggtccccgagaagagcaaggagagcgccggcgagccgtggcagttcatcggtctcctcccgctgttcgacccgccgcggcacgacagcgcggagaccatccgccgcgcgctccacctgggcgtgaacgtgaagatgatcaccggcgaccagctggccatcggcaaggagacggcgcggcgcctgggcatgggcagcaacatgtacccgtccaccaccctgctgggcgacaacaagaccggcgagatgggcggcctgaacatcgacgagctgatcgagaaggccgacgggttcgcgggggtgttcccggagcacaagtacgagatcgtgaagcggctgcaggaccggaagcacatctgcggcatgaccggggacggcgtgaacgacgcgccggcgctgaagaaggcggacatcggcatcgcggtggacgacgcgacggacgcggcccggagcgcgtcggacatcgtgctgacggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagtttttttatttgcttttttttgcagacaaatacaaaccacacacatatatatatttgtaaagattcgttcgtattttcattttcaccgggaagatttgtaactgtcctcctccctccttgtaagttgctcctgtaaactcttcctgaattcatggcgtgtcgttgtagcaatcaccacttcctccctgtgaatgcccacagcgtgtcttggtaaaagcatgtatgtatgaatattggagtatatgttactactcagctccacaaaaaaaaaaaaaaaaaaaaaaaaaaaaaaaaaaaaagggccacac

SEQ ID NO: 4017 - DNA, 2582 bp, Zea mays
cccacgcgtccgcggagagagaggcagaggcaggcggccggtgcatgcatgccccgccctccctccgtgcgcccccgaagacctcctccgcccccggcgcggtgagctcgtgaccgcccggacggcacccgcctctgcggtttgaggctcgctgcacgcactccaataaaacaaaagaagcaaccatggcgtccatttccccggaggacattggcggggacgtcaatctgtccaagatcccggtggaggaggtgttcaagacgctgaaatgcgaccgcaaggggctgtccagcacggagggcgagaaccggctcaggacgttcgggcccaacaagctggaggagaagaaggagaacaacctcctcaagttcctgggcttcatgtggaacccgctctcgtgggtcatggagatggcggccatcatggccatcgcgctcgccaacggcggcggcagggcgcccgactggcaggacttcgtcggcatcgtctcgctgctcttcatcaactccaccatcagctacatcgaggaggccaacgccgggaacgccgcggcggcgctcatggccgggctggcgcccaagaccaagctgctgagggacggcaggtgggaggagcaggacgcgtcgatcctggtgcccggtgacatcatcagcatcaagctcggcgacatcatccccgccgacgcgaggctgctcgagggggacccgctcaagatcgaccagtcggcgctcaccggtgagtcgctccccgtgaacaagcaccctgggcaggaggtcttctcgggctccaccgtcaagcagggggagatcgaggccgtcgtcatcgccaccggcgtgcgcaccttcttcggcaaggcggcgcacctcgtcgacagcaccaacaacgtcggccacttccagcaggtgctcacggccatcggcaacttctgcatcatctccatcgctgccggcatgctggtcgaggtcattgtcatgtacccgatccagcaccgcgcgtaccgcgacggcatcgacaacctcctcgtcctgctcatcggcggcatccccatcgccatgcccaccgtgctctcggtcaccatggccatcggttcccaccgcctgtcgcagcagggggccatcacgaagcgcatgacggccatcgaggagatggccggcatggacatgctctgtagcgacaagaccggcaccctcaccctcaacaagctcaccgtcgacaagtccctcatcgaggtgtactccaagggcgtcgacagggacatggtgctcctctacgccgcgagggcctcccgcgtcgagaaccaggacgccattgacacctgcatcgtcaacatgctcgccgaccccaaggaggcccgcgctggcatccaggaggtccacttcctccccttcaacccggtcgagaagcgcacggccatcacctacatcgacggcaacggcgactggcacagggtcagcaagggcgctcccgagcagatcatcgagctctgcaacatgggcgccgaggccgagaagaaggtccatgccttgatcgacgggtacgccgaccgcggcctccggtcgctcggcgtgtcgtaccagcaggtgccggagaagagcaaggagagcgccggcgacccgtggcagttcattggcctcctgcccctgttcgacccgccgaggcacgacagcgcggagaccatccgccgcgcgctccacctgggcgtcaacgtgaagatgatcaccggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctaccgcccgcgtcgacgtgctcaagttcatgatccgcgccgcgctcagagacaaggccacgggcaacaacgtccacaacaagtgatacgtttctctgggtgcttgtcgcggacggcgtttaggaacaaggactgcggcaagggccggcgatcgcgaggcacagtgggcggtagagcagagacactccacgggcctcaaccagctcgccaccacctcctcctccgaccttctaggcagcaaggactagcatgcagtccgagctcaccgaggaggcccgcaaaggtcgcaagatatacgtagctacagtcttctccggcgactagcccaccatctctagcgccgctgatgcggctgatctcgctggtctccggagaccgacggcgtccagcggtggccggaggagtcctgtgttcttcgtttccttaggtgtacttatgtgggttttggggtggcaagagagtttttttttgtgaactctggtgtatcggatcaagtgaatatgtacctacatgttgtgttcttaattctgcattgtacagctatacactatacaagggtacgggaatgctgaggtgtaacttccatgcaatatacttagttctattcatctaatcatcaaactgccagcaactttt

SEQ ID NO: 4018 - DNA, 1132 bp, Zea mays
  misc_feature (1119)..(1128): n is a, c, g, or t
  misc_feature (1131)..(1132): n is a, c, g, or t
ccggccgggtctggaagttcgacttcgcgcccttcatggtgctcatcatccccacccgcccggacggcaccatcatgaccatctccaaggaccgcgtcaagccgtcgcccacccccgactcgtggaagctcaacgagatcttcgccaccggcatcgtgctcggcacctacatggccatcatcaccgccgtcttcttctacctcgcccacgacaccgacttcttcacggacgtgttcggcgtgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctacatcccgctcgacgtgctcaagttcatgatccgcgccgcgctcaaagacaaggccacgggcaacaacgtccacaacaagtgatacgtttctctgggtgcttgtcgcggacggcgtttaggaacaaggactgcggcaagggccggcgatcgcgaggcacagtgggcggtagagcagagacactccacgggcctcaaccagctcgccaccacctcctcctccgaccttctaggcagcaaggactagcatgcagtccgagctcaccgaggaggcccgcaaaggtcgcaagatatacgtagctacagtcttctccggcgactagcccaccatctctagcgccgctgatgcggctgatctcgctggtctccagagaccgacggcgtccagcggtggccggaggagtcctgtgttcttcgtttccttaggtgtacttatgtgggttttggggtggcaagagagtttttttttgtgaactctggtgtatcggatcaagtgaatatgtacctacatgttgtgttcttaattctgcattgtacagctatacactatacaagggtacgggaatgctgaggtgtaacttccatgcaatatacttagttgtatgtcgccgcggccnnnnnnnnnnaann

SEQ ID NO: 4019 - DNA, 2916 bp, Zea mays
  misc_feature (2608)..(2608): n is a, c, g, or t
tactgaaagccacatatgagaactgcaagtttttgttctctctaattcgtctgcccttttttattttttgctagccattttgtttaaacttggatacttttgctgcaggtcttgttaagatcagaccttatcaaatctagttccgaggagcgctccttgctaaaaaacctaggcagttggttgggaaagttcaccattggtaggaatcaggcactaagggctataaggagattgatccaaaatctcttatcgtggaggtactgcttctctgcattaaactcattggtagttggagacttggagttccaaaagctcccttaggctgtctagatcctttatttagtattgctctatattatttaatatgatatttctgtttcacctgtgttttttggtaaaatttatgtgcttcctgaggtgtacaattcacttcaatgttaataatcagatgacaaacactgtgacaagcatgaaccggtatattctttcattatcagatgacaaacaattggtccccgggctcatttctctgatagaacagggaactgatgttctgcgtgggaaggcccttttgtttgttgctctgctttgcaagaatagtcgaaggtggcttcctcatttcttttgcaatgcaaaattaatatcagctgttgatagatttggaaaagagaaggagggtttcattcatcaatgtacagaagcatttgtgcagttggttgcttctttggtccctggtatccttgaaactgtctccagtgatatacagcagattatgtgtggcaaacgccatggacctgttactgctttagctgggcgagctcatccaaagagcacaattcatctgttccctgtcattcttcgtcttctgggaagtgcatctttcaagcacagagttgtgacaggccatgtattgcttcagttggcaaatcttattaagattttggaggcaccgtttcaggcttgggttgtgtgaactatatgtaattatggatattttgtcctgatgagagtatgttgagatttccttcatcatataactgcaacttcggtgctgtctttccttttcaatgttttgtattacatgatctatttgttgaaaaatccttgccttgaggaattatttatgcccatgtactttcaggctagggatgatttccaaatgacattgttgcgagttctagaagctgctacagaggagccttctgttatacttgatgaacacacaatattcacaagtcgtatcattccaagcttatctgtcttgtacaacggcaataaagatggtgatgccagatttctgtgtttgaagatactctcagatgtcatgattgtgatcttcagtgactcttcattaacttctgacgaacaaacattaactgatttgaaatcaatctcccagaggcattttctgccactgtacccttcttttgcagaggatgaagatcccatacccatatttgctcaaaaactgctagtaatgctaatggaacatggttgtataaaagtctctgatattctacacaaagcaacagtatcccaatgctttgattttttgctaggagatctgtcaaatgcaaatgtaagcaatgtcaagctttgctttgccctggcatctgcacctgagatgaacacccatattctttctcagcttcaagttgttagaaggatagggaacctacttgagtttgtcgctgcaaaagacatggatgattttcttgaaccaaccctggagttttgcagagctttcattattcgtggcactggcagcaacagaagtgtcgccctctccgaaaacccagcacttcttgttgacagtgccttcagcatgagtattgctgttgatcaacaaacttgtgtcacggatatatgcgactttggtggcaacatgggtacttttcttgagctagttggcaattcagatccacagataagtaatttagcgtcagactgtgtagtgttgttatccaaggcagcacctcgagaggctacagtgggcttgttgacaaatcttcctaaattaagcactgccatggacttgctgaagcatgagagctccctacgtctgattcgcttattatacggcctagccttctcatgcagacaatacttggcccagggaatgatcctgtcaatatcagtgtcagctttgatgcgagttgaagcacttgtttcagttttcaagggctccaatgatagccttcttgctgatgctgcttcttatttgagcgccgaactgcagcgcttacctcgctgtggttgaaagctgcaccttgtccaaggaggcaagggtgcacttgtttttgctgcgggtgaagctgcaacatgagccgagcaagtgagcaggacatcaagtacaggtactttatatcagtgactgatctcagttgccacaattgctaagtggtagtttcgctcgtaaatgtgcagccagggtgttttatgctatcatttatgtccagttcggggctgctgtatatggtgcttttgaaccatatttggaaggtggctagaaggaaagaacactttgtttcctcgcgactttggttggcaattaccccagtttcatgtaattctgtaatacctgtaatttctctgagaatactgtagntcaatatcatgtgtaaataaatcatctataaatgcatgtgaagttcatgtacagtagctgttaaagagttattgtaagtctttgtttggatactctattattcacatgaatctacatgtattgaggtgtattagggtataatcaatacatatggattgaggtgaatactagagtatgcaaacaaatcataactcatgaatcttggtactattgtgtagtttttactttttacaaatggtgataacgttctgtgcaaataactggctattttatcgatcattactgtttgctcttgttcagtttttcag

SEQ ID NO: 4020 - DNA, 1192 bp, Zea mays
  misc_feature (1139)..(1139): n is a, c, g, or t
  misc_feature (1171)..(1171): n is a, c, g, or t
cctcgaggccggccggggatattgtacctatcctattacaactctagtgcccaccagccaccccaaaaccctcgcttcgcccccaacgtttgctcacccagaccaagatgctccgccgcgccgcccctacgtcggctgcactctgccgccgcgcgctctctaccacgccatcctcttcccgcaccgcggcggaaaccgcggcggtctcctctgagttgaactccgtcctcctccgctcgctcaaggagcactacctcgaggtctgcaagatgacgccgccgcccaaggtcagcccgcccaagcccttcaccatcgtcaaaggcgccctggaccagccgtcgggccccgtgctgcgccgcgaatacggcgaagacggagaggagatctccatctccgtcgccaggctcgccaacatcctgcccgccggcgccgactctgactcggacggtaccggcgagggcggtggtatgagcgcgtccatcagccagctcctcctccacgtcgacatctccaagcccgggataggaaagtcgatgcagttcctttgcgggctgtacccggacgctcttgggatccattcggtctgcctccgatcgaagaacgccgacccgtttgatggggatatgacttcgaagggagagtaccgagggcgtattttccaagagttggatgaaaaggttcgtgatgcacttcatctttacattgaagcccgcggcataaatgagaagctcttccgttttctccaagcttggctttatgtaaaggatcaccgcaatcttgtacgctggttcaagagcgttggttcattcatcagtgaccaaagccaaagcaagatgtcaagaaccccgcgctgaagatgatcatctgaaaggcggtcgtggagcagttttctccaggatggataattgtcctaggataaagtgaattatatgcaaagtcgcgccagcgaggagttttggtttatctttagtttttattcgccggggaatcagtggtctggtggttgaattagttatcattagtccttgtgatctgctaccctatcatgctgaggtgcttgtcagattctcaattattcaaactccacattttccatcgcaaaaaaaaaaaaaaaaattgagagaccctttttttttatntcatacaaagatcgccttttattgtcactttntaaaaaaaaaaaaaaaaaagc

SEQ ID NO: 4021 - DNA, 1708 bp, Zea mays
atatatatatatatatatatatatatatatatacgggcgggcacaacaaaccgtgaagggagtctcgggcgcttgccgagcgctcgggtccggctgttttttcggagcccagggatccaacatcttgagagaatattcctatattagagtagctccattccactttgattcaaaccaaacagttttagtactagaacagagcggttccattttactatactcgggaaccaaacactactttagtaaagtatgctagaattatctaataatcggtactggttctggtgcatcgttacctttccctctcgtgaggttcttagctagaatttttttaattgatgttttttcctttagttcacataagcacattgtactactcacgtacatgccaagtgcattgatgtacaacaatgtgttatgtgtttgtattctagacgtgctcttgactcatgtgtaagtgtaaagtttttggtgttatgcagaactcttgtttgttacagaggcttaaaactaattatgctgtacaagctaggttgtcatcttagccaagaactaattctgtagtattttctttgcagtgttcatgattaatatacctataggttggtataatatgcaaaggtgtcaattaatattttgctcttgcaatgctaacctgatttctttgaatgcaatgattcttggttttgtgaggtcatttattatcagctgtttaacggcatattgatggagtgatctatacctccgcacatgctagtttcctatgaaacaactgtataagtatttaccaactgtagttttagtacatgtgcatttgaagctctttccattaatttctgatgtgccaatccttgatttaaactgtacaggttcctagtgctgtaattgcactggtgtcatctatcttgcggaagggcgaagatgatctagatcagctatatgccttacggacaattgataatatgtgtagccaaggaactgaatggacatcccgttttgcatctcaggatgtgattggacatctgtgctacatctataaagcaactggaaagcaggagagtacaaggctcattgcaggatcttgtttggcccgcctctcccgcttcagtccatcatgcattcatttaattctggaaaagatatcattcagggatattgcatccacacttatcaagggaaatggacgtgaacagcagattaatctcaatattctcaattcggcattagttaacagtcacactgtgacaagcatgaaccggtatattctttcattatcagatgacaaacaattggtccctgggctcatttctctgatagaacagggaactgatgttctgcgtgggaaggcctttttgtttgttgctctgctttgcaagaatagtcgaaggtggcttcctcatttcttttgcaatgcaaaattaatatcagctgttgatagactgggaaaagagaaggagggtttcattcatcattgtacagaagcatttgtgcagttggttgcttccttggtccctggtattcttgacactgtctccagtgatatacaacaggttatggttggcaagcgccatggacctgttactgctttagctgggcgagctcatccaaagagcacaattcatctgttccctgttattcttcatcttctgggaagtgcatccttcaagcatagagttgtgacagggcatgtattgcttcagttggcaaa

SEQ ID NO: 4022 - DNA, 1743 bp, Zea mays
cttgttcaatatttggctgacattatggatgagtacaaggataagattcaaaatacatgcgggtatggacctatcgcgtttatggcttcagttcagtcacttcagagtcttcctcaagacttaacctcttctggaagatttgatttccacattgagctttctgctcttgcagtacctgagcgcaaagcactattgcaacatcaagttgaggagcatgagttattgtgttctgaggaagttctgtcagagatagcatcaaaatgtgaaggttatgatgcatatgacttggaaattttggttgatagggctgtgcacactgctgcttatcgctttcttctgccttctaatgcttctcacaactctctgaaacgaactttgctgatggaagatttctctaaagcaatgcatggcttccttccagtcgccatgcgtgatcttaggaaatatgctcctgatgataaagatggtggttgggaggatgttggagggctagatgaagcagtaactatcattaatgagactcttgaattgccgtcaaaatacccaaatatctttaccagggcacctgtgcggttgcggtcaaacattctcctgtatggaccacctggatgtggtaaaactcacattgtgagagctgcggctgctgcttgttctttgcgattcatttcagtcaagggtccagagctattgaataagtatattggttcatctgagcaatctgttcgcgacttttttgcaaaggccgttgctgcagcaccttgcctattattctttgatgaatttgactccattgcaccccagcgaggaactcatagtgcaggagtttctgatcgtgtagttaatcagttcttgacggaactggatggtgtggaaaccttaactggagtattcgtatttgcagctacgagcaagccacagctaatcgatgctgcgctcttgcgacctggaaggtttgatcgtctagtcttttgtgatttccctcgatgggatgaacgtttagaaattctgaaggtgcattctaggacggtttcactggcaagtgatgccagtctcgaagatgttgcttctctgaccgaaggatttactggtgctgatctcgctgctattctaacggatgctggactagctgcaattcatgaacttttggacaaccaggagaacggtgttccagaaaccgaaccgtgcatcagcaaagaacttctcatgtccgtcactaggaaggcaagaccttccacaccagcagacgagaagatgcggtatgatagggagtttggtgaattcgtgtcatccaggaagtctatttcgacaaaggcaagagagtcaaaaggcaaaaaggttacactagcttgagcctttccttggccaatattaatgcgctgcaaaatttggacagtggcctacatgaaggctgctaacacgcggacttgtcaagtcatgcgacgtaggcttcctttcatttgaagagaaacaaaatctacaaagaaacctaaccaaggctcacttgtgttagtgtacttggatggaggaggaaggccattggagggacctgcaggtggtcaaaggtgtcatagtaggaaattttgtacggtaatcctgctgtaattaaagttataacacttgtcacaaattttgtacggtggtgaacggtaggaaatctatactacttattaagaaggtaaaaccagtcggcaggactgccctggtgaatgatccgcttcttaacgtgcagcggtcgtcttgaat

SEQ ID NO: 4023 - DNA, 1651 bp, Zea mays
gtgaaacactgggggacgatggaaattaataacgtagaaggaggcgccgtggaaactcgctgccgccggcggtgagagcccgccgagaaacgagatcattttttccaatgcgagcggcggcgccaggaacaggcaagcaactgatatcactgccacgtgggcccttccccttcgaggagcggcgcaaccgcgcttcgcgttatccgaattccgaaaaaaaccaacagcgcgggggtagggtaactgacgtgtgggccgagaaacatgtcgtctcacctcgaccgggccgcttccgcccttcctctccctcttcctccgccggcggtcgccgcgccttcccgcgccctccgagctctaatcctgtcccggggcggcgccgccgccgtatgctccagtctgcgccgcggcggcacgccggcatgcctcgtgcgtcgcctgtgctcccaccactccgccgcggcggcggcaacggcgttggagaaggcgcggcgcgggcggaaacagctcggaatgacgcctgcgctctacgactacctcctcgccaacgtccgcgagcaccccgtgcgcactccctgtctacgcgtttctgtttcgagcccatctgccactaattttggggtcactcacgctaggttctgactgagtgcgccgtcctggatggttccagattctccgggagcttcgcgaggagaccgcggctatgagagggagccagatgcaggtttctcccgctcacccacgcgtccggtcaatgcttgtgcaaatccttggggcgcgccgttgcattgaagttggtgtgtttactgggtattcatcattagctgttgcactggcccttcctgaatctggtcacttggttgcttgtgagagggatgacagatgcctagaagttgccaagaagtactaccaacgtgctggtgttgcacataagattgatgtgaaacatgctttggctgcggattctctaagatctcttcttgattgcggcgaagcttccagctatgacttcgcatttgttgatgctgacaagagaatgtatgaggaatattatgaacttctactgaagctagtaagagttggtggtttaattgtaatggacaatgtcctttggtatggaagggttgccgatctactggttgatgatcaaaagacgatcagtataaggaacttcaataagaaagttttagaggacaagcgtgttgatatcagcatggtgccaattggagatgggatgacaatttgccggaagctagtagatacttgaattcacaacgtttttgtgtagatgcggaaaacttcttaccaaggtcaagccctgaaaaatcaaactggtatgataaatcaagtaaaaatggttatagatgatgaacctcttggcattgacaatatctgcactgcaaatgttgctagtggcctgggctctactaaccacagtggtggggaagcagttggtggcagtaattttgattcgctgcttagaacgctaagatgagtgtggcgtgtcttgcacacagtataacttgaattcaagtacaaaaccagtgttatggtgttttgttgatagaccacagtttcatctcaggtgtatatggaactatggaagtgtggtgcacatattaaattgtgagtcgtgatcatccattttatatct

SEQ ID NO: 4024 - DNA, 6360 bp, Zea mays
  misc_feature (4517)..(4517): n is a, c, g, or t
  misc_feature (6292)..(6292): n is a, c, g, or t
gcagagcacgagcacctctaggtggctgctgactcctcgggacttgtggaacagacaagaagacccaccactgagctccctgccaagtgctaaagcacccacggcccggcggctcactcagccccgcaggaatatttggaacatgtcctatccctgctcctcatgatccgcataggcacaagcacaagccacgccacgccaacaaccctctctctcgctctcgggggtcttttccatccgtccgtccggctggggtatagttttcagtcccacttcccttggtttcccggccgcgctctcagttgccccccccggctccgactagtaataaagcgctacgcgccacgcatccatcagcacaagtttctaaactatatattgtcctaaattctgaggactgacggaatatagttttggtaatcatgcattttctttaatttccctgccgcgtacggagtacttcttctcttctttcagtaccgccgtgcatgtgtgcctgcctgttcggtggtgttcagtgactgctgctgtccttgtcttaggtacactgtgctttgttggcatgggcgcgttcggctgccctgcacggagcactgttgcagctgcaaaatactgttgcagctgcaatccctagagagaaaatactgtagaagccgcagccgcagtcggattaaagccgcagcgaacaaggaagatgatgggcactgccttgtccatggttcaatggacactgactgtgtcccgtttcttcagtagagagaattcagcagaactgagcaggccgccgtttcttcagaaaggctgctgaaaggaggaggaggagggtaggagcatgataggaggatgagccgaggtgacaggaagatgatgggcatggatctcggagcaaaaaaaggtcactggcgattggtgaagaggcagccaacttcgatgagaattgcatcacatgacatccacgttgcatgcaggggaggctgccggaatggaatggaatggaaggaaggctggctggacctggaggaattgggtgggtgcgtggtgggaggccccgaactgaaatgacaggctctgggcacgcgcagcattccaaaggcggcagcaatcgtttgcggccttgaatggaagaaaagttttttcatttcattccagggcctgcctgtctcccttccgctccctccatggggctcacacggtcacaccatggccacagttcctgccggccagtttcgccactgttcatcagagcgctcgtgctcggggtttcgttttgtttatcttggcctattccaggtccttctcccctcttcaggtaccagttgtgcaatgcatgcattccattcattcagtcgctgcaggtgcaggtcaccccaaatacactagagctactacaagtacagaaatcccatgtatttcgctttagtttgttacagaagggtcattgccgtgcgctagaaaagtctctctgttgaagagcagtgaagagacgatgaaatactaactccgatcctagtagttgtactaacagcactacctcgcaagtttttccagttttttttaaagaccacctcacaagctgctttttccaatctgaacaattgaacatgtagtaacaataaataaacaggtcagagttcttcccgctccagtttccgatgctcgacagattaacgctagttcccagaggatgagcaaaccggcaggattaaacaaacgatgggggagagaaagagctgcattagtggtcatcgtgggggccaatagagtcgagaatactaaagcacctggggcctggggggtacgtacccgaactaccctagcctttctttctttctttccatctcactattttttgccacctcctatacacacacatggtgggcttgatgtgagaggatgcccggggcaaacaacacgtaaaaactaccaaggagatccagcctaataaagctcgggaaaatttagaagggcatccaacccaaccaggtagtgtttctgaaactagtgacagccctaccctagcgctagcgaatccagagaaatccacgtactgcttcttttcttacggaaaccgtaggaactttttgcattgtttttttccttcttcttcttcttgagataggagtagggatgtactccgtccagttagttttgtaagaggctaatgttaaaagtagaaatatcaaaaacttcttataatttgaaagttaaaagcagttattgcccaaattactagctaaagattgtgacgtttggatttgatatgactagagggagcattaatataacatctaatgtggtatacaaattttaaaaagtttgaaaacagggccagagaacaaggaatggccaaattaaatgactaacttagcttgttaattacctgacgtgctagcttgacagtgtaaacgcatcatcagtagttcttatgctatacatgtttctgctagcagttacacactaagctgtaaaatgccggtctagcacccaagctgcacatggcagttccaatgtcctactgaccagaaataggcgatgaagctattgcattcttatttctttgccctaaaaaaagaacttaaaaaggttattgtatcgtccatgacaggtagtaaaagtgacctgtatttttttctcataaaaaatgtgaccttttgctcttgctttgatgtaaattagaggcgtaataactaggaacgaacaacaagaggcagggtgcatgtagttgttgcagttgcatctcaatggaagccctcgatcatgagagcatgaacacatcactgctctgacttctgatgcgctggttgtggttattgccattccttccatccatatgtttggacagatagaggaagaggccacagctgaaggctgaggccagcactccttcccatctgtctttgttactaattacttgggcctatgaatctaggatgcagtagactgatggatgtttacaaattacaatgccatcaatgatgatgcccaggatatgctagttacggaatcaacataataacgcaatgataagtaagcataggccatgaccagccatctaataacagattagattattaggccagaccgccagactaatctggttgagcaaacacttccagtggctagtgggaggcaaaaagcctgattaggatatacaactacaggcgccagtacgtactaatcgtccttttgagcattctgtgaagcagaacagaggcggcagagtttcagaagttctgctgccctgttccagtccttcataggtgcaaccgtgcaactgctatactacacgtaggaacagtacatcttcagctatactaaattcagttttttcttcttcttacaaacgcatattttaagctacagcattggcaggccattgctcgatttgtttttttctcggtggttggacttacatgcctacaggaaaactaaaacaatacgtatatgtggttttctgataatcaaatcaaagggggaggggggatgtgacaccagaactagttctttcccatcacccattattgtttgcttttgcccagtctcgcgaagaaaaaaaaatgaaatcaaaagaaaatatcaaagcgacgagcagcgacaactccacgtctggagccaggtgatgtatgagtgcaggtactacacggtacatagattttatttttttaaaaaaaaatcataagcatttattttatttatccccaaattatgaactggactttgctcgctggtctcgcagcagccgagcccaactgcacacaaaagaaatgggcgcatgagcaggcacagaaaaactaaacagagaaagcatgcattaattagaccaaacccaaaacccctaagcaaaagattagcaatgattggcgtctccattgtgcacttgcacaggtactagtactcctgctaggcttgttgttgtagggtgcctgccccatgcagtgcaaggagggaggggtgtgtcaccataaaaatttagcggcaagggcgagggcgattggaagctcaaaataatgagctggttgcccaccggggagacacgccggatttgtttaatcccctggccctaatcccccagccctgccgtctcctccttataagcaatggcggaggggtcttgctcttgcattgcacctccggccaccgcgccatagcccgcagtaattaagcaggcgagaacgacgaagaggcggtcacgcaccacaccgatcaatccagctcgagcgaccgatcacacgtgcagcacagcacagcacagcggtgctcggcgaagagagatgacggggttcgggtcaccgtgcggggcgtgcaagttcctgcgccgcaagtgcgtgcgcggctgcgtcttcgcgccctacttctgccacgagcagggcgcggcgcacttcgccgccatccacaaggtgttcggcgccagcaacgtgtccaagctgctcgcgcacctgccgctcgccgaccgcgccgaggccgccgtcaccatctcctacgaggcgcaggcgaggctgcgggaccccatctatggntgcgtcgcccacatcttcgcgctacagcagcaggtgtgcatgcgcgactgccccgccgcgccgtctctgggcttgtctcttaattgtgatagggtttaattgctgaccggcccgtgccaatcgatccaggttatgaccctgcaggcgcagctggcgtcgctcaaggcgcaggcggcgcaggggcagcagggcgtgcacgaagacgccaagggctacgtgggcagcgccgccgcggagcagctagggtacggctacccctggtgcagcggcaatggaggcgccgcagcagcagcagcaggcgccgtgggcgcgcccgccgcgcagccgggcgcgtacggcaatggcgcgcacgagtccctgaccgcgctgctggggtcgtcggactacatgcagcagtcgctgtaccacgcgttcgagcaggccggcgcggacgacgacgacggccggcaggggtacggcttcgaggcagcggcggagtcctcgtcgctcggggcggaggagagcgggtggaggtcgtcgtcggggtaccaagactgcgaggacctgcagagcgtggcttacgcttacctgaaccatcgctcgtaagaactgagaactactactactacaagagagagagagagagatatagatatatagacatatctgtcctcaattcctgatcatgttttggactttagcctggggaaatatatgcgcgattttcgatcgatcagtcgatcggtctccgctacaaataatccagaagcatgcatgcatgtgacagaccactgatatataatagatccacacattattgatcatcagtgtagaaattaacgtacgtagcctaattaattggacaaagaaaatggagagcccttgctgtgattatgctgctagttctgtcagtggtggggttgtgttttcttctccaactctctgcctacctgctgcagcagtgtctgcagacgataaggttagattcgtcatgccggccggaaaatgtactccaaggaacatacaaggcagcatattgagagacaggtgattgattcatggccacacgtggaagatccaattagcctactattttcgttgactccttttactggaactctttctgatgggacatgcacacacatcttcagcatatatatagctactatctagtagatgatatgatagagccttttgtcttgcgtagacaatcctactatagtgattaataactctcctatatctggattattaccctatagctacttgattaccacacatgtagatattctaagtcatgaccattacatccttaaaaaaggataattatggtgactcatcataattagtgtggtgtctaataatctgtctattttttcccaggattacatttggtaaaaaccttttttctgaagttttgtttatttgtacacaaattttggttagatgtttccattgcgtagaccaccatcttttaaaccatagatgactgtttcacaaaaaaaagttgactccttttactggaactctttctgatgggacatgcacacatcttcagcatatatgtagctactagtagatgatatgatagagccttttgtcttgtgtagacaatcctaccatagtgattaataactctcctatatctggattattattgccctatagctacttgattaacacacatgtagatattctaaatcatgaccattacatacttaaaaagggataattatggcgactcatcataattagtgtggtgtctaataattataggtgtacatttgggccgggtntgatgggccggcccgaagcacggtaaaaaaagcacggcccaagcacggcacggcacgaaatatttagg

SEQ ID NO: 4025 - DNA, 4764 bp, Zea mays
  misc_feature (1366)..(1366): n is a, c, g, or t
  misc_feature (4015)..(4015): n is a, c, g, or t
  misc_feature (4071)..(4071): n is a, c, g, or t
  misc_feature (4571)..(4571): n is a, c, g, or t
  misc_feature (4674)..(4674): n is a, c, g, or t
ttctttgataccttgcaagttttgtctaaaatacatcctttgttgtgtgtttgtccgttatcaccttaacccttgtcatccctcgatctttactttgatgcttatcctatacctgcattttaaagccgccttccccatttcagttcaagagtgatgtcttacccatcccgctcttgttcgttccctttttcctttgctacacccagcacagttttaggacctgctcgttttaatctcaatctacgtggattggatgtgattaaatgagtttaaattcctagtaatctcatcaattccaatccacatggaacgaggataaccagagagaggctttgtttggttatttaaattcaatgtggagtagagtgtattgtaatgaattgtgatgaattttgacttaggaaatatcagttgatgtcaatagcgcgacgacagtggaacaagcagaagagcagcaacgtgggatgcattggtacatggcgggcttcttcgttgccgccgcgcgcgtccaaccggagacaatcagacaaagcttcgtgttggccccggaacgaaggaagcaacgacgagcccgacgggccccttgcggttgcggttgccggccgtcttggctctgccactcgcttcgcgggcaagcattcgccgccacggcaagcccgtcatcccttgcttccctcgcccgccgcccgggaagaggccacattcacatcacatcagaccgatctgatcgccggagacacgtttcgtggcgtcgcccgcacgtaccaaccgcccccggccccgccggtgccaagcaaatcttacgacgcgggacacggccggggtcctgtcgtcctgcgctgctgctgctgcgtcttcgtagtcgacgtgagccgcggcggccgcggttgagggtaaccacccgtccatccagctgcatcgcaaccactccaaccaaaggacgcgaagaaggccggcgtccctgatctccatctccatctccatctagttaacgaggtaggccgtgtcggaactgctccaccttctccacgcccgtgtgtctctttccagatcaggtttgtgttcattgtcgtctcctcccgtccccttcgcttcagctcaaccaatgccagtacaatcatcctcgtgtgctaagaaaacatgacataattaaatcattgcttcccttcaagcgtctttccgcgtttccaacgcttagccgctaatcatcgctgtccacccaatcaaaattaaacaccatacccgtggctccggtgcttattacaaaatccaagattttaaaacatctatagtatttcgttttttctactgtgtgacgcgcagggacacgccgacctgtcgcctcggatccggaggactgtttgtngtcagatctcaccgcgttggcccagtcaaagcccagcccaaccgataccacgccaggggtataaagcaccagcccgagcaggcggcgagatgcggcggcgcgcggggaagctgggccacaccctctcccgcatcgtcacgtccaagccgcgcttcgccttctcccagcccaggcctaggcccaggcccaggcccgcacaacccggtctgccttcctcacaacccgtctcgatcccgccgcagccgccggagcttccccccttcgtccccaccgccatgccgcaccacggcagccaccgcccgccggcgccgccgccggggggccccgtgttcccgcgcgcaacgtccacggtggtgcccgacccgtcccgcttcttcgcgccgccgctcctcgccgcgccgctccccaccaactccttcttccagaacttcgtgctcaagaacggggaccagccggagtacgtccacccgtactccgtccgctcccccggaggcgccgctctcgacatctgctacccttcgcggaaccactcgccgtccttcgtcatccagaccttcgtccccgacctcaccgtctccgacgccgccgggagcgcgcagcgccactgcgtctcggctttcgacgacctctccgtcacgctcgacgtctccccgtccctccgcgcgcacctcgtccgcggatgcccgtacgtcaccgtcaccaccacggccggcgccgtcgacatctccgtcgcgtccgtccatgccttcctcgacgtcgcctcctgcgacgactccggcaccaagtggcgcctcgggatgaacagcggccagaccttcctcctctacgcgtcggccccgatccgcctcgcgcagaccaccaccacgcagctctccgcgcctggcttcgccggagccatccgggtcgcctacctccccgacgcgtccatggagccggtcctcgaccgctacagccgctgcttcccgaccgccggccacgcggccctgaacaggcccttctgtgtcgactacgcctggcgcaaggacgggcctggggagctgctcatgctcgcccacccgctccacctccgcctgctcgccgacgactgccccgtgcgggtgctcgacgacttccggtaccggagcatcgacggcgatatggtcggcgtggtcggcgacgcctgggtcctgcgcaccgacccggtttccccgacgtggcactcgacccgcggtgttagcgaggacggcgtcgccgaggtggtggccgcgctgcgagccgacgtggccggcctcgcgtccaccgcgataacaaccacctcgtcctacttctacgggaaggcgatcgcgcgggcggcgcggctggcgctgatcgcggaggaggtcgggtgccccgacgtgatcccggcggtgcagcagttcctcaaggccgctgtgacgccgtggctggacggcagcttccaggggaacggcttcttctacgacgccaaatggggcgggctggtgacgctgcaggggctcaaggactccggcgccgacttcgggttcggcatctacaacgaccaccactaccacctgggctacttcctgtacgccatcgcggtgctgtccaagatcgacccgtgctggggccgcaagtacatgccgcaggcctactccatggtggccgacttcatgacgctgtcgcgcaacaaggccggcgccagcttcacccgcctgcggatgttcgacctctggaagctgcactcgtgggccggggggctgacggagttcgccgacgggcgcaaccaggagagcaccagcgaggccgtgaacgcctactactcggcggcgcttgtggggctcagctacggggacgcgcacctcgtctccgtgggctcgacgctcaccgcgctggagatgctggcggcgcagacgtggtggcacgtccgggaaggggagggcatctacgaggacgacttcagcgggaacaaccgcgtggtcggggtgctgtgggccaacaagcgcgacagcgggctgtggttcgcgccgcccgagtggaaggagtgccggctggggatccagctgctgcccgtgctgcccatcagcgaggcgctgttcccggacgtggcgttcgtcaaggacctggtggcgtggacgctgccggcgctagcgagggacggcgtgggcgaagggtggaaggggttcgtgtacgcgctggaggggatctacgacagggaggcagcgctgaccaagacccgcgccctcaaggggcatgatgatggcaactcgctgaccaacctgctgtggtggctccacagccgaggcagcgtcgtctgtgacggcgacgctgggttcggccgctgctgctggtaccgccagtactgccactgacgaaagtgtggtgaccagcacgagtgtggttgttcatgtctgcttgcggagcagagcacgtagatcagtgaagggatggagttgatacgttgcaaagtcattgtggttgttattcgttgatactacacacttctatacagttgaataaagtcagtcctttatgtgaaacaaaaaaaaaaaatctgttacatggatcttgggttatcataaatttctggcttgacgagattgttggttacttaattttgattccttaatggcattgaaagacaaggcaacatctatcttttttaatctctcnctctccaagacaagatagaataaaggatgaaaagaatattaaagacaacataaaanacaagttaagcatatatcatgtgattcaaccttaaaagctattatttttcttcccttcttttatgtttaacaaaaattcacatgaataccttaagttcataaagttacaagaataaggtaaagaaagtacaacttcataggtagaacaatgaattccactctgacaaaatcacaaaaagcatgtctaaatcatggcattgttcctctatttattagcgcatgatacatcttcggtgaaattacaatcgtatcctcaagcctatttatttaaatcagatatattgagggtaatgttgtcttttcctctcgctgtcttgatgaatacgttttgaaaacttttcataatcttgctcggctttgttactcatgcatgcacatttgtatgtccaaagttgttgtcttcgtgcctgtgcctattagaagcttcagttgaaaccgaccttctatattactcctgcatcatatgaaataagatatagttgttgaattagtgttttganaacctttgggagaagaagtcccccaacagtagaccctcacgatattagttcgtttttcataatgagcttagaccgcgaaataaacgaaggccttgtgccgaangtccgataaataccttccatgaacacgttattaaaaaaatggagagttgaaacgacgtgactcctggccttcaccgcttacgacatttat

SEQ ID NO: 4026 - DNA, 1924 bp, Zea mays
ccgtcgcctcggccagtcgtccgctcccggcagcacgtccccatatatcccctccggtcttctcgtcgtccgctcccggcagcacgtcgcctcgccccccactcccacgtctctgtccctctccctgccctcccccgtcttcccaaccaccacccacccgttcttttccagccaaaccaacgcacgcacacggcacaccctccttctggcagcagagcggcagccaatggccatcgagacggacgcggcggcggcgagggcgagggcggcgagctcggtttcagagacggcgcccatgtccccggccgccgaggcggcagcggctgcggcggccccgggcccggcgcgcccgcgcgggtggctgaggaagctcatccccacggactacctgccccggagcagccggcgctggaggctggccgccccgtccgccgccggcgcgtccaggctcgcatcgtcgctctcccgctccctcaggtggaagcgcctcccggggctctcctccctcaccctgcgcagcggctccgcggcggcggcagtggacgccgtcgcgttccgcgtcatgtacgtcgtcgaggccgtcgtgctgggcctcgcgctctcctgcttcttcctctgctgcggctgccacctctaagctcccaccccctgcttttcttccccctacctcttcactactctggtcgtctccggctcgcggctcggcctccgtctcggcgtgtaacaaaaatgcccatcgtgtttttttttttttctttcgatgatctccctgtctgtaaatttcctaccttttgctttcggtaggtaaaaaagaacacgaaaacttgcgatgccaaaaaaaaaaaaaaaattttgttggatgctgtgaacgcacgaaattgcgatctcggatactgggacccactgagttcttgtttgttcatgcaaattgctgccgctgtggcgctgtcccgttaaaaaaccaataccggaggacctggtcgccgccggcgcgagcctcgctacgcgccgtggccgcagcatccgacgtggtgttcaccatggtcggtaaccccggcgacgtccgtgcggtggtcctggagcacggtatgccgatatggtgccctcgcgggcctcgccatcgaagcgccgacatccgggggcgacgtcggcgcccaggacggcacgctcttcgcccatgcggcgacgaggccgtagtcgcttggctcgagccgctcttcaccttcctcggcagggcgacccgcatggggcagctggcagagcagcaagatcgccatccagatcgcggtgggcctcggcgagttcgtggtcttcgcccacctggcggggctcaacgcgccgctgttcctcctcgcggtgtccaagagcgcggctggatcgcgcgtcacgacttcttcggcaactgattgctccgccgcgagttcacgtcagaggtgggtggcagcgtgccgtacatcgtcaaagacctcggcatggcgctcgaggtcggggacggcggggaggagtccaacgtgctgcctggagcggcgctgtaccggcagatgttctcggcgatggtggccaatggcgacggcgacttgagcttgtagggactgatcaccgccgttgagcgcctgaacggcattggcgagtagagcgcagggctggtctccaaaatgcagcactggacttgaaaacttgtgtattttttctgaataaatttggggccatgtcaatttgtcaaatcatgacggggctttacgtccgtcgtgtatcgcgtttgacttgctgattttcgtttgtcattttgcagacactaaaaaacatgtgggatttgtgaatacaccgcagaaacactgcaactacctcaactgaaatatctgacgggctgagggctagtcgcgagggactgtaacaccaggggcttcctgctgaacgtgcaaga

SEQ ID NO: 4027 - DNA, 3161 bp, Zea mays
  misc_feature (533)..(533): n is a, c, g, or t
cgccttcgttagatgtgaaccaatagtagtgacttatttgtatatattaacccaaaggtttaaaaggtaggttaactttcatgattatacaagctacccccttaaaacggtatgaaccaaaagaatagcataccatcttattcagttcctctgggcttggtaaaaatacagactggaaaatgatgtagtacagaaattttgccctgtgccatagtgacattttcccccaggtcctcctcaaagtgatcttcaagacaaacaaaggatagagatgagatgatattaacttgaataaaagtaaccattagtcatgttcataactattgtgcagcaaattctggatacaaagatttcaaaaagtgtggactgatttgcaaggaataaacatgtcatgccagcaagtagcaatagttaacactaccgccaataaacataggtgaaccactaaaatgcttcttttattcctaaataaaagcaaattctaaattgctagtaggtgtctaaatatttgggattgtgggccatatatcaanagaattagccttatattaggcatggaatgttaaaacagaagactcgaaataagcaagaggagatagctacgaattcagaatacaaaagccttgcactgttcattctgaacatgcttatatttctcagaataaagaaagatgggtatgcactaggtattgacatgtgaaaagcagaatacatgaccattctgttttaaacattatgccaaatgcatgaaaacaacaatatcagaagttaatgatgtatattctaagtttcatacgtacataaccagcctccattgctgggttgtttacctggacagggcggtctcctaggataactttgccaccgtagctcattgcttcctcaaatgccacccggaactcagctccaggtaacacctcaagttggctagcaaccttaaataacaataacaatgctgatcaaatgataaaaacacaactattgctaactgcaaagacaaccaccaaaaaaatacctttgcaagaaaccagctgtagataattccaaaagtgttcatcttatttttcttccacatgtcaatcatttcattcatagtaggaacctgtgggaacaggttagaagatgaactggatgatttcattatactctagaaataaaaggtatgcatcttctatttggtttatgccattagtaagactcaaaatgttcttaaaagtagcacggtatgtcctttaaggctatatacttttagttataagtaacccccgaaaaacctttactagatacaataaaatcaatactcgcctgacaagcacatattatccttcttctgcgatggttcagcaatccagacaccacaaggcataacattataaaactcgacgtaagacagcccctaggtattatatgaagaaaatcttctcacacaggtcgagaaaacctccgaacctctacaccacccataaggcataacattatagtttattgttttgcccaactttatattaggaattacaaataagaagggttggtattcatcttacaaatgtgcagatacctgaaggttttgtggtgtcaaaattgcaaccctgctcatacagagctccaagaaaacagcctacacatgcaagagagatgcaaagaaattagagtaatgtcttgcctcggcaaagaacaaaacagaaacaatccaaaacaggcagcaaacctaccaaaatccaccactcaacaaaattattgatgatgagtagatagaggaagaacctgaggtttgaggtagttgatgatggccttcacttgatcacatgattcctgcaacaaaatcaagacaaataatcatgtcatgatttgtattaattacggccgttggatacattcacactcaaactctagatatgcatcaacgcggaatgatagggtgttttgcatggctctagagcaaaactccaaggaggaggaggagctagccagagccagccaaacaccccaatttcatgcagctctttcatgcagttttaagaggtgcagtataagtttttggagaagcacctagatatggagtttgaagatatttatccaatatgagaaaacaatagactccgctacaccttaaagttttggagtagagattctacggtggagcagagccatgccacgcgttagtatatacgaaatccgagcagaaaaggaagatagcttcagtacaaattcccctgtgttcctcttctaattatgcacaacctttttgtctcccaactccaaagtagtaaaagtacagcagcatgagaagcaatcagaacaggcagtgttctctgcatgaaacaagcaatgcctacacacagaatccaatccgagcgcctacagttcgtccacgaaatcatcaaccgcttataaaacataccggcatcggcagacaaacggaacaggagctcacctgcgacacatgagcgggcccgacgacgtagacgcggcacgtcccgccaacccccgccgccgccgcttcggccgatgtctcgcattcgaggcacaccacccccttggcaagctcctcgggcagctccttcatctccgctacaccgcccgccggcatcgttccggacccggacccggtcccggtcccggtcccggtcccggtctcggtcccggccccagcgccctcgcccccagcctccgcgtcctcgaattcagaggcatcctcgtaaccattggtctcggcatcggtgtcagtggcgggtgcggggacaggctcgggggcggccggatccatcggcagggcgagaagaggaccgaggcgggacgacgacgcgaggcgcgtcggcgaggttggggcttgggcggcgaggaaggccgcgcgcggcgaccaaggaaggcggcggtagatagtagagatcggggctacggattggcggtggcggattggcgatggcgcgtgcgcggcgagcagtcgaggtgcacgggtcatgcggcgtcgggcgtcgatttggggcgggattgcgagacctcgccgctcgttagctggtgcgggtgggactctgattgtgggcccgagagtttaacggctgggatcggtaccgtcgacgtcagaggcgtggcctccatccgtcagatccaccgttttgtttgcccgttgtaatacggtaactgtgacgtggccgaagcaa

SEQ ID NO: 4028 - DNA, 3672 bp, Zea mays
attcaataatttttaaaataagtgttagtttaatttgttagattatataatatgaatatattataatcacaaacaaacacacgagtttaaaatttgttggactatataatgtaaatatattataattccaaataaacatccctttaagcataatctagtcccacacacctagatcagcggccggaagtggtaattgaatatttgacactaagaaaataaactcggtaaacactgctcacttattatgaggtcatcttctatgtcatggatgtatctagaggtaatatctattttaatatcgtgaaatattgtataaaagtaatgaaaaaaataattttagattccaaccgtttagagctagtttgggagcctcaaacaaaaaggattggaggggctaaaatctctttcttatttaattttgaataagcagtgaattttataaacaggggccggcgtcgagtggagatccaatccgaaatccgaccggcctcctcctccggtgggccacaggagagcccgttgaaatcctggacctctcaattgtccttttctctctccccgcccaccttcccctgttctgccgcctccccagtccggcgtgcatcagcagcgacatcagagtcggcgatgggaggcgtcatcgacgttctcgtccccttatgttgatgaagtggtgtgccgtggagattccttgaccgatttcttgccggtaagacggagtctgccatctgcgtggctggtcatcgcggtgagcaaggaacgacgaagtgcgcccctccgcccttcggctcgtcgttgtgccttgcgtcgtcgggtggagttccttcccctgcttcaagctaattcggtttttccctctcatcctgtcagttttctctttgttggcattttcggttctctgctgtgaggttttttaaggtgattttgttcgcatctgtgatttgtgtctctgtgttcatcgtttgatgagggattcgatgccaaattcatttgaatcgattacaggaaatcatgcaaaaaatcaaacacatacctgtagaattgcgttggattggattccaaaaaataatgaaggaaaaaggaaaaacaaatctgatccgattttgtggcctgcatgcttactaacttcgtttttaagaggctccaggaaaatgtaattttgggtagggtttgtcaagcggtggtgcctgaatgtatcttctcctgtcacctccctcctttcacattagagttattgggtctacctttactgggtctactcctggatcctgctctatttaattatccttttttgtgccaaagcagccaaaccgccaatcaccacaaattgtagattaatgtttccagcattagcttgctgctcctggttccatacctgcaatcagttgcaaatacaccatgttttgtactaccccctcccccaattaaactttataattaaatgaaaaagtgtaggagtttgcctagtgaccacaaagcattttttggtgcattggaatcttgtgtatgcttgaatttaaaattatgaattcaaatgttgttgaattacatgcaggacccataaactttgaattattatgatgtgaaaaatgatttataatacagtatgtgcacaagtgtagatagatataagaaaatgaaatataggggaagggatcattggtagtgtcaccctaaagtgctggaaaagttttaaggtgcttcccatagaacaacttcttgggggagcactattggtatggaattgctcttattcagtttttttggggtttctgaggatcctccatgtcccctagattattgacctcactttgttctttgtatcgatttattgttgtaggcagttataatagtaggaggtatgcgtgctttgtagaatcatacagatgcttgttgaacatgtgtctttgtttctgtgtctgtgtcaacaagatgttctagcatcaacaagatcctgattatcatgtccaacttccagacaaaaagagtagagcagcaaaatggagaaccatggaaaatttgatgggtgggatgaagttctggaagaagaagatgagttagcgagtgtatgcaaatatcctattagcacatcgtacctttcttatggaacaagcagaagtatgttatctcatttccagcatctctcctcttagagagaatgttgtgagcaaaggaggactttgttttgttaaactataccaggtggacaatctaatgcgtgtcctctgtttccctactgcagggggcaaaagtgtaaagaagcctagattctctttacgaggatatgattttgttccattagatgttaagactgataacttgtgcattggggagcaagatgtttcttctgcagtgccatcaactaaagcttcacaaaccatggtggctgaacggttggaaaacgttgaggaacaaactgaagatttggcaccagagtttgcccttccacccaaagcaaatacttcagtttctgagctgctagataatttacagcgtaggggtggttcttttgtcaggacaccatctttgttgcaccaacatgctccaagcatatcaatcagggagcaggaagtttcatccggagtgccaccaactaaagcttcacaagctttgatggatgaaccgtttgaaaatgtcaatggacaaactgaagagttgccatcagagctcccctgctcgatcaagagaccaaaattttcagttgcagaacttctagaagacctacaggtcacaccaacacaccagagctaaacattggaagtcaaagttcctttcttccgagaagaaaacaatagctattctaggagacaggagtattgacagtgaggaccccttggagcatgtaattgacggaacatctagcgaggaggaagatgctactcaaaaccacttgagtttggtgaacaaagatgagaaccagcaaactatggctgacctatttcaagaagtttttaatccaacaaacatggatggtgccatgaaatcaatgacatcaacaggagctggtaactatggaagaatgcaacagattatgcagatggaaaaatattggcatgtggaattcttcagacagtatagcagagagcacagttattcaggtggtgctgttggtagcagttggtgatttaaagggaactactgttcagattatgtcaaggtcattggaaggaaagctaacagtctgcagctgcatgttccaggaaaagggcaatgatgccactataagtaatgcctcagcagacggcaccatggatgaaagcagaactaggaggactattatcttcagtccaaagatatgcaacaatgtagatcttctggttggaaacataattcatatcttcccaccatggaaggaagttaaaatacaagaagagcatgtgattatttgcacctacttctcgcaccaccaccggacttgatactcggagatatttctgtgctagctgcaaagctagaggcagaccgccagcataaccgttgctgacagtttaatgttgatgtactcgcagtgtctattctgtttgttttgtaatcacaagtgtactggctgcaaagctataggcagaccgcaagcataaccgttcctgatagcctaatgctgatgtacttgcagtctctcttctgttttacaatcacaagttcctgaggcctcaaaaaaaaaaaaaaaaaaaa

SEQ ID NO: 4029 - DNA, 3062 bp, Zea mays
atagtaacatgtcagtgctttcttgtcagaaatatgattcaaaatccttctaccttatatgtggtgcacagaagttccaaattatccgagcttatcgtcaatctaaaagatagacagcagaactaccatcgatttgagctagtgacaccttgggcagtttagtcatgtcatcaggattcaggcataacccagacatgccctagcaccgtcatgcatccaatcattcagtataatgggaggaggttcggaataacctgtactgaaatttgcatcagaaattcaccaaaaatgccgtcttcctactggattgctttacacataaacaagacgcttatattatttgagttaggatagaatgcaggacctttctttgctagagttaaactttaaaatggaactcacctaagagtaaaacaatccgacttccaggaggtaggtagtcgatgatgggacagagaacttgcatggatttgtgtttatttcaaaaaatttaaacccattacactgcgttgctgtcggtttgtgcaaatgtaccatttgttggttcaaactagatctggacttgacctcagagaagtgatccaggttcatcacttgtctctccatgctactgacttgtgccttcagtactctgatctccatctccatcctagatctctcagcaattcgggaattttgaacgtcttctaaaatctgaagtgcgtactgttcttgcctccatcgaggagtctcttctcgtggacttgtaaccactaactccagtgtgcggtcccttccagaatcccttgcaccgtctcgcaaaggcactttgatctccttacaagatgaaatcggatcctgagctgcatgctgagagtaatacccaacactggttgtgtgtaccctgtttgatggttcggcacgaattctacccaatggttcctttatatcttttggatccgcagacctggtgttctgtgttctccgaccccctccgtttccactcgccccaaatttggagtgaactgtgtttatagaatcagaagttaacctttcgcagccttttgctgattcatcgggccgcccaatatcattctccctccgttcatccgtatttgaaggatcaattataaactctgctgatgcctgatcttttccagaaactttgtcattctccctgaaaatggacatctcggtttcattctccaaactttcttgtttaacttttaccaggttgccaggctcttgtggaagagcaagagctccttcaggctcctttcttgatgattcatttgattcagaaccttcgacttctgttatagagtgtacttcaaagggtgcttccttttgctggttctcagacgaaattttagacccagctatattgacagcttctgttgtaagaatagtttcatgaaacattgttatggccacatcaggattcactccaccacattcaagtgcatcattgtcagctgaacctctgtttgtgttttcatctaccaatccctgatcatgcttctcctgcactgcttcttcctgtgactgagatgcatcagctattggtcaaacggaaaaaaaaatacattgaaacggaaattgttctcaccttctccgaacttgaagcacattggttgagtgttccttgtcttaacccagccatgctaatctccataacagtcgaatcagatttcaattcaccagtatcaatcatactagtttcttccaaaaccctcttctcattcacatgcccaactccatgacgcttcttatcctcccttgcctgcaactgtagaacaagttcatcacaatgaatcatagttaggccccctttggcaagttctatgccagctccgtctcctcctggaaatggcactgcagcaggagctagacccccaaaatgaactaggggcctactgtagcaggagtcagaactaggaggagctgtgccaaacagtgctgcaaagatctagatcctgaaaatgtacttgcctcctctgtgttgcaggcctccttgtttagcactggaccactaacatccactgcaactccagaggctttcactctaccaccaccgagctcacatgcctcttcataggatactccacttccttctcttacttcacactccactctttcctccattatatggtcctgcaaaagaatatcccgaaaagaatgtcattctaacttttgtcctaagtcaagccacattaaagtttgaccaagtttatacaaaaaatatcaatatttatgatattaaataaggatgattagattcatcatgaaatatgttttcttagtagacatatttagtgtcatggatatcaataatcttctctataaacttggtcaaacttaagtaagtttgactaaggacaaagctaaaacgatactctttgaaacagagggagcataaaaatagaaaagatagtgcaacaaacaaaagagttatattctaggtagactcatttctttgttattcaaaagttcttggttttgtattcctttggtaggcttgaccctcttaaccttggtatgagttggactattatgatatcgcccataaacaagaaagttttcgtcttctaacaaattcattttgttattttcaattgcagttcctaaattgtatctttcctctcttgctagttgctgcaaacagtcgtatttcaggaatcagataatattaccccaacaataacaacatcaacatagccttttagtcccaagcaagttggggtaggctagagttgaaacccaacaagatgtcaccaaaagggaaaagagagaaaaaggggaaggaaaaacttttgagagcactaaaaggaaaaatgcctaatcacggtttgggcacgtggatagcttctttccaagcacttccatccaaacacaactctattgggatattccattccttgaagtccttttgattgcctcctcccatatcaagtttggtcgacctctaactctcttcacattattgtcctgtcttatgatgcctctatgcactagtgcttctgggggtctccggtggacatgcccaaaccatctcaaccggtgttgaataagcttttcttcaa

SEQ ID NO: 4030 - DNA, 1084 bp, Zea mays
  misc_feature (27)..(27): n is a, c, g, or t
aactgctacaactgaaactttcagttntctctttcgacactcctcatgaatagcattagctcctgcatggctaccatttccaccaattacaaatagcatgtcaattcttctggcttgtatactatctacaatctcactagttttagctcctccacgagagactcctaggaaacttcctccagaaagatttatgttttccaccacgtcacgcgagagcggcatttcttttaagcctttctcaaaaaaaccacgataaccaaatgggattccgacaatattcttcaccccataagtctccagagtaaatactatctgtctaatgacatcatttagaccaggacagagccctccacaggtaacaatggcagcctttacttcttcaggttcgtaatatatctccttacgaggacctgcacgatgaacccagtgttccacccagctacaatcaggatcaatgcactcagctccagcagaagtaggagatgcatactttatcaccttcaaaagggctctatcattcttatttacataaccgttccacatatcagttgatgagccatcaccatcacccaggggaattctgtttttcttcaaagagaatgtagttcttcttggttccaaatcatatatatcattaatgtgtggcaaactaaaacgcctgttccagtcttcctggtacttttggttccaagaaggatcagtgaaatctaggtctagcttccctgatatagctgtcacacacagtgctctttttctgcacttttgcctgcttaaatgagtgaaaccatattgacactggtcctttgttggacttgaccaatgttgctgtgtgacagaacttgtacttgctttgaaagcaacagccatcccagacaaggtcataaaaagttataatggacctgcggctttcgacggcgataggagatggggggattcagcttggagcgcgctctgctccggcctgccgccttggagggttcgggttcggggttcgtcgcgtcggtgatcggttcgagtagttttacaccctgacgcggcggagaagcagaggcagtggagcggggattgacggaggagtccaggt

SEQ ID NO: 4031 - DNA, 1805 bp, Zea mays
tttctgtgtctgtgtcaacaagatgttctagcatcaacaagatcctgattagcatgtccaacttccagacaaaaagagtagagcagcaaaatggagaaccatggaaaatttgatgggtgggatgaagttctggaagaagaagatgagttagcgagtgtatgcaaatatcctattagcacatcgtacctttcttatggaacaagcagaagtatgttatctcatttccagcatctctcctcttagagagaatgttgtgagcaaaggaggactttgttttgttaaactataccaggtggacaatctaatgcgtgtcctctgtttccctactgcagggggcaaaagtgtaaagaagcctagattctctttacgaggatatgattttgttccattagatgttaagactgataacttgtgcattggggagcaagatgtttcttctgcagtgccatcaactaaagcttcacaaaccatggtggctgaacggttggaaaacgttgaggaacaaactgaagatttggcaccagagtttgcccttccacccaaagcaaattcggcacgtgctgagctgctagataatttacagcgtaggggtggttcttttgtcaggacaccatctttgttgcaccaacatgctccaagcatatcaatcagggagcaggaagtttcatccggagtgccaccaactaaagcttcacaagctttgatggatgaaccgtttgaaaatgtcaatggacaaactgaagagttgccatcagagctcccctgctcgatcaagagaccaaaattttcagttgcagaacttctagaagacctacagggtagaagtggttcttatgttgagacagcatctttgtcacaccaacacaccagagctaaacattggaagccaaagttcctttcttccgagaagaaaacaatagctattctaggagacaggagtattgacagtgaggaccccttggagcatgtaattgacggaacatctagcgaggaggaagatgctactcaaaaccacttgagtttggtgaacaaagatgagaaccagcaaactatggctgacctatttcaagaagtttttaatccaacaaacatggatggtgccatgaaatcaatgacatcaacaggagctggtaactatggaagaatgcaacagattatgcagatggagaaagattggcatgtggaattcttgagacagtatagcagagagcacagttattcaggtgatttaaagggaactactgttcagattatgtcaaggtcattggaaggaaagctaacagtctgcagctgcatgttccaggaaaagggcaatgatgccactataagtaatgcctcagcagacggcaccatggatgaaagcagaactaggaggactattatcttcagtccaaagatatgtaacaatgtagatcttctggttggaaacataattcatatcttcccaccatggaaggaagttaaaatacaagaagagcatgtgattatttgcacctacttctcgcaccaccaccggacttgatactcggagatatttctgtgctagctgcaaagcttgaggcagaccgccagcataaccgttgctgacagtttaatgttgatgtactcgcagtgtctattctgtttgttttgtaatcacaagtgtactggctgcaaagctataggcagaccgcaagcataaccgttcctgatagcctaatgctgatgtacttgcagtctctcttctgttttacaatcacaagttcccgaggcctagttcggattctccaaaaaaaaaaaaaaaaaaaaaaaaactcgagaagggg

SEQ ID NO: 4032 - DNA, 2061 bp, Zea mays
agctgtcgtggcagtttttggcgttgcatttcgacagacagctagctattcagttgaactctcggcgtcgaatctcctccagccaccgcgcacactctactggacgcccggtggaaggagatctccgggatttgagctgtttctgccctcacctccgctgggccggcgtcgagtggagatccaatcgaaaatcgaactgacttcatcttctgttggtcaacaagagagcccgttgaaatccgggacctctcaattgtccttttctctctccccgcccaccttcccctgttctgccgcctccccagtccggcgtgcatcagcagcgacatcagagtcggcgatgggaggcgtcatcgacgttctcgtccccttatgttgatgaagtggcgtgccgtggagattccttgaccgatttcttgccggtaagacggagcctgccatctgcgtggctggtcatcgcggtgagcaaggaacgacgaagtgcgcccctccgcccttcggctcgtcgttgtgccttgcgtcgtcgggtggagttccttcccctgctttaagctaattcgacaaaaagagtagagcagcaaaatggagaaccatggaaaattggatgggtgggatgaagttctggaagaagaagatgagttagcgagtggggcaaaagtgtaaagaagcctagattctcattacgaggatatgattttgttccattagatgttaagactgataacttgtgcattggggagcaagatggttcttctgcagtgccatcaactaaagcttcacaaaccatggtggctgaacggttggaaaacgttgaggaacaaactgaagatttggcaccagagtttgcccttccacccaaagcaaatactttagtttctgagctgctagataatttacagcgtaggggtggttcttttgtcaggacaccatctttggtgtgtattgtcttgcattcttttttcatattggagttcttacataacacctatattacttctgaatattttaatctagttgcaccaacatgctccaagcatatcaatcagggagcaggaagtttcatccggagtgccaccaactaaagcttcacaagctttgatggatgaaccgtttgaaaatgtcaatggacaaactgaagagttgccatcagagctcctctgctcgatcaagagaccaaaattttcagttgcagaacttctagaagacctacagggtagaagtggttcttatgttgagacagcatctttggtttgtttcttgtgatgtcatttcatgatttggggttctgagacaagatagcttgcctctgaatattgtaaaaatttattgcagtcacaccaacacaccagagctaaacattggaagccaaagttcctttcttccgagaagaaaacaatagctattctaggagacaggagtattgacagtgaggaccccttggagcatgtaattgacggaacatctagcgaggaggaagtatggtaacacaaacactttatattagtcattgttcacttgaaaattgaaatactcaacatatttttcttttatcctggaataggatgctactcaaaaccacttgagtttggtgaacaaagatgagaaccagcaaactatggctgacctatttcaagaagtttttaatccaacaaacatggatggtgccatgaaatcaatgagatcaacagggtataataatcttgaattcttgccagttcttattgaaatgaccatttgcactggaattctgattatttattagtcttgctctgtggcagagctggtaactatggaagaatgcaacagattatgcagatggagaaagattggcatgtggaattcttgagacagtatagcagagagcacagttattcaggtggtgctgttggtagcagttggtataacttatatgctttggattaggcacttgtctgtttgtatacaactatacatggatttcagagatagtgacagttcaaattcgtaggtgatttaaagggaactactgttcagattctgtcaaggtcattggaaggaaagctaacagtctgcaggcatgca

SEQ ID NO: 4033 - DNA, 882 bp, Zea mays
  misc_feature (71)..(71): n is a, c, g, or t
  misc_feature (700)..(700): n is a, c, g, or t
  misc_feature (741)..(742): n is a, c, g, or t
  misc_feature (755)..(755): n is a, c, g, or t
  misc_feature (772)..(772): n is a, c, g, or t
  misc_feature (801)..(801): n is a, c, g, or t
  misc_feature (812)..(812): n is a, c, g, or t
  misc_feature (833)..(834): n is a, c, g, or t
  misc_feature (839)..(839): n is a, c, g, or t
atgttcctgacttggcaattcgccgccctccagcttgagcttgagtatggcactggcctcttcgacgtacncggcgttggagccagtccctagtatcacaccgaacgacgacgtcctcatcgttgtaccggcccgcagccagcgtcccgaccgtatcgttgatcagtgccgccacacgcatgtcgacgccttgcttctccatggccgtctgcagctcggcgacgacatcctcaccaacagcgtcgtcgaccgaaaacgccttggtccacttgatgagcgtgcctgacgcgatcgacgtctggcgcacggggaaagagaaggtgaacccgagctctctctgcctgccgtccccttcgcccgccgcggcgacgtacttggctagcgccgaggcgatgaagccaaacagctccgatgcgttgcctgacatgaggtgaggagggatggacacctccttggactctcgcttggccacacgcctgtccttcccggcgagctgcacgcgcagcacgcggaagttcgttccgccaaggtccaaggcgtagaagacgccctcttcgttccccgtggggaggttgtcgacgaaggagacgatcatcttgatcttgctgccgccctcctcgcgcagtccggcgcgcatctccgcctccatcgccgccgccacctcgtcgagccgcgccgcgcacgcctcgcggagctccgnccaccacccgctaccgccgcctccaaggtccgccgccgccnnaccatggtcaacnccccggccctcccgtcnaccgtcgtcgtcgaggaagctactagcgnggacaccctcncacgctctgcgtcgtcgaccnngcgcnaccggcctggcgacgacgaaagaaaagctgcggacgcgtgaaa

SEQ ID NO: 4034 - DNA, 1267 bp, Zea mays
cccacgcgtccggtcatgcttccttttttacggcctgacctcttcaaaggcgggcttctgaaaccctgcagaggtatactactttttggtcctccaggaacaggcaagactatgcttgccaaggctatagcaaatgaagctcaagcaagttttataaatgtctctatgtcaactatcacatcgaagtggtttggtgaagacgaaaagaatgtccgagcattgttcacgttagcggctaaagtatcaccaaccatcattttcgtcgatgaagttgatagcatgcttgggcagcggaacagagctggagagcatgaggcaatgaggaagatcaagaatgaatttatgacacactgggatggcctcttgtcaagaccggatcagagaattcttgttcttgctgcaaccaaccggcctttcgatcttgatgaggctataatccgtaggttcgagcgaagaatcatggtaggtctgccatcgatgggaagtcgggaactcataatgcggcgacttctgtcaaaggagaaagttgatgaagggctggacttcaaggagctagcaaccatgacagaaggatatagtggaagtgatctcaagaacctgtgcacgacggcagcgtatcgccctgtgagagagctaatccagaaggaaagaaagaaggagctggagaagctgaagtgtgagaaaggagaaactccgtcggatcctccgaagaaggaaaaggaggagaccatcattctaaggccgctgaacatgacagatctgaaagaagcaaagaaccaggtggctgcaagtttcgctgctgaaggcgccataatgagcgagctgaggcaatggaacgagttgtacggtgaaggcggctccagaaagaagcagcagttgacatacttcctctgagcaatatgaaaatcaggcgcaaaaatgtatgaacataatttgagaagtagagtagagcacaaagcagccatgaggaaatagaccgaacatgtaatcgtgtataagaagaacatgagaaaagggtgcgtgttagggggacaaggacaagaaatcaggccgtaaaagccagtatctggtgtaggacaaggaaggacagttttcatctccaccaaaattccagtttgcctgtgctggttgttgttgtattacactaataatggatctgcggtgtagatcgctcttctcttcatcttttcctggtcgcatcatccttctgtatatgtacaaactggtaggttgtggcaacgaaaggtttttaaagcagcttatatat

SEQ ID NO: 4035 - DNA, 1978 bp, Zea mays
tcttcttttcttttatcgttgggtacatcccccccccgccgggacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggcttcgcggctgccgcgggcgcgcacgtgctcggcgtctgctatgggatgcagctcctcgtgcagtccctcggaggcgccgttgtgtccggggagcgccaggagtacgggaaaatggacgttgaggtgacggcggcctcctccgcgctctacgggcaggcggagaccgggaagcgccagacggtgtggatgagccatggcgacgaggtggttaggctgccggaagggttcgaggtggttgctcgcagcgtgcagggagccgtcgccgccattgagaaccgggagaatcgcttttatgggctccaataccaccccgaggttacacattcagcccaaggaatggaaacactgcgccgctttctctttgatgtttgtgggatcaaagctgattggaagatgcaagatgtgctcgatgaagaaatcaagaccatccaaagcacggttggccctgacgagcatgttatctgtgcattgtcaggtggtgttgattcaacggtcgccgccactctcgttcacaaggcgataggagataggcttcactgtgtttttgttgataatggtctattaaggtacaaggagggagagcgagtaatgacaacctttgaaagtgatttgcacctgccagtgacatgtgttgatgcctcagagcaatttctcagcaagttaaagggtgtcgaagacccagagaagaaaagaaagatcattggcagggaattcatagctgtctttgatgactttgctcacaagctggaacagaagataggaaaaaggcccgaatatttagttcaagggactttgtaccctgatgtaattgaatcatgcccacctcctgggagtggaaggacacattcccacaccatcaaaagccatcacaacgtaggtggccttccaaaagatatgaaattaaaacttattgaaccactcaagctcctattcaaggacgaggtgcggaagttggggggtattttgaatgtcccagattcatttttgaagcgacacccatttcctgggcctggtcttgcagtacgtgtcctaggtgatgttacacaaggcaatgctttggaggttcttcgtcaggtggacgagatatttgttcagtctattaaagacgcaggcctgtatgataaaatttggcaagcttttgctgtgttcttgccagtacagacagttggagttcagggtgaccagcgaacccactccaatgccgttgttttaagggcaatcaccagtgaggatggcatgactgcagattggtactattttgagcatgcattcctggtagatgtggtaaacaagatttgcaacaatgtgcgtggcatcaaccgcgtttgccaggacatcacatctaagccgcctgcaacggtggagtgggagtaggaggatgggagggaccctatggtctggtctgtctgtctgtcttgggttaaaacccgctatgtcatgtcactgctctcaacacgttgcatggatgtcacaaatagcaagcagttaagagtgaccattcgtcagtcaatacattaggtttatcatgaattgtttgttacttaatacaaggactgcattgcatggattgtaaaaaaaaaaaaaaaacccccgagaaaaaaaaa

SEQ ID NO: 4036 - DNA, 2462 bp, Zea mays
gcgcgccactcggtcaacatcatgtttaaactcatatcaagacgtgttgagtaaatcatcctttgacatgttggcaggagtctaagaaactgcagtttgcaaggagctgttccagatttgagtgtcgtacctaaatttggctacttgcttggatcttagctggaaccagttgaaaggatctataccgactaataggcttgcttcaaatattactacaattgatttatcacacaactttcttcaaggaactgttccatcaaacttctcagggctacctaatattcagtacttgtcagtcaatggcaacctcctaaacggttctgttccaccgacaatttggagtaacattactttcacgggaaatagagcccttgttctggacttccaaaacaactcccttgacactattccacctgtatttgagcctccacaaaatgtcacggttctactttatggaaaccctgtatgtacggcatctaatgcagcgagagcagctaatctttgtcaacctacttctgtaactgatgccccatctggagagggaaagcaagttagtacgacgtgttttccttgcccaacaaattttgaatacaatccatcatcccctattccttgcttctgtgctgcgcctctgggagttggatttcgactaaagagtccaggaatatcggacttccgaccctataaagaagcctttgagaatgacttaacctctctgctggaattgcgtgtttatcagctgtacattgaacgctacatatgggaggctggcccaaggctgaatacacatttaaagttattcccaaataatacaaatttattcgatatggctgaggttgtgcggcttagggaagtacttgctggatggcagatcactctattagatgtttttggtccatatgagcttctcaatttcacacttggtttctatgcagatgaatttcgtactgcggcgtcgccaggtttaaaaggtggtgcacttgctgggattttggtggggacaattgttgctgccattgcagtatctgtgttttctacagtttttataatgaaaaggcgcagaaaacaacgaacaatttcaagacggtcattactttcaaggttttctgtcaaggttgatggtgtgaaatgcttcacatttgacgaaatggctgtggcaacaagggattttgatatttcagctcaagttggtcaagggggttatggaaaagtttacagaggaaatttagctgatggaacaacagtggcaatcaaacgtgcacatgaagattctctgcaaggttcaaaggagttctgcacagaaatagaattgctgtcaagattacatcatcgcaatttggtttctcttgttggctattgtgatgaagaagacgagcagatgctgggttccgcgtgcccgcccggggggtccctacgtgatcatctttctgctaagactgaaagacctctgagctttggtcagagggtccatattgcgcttggtgctgcgaaaggacttctatatctacataccgaggcaaatcctcctatatttcatcgtgatgttaaggccagcaatattcttctagattccaagtttgtagcaaaggtggctgactttggtctttcgaggcttgctccagtgcctgatattgaagggactttgccagctcggacgcgtgggctctactgttgttaagggcaccccaggctatctcgatccagaatatttcctgacccataaactgacggaaagaagtgacgtgtatagcctaggtgttgtttttcttgaactattgactgggatgaagccaatccagcatggtaaaaacattgttagagaggtaaacatcgcttaccagtcaggcgacgtttccgggatcatagacagccggatgtcctcataccctccggaatgcgtaaagaggttcctctccctcgcaataaggtgctgccgggacgacaccgaagagaggccctacatggccgacattgtcagagagctggagaccatccggagcatgctgcccgagggagaggacgtcctgtcctcgacctcggggtcgggcttgctggcgaagtccatgtcatcatcatcgaccaccaccaccggggccctctacgtgtcgtcgcatatttctggcagtggtcaggcggacagtggcatcccctccgggatggtggctcctcggtagcgttgctggcgccggaggttttgtagacacctgacgggcggctgtgatctgtagtgaactagcttgtaagtagtgacaggacaggagtaatggtggggtggtgttcccttgccctgcaggtgagttgttgttctgtacatgagttttttgtgaactgtgctggagcctgctgggaccaggttgtgctgtaatagtggcattggtaaagaatacagatgagggatatatactgagttactgacgtgattcatcccaaaaaaaaaaaaaaagggcggccgctctagagga

SEQ ID NO: 4037 - DNA, 4157 bp, Zea mays
  misc_feature (1926)..(1926): n is a, c, g, or t
  misc_feature (1969)..(1969): n is a, c, g, or t
ggcttgtgtttttgcgagggaggtgtggttcagatctctaagcaggctgggcctcaacatgttactcacacgactgatgcggcgatgtttcaggaatggtggggagaggcagaaaggaatgtgcctaagccaaataaagaaaggctttaattcctttgtgagtttagtagcctggcaaatttggaagcatataaatgcttgtgtgtttgatgatgctttcccaaacatcaacacaatcttgcagtccatccatgatgaggttcgagaattttcttggtcgggacaatatttcggtcttttattagccatcagtgggttgtgtgcgccttgagtgctggtcccaggcattataccgggaggatggtctttccctcttcgaccgagttttttttaataaagcaccgtgtcctagaatctcaaactgtggagattgtccagtccaggtccaacagacatgtcagtttttccacggtactcccaaaacatgcagcgaaatgagttaatagcaggaagcagtgtatttgttcgcaatagctgaatcaccgtcctcgttattcgcagaatatccccccgtaagttagagaccgccgagtccaacgggcaggtacacaaggccagatcggaagaggaacgggcgcgtccatcccagcgggcccggccggcctgtgtgtgtgtgagggggagatagagagggggggatgggagtaggtacgtaccgtagacctcgaggaggcgggcgaggcagctggcggcgaggtcgcggtcgaagccggactcgactgcgaggtcgagcaggcggtgctgctcgccatcccgcgcacgttgctgcatctccgcgctgggcgcggcaacccctagcgtcagcgccgccgcggcggagacgggacggatacggaacggcggcggctctggctgcgggcctccttcccgggttcccctccctcctttttggcgggttggcgcgcgggggaaactggaagagtggctcggtggggcacggttgggacttgggacacagcggcgcgaatgggtagcagttggctgggccggcgggaagaagcccagtatatatataaataagaaggctgctagtggtggtggtggtggcggcgctgcgccgagagggaagaatggccatgtaggatccagccgtagagctgggtgggcctggtgaatttgcggtggagcggcccatgtggtccaaccgtagggcgatttgcggtggcccggccatgtggaacggaagagtctccatcgtgtttcttttttcctttttgtgatccacgtgtgagattattatagggcaggttggttggtgacaaactctttatctctcttctctactatagttaagtgtttaacgaacaacagattttgcaaatattctgaacataaaaaaaacatagcaaaactgacgggcggcaccagcaatggccgtgccggtgatgatgatgatggggcggcatggaaaagagagacggaaacggaggacgctgacagggtggcaggctagtaggtcgtagctcaactgtgcgccgcgtcacttgtacgtgcggttcgggttgccccgacaggtgtccgtccccccgtcgcggccaccggacagtcgacggacgcctccggccaccggggatgcgctgcggcggtcccgcgcacgcacgcacgcgacggtcctactgtggagtcacggatggctgtcgcggcgaggcccgtctcggacctcgcatcgtgatcccggccctggatgacgacggcccatggatccgcatgcgcgcgcggcaacgcgcagcccacgtgggccggccggtaccaacagtattcagtagccgcccctccagacatgctagtatacgaacggcggcgctacttcaactgcggcggcgactcacaccgtcggaggagtccaccggccacctagcaggcttnggaccgcggcttagggtccagatctggttatccgggcggcggncgggcacgcggaataataatatcctcccacgaggacacccgcggagtctggttattacagcacgggccctggccgtgggcgcgggccggagccgctcgctattcagccaaaccacgggggttccgcccgcgaaacaaccccgcgagttaaaaactcccaccacctccacgcacgctctcccacgcttcccgttccttctcccagacagacagactccccagtccccacacaccaccatttccccccactccgcccatccgtccgtctccgtggctcgcctccacgccccgtaccggcgatggccgccgaggcagcgtgctgcgacgacagcgcctgctcgacgcccttcgtgagcgcgccgtccagccccgcccgggacagggacagggaaagggacacctacccgtcccacttcttcttcagcgcgccgaccagccccacccgcggcaaggacgccgccgtcccggacctggacttcgacttcgacttcgacttctcgtcgcgcttcccgtcgccgtccgccgccgccatgtgctccgccgacgagctcttccacaacggccagatccgcctcgccgccgcgctgctgctgcagccggacggggacgcggacccggacccggaccccgccgcgggcgcgcagcacgagaaccagcagcaggcggaggcggcggacgagcgcgggcgcgtgcggagccgctccgtgcggcgcaaggcgcgctctatgtccccgttccgcacgcactggcggtccgcgtcccaagtcccggtgccgaagcccgagtccgccggcgagtcgcagcagcagcagcagccggcggcggcgtcgcgctcgtcgtcgtcgtcgtccaccgcatcctcgtccgcctcgtccgcgtcgtcgtccaggggctcccgccgctggagcgggttcctcaaggacctgctccaccgcagcaagtcggacggcggcaagagcagccaccagcagcagcagcagcagcagcagcagcagcagccgcactcccaccaccaccactgcgctggcgctcccccagccgcggcggcgccgtctccgtccccgtctccgtctgtaaaggttgggaggggcaggaggaggtccgcgcacgagcggctgtacgaggcgcggcgcgccgaggccgaggagatgcggcgccggacgtcgctgccgtaccgccagggccagctcctcttcggctgcatcgggctcggcggccgtagctacggcatcgccagggggatcaacgccgccgccgctgtctcctccaggtcgtagtgtgtgtcagtgtgggtggtggtggtggtggtggtagtgtgtgttcagtgtggttactcttcagtcactactgtgaactagttagtggcaaccgtgtttaaaaaaaagggcttgttccagtgaaccaacgatcttcgcttctgtgttttagttgataaactgaaacttgtatgttcatctgcgtgctaagtcaggattctgcgggaagaagaaagctctgttctttcttcagtaatctaacaggatgcccggcagcacggcatggcatacggcttttgcttgacgcctcggtaaagtgcagtagtagtagtacgtagtaaaaagattcacagaagatatcagtgatgagcctcgtcggtcgtgcgcacggcagctccaccgcgtcagcaacagtcactgcgtgcccggcccgcccttgggcgtgaggatgatgggacaacacctgtcctgccctgcccgcccatgctgccagcctcgcctcgcccatggcggcctgtcccacgcatggcatgacgcagcgccgtcgtgtcgccgtccctcctcgccacctcgacctcgaggcaggggcaggcgcagggacactgggacagggtgaggtcgccatgccgttttgttgggagcatatgcggccgtgcccctgctctgggactagcagcctggttgctactgctggtagggacggacgaccgatggcattagcagcccgaccaccttccttaagtgctctgctgcccccatcggtttaggttactattgccacggcaccaaaaaaagaaaaaaaaacaaagacctccaatggcgagcgccgagggagatccaacgcgatcggccagggcgctaaagaaacagtagaatacactgcgccactgattcattattgccccggcagcgcctgcatgcaaaaactccatc

SEQ ID NO: 4038 - DNA, 873 bp, Zea mays
atcgattcggcacgacccatggagaacgtcgccgcgaattcttccgctgcggccgccgccgcagggaatggcgtccaagcatcgggggccggaggggagcgcccggaggacgcgtcgaagcagaacctggcgcaggtgacgagctcgatccagaagacgctgggcctgctccaccagctcaacctcaccgtctcctccttcaactctgcctcccagcttcccctcctccagcgcctgaacgcgctcgtggcggagctcgacacgatgcagaaactagccgagggttgtaacatccaggtgccaatggaggtcgtcaatttgatcgacgatgggaagaaccccgacgagtttactagggatgtgctcaacagctgcattgccaagaaccagatccccaagggcaagactgacgctttcaagagcctacggaagcatctccttgaggagcttgaacaagctttccctgaggacgtagaagcatacagggagatccgtgctacttctgctgctgaggcaaagcggttggctcagtcccatggcaatttgcttaatggagatgtcaaagtgaaagctgagcattgactgaagggttgcgcggtatcttcagttgataacttatctttattattcttccctgtcacaaaaaaaagagaggctggatgatatgatggtaaggtcgcatcgaatggcttaagaaacttgtagggggaaatggatatgccttgtgagtgtgagactgatcaaacccttgcaaaagttctgtgatagtccctgcttggctgattgaagtaagtttgatgttgatatctgctgggaatatatataatcaatataaaaacttatcaaaaaaaaaaaaaaaaaactcgagcccgg

SEQ ID NO: 4039 - DNA, 936 bp, Zea mays
  misc_feature (895)..(895): n is a, c, g, or t
  misc_feature (925)..(925): n is a, c, g, or t
gacctccccccgtttcaatcaaaatggaaaaaggtttcctcccttcccctctcttctgaatccggcatcaccatgcagaacaccgtcgcgaacccttccactgcggccgccgccgctgcggcagggaacggcggcgtccaagcatcgggggctggaggggagcggccggaggacgcgtcgaagcagaacctggcgcaggtgacgagctccatccagaagacgctgggcctgctccaccagctcaacctcaccgtctcctccttcaactctgcctcccagctccccctcctccagcgcctgaatgcgcttgtggcggagctcgacacgatgcagaaactcgccgaggggtgcaacatccaggtgcctatggaggtcgtcaatttgatcgacgatgggaagaaccccgacgagttcactagggacgtgctcaacagctgcatcgtcaaaaaccagatcaccaagggcaagactgacgctttcaagggcctacggaagcatcttcttgaggagcttgaacaagctttccctgaggacgtagaagcatacagggagatacgtgctacttctgctgctgaggcaaagcggttggctcagtcccagggtactttgcctaatggagatgtcaaagtgaaagctgagcattgagcgaatggtacgactacagagggcaagtttgttatctctgcttagttttggggatggctttgttaaccagaaacatgcatatctttctattgcacgtcccctgatcagtgaatgtgtacatactatcgtagcatgtgtggcccaatgtattcaacttaactaataacttcaaaaagatatccggagcatatcgaactacggaaagctaaaaaaaaaaaaaaaaaaaaaaaaaaagggggccgctcgcgtnctagaaaaaaaaaaaaaaaaaaaaaaaaanccctggggggg

SEQ ID NO: 4040 - DNA, 1728 bp, Zea mays
ccggccgagcatccaccaaatccagcgggtccgtactcatctgcttcacctccgggttccggctacggcggcactcttctctggcaaccggtcggaagatgttggatcttccgcttcaaatcgacgcataaaggacgcagattagttttattcgcgtcaaatttattttgctcggtgtagttctgttcattaattaataattttgtactggatttaaggtgcttttattttgaaggtttcttctcccggaaattttcacatcccgaaacgactggaaattgaagtagccatttgatgctgttacctgggttcataagttgttagacttgttatttgtttgttaatcctagctattgcatattgtgtgcctgaccaggaccacagaaacatctaggcaacgagtcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccgtccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacgccgagatcgagagcctccacgtctgcgacaacctcgcggaccacatgatcgggaacgtgtacgtggagttccgcgaggaggagcaggcggcccgcgccctgcaggcgctgcagggccgctactactcgggccgccccatcatcgccgagttctcgccggtgactgacttccgggaggccacctgccggcagttcgaggagcacagctgcaaccgcggcggatactgcaactttatgcacgtcaagcaggtcggccgggacctgcggcggaagctgtttggccacctgcatcgctccctccggagccacagccggggcagccgcagcccgagcccataccgccgccgcggtagctcgtccaggtccagggaccgcgacgattactactactacaactaccgtagtggcagtggcagccgcaggagcagcgagaggcaccgcagccacgacagcgacgggagccgccgtcgacgcgggcggtcgaggagccggagccggagcccggtgagggaaggcagcgaggagcggagggcaaagattgagcagtggaaccgcgagcgggaggcagctcaggtgtaagcagagcaggttccccctcccctgtgatgagtggttgctgcattgttattggccttggtagttgccatgttgctgttgctgaagcctgttatcatgtattgatgtgtggctcaggcagggtaaggccataaattgaacctgaaattggactgtgatctcttttgctgtggacgggttaccattaaggccctgtttggaaaccacggtttttaatactataatatactttagtcaatgacaataccacagtttaaaatacgaaaaaaaaaaaaaaaaacagtattaagtatttttttttgcacgcggtagaaatgtgcgcgctgcattttacggagaaaactgaggtataaatctaagtttagaatacttaaaaaaagtacagtatttgtaatactttagttttgaaaatagagattttagttggtttatcagaatactgca

SEQ ID NO: 4041 - DNA, 1576 bp, Zea mays
tcttccccgccccggctccgggcatccagcaaatccagcgggtccgtactcatctgcttcacctccgggctccggctacggcggcactcttctctggcatctctggcaaccggtcggaagatgttggatcttccgcttcaaatcgacgcataaaggacgcagattagttttgttcgcgtcaaatttattttgctcggtgtagttctgtccattaattaattattttgtactggatttaaggtgctgctattttgaaggtttcttctcccggaaattttcacatcccgaaacgactggaaattgaagtagccatttgatgctgttacctgggttcataagttgttagacttgttgttatttgtttgttaatcctatagctattgcatattgtgtgcctgatcaggaccacagaaacatctaggcgacgagtcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccgtccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcaggcggcccgcgccctgcaggcgctgcagggccgctactactcggcccgacccatcatcgccgagttctcgccggtgacggacttccgggaggccacctgccgccagttcgaggagcacagctgcaaccgcggcggatactgcaactttatgcacgtcaagcaggtcggccgggacctgcggcggaagctgtttggccacctgcatcgctccctccggagccacagccgaggcagccgcagcccgagcccataccgccgccgcggtagctcgtccaggtccagggtccgcgacgatttcctcgccttcttctgccactacttccgtagtggcagtggcagccgcaggagcagcgagaggcaccgcagccacgacagcgacgggagccgccgtcgacgcgggcggtcgaggagccggagccggagcccggtgagggaaggcagcgaggagcggagggcaaagattgagcagtggatccgcgagcgggaggcagctcaggtgtaagcaagttccccttccctagttgccatgttggttgctgcagtgttattggccttgctagttgccatgttgctgttgctgaagcctgttatcatgtattgtggtgtggttcaggcagggtaaggccataaattgagcctgaaattggactgtgatctcttttcctgtggacgggttaaaaaaaaaaaaaaaaaaaaaaaaaaaaaaaaaaaaaaaaaaaaaaaaaaaaaaaaaaaaaaaaaaaaaaaaaaaaagg

SEQ ID NO: 4042 - DNA, 1273 bp, Zea mays
ttgggctcctggcgcccatccaggcatccaccaaatccagcgggtccgtactcatctgcttcacctccgggttccggctacggcggcactcttctctggcaaccggaccacagaaacatctaggcaacgagtcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccgtccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcaggcggcccgcgccctgcaggcgctgcagggccgctactactcgggccgccccatcatcgccgagttctcgccggtgactgacttccgggaggccacctgccggcagttcgaggagcacagctgcaaccgcggcggatactgcaactttatgcacgtcaagcaggtcggccgggacctgcggcggaagctgtttggccacctgcatcgctccctccggagccacagccggggcagccgcagcccgagcccataccgccgccgcggtagctcgtccaggtccagggaccgcgacgattactactactacaactaccgtagtggcagtggtagccgcaggagcagcgagaggcaccgcagccacgacagcgacgggagccgccgtcgacgcgggcggtcgaggagccggagccggagcccggtgagggaaggcagcgaggagcggagggcaaagattgagcagtggaaccgcgagcgggaggcagctcaggtgtaagcagagcaggttccccctcccctgtgatgagtggttgctgcattgttattggccttggtagttgccatgttgctgttgctgaagcctgttatcatgtattgatgtttggctcaggcagggtaaggccataaattgaacctgaaattggactgtgatctcttttgctgtggacgggttaccattaaggccctgtttggaaaccacggtttttaatactataatatactttagtcaatgacaataccacagtttaaaat

SEQ ID NO: 4043 - DNA, 2662 bp, Zea mays
  misc_feature (2603)..(2603): n is a, c, g, or t
cccacgcgtccgcccacgcgtccgcccacgcgtccgcacgcttcttgagcactttgggcgagaggtggctgacctgaggtcggaaaggagtgttctgaagcaagagtggcaagcaaagagtgaggagctgcagcagctgcagagtgaaaagcatgacctcctaaagataagctgtgagctacggaaggaaatggaggctcgtaaccgcaaagtggatgaactgaaatctgaggcaaagttcttggttcgacaactgtcggaattgcaagagtcacggcagtcgttgcaagcagagattgtcaagctgattgcagagaactcttcactctctagcaaagtttacagatccagagagaaagagacgtcatttgatgaggatttcagcacacttgttgatgaagcgatcaggacagatattcttggtgtcatttttagaagcctttatgaagagaggacatcacaattgcagcgtttgcatgaggattttgggtctctacatgcagcaggcaatgagctgtatcaggaaatcaagctgatgaacaagaagctcggagacctacagcttgagaacaactatcttgagaaggaactcagtagaactctaagcatctgtgatggctctggtacagaaatttcctccggaagaaggcgtgctatgaggagggacacgaagctattaaaatctggcaggaaaagccaagagggtggccagaacatggaacaacgaaaagaagttgacaatgctggcctcgagaaatcgaacgaaatgcttagagtggagctccagaagttgaaaaatgaactgcaggtccttaaaagcaaggaacagcctgtgattgacgtgaaatcttgtgacgcagagatcactaaactgctggccagcatgcaattggccacagcgaatgcgtctctcttcaaggagaaggtgcttgagctcatcgtgacatgcgagagttttgagatcagtgacatggtgcagaaagaggtgctgaaagaggagatcactcggaggaactcttacgtggatgagctcaaggacaagcttaatgccattgagattgagaacagaaggctgaaggttgatctgaacggcgacttcacactgctcggagcattgcaaactgaagttgatgccctggagaaacaaaccttgtctctagccaaggattgcctaccaccaagcatgctcaagaaggaggtatacatattatgccatgtggttattcaggcgtctctgatattggtatgtttccttactcatgagactcattctgcttattgtttttggcaggagaatccactatcacctcagctgtcaaagattgctgtgaggccaagtgaagatcagaacaccacaaaggtggtgaaggacatggagctgcagaaactccacgggaccatcaaagcacttcagaaagtggtgtcagataccggggtggtcctggagcaagagcggcttgacttcaacagcaacctccaggacgcgaggaagcagatcgagatgctgaagctgaaggagatcctggacagcgacgccagcgacgtgaactacgagcggatgatgaaagacatccagctggacctcgtccatacgcctagccggcgagccgccgcatcctcacacgggcgccacaggaagaagaactcagtagccgcgacggcgcagtctgacgacaacaagatgctcgcgctgtggagcgtggacagggtgagcagcggcagccggcggcacgacatggacctgcggccgccgcagagcgaggctgccgagaccgagaagggaaagaagcggccatcctccgagccagtgccagttgtgaccgtgaaggacctcagcgtggacaagcaggaggtcctctcacggcccacggtgatggcagtggcggcgacggccaccacgactgagccacaccgggagtggaagaagaaggtgatcgaccggctatcctcggaggcgcagcggctccgtgacctccggaccatcgtccaggagctgcgcgccggcgtggaggcgtcgtcggacgcggagctggacggcgtcaaggcgcagatggccggcgcggagggcgccatcgcggagctggtcgacgcgaacgctaagctcctgaagaaggcggagggttcacgtcggcgggcgacggcggcggcgacgtggacctgcgcagccggagccagcgcaagatcctggagcgcgtgcgcaagatgtcggacaaggccgggcggctggagctggagctgcagcggttccagcacgcgctgctgcggcacgaggaggagcgcgcggcgcggcgcgcggccaaggcggcggcggcgagcaccaccgtgcaggtgcagcggcggtcgcgggtgcagcttgtggagtacctgtacgggcggcggcgcgacagccggcggcccaagcagaaggcccgcggcccgtcctgctgcatgagggccaaggccatcgacgactgacgtgacgtggcgtcctaggtaaataatttaattactggactgatcttagttacgtcggaggttctttttcctaccctaaagtaaagtaaggtcttaagatgtaaatcgtacgtaggcaactcttgtgttcctcgtctgcaaatttttcngcatgtaaaattccagacggtaaaaaaaaaaaaaaaaaaaaaactcgagagtcttctag

SEQ ID NO: 4044 - DNA, 8128 bp, Zea mays
  misc_feature (7771)..(7772): n is a, c, g, or t
  misc_feature (7775)..(7775): n is a, c, g, or t
  misc_feature (7914)..(7914): n is a, c, g, or t
  misc_feature (8037)..(8037): n is a, c, g, or t
  misc_feature (8051)..(8051): n is a, c, g, or t
  misc_feature (8056)..(8056): n is a, c, g, or t
  misc_feature (8058)..(8058): n is a, c, g, or t
  misc_feature (8061)..(8061): n is a, c, g, or t
  misc_feature (8067)..(8068): n is a, c, g, or t
  misc_feature (8070)..(8070): n is a, c, g, or t
  misc_feature (8105)..(8105): n is a, c, g, or t
cacaaaaaaagttaaacaaattataaattgtgacagagagagtataatatagaagtatgcatgtactaacacactccttccttccgctctaagttacaaactattctaatttctttaagggtaaaaccaccttaaatttagctaagctacgtaaaaaatataaatacttatggtatcaaatagatacactataaaaatataattaaggaatgatataacaatacttaggactagtttgggattccatttttctaagggattttaatttcacagggaaaaataaactagtttctcttggaaagatagaaatttccttaggaaaatagggttcccaaagtagcccacactataaatgacatgattgttatataaatttaattaaacttaagatgctttgtctctctaaaaaataaaataaagatgaaaagagtagtgaaaggcatttgatatcctcggaacaagattcgtcgttcataaatcaggggatcgtgcacgtgaacaggtcaaggagatgaccagaatatctgacaataccatcaccaaaaagaaaaagaaaaacccccgctgtgttgagtgttgacaaaatcaccgtccactgctatgctaccccagtaataatcccacatttaaccgtctaccgtttcttcttgaccgtttcctccttgtcttcgccgaaggaaataaacgaaacagtcaaaacagcaactaattactatcccaacgttaacagctcacaactgacagtaaaccgcgacggtaaaaagaaaagaaacgaaatttacagtaacctccctggcccagccgcagagacagatgaaaatcacactagccggaccagccgcgcaagcataaaataaaaccaggagtaacacagtaaaaaaaaaagagtaagagtaacacagtgaaatcagcaaagcgactgtgattcacgcacctgctctttctcgcagaacaatcaacagagtgtttaagtgtactcgcctaataaaaatatcaaattgatgcgccttaatctttgtcctttacctttttccaattattaataaaaacaattaaacaattaatacccccatcagtcctccccacacacacaccagtacaccacactgctcctgctgcgtcccatgattgcagctgcttcatctctctctctctctctctctctgcccaggagtgagtgacagcctctctctctctctgtccctctgttcgtgatacgagatggtgcggtgctaatgtggtggtggtgagaatgatgatggaggtttagggctagctagtgtgagtgtgaggggtgaggaaggagcagccggagctcccgcgctccccggcgccggcctgcagctggccaagaccctcccctcctccgccctgcatcgtaagtccgtctcttcttcgattcgtgtgggagtcactcacgcaacggcaatccccgtcctgcatcctaggccgggccgccgggggacgaagagccgccacctcttttcgtttctgcgacgactgcgtttatcttgggcgtggaaagattctcgttcctctgcgtgcgtgcgcgcgtctcgctactgtttgccgttctcgtggcccttgaccagggccggccgccgatctctgcattggcccttcgttctgctgcacaagtttggccatggatttggttctggttctgcccactgctcttcttcaggggagatgggggaatgcgtcaggattttcctttccttcccgttgcgcttcttgttctttgggaaggagaaacgcgacgagttcgtgcttcctttttttttttggtagtttctgttctggaccccatttcgcccccacagatttcgcccggtgaaccccactatgttgtaggaaaatgccttgatttctgctttccttcccttgcgtccatattcgtatcgtcctcgttggcagcagcagatggcgcccctgccttagtaggatttagaactcgttcgtcctttcttcttattattattatcatcctcattggagcccgtctccagtctccaccaagcagcatccagttcatgaaatgctgcccgtgttcatgatttcctccagcacttactgcaggtgcggatttctcacccgtggtgttcttctttcggggaggcgatctcaggccttgcgtggttggcccatgggcgttctctcgtctttattgcgttagttggggggcttcttttcactgccctcctttgccctttcttttttcctttaccaattctttaaccattgtctgatgctccgttcgcactaatggaggttgcttccgttctgcactgaccttgtttctgtgcctttgtgtagcaagatggtacaatattcgagctgtttttgagggtagggttctgattcttcccctggaagtattttttccccaataaaactttgggtctttgtggtggcaaaacttgggtagttttttctttctttctgttcttgaggtaattttctccacattttcgggatgctcaggcgttattttgcatctggatttagcaactgcttctcctcaaaccgtcgaatcataacaccagaatcttgtgaaaactatttgttttctgcgtttcaataccgtcccatgctggggcagtaatttattgcatgaatgtgtagctaatctttatctttgaccattgttcgatgctattattccctcttggcccgtgctgagaacatgatatgtggtataagaaatcggaacagagccattatttctaccaattgcaactctgatctgtaaacttgcgtgacccaagccgtaatggtgccaatattccagtttttcagttttatggcttagtgctagttttgaaagtttatgatgttctgcaggtagtaggttggtgccagactcttgaacagattcaactctagttgcttgggtctactgcatcagctttgaagccacagaagttttctcaagagcccaggagtgctgttctgctctcttagctggcctcaatggccatgtcgccatccaatccaatgcgcaagtactcatggtggtgggatagtcacatatcccccaagaactccaaatggctccaggagaatctcaccggtaaactttcttggttcactatggtgatttcactcagtctagaaactggagtgattctagccactgccagaaattagtaagatgtacatgccactatgtacttaagtgtcaactttatgtttctattaatagtttattcagagtcatcatgccgcagatttggatataagaactctgccttacctattgtagcctcaactgttcgtgagattatcttagcaccgccttgtgatttttaagggtttaactgcaataacttaagtgtttaataaacacagttctagttggacgctcttgactctgatttattgtcgaattaaacttcttgtggaaaagacagcagatttgtagggcacaagttcataaatagcttgtggcataaacctgtaccgctcatgggttgcagctattttatgatgattggaccactaactctgttgaaacaaattcaaatcttggatgctgtgagagctaagcttactacacaaagagaaacaattagatttggtgtctgtccagtgctggcggtgttcttgcacacttgtctggtggtttatttcttcttttgctgcatttacttaaaacctgtactgaatcagtgtttaataatgtggtcacacagatatggatagcaaaatcaaagtgatgatcaagattattgatgaggatgctgactcgtttgccagaagagcagaaatgtattacaaaaggcgcccagagctgatgtctttgcttgaggagttgtaccgtgcttatcgagctttagctgaaagatacgatcatgcagctggagaactccgacaggcccataaaaagatggcagaagcatttcctgatgagtttcagttggactttgatgatgacttgcctacagaaactgtaactactgaaactgaagcagacaatcgtgatatgactccatttttcctttcattcatcaaggctggtgattcgaaaaaacgtgctaaaggtatgcccgtgaaatttaattcctcagcaagtgcaatttgcaatatcctgataaatggcagatcaacctaatatattagtgtttcacagaggatcaagaccatgagaagctgcaaaaagagatatcgagtttgtcacaggaaaatcaagaactcaagaagaaaattacatcagtgttagaaaaaggcaatatggctgaatttgaagttctttctctcaaggaggcccttgcagaacaagaagcggagaaggaagctgcattttcacaatgccagcaatccagtgatcgattacagagcctcaagtctgaaatattgcatacccaggaggagttcaataaactgaaagaggagatgcaaaatggactgcaggcttgcagcactgcagaggagaggtgccttctgcttgagacagctaaccagaatttgcttctcgagctagataagctgaagcttgcctcaaaagaaaagcatgacgagctaaatgaaaaacacattgaattggagaagcttagcatctctatacaagaagagcaactcaagagcatgcaagcagaaatggcccggctatctgtggagaagcaattgacacaagcacaggagaagctaagacttatgtctcttgaaaagcatggggaaacaagtaagattgagaacattgaatcaaccagagttcaacttcaaaaggaattagacagtattcgagaagagaaccggaaactggatgatcaaaaccactcctctacctctgtgataatccgtcttcaagatgagataatttctttgaagaatgcacagcggcgtcttgaagaggaggtatctcggcatgtggaggataaaaaggtgcttcagcatgagctttcacacctcaaagatagcaagggtgacatggacaggaagcacttttcgatcaaggagcaaatacaagaggtgaatttcaatgtagaatcactccaatcacttgctcaagaggtgagggatggaaatgttgagctaaaagagaccataaaaaatcatgatggtgtaaaagccttgtacgttgataatctgatgttgctggagagaacgctggagaaaaatgctcatttggagagatcactttcagctgccactaatgaaattgaaggattgcaggagaagaagtctgcattggaagaatcatgtaaacaccttcattccaaggttaatggccatcagtctgagagggccatgtttgttgcacggattgagggtatttctcataccgtagagaagctatcagaaaagaatgtcttcttggaaaatttgttatctgataagaatactgagctggagttgcttagaaggaagctgaaagattcagaggaatctactcatgcattccgcaaccaaaattctgtacttcgatctgaaaaaagaactcttatgcgtgaggtatgatgcttggaatctcttgctttctgtttatttttatgctaattagaaaactatgtaaattgatccctggatacttttatgttgtcaggtggatagcatcaatagtgctctactcagtttggaaacccaatatgcagagttagaagggcgatatttggatcttgagcaagacaaagacaaggccctcaatgaagtgatcaaactacgagacctgttgcccccgcgtccgcccacgcgcccggaagccaccaactcagacatgactaaattcagtgctatacagaagcagataggccttctgctaaaagaagttcaccgcagggaggaccagcttcaagaggaggagcacaggattgttgaagctcagactgaaatttttatcttacagaggtgcttaggtgacatggctgaagcaaatgctgatgtcttggcacaattgcagaagcaacaagtggtatgcaaggatcaagaggagaaagttgatttcttgtcacagaacaaccagcagctgactgaagggataggttctgtagtggaagtactgaatctggatgagaaatacggatcattggatctgatgaagattgatgttgttgtgcagctcctcttgcatgagatcaagtgcctactgaatactatttctgatgctcaggatgtgaagcagaaccagatccttgagaagtcccttgttgtcacgcttctcgagcactttgggcgcgaggtggctgacctgaggtcggaaaggagtgttctgaagcaagagtggcaagcaaagagtggggagctgctgcagctgcagagtgaaaggcatgacctcctaaagaccagctgtgagctacggaaggaaatggaggctcgcaaccgcaaagtggatgaactgaaatctgaggcaaagttcttggttcgacaactgtcggaattgcaagagtcacggcagtcgttgcaagcagagattgtcaagctgattgcagagaactcttcactctctagcaaagtttacagatccagagagaaagagacgtcatttgatgaggatttcagcacacttgttgatgaagcgatcaggacagatattcttggtgtcatttttagaagcctttatgaagagaggacatcacaattgcagcgtttgcatgaggattttgggtctctacatgcagcaggcaatgagctgtatcaggaaatcaagctgatgaacaagaagctcggagacctacagcttgagaacaactatcttgagaaggaactcagtagaactctaagcatctgtgatggctctggtacagaaatttcctccggaagaaggcgtgctatgaggagggacacgaagctattaaaatctggcaggaaaagccaagagggtggccagaacatggaacaacgaaaagaagttgacaatgctggcctcgagaaatcgaacgaaatgcttagagtggagctccagaagttgaaaaatgaactgcaggtccttaaaagcaaggaacagcctgtgattgacgtgaaatcttgtgacgcagagatcactaaactgctggccagcatgcaattggccacagcgaatgcgtctctcttcaaggagaaggtgcttgagctcatcgtgacatgcgagagttttgagatcagtgacatggtgcagaaagaggtgctgaaagaggagatcactcggaggaactcttacgtggatgagctcaaggacaagcttaatgccattgagattgagaacagaaggctgaaggttgatctgaacggcgacttcacactgctcggagcattgcaaactgaagttgatgccctggagaaacaaaccttgtctctagccaaggattgcctaccaccaagcatgctcaagaaggaggagaatccactatcacctcagctgtcaaagattgctgtgaggccaagtgaagatcagaacaccacaaaggtggtgaaggacatggagctgcagaaactccacgggaccatcaaagcacttcagaaagtggtgtcagataccggggtggtcctggagcaagagcggcttgacttcaacagcaacctccaggacgcgaggaagcagatcgagatgctgaagctgaaggagatcctggacagcgacgccagcgacgtgaactacgagcggatgatgaaagacatccagctggacctcgtccatacgcctagccggcgagccgccgcatcctcacacgggcgccacaggaagaagaactcagtagccgcgacggcgcagtctgacgacaacaagatgctcgcgctgtggagcgtggacagggtgagcagcggcagccggcggcacgacatggacctgcggccnncgnagagcgaggctgccgagaccgagaagggaaagaagcggccatcctccgagccagtgccagttgtgaccgtgaaggacctcagcgtggacaagcaggaggtcctctcacggcccacggtgatggcagtggcggcgacggncaccacgactgagccacaccgggagtggaagaagaaggtgatcgaccggctatcctcggaggcgcagcggctccgtgacctccggaccatcgtccaggagctgcgcgccggcgtggaggcgtntcggacgcggagcnggacngngtnaaggcnnanatggccggcgcggagggcgccatcgcggagctggncgacgcgaacgctaagctcctga

SEQ ID NO: 4045 - DNA, 2272 bp, Zea mays
caggatgtgaagcagaaccagatccttgagaagtcccttgttgtcacgcttcttgagcactttgggcgagaggtggctgacctgaggtcggaaaggagtgttctgaagcaagagtggcaagcaaagagtgaggagctgcagcagctgcagagtgaaaggcatgacctcctaaagaccagctgtgagctacggaaggaaatggaggctcgcaaccgcaaagtggatgaactgaaatctgaggcaaagttcttggttcggcaactgtcggaattgcaagagtcacgacaatcgttgcaagcagagattgtcaagctgattgaagagaacacttcactctctagcaaagtttatagctccagagagaaagaaaaggcagtgggtgatgatttcagcacacttattggtgagacgggcaggacagatatccttggtggcatttttagaagccttcatgaagagaggacgtcacaattgcggtgtttgcatgaggattttgggtctctacatgcagcaggcaatgagctttatcaggaaatcaagctgatgaacaagaagctcggagacctacagcttgagaacaactatcttgagaaggaactcagtagaactctaagcatctgtgacggctctggtacagaaatttcctctggaagaaggcgtgctatgaggagagatacaaagctattaaaatctggtaggaaaagccaagagagtggccagaacatggaacagcgaaaagaagttgacaatgctggccttgataaagcgaacgaaatgctgcttagagaggagctccagaagttgaaaaatgagctgcaagtgcttagggccaaagaacagcctgtgatcgatgtgaaatcttgtgacgcggagatcactaaattgctggccaacatgcaattggccacagcgaatgcgtctcttttcaagaagaaggtgcttgagcttgtcatgacatgcgagagttttgagatcagtgacatggtgcagaaggaggtgctgaaagaggagatcaccaggagaaactcttatgtggatgagcttaaggacaagctaaatgccattgagattgagaacagaaggctgaaggttgatctgaacggtgacttcacactgcttggagcattgcaagctgaagttgatgccctagagaaacaaaccttgtctctggccaaggattgcctgccaccaagcatgctcaaggaggaggtattacttattttctgtcccatattctgttgttcggatcattcaggaatctctgatcttggtatttctccttactcacgagactcattgtgcttattgtttttttgccaggagaagccatcatcgcctcagctgtcgaagattgatgtgagcccaagcgaagatgaaaacaccacaaagatggtgaaggacatggaactgcagaaactccacgggaccatcaaagcacttcagaaggtggtgtcagataccggggtggtcctggagcaagagaggctcgacttcaacagcaatcttcaggacgcaagaaagcagatcgagatgctgaagctgaaggagattctggacagcgacgccagcgacgtgaactacgagcggatgatgaaggacatccagctggacctcgtccagactcctagccggcgagctgccgcctcacacgggcgccacaggaagaagaactccgtggctgcggcggcgcagtctgacgacaagatgctcgcgctgtggagcgtagacagggtgagcagcggcagccggtggcatgacgtggacctgcggccgccgcagagcgaggcggccgagaacgacaagggaaagaagcggtcgtcgtccgagccggtggttaccgtgaaggacctcagcgtggacaagcaggaggtcctctcgcggcccatggtgggtgcggtggtggtggcgacgggctccacgacggagccacaccgggagtggaagaagaaggtgatcgaccggctatcctcggaggcgcagcggctccgggacctccggtccatcgtccaggagctccgtgccggcgtggaggcgtcgtcggacgcggagctggacggcgtcaaggcccagatggccgacgcagaggacgctatcgcggagctggccgacgcgaacgcgaagctcctgaagaaggcggaggagttcacgtcggcgggcgacggttgcggcgacgtggacctgcggagccggagccagcgcaagatcctggagcgcgtacgcaagatgtcggagaaggccggtcggctggagctggagctgcaggcatgcaagc

SEQ ID NO: 4046 - DNA, 1822 bp, Zea mays
ttttttttttttttttggcgataagtatatgctatagttaatgatgcagtataaaccctgtgaacatcaagtaccaagtcagcaaccaagcccatttcctgagaactgtgaactaatcactaatcagtactatgcgtatgcagactgctaccaaacaaactctaaaatcagaaagagatcatcttactgttaggagcgtgggctcaagagaaacaaactcccaccacctaggcatctaccgtcttgagactagtgttttccttccagacttctctgtgaaacttgttagcagcaacctctgtctgaatgtatggtatgcctccaagctagtcccagcccacctctggcaaaaacgctcatctgtgggcacaaaggagctcagaggaaatgggccctttggagctttcttcaaggaaaccagaaaacgatggcggggacggattctttgatcaagagacaaactcaggtacataggatatttcgttaaggattggacctcattcttgaggtcattgaccaagtaaagatactttggcttgagattgtcctccaatgacaaagataacacctgagtaagacttgtcaatactttgagaatgtcagagtttctcataccaatgcttctcaggaaatttagtcgaggtaagattccatcttcaatgctgtagtgaagcagctgagggtgttttgtgaccatcttaacaatgctatgtttgggagcatccagttcttttgacaggaaaagcgatcgagatttccatgcactatcaattttctgcaccagaatctgtgggcttagctgcactactttccccacatcactctcctcaatacctacttcctcaatcagataccttactgttggcttcagagactgctccacactgtaagagaacatcgaaggagcagcagaaataatttgccctattcgtctatttggaactccaatgctcacgagaaaatcaacatgagatttcagattgccaagggtgtattccagaatctgtggctgcctcaccagtatccttttcatatctttgcttttaaccccagcatttagcaggaaatccaacctttcttctgctgaagcctgactgatttgaaagcaggccatgtgtctctcatagatgtaagtaaaatgagactcttttagtccaaaggtgcacaagtaatcaatcagtggtaaccatttgtcatcgaagtcatattcttcttgtagtttctggaacagacttcgagagatacttgcatttttcaactcaacttctctgtccatgttcttaagatctgttgatgatcgtcccactttactcctaggatgcatggacttacttcttcctggactaccgtatttgtcatgggttttggtttgtcttccttcccagttttcttttaccattggagtttggagtcctggtttcttgcttgaagcacgagggctgtttgaataaagtacaccaggatattccaaacccgacaagtcatcatcgctctcgtagccctcctcgtcgtcttcatcgtcctcgtcgaactccgcctcctcctcgtcgtcctcgtcgagatcgtagtaggggtcccgagagcggcggacgcggcggttgggcttgaggaggcgcacgttggtctggagcgaaaacgcaacgccgcctgcgcgggcgtgaaggggggtcgcggaagcggaggcaccatgggctggggaagggaggaggatagagggccgtgcggcggcgagcggccgcggcagctggagctgcagcgccatggtgcgagcgagcgggattgcgcgcacggcgcggccttggatatttctttttggggtttt

SEQ ID NO: 4047 - DNA, 3261 bp, Zea mays
tttcatagtaattataacgaaaagacaacgttcgtatggtaaaataccattataatggtaaaatacctatgcctcacatacgtgcccaaatatgcctcacacggtacctaccgtcctgagattactggaacggctatacgaaagagcaaaaataatgttttagggctaatttgggaaccacatttttccaagagtttttcgttttccaaagaaaaattaggttattttcacttgggaaattgaaaattccataggaaaatacggtggccaaactagcctttaaaatggcagatatctaaaataaaaataaaaaaaatcggcgaccatggcctgaggctgagaggcggtgacccagcacaggtttaccgaaacgcccctgcgctgttgaatacatacataccttccctttccaggcctcggctccgtccgtccccaatctcccctttcgtcttctcttcccgctcccgtcccgaaattagcccaccgattagcttgcttgccctagcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcgggggagcgcgccgcggcgcacccggccgcggcgccggcggggagcgtgaagcgcagccgcgtgctgctccagtccgctgggtgcggggcggaggaggacggcgagggggccaggttcacgggcgtgcggccggcggccgtggggccggtgggcggcggagattcgcgacccgctgctccgccgccgcgtctggctcggcactttcgacaccgccgaggaggccgcggcggcctacgtcgcagcgcgcctccgcatccgcgggcccagcaactcgctccctccgcccgagcaccgcccggccttgcccccacgtcccccgccgccacctcagcagcgggagaagaagctgccgctgccgccgccgccgccgcctctccttccgcttccgccgaagaagcagcagtatccgccaccgcctctgcttccgccgaagaagcagctgtatccgccaccgcttcccctcctcccaccaaagaagcagcagcagcatcaccatcacccgtcaccgcctctgcccacgcttccgccgaagaagcggctgccgtcgccgcctctgctgcgcgaaagcaagaagcagtgcgtcgcctcctccccagcggagccgcgtttcatgccgctgccggtgtgggcgctgatgtccggctccgggaagcgcaagaagcggtcgggctgtggcgggcgcgtccccgccctccacacccccgccgccgaggagacggggcgcgcctgagaaggctgagacgactgggacctccctgcttctggtatccatcccctaccgcttcttgatcatgccatgccaatctgaattgccgctcaatcggtgctgatgtgaagagcctgtaacctctctgattcatgaactgatgaatttgtgtacatatgctgctgctgctgctgctggaaccgcagcgggtgatgaactgatctgtaaaacccgacgtattattcatatgtaataaataagtatctgttgacaatttcgatccgaacaagtctagttgctgtggagattgcaagattgctgccacagttgctcccttagttttgacgatggcagtgaaagtaacggctgcggttccgcctctttgttaaagactttgggtgtgtaggtaggagtgccatgacccatcgagcggcagagcagagcgagcacacgtgcaggctttacattttttttttcagtgcacgctcactggcagcagagtatctacgtccaacaaacgtcgttgcgtgccaggggtcagagcggaaaagggcaaaaaaagcagttgccgttgccggtacaacatacgaaatactgtccctagactaaagctccaatagttagcacatacaaacatgagacggtgtaacggttttctaagtgcaaaaaacaataaaaaacaacatggtgtaactctgagtttctaaatcataaacgcatctaaaagataaatcataaacacatctaaaagacaatgcgtatagagaatcgtatagagacacgggttcttcgagaattgtattttttgcaattaaccgcttagagagacctcgaggttgtacatgtccttatgtaaattttagctttacaattatagatttagaaaattgctaaataactttagaagtaaaaagttataaattctctaacatatctctaaatatatgttatagtttggttttgaatttactacttttattttgattggatgtgtcacaagacattcggttgactggagttacatcggcggtagaagacctagcatatggatctcgctgaatccatgcacgatgagacgatccatttgctgaaggtaaatcacgccaacatatatcctttgtttatatatatattatgcaatgactagtgcgatcgtctcacgtaaacacatcgccgaaacatatatcctttgtttggggtggcgccgtaaacatggctttctctaccgtcgtgtgagtcgtgaatgtgaaaagagtgacgaaataaaagattgccagattgccgtcattcttttggtggttcagaagttggttaaaggttgccacttgttgggaggaaatatgttagatgagaagtagctaaatctaggtagtttatttggagagaagtttttagcataactacctaaactattgatgtagggagtattttagagaaatatcggagttgctctattttcagcactatatactccttaatatttctcaataaatcaacacttttaactcgaattacttgcatacaaacaattcatgctccgcatgttctcccatgctctttatttcgttcttcttgttagggatggattcagatcgaatacgcatggaaacgaatccggatgtcactatttaacgtattttaattcgaataagaatattatcgaatacatatatgaatacaaatattatcagatactaatacaaaccggacagttcgaattcatattcacatccgaatacttacttgatttaaaatatatcataataacaagtattattttgttttatcgatgcatttatagttggtaaaaatc

SEQ ID NO: 4048 - DNA, 1644 bp, Zea mays
taccctcgcaggcctgccgggagtctcccacccgcccaggccagcgcccctctttctctttgtgatgtgggcggcatgcactgcacgatagcgacgtggcgcgcccatccaattccgtgagcccatccagttcgtgttcgcgtaagaataacggcagccagccacagcccacaggcccccaaggactctcgtcgctcgcctttcccccaactttctccccccgctcggccatacggccactcgcctcgcctcgctgaaaccaatcgcctcttctctccctctccctctccctccaatgcttcccaccgatcgctcctgaagcggctcaactgctccagattttctcgaggctgaaattttggtgtccttgctcagccatgggtagtaggagatatgacattgatacgaggagatgtgggatccactcaagaccaaccaaatcaatgtatctggatgctcaacaaatcgtcagctgccaaactagagtgggagaccacgatgttggttcctgtgctgtgaagcatcacttcccgtctccaatcgtatcttggatagaagatctttccagctttggcaatgcttcttttaatcctgtctctgaatatgtggatgagcaagccagagcttcagtgggacagtcttcagcatcaagtaatttgcatgacatgcaaatatcagtgagattgacagccgaattcatggagcttgcaaaggagaatacaagcaataatctagagacttgtggaattcttggtgcttcatttagggatggaacttattttgtcacgatgttgattataccaaagcaagaaggaactgctcactcatgtcaggctgttagtgaggaggagatacatgccgtgttatcagagcagtcactttatcctgcagggtggattcatactcatccttcacaaacatgctttctatcatcgatcgacttgcatactcaatactcttaccaggttatgttaccagaggctgttgcaattgtggtcgcacccacagatccaaccaggagttacggaatattcaggctgactgaacctggagggatggatgttcttagggagtgtgacgaaagtgggttccacactcaccgagagacaaccaacggcagcccaatctatgaaacctgctcgaaagtgcacttcaatcccaacttgcggtttgagattgtcgacctgcgctcggctcaatgatcaatgggactaaagctatggcagcacgtgctcccttgtgctccctcttggcagaagtatataccatagagcttgctgacgatgcgtgataggtatagtgacagcgccaagccggaaccaagatgctcatgttacttatctgacatctgcgctggtatttgtcaaagaaaaggagtaactgaaaactagcactggttatcttgtctgttcggccagcctttgagttggtattttaagtaatactgtatataacatacaactggggcaaaacacacacacacactattaacttggtctgggatgtgattgtaacgtagcgcaatagcgcttgactgtttctgtggcactgccaatttacttactaattgtcagtgactggagtatgaagaaatacattaatttggcagttccttactgaaaaaaaaaaaaaaaaaggccccta

SEQ ID NO: 4049 - DNA, 2896 bp, Zea mays
acaaatttcgacagggtcgacattacatttgtagtgaacttactaggttcacataacattgctcctaccaaacgtcgttagacgcggagtaaaacatattctcggatatgttaattatacaagagatcttagattattttttcaagctatttatctgatccccataatggttgatcctatatagactatgtgttgttacatagaggaacaaccacatagaaattttcaaaacaaactttagtgtctacctcaacaaaattattcagagacaattgactatatgaggcatcatgtaaatgtgtttagcttcacagaacggtaaactacatacaacaatcatgttggattgaaactattaattcacaactaattatctatgaaataattctacttatgttactcagatgaaaacaacaacataaaccatggtgcgttgatactatgaattcaccaaacatgttttttaaattgttttatccccatgagttaaaataaatgggtggcagaactgtaatgggatgatctcatcctaccagctgcgtgcagatcttgggaaccggcgccttggaatccttggtgtggtccgttcaatgatgaatggaaatctctctctagttcatccacatttacattatatactactattccacacaattacattacacacagtttcgcagctggttcctttgagatcgcattcgctgttcacttggcttccgtcagcccagcctgcttcgccgtggcggttgcggcgctcccgcagcccgcgacccccggcgggaagttgagcagcgccttggctccgcgcatgcggaccgcggcgcggtcctacgcggcggctgcctcctcggccgtggcgaaggtgccgagccagagccgcgccccgtgccgcgccgggtcacggatctccgcggcgtacttgccccacggccgccgcctcaccccgcggtagtggcgccccgccgtggccgccttcggtgcgtacgcggtcctgctgcccctgcgcgcggctccggaagcgagcgccttcagcgtaggcagcgacgagggcggctggtaggtggcgggcgccgcggcggaggtggaggcggagccggatgcctcgcggagcacgtcgaagaggaccatgtccagggagtcgtcctcgttgaggggcaggtactggctgtgcccgtgcgccgccgctgcgccgggcagggagagcgacgcgcccgcgcccgcgcgtggatacggcgcactggcgccactggtcgccggaggcgcgggcgtggcgacgtcgcggaccacgctgctgcttcgctccaaggagagagacatgtttttcgatttggctgtccctgcgcacgctcgcgggcctggtcgtgtggccagagcatgagacgacacgcactgagagtgccttgttgttaacgacctgtggtggagactggaggaagctgtggctgcgctatttgagttggaggaattggccgatgacatgtgattgatagcatataatataataatataataaagcacgcagaatgcgaattggcagccatctctcccttttctagttgttatatcatattagccacagtggggcgcgcggcggcttaaatggctcatgccgttggatcgttcagtttactaaggattgtttgggagcaagtggaatggaggagtccctcgctatttaaaattgaatagtaggagattctagccccctcaatcccctctattacctttgcttccaaacaagctctaattgtggcacgacaagaaaaacacggtagaataagtataaaccgttggatcattcagtttattagaattgtttgcttcaaattaaaattagttgtttgaacagttgtagctttaatctataaagataaaaacactgaagcagtagaagccagtacgaattagggtcaagtaaacaggtagttaatttttatggtgctcgtgccacattgacggaacgtggacaatggtgcgccatccgccataggcgtctcagtttcttggggcaaaggcaacgcaacgcaggaggcaaactggccaactaaaagtatcatcgtaatggaagatgctctgacaaaagtagctgcagtcgcagtcgctagtttggccacgtctcctcagtcctggccatgcatcttctgtgacaaaaaaaaaaaaaaaactcgctttcatcacgctctgaacagatgtgttaattagccactagagtaattacaacgtttggggggtccttcttctagagagttttgttaattaacttgcgatttgttgagcaagaggtcgagaagatatttgtctacaatactgtgcgctgctcttcttgcaacagtaaaatccacatgcgcttcgggtgatccactaactctcggtttccaccaagtcatataggtgatatatattaatcacaagcaagactaagaaacactaactctcacttgaactaatcaagtctaccgtaagatcaataacagggaccttggttcacagtagtcgacttggcgaagtgcaatgaacaatgtctatttcattagaaaaacaataatcaaacctcaagccgggcatcaccccctggacacgcctaataggctctaacagaatatacagctcaattgactgagtctgtatgtgtcctgagggtcgattttacctcatattgctcttgtaatctgagatagactttaacttaaattggactaacctccgccatggtataggtgagttgtatgtccatgctggtcctcttgtctccttacctttggtttgtattttaaggagtggtgttcttattagacataatgcattttttgttgattggatgtgtattgaatttaatgttggaatttgggggtgtgtcgaggtttggatgtacattgaattgcgagttggaactgca

SEQ ID NO: 4050 - DNA, 2329 bp, Zea mays
ctcgagccgcaaggagtttgaggagatgtctgagcagtacgtggccgtcacgacgaaggagaagaggagaagggcatgctatcgctgtgggaagaggaaatgggagagcaaggagtcgtgccttgtttgcgctgcaaggtattgcggctattgcgtccttaggatgatggggtcaatgccagaagggcgctagtgtgtcaactgcatcggccagccaatcgatgaatccaaaaggtcgaagctggggaagaactccaggacgctttcgcggttgctcagcccgttggaagttcggcaaatcttgaaagctgagaaggagtgccaagcgaatcagcttcggccagagcagcttattgtcaatggttgcccattgcggccagaggagttaaccgacctgctaagttgctcacggcctcctcagaagctaaagccaggaaaatattggtatgacaaggagtcaggcttatggggaaaggaaggagaaaaaccagacaggattattagctccaacctcaattttactgggaagcttcaggtcaatgctagtaacggaaacacccaggtttatatgaacggaagggagataacaaagattgagctgaaagttctgaaggttgcaaatgttcagtgtccccgtgacactcatttttgggtttatgacgatggtcgttatgaggaagaaggtcaaaacaacataaaaggaaaaatatgggaatcagctctggcacgttttgcatgcgcattattttcactgccggtgcctccggggaactcaaatggaaccagagatgaagttccatatacagcaagagctgtccctgattatttggaccaaaaaagaatacaaaagctgctgcttcttggaccacctggtgctggtacgagcactatttttaagcaggctaaatacttgtacgggactaggttcacccaagaagaacttgaaggtatcaaactgatgatccaaagcaatatgttcaagtatcttgggattttgctagagggccgcgagcgttttgaggaagaggctttgtctagattgaattacacgatttctcagggtgaagaaactcagcatgatgaaaataaagccaatggatcaaattcttgtatatactccataaatgcgaggctaaagaaattttcagattggcttttggatatcatagcaatgggcgacctagatgcattcttccctgctgcaacgcgtgaatatgctccgtttgttgatgagatgtggaaggaccccgccatacaagcaacatttaaaagaaaggaagaattgcattttctccctgatgtggctgagcacttcttgagcagggccgttgaggtgtcaagcaatgagtatgaaccttcagagaaagatgtaatcttcgctgaaggagtaacacaaggaaatgggctagccttcatcgagttcacacttgatgatcgcagcccaatgtctgaaccttatatcgacaacagtgaggcacattcgcagcctctcaccaaatatcagctgatcagagtcagtgcaaaaggcatgaatgatggctgcaaatgggtggaaatgtttgaagatgtccgcatggtaatattctgtgtagcactcagtgactatgaccaattgggaccccctgtaagtggcagcagtcggcctcttgtgaacaaaatgatgcaaagcaaagagttgtttgaggctacaatccggcagccatgcttctgcgatactccatttgttctggttctgaacaagtacgaccttttcgaggagaagatcaaccgcgcgcccctctctagctgcgagtggttcaacgacttctgcccggtgcggacgcaccacaacaaccagtcgctggctcatcaggcatactactacgtggccatgaagttcaaggacctgtactctgcgcagacgaaccggaagcttttcgtgtggcaggcccgtgcccgtgagcgccagactgtggacgaagcattcaagtacattagggaggttctcaagtgggaggaggagaaggatgacaactgctaccaggaggaatccttctacagcacgactgagatgagctcctccccgttcatcagagcggaatgagatttttttgtttttgttttagctgatcaaatcaatcactgataatcagtgtatattgattgtctaattgatttgcttattcgtatcctagttggtattggttgtgtgtattttagaactaaggctgggctggcatataagaatcgagtgtccatgcattgtatgtaccagtactaatttaattttatccagctggttaaaatgtactccaaaaaaaaaaaaaaatcgagaaaaaaaaaaaaaaaa

SEQ ID NO: 4051 - DNA, 3172 bp, Zea mays
  misc_feature (492)..(492): n is a, c, g, or t
ggatttaagtaacgtggggtgttcatataaaatactacgggagtaataacacatatccaaaacatgtgttatccaaaacaggtgttcgctcaaacaaaaaatccgataaaaaaggttactgattgtattgtgttatccaaaacatgtgaatttgtgtttttgtgatatttgtaaactttgttgtattgtgatattttcatattgatatggttaccgattgtattttagattccgaccgataccgatgttttttttaccgaacttccgttttcgatgattccaaaataccgatgtcgtttccgtttccggaattaccgtttccaatttcgtttccgataaaaaatatgaaaacggtaacagttttaatgttttccgatcgtttccgaccgtttttatccctattacaggccactcacgcacacagactaggcctatgaccccacattgtccttagggcttatgcccataacaaatggccagccatcaatgccnccgcttgccgagcaagaaggcagactagatggagtattgggccgcaagtaaaaatgggcctgcaagtccagcgtgctgcacggttagacgaggagcagcctatgccggccctaaacccgtgtccccctcgtttccgctcttctgctcctcgcgccgccgcagcgacccgacgacaggtaatggcttccgccgcggtgctccggaacgccggatctcgccgcctcttctcctaccccaccctccgtgctgctgcaatctcgggacccgccgtgctaccagatgcgcccgtggcggcgtcggtggcggcccagccgcccccgctggcctggacactctgggcgatgtccatggccaccttcacacgcacgtgagtactccttggttcagattcgttccatgcacactacactgttcgaagctatccattttcatggattcctttgcttcgtgtgattcacattccaacccggatcaatctgcgcaggaagccccatgtgaacgtcggcacccttgggcacgtcgatcacggcaaaaccagtctcactgccgctattaccaaggttcggtgcgttagacatgatcatccttcaattatgatggctattccactccgattagggatactaattttgttttccctggattacttggtcgatcaaaacacaccaagctgaatttgcagggagtatttaagtgtctagagtaactatttacatggacctcggcactttgtttcagggaatatcaactacaaggaatttgcttgcagatgatgctatggtgcctatctcctctcctttgactcctccactaggtgacagtgaagaaactgacaaaaagggggctgtggtaaaacgcctaaaggtccaagccataaaaaaagatatcaaacaggtaaaccaacactgcagaaccagttattattttgcttgtatgaaacagctatcaatttgctatttgaattgacagcatatctatgaatgtgtagacaatcataaattagctgtacttggctattttatgcatgtgtgtttctctggaatagtgaattatggcttcgtgagatttcaatgcttccgtaatacaaattcctaaactgctgttgctgagtgcttgtttgtacaaattcggctcagattgaattactaaacacttgataatgatactaagcatatatagtgacaaagatagtgtttggtttaagtaatcattccattcaaaatgaggtggtgcatcatagatccattcatcaaatttggtgggatgactccattcctcatattagtattaactaattaactcattcctcaaaccaaacaccctaaaagaggaggaacgctgtacagatttcattaactcgtatattgggcattctgtaatctattgtcatcaagagatctatgcatcttatgtttctgaagccttctggctattttagagtcccaagaaggtgaatctagtagcaaagctggttcgaggtatgcgtgtagaagatgcccccctgcagctgcaagtgactgttaaaagggctgccaaaaccgtttaccaggtccgtgcttgtggaactcttaaccattcaactgtttcctatgatagcgcaaaatgaccgaggacacatgtcatggccatttcatcttacaaattaattactgcaggtgatccattctgctcgggccaatgcatctcacaaccatggattggatcctgataagctcattgttggtaaggcttctaacaaagcaaggtccatcccctactttttgtttggttataatctaatcagcttggtgctattcataacaaccgcagaggaggcctttgtgggaaagggacttttcctgaagagagtgtcttaccatgccagagggaggtccggcattatggtgcgaccaaggtgcagactgacagtggtggttagagaagctacagctgaggaggaggcaaagatcgccaaactcagggtgagcaactacaagaagctgaccaggaaggagcagcagcttatgcctcacaggctcatcgaggttagcccgaggtggattcgcaagaggaaagcggaggctggtgctacggcgtagtactttatgtatgcagaacctgcattcactgctttgcacatccgaggagcgaacatgccttccctggcacaaatacttgatcctctctcggtgtcgattcacgcaaacgggttacaaagctaggcttggtttgttttgctctaaatccatgtggattggatgtgtttaaatcgcaaacaagtcaaaatcctttataagtttttctaatctcatcaaatccacatgggatagagaataatcgaacaagaccgtaggtggattcgactatttggtaatcttggtcgtttggagtctaggaagagaggaaaatgctatgtattttagcgatgtgcattgtagccaactaaaacctcgccaaagcattggatgtgcatgagacacgtaccattgcttctacaatttcatgcaactattggtttcagctggtttcaatgctttgtctagtgcgcattgtacaagaagactacaaatggtggtaagctgtagttccatgcagctggaaagacgctaaggtgtacaggaccgaaccgcagcaggaccagcatatgccatgatatctcccgttcccacatctcaggttagaactttacatacaatttttc

SEQ ID NO: 4052 - DNA, 1472 bp, Zea mays
cattgggtacctcgaggccggccgggacggttagacgaggagcagcctcggccccccccaaacccgtgtccccctcgtttccgctcttctgctcctcgcgccgccgcagcgacccgacgacaggtaatggcttccgccgcggtgctccggaacgccggatctcgccgcctcttctcctaccccaccctccgtgctgctgcaatctcgggacccgccgtgctaccagatgcgcccgtggcggcgtcggtggcggcccagccgcccccgctggcctggacactctgggcgatgtccatggccaccttcacacgcacgaagccccatgtgaacgtcggcacccttgggcacgtcgatcacggcaaaaccagtctcactgccgctattaccaagggaatatcaactacaaggaatttgcttgcagatgatgctatggtgcctatctcctctcctttgactcctccactaggtgacagtgaagaaactgacaaaaagggggctgtggtaaaacgcctaaaggtccaagccataaaaaaagatatcaaacagagtcccaagaaggtgaatctagtagcaaagctggttcgaggtatgcgtgtagaagatgccctactgcagctgcaagtgactgttaaaagggctgccaaaaccgtttaccaggtgatccattctgctcgggccaatgcatctcacaaccatggattggatcctgataagctcattgttgaggaggcctttgtgggaaagggacttttcctgaagagagtgtcttaccatgccagagggaggtccggcattatggtgcgaccaaggtgcagactgacagtggtggttagagaagctacagctgaggaggaggcaaagatcgccaaactcagggtgagcaactacaagaagctgaccaggaaggagcagcagcttatgcctcacaggctcatcgaggttagcccgaggtggattcgcaagaggaaagcggaggctggtgctacggcgtagtactttatgtatgcagaacctgcattcactgctttgcacatccgaggagcgaacatgccttccctggcacaaatacttgatcctctctcggtgtcgattcacgcaaacgggttacaaagccaggcttgttcgttttgctctcaatccatgtggattggatgtgtttaaatcgcaaacaagtcaaaatcttttataagtttttctaatctcatcaaatccacatgggatagagaataatcgaacaagaccgtaggtggattcgactatttggtaatcttggtcgtttggagtctaggaagagaggaaaatgctatgtatttcagcgatgtgcattgtagccaactaaaacctcgccaaagcattggatgtgcatgagacacgtaccattgcttctacaatttcatgcaactattggtttcagctggtttcaagaaaaaaaaaaaaaaaaaaaaaaaaaaaaaaaaaaaaaaaaaaaaaaa

SEQ ID NO: 4053 - DNA, 602 bp, Zea mays
ttttttttttttttttgcttcacagctgcgctttatttgctagtagctagcggtggaagaagaagaagcaatctataagctagtacatagtactcctactacggtagtaacaacattcttggatccaatccatcgacgttaacatgcataaaaaaaagaaaagactactagaaagggcagcagcaattaattaactaaaacacacaagagctatagctgctagccagcttaattagctaatactaaaaatatatgtgatgcgttactgccggccggctggcagcttgccgttgccgccgcggaggaagtgcagcagcacggggctcttgcaccgcgggcacttgggctgctgctcctccccggacaccatcacgtacatgaggcactgcgggcaccccaccaccaccatcggcttcggcgccaccgcctgctgtacctcgtcctccgcgtccgacgacacgcacgagctcgccggcgactcggccgccgacccgccgccggacatcgtcgtcgtcggcctcttgccctgcttgctcatgcacgcacggttacctagctacctagccagccagtcacagacgacggggattttgttgttaaag

SEQ ID NO: 4054 - DNA, 5228 bp, Zea mays
taggaggacgagggagggatccagcgagcggagcggagcggacgccaccctcgcgcgcacacctacgcgcaggcgcatacaccaacgacgccgaccccttccagggagggagggagggaaccacacaaccggacccgacccgacgccccgaggcgagggcgagggcgagggcgagcggtcagccggccggggcggggaccaggggggatcccctcggcggcgtcggcgtcggcggccatgggcgcggcctccccggcgatgtgggccgggctggtcctggtggtgttattggccgcatcgggccccgcggcggcggggctgccgaggttcgccgaggcgcccgagtacaggaacggggacgggtgcccggccccggtgacgggcgcgggggtctgcgacccgggcctggtgcacatcgccatgacgctcgacgcgcactacctcaggggctccatggcggccatctactcgctgctcaagcacgcctcctgcccggagtccatcttcttccacttcctcgccgcggagggcggcggcgcgccggccgtggccgagctccgggccgccgtggccgcctccttcccgtccctgcgcttcgagatctacccgttccgcgccgacgcggtcgccgggctcatctccgcgtccgtgcgcgccgcgctcgaggcgccgctcaactacgcgcgcaaccacctcgccgacctgctcccgcgctgcgtgccgcgcgcgatatacctcgactccgacgtgctcgccgtcgacgacgtgcggcgcctctgggagacgcgcctgcccgccgccgcggtcgtcgccgcgcccgagtactgccacgccaacttctcccgctacttcaccgaggccttctgggacgaccccgtcctcggcgccagggtctttgccggccgccgccgcgcgccctgctacttcaacaccggcgtcatggtcatcgacctccggaggtggcgcgttggcaactaccgccagcgcatcgagcgctggatggagatgcagaaggagaaaagaatctacgagcttggctccttgccccccttcctgctcgtcttcgccggcgagatagaggccgtcgaccaccggtggaaccagcacggcctgggcggcgacaacgtcttcggcagctgccgccctctccataacgggcccgtcagcctgatgcactggtccgggaagggcaagccatgggaccgtctcgacgccggcaagccttgccccctcgaccacacctggaagtcgtacgacctctacattggcgagaatgattcttcaccagcatcagggccgtcccggtcagccttgtcatcgttggtggcatggtagaagttcatatacacaataattctttgatctcgggtgcccgtggttcttggccggtaatggaattgccttgcgatgcattcccactgccggctgccgccacagctgctgccgcaagccagctgccgccttcggctgtacaggacagtgaggggaggggcggtatacagattgcagcaggagcagcagcagcagcaagggggtgaagacagtgaatagcgggggggagcaaattcttgttcgttttgcactatgattgagattgattcattaggctctggtttggaggctgtgactatcatgggatggaaggaattacttggttggtggtgtacaattcttggataggacaaaggtttcggttttttggtgtattagttcagaattgtttcatttacatgtctattcagtacactcgtgtaatacggattaaattgatttgaaacaaattgagtgcatcctggtcgtgtacctgtgctgtaatcctgctctctttgtgactttcgtcatccagaatgtcctgccaattgctctcttggttgccatgtttattgtctatgtagggattctaggatagcacaatggtttgctgttctggttttgcgtattatgctcagcaagaatggcctaattcattgttgagagtccttgccatccttactccatccagaatggcctaacatgctgtgctcctgccattgttggtactgtctgtctgctgttattagttctacaccatttggttaacaagctttagctaatgtctgattcctgtgttcacctgttgttgaacttgaaatgctgtttcctgtgtactcgaacttcacaatgcttccaagatgggatgactgaatttgatttgactcgtgagctgtgcctaatagcgtttcttcagcgttacacatatgcaggggcatcagtgagtttaaaagagcactagacctttacaggtgggtgtgcaccaagagagagctgcaaagaaagggaaaaaaatagcaataatattgaagttagttaggatgaactttttatatcgcaagaaggtggacgcgtaagacggggacttctcaacggactcataatacagtgttaatacagcctctaatcctccaactaacgccacctaaatgtgcacaaagccggagaggcagataacctctctttaaattatcagtcacgggcgacggaatctttgaaagcagaccgcaggcaggaacgcagtaggaaaggaaactatatcatttgaatcctgacatgagcatcagagttataaaggctgttttctgaaatcgcggcagctgcatcagcgtcccaaattatgttcattggtgattggtgaggctgaaaatgaaatgaaatgaaatgcagcggccgaatgggcatcctccacgcgcagtgagccagcgacatctctctctctccctggcgataacttgagcaggtgcaggctttttgcagctggactggacctgtacatcttgctttcactacagaccacacagcaatagctgtgatcatgatatataggattctgaaaaacaatacaaaacaaatcaaatcaaatcactctcctaaatatcatggtcccatgcggtgatactgcgcggggagaaactgtggccactacttccaaatcggacggctcttggtgcacgatgtccgttcccccacatcgcttggcatgctggcaggggtgtaaggctacgccacacacacagctgcacaggctggaagctggcagtgaccaggctggagaggtggaaacgcaaggcaagtgcaactaatgattgcctgtattcgttcatcctgcttggccactgcgcttttcatatttcgttttttttttggctaaaagctgtctacagcagcttacctatcatatctcttatctcgtcttcatcttaaatttcatcatgtaaataatacaatctacaatataaaagatgttgttttacatgatttttattagggccaaatggtccatctcggtatcacccttgtgagtgcgatgaactccatccccactcccccacacacactggtggtcatcaaccaccctacgccattgtattcaattcctttcacatgcttcatgcccgtacgtactcccgggcggacaagagcacgagttcttttaggccggctggacagtgccatctgccatgccatgccaatgatgggcactggccaacggcatcgccctgtgatgtttagaagatcgccgtcgctcgatcgccttgtggttcatgcatgcacgtcaggcaggcggccagcccacccacccctcctggaagctaccggtctctcgttccagcccctattacgtacgggcaggtccggtacggttggtgtggtgccgccgcggcgtcggccggccaccaccggctccaactttaccaagcccgtgtcatcgagaggacgcggagcacgtcgtcggaagttttcggagcgccgggtcgcggtcgtggcgatccgcatccgctggcccgagcgagctctttcaggttcaccatcgacgtgatgtgttgggccagtgctggggactgctttaattcttggaagaaagtgatggcgtttggtgatcgtttggagcctagcatttgcgccgagtagaaaagcgtttaggctgctgcaggttttgataggggatgattgatatggttcgtgcattgcagagagacgcatggcatggcagtaggagatagcgccaatggcatagaaggacaagagagcagcctgttttttttttattcgatgaaaaggtggaacaacacttgaaagtaagccgtaataatcgtcacgggatcaagccaaaacactaggtgtgtttggttgcgggacaactagggacaaccaggatagagacgtcctctaacatcctcttttgtccctccaattttgagggacaactggagacaacactgtgataatcatattccaatccttaattctgaatcaaacaaccttatttgagaaataattctatcctatcatgttctatcattgcaaccaaacgcatcctaagaccctcacatggcgacctccccaaaacccggaggtatacttcctattctatgtttttctagtggctgtagtttactaactaaggtcatagatagctaatattggtatcagagtcatagttttggattaaggctctaaccctagatactagaatctcttcgattttaagtagaatctgagtaaatgctctcacaagtctcgagtttgtgttgctatctcgttagaacaacaagtacaagaagaggagaaagaaaccctaacccttgcatgctctaaatccccacccaagtagatagaggaagcagaagaatctctcggaacttaccttggttatcggtgacgtgggtcacaggaagaggaggtgcgtccgccggtctctcagaacttacctttgatgtgctctcgaatcctgaccatggtctcttgggctctagcattagggctatacctcggccatcaaaatcactggagatgaaccacctggtggtgctctctacgggagcgcggacggtccgcggcatagaatcgaacggtccgcgaccttggtgcaggagttgtttcctccctacacgctttcggatggtctgtgactggcgcataggtcttcttcgtaggaaactcatatctcgcctccaaggagggaccccgtcggagaggagacatcctaggtgtgtcttagggtcgttaagccacccaagacgtctctagacgacgccgggacgaatagagatgaagaaataggtcgaggaagactaatactaaagctaaactaaggatagattactcatattcctaaggaatggaaagaacaatgcaaataagataaatttgttaagtatgtttgattggatcgattgtgggggctcaatcag

SEQ ID NO: 4055 - DNA, 3396 bp, Zea mays
tttggagttatttataacccgaactcagacatatgatgtctcttgcatattttaagtgttgaaggaacatatttgagggtgacgaagcacctttgcctagtgagagaattaagagttgataatcatttgattagcgatctcattagtgcattaagagtagcttatgtgcattcaccactctcattagacttgatcagatcaagtgagagttagtgcttgttactcttggtagttagcatcacctagacaacttggtggcgagagttcgatgagcattcaaatagattatgggtgacccaactaaagggtgtacccagttgtgagcaattcatcatgtctgagaggcaaagaacctactaatagagagacacatgttccttgcgtggatcaaggatgagcgacacccttgtgcaggtgctccaataagaactagcagaaagtgttgtctctctagtgcctaggcaaaacattgagacatttctaattcttcctttatattgacatgtacatttgagaaattatagttaagtatttactttactagaattgccatattagtatagattggaacttagggtgtaaattttttgattgataaataaaaatacttttaagtacaaggaatgaagttaagtttcttaatagttttttagtttatgcaagaaaatttagagaatcacaattcatcgtctcccatgcatattgattccttcgatttgaaatgattttcattctcaattaatacaatgcataccaacaaacttgtcgacttggctgcttgtaaagagacagagagttttatagagtttcatccttagaaaagtcataactcagaaactactaagtgatttctatagctgccacctcactaaaaatcacgtataaaaactataagttccaatgctattttcttgttgtggtatcgtaataaatgtgggtatgacgacgtagctagtgaggtgcgtgtgagctccacagatagaaacaggatgctcatccccaacaccaaaacaataatattttttgtgttcgttgcacatgtagacctgatttcgtacgaaagaaatgattttctcatctttctcattaattttttttgccatgtcaccaagttgcttatatggcagctaaattaatgctatagaaactagataacatgaagggttgagactgctcttactatcctcatcgttacagttacccacacaaaaattattttactgtcccaataaatgtcataaaactctactgaaactaaactgaatttccaaacaggagtgctaccaaaatgtatattatctccagctatatgcagtcatgcttttgaagttagcgtaataagcaccttacccgaccatcctaccactaacactagatttaacacaaatgcaggtacaattgttgttcaatcacagcatgcaacagctacccagacttcaagaggcaccaaaaaaacagaaaacaaacagcacagtgctcaagcggcacaactggaagccaacacatccacacaccagaccaaaatcaacgcgcttccccaaacacgcacgggacgccctccagtccccctccgtttatcgctaacgccacccgtttttgtacacacacggctacagcagcggccaatatacttccgcctcgcccgccgcgacgcacccaccactctccccccccccccagtccccactactgctactgcgagacagcgcagcacaggctgccgcccgctggccgctgcgagcagagagaatccaagaacgcgcaagagcccccctcgtcaccaccgtccatgggcggcgctgcgggcgaggcgatgtgggccgctgttgtggcggcgacggtggtcttcttggccgtcgaggtttcgggtgccgcgtcggcgttgccacggtttgcggaggcgcctgagtaccggaacggggaagggtgtccggctgcggcggcgggggtgtgcgacccgggcttggtgcacatcgccatgacgctcgacgcgcactacctgcggggctccatggcggcggtgtactcgctgctcaagcacgcgtcctgcccggagtccatcttcttccacttcttggccgcggaggccggggcagtggacggggcggacccggagccggagctgctgcggcgcgcggtggcggcgtcgttcccgtcgctgcggttcgagatctacccgttccgcgccgaggccgtggccgggctcatctcggcgtccgtgcgcgccgcgctcgaggcgccgctcaactacgcgcggaaccacctagcggacctgctcccgcgctgcgtgccgcgggcgatatacctcgactccgacgtgctcgccgccgacgacgtgaggcggctctgggagacgcgcctccccgccgccgccgtggtggcggcgcccgagtactgccacgccaacttctcccgctacttcacgccagcgttctggtcagacccggtgctcggggcccgcgtcttcgccgggcgccgccggccgccgtgctacttcaacaccggcgtcatggtcatcgacctccgccgctggcgcgccggcaattaccgccaacgcatcgagcgctggatggaaatccagaagcagaagcgcatctacgagctgggctccctgcccccgttcttgctcgtcttcgccggtgaggtcgaggccgtcgaccaccgatggaaccagcacggcctcggcggcaacaacgtccacggtagctgccgcccgctccacgctgggcccgtcagcctcatgcactggtcgggcaagggcaagccctgggaccgcctcgacgccggcaggccgtgcccgctcgaccacacctggaagtcgtacgacctctacatccccggcgactctggaggcgccgcctcgccggcgtccgggccggcattgtccgcatccgtgttctcttggtagagagatagcttctagttccattgtcttgctgtggctgttgccgccgctgctatgatctagctgccgctcgtggtgggctgtacagggcggcgttgggagcggcggtggcgacatgacaggggaaatcaggaatgagttgatagagaagggggagcctttgccctcgggggtagaattcagataagttattggggagagattttgattctttttggtcgggctggtgattcttgggttcccaattctctcgattggatgttgtaaagacttggaattttgttcaattattgatcattctttcattcatgtgccatgccttcttgacctgaatccttttgccccttttttttacctttattacattagatgaactaacctaactgtactgaaatgcgcttgtatatgagttctctgccagtttgagacaggcttatctcccctgcaaaaaaaaaaaaaaaaaaaaaaaaaaaaaaaaaaaaaaaaaaaca

SEQ ID NO: 4056 - DNA, 3780 bp, Zea mays
atgagtccgtctcgacagtgaccggacctcttcgttagggttgaccgcctcttctctccgtctgcctgtgctactactagggttagggctccggcaaggcctccctcgcgccggcggcgtcagcagcggatatgggtgttccggcgttctaccgatggctggcggagaagtacccgatggtggtggtggacgtggtggaggaggagcccgtagagatcgagggcgtcaaggtgcccgtcgacacctccaagcccaaccccaacagcctcgagttcgacaacctctacctcgatatgaacggaatcatacacccctgcttccacccggaggacaggccctccccaacaacatttggtgaggttttccagtgcatgtttgattatatcgacagactattcgtcatggttcgcccccggaggcttttgtacatggccattgatggtgttgctcctcgtgctaagatgaatcagcagcgctcaagacgattcagggctgcaaaagatgcagctgatgcggctgcagaagaagaacggttacgtgaagagtttgagagggaaggcagaaagcttcctccaaagcagcaatcacaaacatgtgattcaaatgttattactccagggactgaatttatggctgttttatcagttgctttgcagtattacatccatcgtagattgaattatgatcctggatggaaacaaattaaagggaacataaaaacatgtcccacctggccaacggaatctgtctggttttaacccaaatacgcgccattgcctgtatggcctggacgcagatctgatcatgctagctttggcgacacatgaagtacacttctcaatactgagagaggtagtttatacacctggacagcaggataaatgcttcttgtgtggtcaggtgggacatctagcagcaaactgtgaaggaaaggtgaaaagaaaagctggggagtttgatgagaagggtggtgctattgttcccaagaagccctatcagttcttgaatatatggaccctgcgggaatatttagaatacgagttcagaatgccaaacccacctttcaagattgattttgaacgcattgttgatgatttcatcatcttcatgtgcttctttgttggcaacgattttcttccacatatgccgacgctagagatccgtgagggagctattagcgtgctcgcggccgagtgtacaagaaggaatttccctcaatgggtggatatttaactgattcttgcacgcctgatctgagcagagttgagcacttcattcaagcagttggttcatatgaggacaaaatatttcagaaaagagcacgtttgcatcagcgtcaagcggaaaggataaaacgggaaaaagctcaagcaaagcggggtgatgatctggatccccatgttagggatgaccttattgtacctattcaacgttttcaagggtctcgcctagcctctggggctgtacctgtgccatatgagcagaatggatcccataaagacaataaagaaaggaatagtcgagcccggaaagctgcacgagtatcaacgtcaggttccagcattgcctcagccttagttgaagctgaaaatgacctcgaagcccaagaatgtgaaaacaaagaagaactgaagtcaatgcttaaagatgcacttcgcgagaaatctgatatttttaattctgacaatccagaggaggataaggtgaaacttggagaaccaggatggagggaaaggtactatgaagagaaatttggggcaagaacacccgagcagattgaagaaatacgcagagatgttgttctcaaatacacagaaggattgtgttgggtaatgcactactattatgaaggggttgcctcatggcaatggttctacccttatcattatgctccgtttgcttcggatctaagtggattgggccaacttaatattaaatttgaacttgggacaccattcaaaccttttgatcaacttatgggtgttttcccagctgcaagtgcccatgcgctaccgctacagtatcgacgattgatgaccgatccaaattcaccaataattgatttttatcctacagattttgaagtagatatgaatgggaagagatattcttggcaagggattgcaaaactaccgtttattgatgaagatcgtttgttggctgagataaaaaaagttgagcatactttgacgcctgaagaagcaaggagaaacagtatcatgtgtgatatgctttttgtgaatgggtcacatccactttcgccttatatctactctctcaacagcaaatttgggcatctgcctgacaaaaggagaaatgaaattaaagaaaaacttgatccttctgctagtggaggaatgaatggatacataacactttgcagtggggatccatgccctcctatctttaggtctcctgtggacgggctggaggatattatggacaatcaagtgatatgttcaatctacaatcttccagaccatcataagcacatagcccagccgccagttggtgttatcatgcccaagaagattgttgaagccggtgatctgaaaccacctccagtgctgtggcatgaagatagtggcaggcggcctcatgataatagcaacaggcaaaacccatctggtgccatatcaggccgtcaacttggagaggcagctcaccgacttgtcataaacagcttaaatgctcagggtagggggcaacatagtggcacatcaatgccatatcgaactataatgaatggcttgcatcatctggatgtagcgtcccctgtcagcaatcaaggcatgcgtccacaagtggggcagtctgccggacctcctggttggtatgttcctaggggtagtgtatcaaatggtcaaccaccagcttatgcatcatcaggatcaggtcattatcagtatgaaagttcggggcattcacaatatgaacaaggtaaccatggaaggcaacaatctcacccatatgcaagagatggcttccatgatacacgaggaagggttccacctgcatatgggtaccagcagagcaacatgtatccatcgggtcctggattgtatgggcaacctccatcagcatatcctggggttcatggtggaggctaccaaccccctccatatggcggaggccagcagtggcagcaacaatcatatagttcgtatgccgtgcgaggcccctacggaggcaggccaccacccacaagggctgattcagggtcacagcaaccacagaaccgttatggtgctttagacagaagtaacaaccggaggccttcatctggatacagaagataatagtttgtgacccagtttatgttatagctcaaagtttgttatcagtagagcttcgagtaactcagctaaagcataggcggaatagtctgctaagtcttgtgaccttcaagcagttagggggtggcatcaaagatattgggaggcaaaatttgtatgctagtgcagactttcaggtactagcggttttgatcgccattgaagcagctaggtttgcggcatcagaggttttgcgaagcaagatttgtatactactgttatcaacgggccatcaggtactggtggctggtcgccattctttatctgtagttaccatttgtttagaagatgtcataaacggccctggggcttaaataggtcccattgagaatatttttgaaggacgtttactctgagacttgacaagttttgggggcattttgatatcagataaatgtatgcaggagtgcagttttgatgatgtgtgtattccaagtcattaatt

SEQ ID NO: 4057 - DNA, 1589 bp, Zea mays
aaaaagctctcggcgcttattaagtcttgacgatttatcattccattacatccacacctgcgatggagtacgagcgcggtggcggaggcggccgcggccgcgggcggggccgtggaggcggcggaggaggagggcgcggaggcggcggcggatacgggcagcagcacggaggcggcggcgacgcccgcggaggccgagacgagtacggcggcggaggaggagggtacgggtacgacgaaggagaaggctatggcgggggtcgtagaggcggcggcggagggtacgggtacgacgcccgcaagatcccgccgttgtcgtctccgtctcctccccctgcccacaactcgcaggatcccaccgtcaccgtctttctgggattcaattctgctctcaatttcttaatatgttcgggcatgttttgtttcacctgatgcctgtgcctagttgagcgagtgcatggacctagacatcacagtggaattctggtcccttcaggcgctgcgcagtttcttctcctcctaccagacatctagcactggacctaaactagacgagcacttcgtcatgagcaacaaccacgccgcgcgcgcacaatattttttccagcaaatggaagtaaattttttgtgttgattcagtcacccatttgttgtgttttctccaaatactctaagttggactgattgatttcagatctgtttgtttaaagttcatctattccagctttataacctagtttgtataaactcatctggtcaacaaaaagaccaagttataatccagtcgcaagcacctacgcccgcccacccgcaacgctcaatattcctatgcctgcaggctgcaaatgaagaacgattacgtgaagagtttgtgagggaaagcagaaagcttcctccaaagcagcaatcacaaacatgtgattcaaatgttattactccaaggactgaatttatggctgttttatcagttgctttggagtgttacatccatcttagattgaattatgatcatgaatggaaacaaaacaaagttattttatccgatgccaatgttcctggtgaacgggatctgtctggttttaacccaaatccattgcctgtatggcctggacgtatatctgatcatgctagctttgcagacacatgaagtacgcttctcaatactgagagaggtattttatacacctggacaacaggataaatgtttcttatgtatttaggtgggacatctagcagcaaaatgtgaaggaaaggtgaaaatgaaagctggggagttttgatgagaaggctgatgctattgttcccaataagccatatcaggttatttgtctattgtacaacatgtggtagtgtgtgtgtgtgttgggggggttcgcgccctcactcacgatcaatgacccgactctttccctctcttcccctcctctgccacgagccctaacccacttgaagcacaacatgatccatgtgagttgtgctttgggcctgcattagggatcagcaacttcgcacgcgacgaaatgaaccgccacgactgcgttgggatcaagaaaaaaaaaaaaaaaattatttcagtgtcgtgtttttttt

SEQ ID NO: 4058 - DNA, 728 bp, Zea mays
caagtgcaattgggatgtgaagagcatagaagagaacattaaattgcacttgaagattgctgcactacctgtgttttgctgggcgcttgaccatgttgccagattcttaaggcgtaattttgcgcgatcctctttctataggagatacctggaagaacctgtctttgggtagagacaaataacactacactaagcctccttagttcgaatgcggagattgccttgggttttcttctgatcatatcactgttctcgtggcgccgtagcatagttcagacattcatgtactggcaggtgttgaagctgatgtaccatgctcccgtgacatccagctatcaccagagtacctgggcgaaaatcggccggattgtgaacccgtacatccaccgctacgctccgttcctccagacgcccatttttgcgatccaaaaatggtggttcaggtaaaaaaacaggccgagctgcaaacatagcacagtcgagtcgccgcgttcttatgtaatgctgtaaccttttcccagaattctggagggccattatcataacaaaaaggtttttagctgcagggcccccaacgccgaattgcaaaactcagcaaaaatgttccgtgttttttttttttgttgggccccgatgcctgccttcgtagatttgcttgcaatctttacttcaacggaggagtgtacattctgtttgtgcgtaggtcatgaaggaatctccttggattg

SEQ ID NO: 4059 - DNA, 1601 bp, Zea mays
cctcgaggccgcgccggggtccggtcgtacgtcgtacctcgtgtactcggctgtctcccccacaaccagtcgcctacccactgcctcgcatcggcatcggcgtgccggtgctgccaagctaaaattccccaactcgcgtcgcgtcgtcagtgtgcgtgccagtcctccggcccaaaccccccgcacccaacccccagccccggcaaccgatggcggggtccgcggccgacgcggagcaggagcaaaagcgggcagcggcggcggcgtacgactacgagggcgacgcgcgctgggccgagtactggtccaacgtactcgtcccgccgaacctcgcctcccgccccgacgtcgtcgaccacttgaagcgcaagttctaccagcgctacatcgaccatgatctggtcgttgagccaaggtcattcaccagttccactcaggccagcaggccagatgtaaggtcttcgtcttcgtcatccaccgagaacgtcagggagcgtaattcaggatctactgcaaggtcagcgcctccaccaccgccaccaacacatacagacagtgccgtcaaccctttacggttcgacgcacgcactatacatttctccatcaacgcatggatacttgtggttgctggtctgggaatgcttcctattttgccaaaacaccttgccgacagagcttgcaaactttcacttctgggaacaatattgtcatcagggtattctctatacagtacttatgggaaaccaagagcatggaacatgccagcaattcaagcttggttgcagtctatacttgcaacaaaggattttatccatttaatgttctcttctatgctcttcacatcccaattgcacttgaagattgctgcactacctgtgttttgctgggcgcttgaccatgttgccagattcttaaggcgtaattttgcgcgatcctctttctataggagatacctggaagaaccttgtctttgggtagagacaaataacactacactaagcctccttagttcgaatgcggagattgccttgggttttcttctgatcatatcactgttctcgtggcgccgtagcatagttcagacattcatgtactggcaggtgttgaagctgatgtaccatgctcccgtgacatccagctatcaccagagtacctgggcgaaaatcggccggattgtgaacccgtacatccaccgctacgctccgttcctccagacgcccatttctgcgatccaaagatggtggttcaggtagagagacaggccgagctgcaaacatagcacagtcgagtcgccgcgttcttatgtaatgctgtaaccttttcccagaattctggagggccattatcataacaagaaggtttttagctgcagggccaccaacgccgaattgcaaaactcagcaaaaatgttccgtgtttttttttttgttgggcaccgatgcctgccttcgtagatttgcttgcaatctttgcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4060 - DNA, 2024 bp, Zea mays
tacctcgaggccggccgggattgcccatccccagatctcaacccgaacctcccagccgcgccgccctgatggcctacaccacctcgccgtcgacatcgacgtcgacggcagcggcggtggcctgggccttcgctgccgccacctgcgtgaaactcctcctcgtccccacctaccgttccaccgacttcgacgttcaccggtactggctcgccctcacgcacgcgctccccgtgcggcagtggtacaccgacacctcctctcagtggacgctcgattacccgcccttcttcgcttacttctcccgcctcctctccctccctgcgccgctcgtcgacgctaccctcatctcaatccccgtgcgtgacgcgacgcccttcgctcatctcatctacctccgcctcactgtcgctttctctgacctcctcctcctcggatccgtcctcttactggcgagggacgcgcagcggaaacagcggccgttcctcgctctcgcgctcgtcctatggtcgccggcgctgttagctgtcgaccacgtccactttcagtacaatggattcctcatcgggctgctgctgctttcgctgcacttcctcgagcaggggtgggatcttattgggggagtcgtgttcgcatgcttgctgtgctcgaagcacctgttcctcgtggcagcgccggtgtactttatgtatttgttccggcattattgctgtggccggggtgtcgtgaaggggctgggaaggctcgtgctgatgggttctggagtggctgctgtttttgccgcagcatttgtgcccttcgtgtactatggtcagatgcaacaactaattagccgattgtttccctttgggcgaggcctatgccatgcttactgggcgccaaacttttgggtattctatattatacttgacaagattcttgcatttcttcttagaagactaggctttaatattgccatacctgaagcttcgtttactgggggacttgttggtgattcgtctccttttgctgttcttccaaaggtcaccccaattgctacattcttattggtcattcttgccatggctccttgccttatcaaagcattctctaatcctcaaccaaagcatattattagatgggtctcgtatgcatgcacatgtgggtttatgtttggatggcatgtacatgagaaggcatcacttcatttcactatcccacttgccctaatcgccatggatagcttgaacgatgccaggcattactttttgttgtccatagtttcatgctactctctattcccgttgctgtttgagaaccaagagtacctgataaaggtgctgctgctgctgacctacgctgccctcatgtgggtaggctttacggtccattttgctgcaaagtctgacctggaaggaaagaaaataagtcggtctggcagcacagtgaagaagaatggcatcattgggtggattggtttaagctatcttttgggaattgcaggcatagaattatggtctcaagtatttcaccatcatgtattcggcgataggctccccttcctacctcttataatggtgtcattctattgtggccttggaatgatgtactcctgggtgtggcagcttgtacatatagtccgacacacatgatttgattaccggtcatcagtggaagcattctcttgcctttcttgggttgaggctaatcgcgatgacaatgctgcctggaccgatgcagcggccaacacagtcatgtctgggcacagcattttctttttagctgtcgaagtcattgtctgtgtgcaagaaatttttagagatgtgtgaccgtgttatgatgtaattaatgtcagtttatataagtaacagaaaatctgcttgtatcaacccgcgcttcatgcgtgccgctcttttccccatctcaataacatctggcttctgcatcgagtaactgaatgtgtgtatgatatatggaaccattctaattttctaggaaggaaaagaccataaaatgtgatgtataatcctgccttgttatcttttctg

SEQ ID NO: 4061 - DNA, 2872 bp, Zea mays
ggtaccctgactgaagaaaccaagagaatcaatcttgggttcgccgacgagcgcaaaactgctatcatcagttccagtctggatgacaaataggaaggcgcgctcgtctagtttctgcaagataaccgagacgtattcgcatggcaacctgcggatatgccaagagtcccgaaagaactggccaagcatgaattgaaggtctacccctaggcgaggccgatccgacaaaaattacgtcacttcacgcctgacaagagagaagccatccgtgctgagctggctcgcttggtcgcggcagggttcattagagaggtgttacatcctgagtggctagctaatcctgttcttgtactcaaaaagaataaagtggattggcgcatgtgcgtcgactatacggatctcaacaaacactgtccaaaggatcccttccggcttcctaggatagaccaggtgatggattcaaccgccggatgttctttggtggctttcttggattgctactctgagtatcatcagattagtttggctgaagaagacgaaaaaaaaaacggcattcatcaccccgtttggtgctttctgttatacctccatgccgtttggcctcaaaaacgctggagcgacttatcagagagctattcaaacatgcttagccgatcactggggcaagcgtgtggaagcttacgtagacgatgtggtgatcaaaacggagaatccggaaaatttcatcgaagacttacagtgcaatctcgactgcacaatagtttaattcggattggccttttggtagttgtaagttaacagcttactgactagatatctggtgtccattttggataattctgatttaggatgacaagaaatttcaaggtgagctctttgggatctgcaatcttttccgtgacttgtccgataagctttttactagtgagattattgagatgcatggagaacatggcaagagtagtgcaacagaagcaacagggataagagaaatagtcgatactgatttatttggttcacaagagaataggaagtcttccacagcaacaacacatacggatgatcagaaattggttgattttggtatgctctttctctgaaaaattacttggtgtttaccatataatatactcatataatattaccgcagctattagcttcaaaggctgatacagaaaactagttactcattttagatgcaatctatacctttggagatacttctcaaaagattttgaaatactgcactgttctgttctttgtttatctgtacctagtattcaagggctgctgttcaatgtgtcgatttctagttttgggatatttgatcttattcagtcacagttcatcataaattcagagcagcttggtttttccgcgaacgtgccttagcacgtcttcattcagattcaggtagcttgcattttgtacactaaaatataaactgcttaaaaagttgaaccatcatgttattttacgctgttttggaatatcaagctattcttttgtagccagaagctgagcagctgtttatgggtccagctataattatgcagtgattctcttcgctgaaaagtgaaaaacctgtcaaaatattttctccctttgactcccgggtgtattatgtaacctctcttccctctcactgatccattttattttgaagtaataaatctggcctgtctaacagggatagtttatgcccaccgcaacgaggatgtcgtgaacatgaggacagacggaagagagaaaggtggagcagacgagactgtccagagctccttagaggagctgcttagtaagaatgaaacaaagcacactgccatggaaaaatcttattcatcggaggagaaaagggaagtggcaagatcttattcactggagcagaaaaagaaagagtttagctgcatcgcatccttcatgggtatggatgaccttgaatttagcaagtggttgctatcagcctcaccgcaccagcggtctgaagtgctgcaggactacaggaggaagaagaaagatcagaaatgatgatgcaggtcctcggagctaaccggctaccgcaaagctttgacgtagtgattagcttgtgtagctaattgtggtagttatgacaagggaatggtagtaaaattgacccgtggcaccgatcagtatgtatgtctgcagccccgcttattttgaaccttatattggtgcaaactgagctcagcaaggccttggtcactctccctggccgtttttttcggtcaggtgaaatataatctgtattgtgtctgttagttcctgttcagctgtctaagcctttgttagcgagtcttatcatgttaggtggcttgcaatgttaccttggtctgtactaatcatttggatatcgtagtcttctccgtactaaaatataattcgttttagataaaaaaaaaaaaaaaaggtaacttatgaatgtagtttgtctgtgtgtggctacattcattggaacgagttatttacaaacattacactcccttacaacgtagttttcaactttagaaccgtgtctttgcctctctcaattttagaaccaagattcactgtccaacttcaaatccatcattgtggttaaactaccgaacctggcgtctgcttccctttcttcctcgacagactgccagcggtccagctcgcgcacgcagcgcagacgtaacgcgaatgcagaaccatgggtctgccttatagtcgcacgagatccggtagcactgctcacactaggcgtcgtcgttgaagagcgccgtgctcatcgcagccatgtcgatgccgcacccggtcacgggcgagaattttgcaattatggcaccgccaagggcgggcttcagaaacatggcacgcccatcaccgc

SEQ ID NO: 4062 - DNA, 1435 bp, Zea mays
aaaagacgcgtcgcccacagcacgcacgaaacacacgagcaggtttccgttctatcctgcgcttactcgactcgtagcagcgcgtccgagcagaccagacccgcccggcctggttgtggtcgaggaggagactggactggaggaggacgggatagcagacgagaggagaggacgcgcacgccatgtcaggtccaccgccaaagccttgggagcgatctggaactgaaggaacttcaggtccagcacctttcaagcccccatctggtggaagcaccagtgatgttgttgaagcctctggtaccgctaaacccagcgaaaatgttactgcgatggaggggaatgccgctcccaatgtaaatagcactatttcaaggcctatgccacagcggccttggcagcagacaggttatggaaacacctatggagggtatggtggatccaacatgtatagttcatatggtggatttggcaacacttatggtaccggtggactcggaaatagcatgtactcgagttacggaggaggttatggtggtggcatgtacggtggtggcatgtatggaggcggcatgtatggtgggatgggaggttatggtggttatggcatgggcggaatgggtggtatgggcatgggtccatacggtaatcaggatccaaattcgatgggccctcctgcatccccgccaggcttctgggtgtccttcctccgagtgatgcatggtgttgtcaatttcttcggacgaatctcattccttgttgaacagaatactcaagcatcctatttcttcatgacagcaatgctgcagctcttcgaccggtccggtatgctctacggcgagcttgcacggtttgtgctgcgtttgctaggagtgagaagaaagccaaagaaggggggcagcattcaggggccagaagcgctggcgttcgagggacctagccggcagtctatcgaggcaccgaaaacgaacaactgggacaacgtctggggaaactgagatcatgcctatgggtgcaacgagttgaatcatatagaagaagtgcaagggctatgacctatgggagtttgcttgccttttgattcatcaaaaagaagattgcggccagataccgcctttggtggcaacttaggggaagctgtgaagaagaaactgctgggcctctcttgcttttcgcagctttgctttgatgtacctgcgagggccatggcccatgacagtggtaggtttttctttaatcgcaactgtaaggtttggtgaagaacggtttcacagtgcactgatatatatgtagctgcttgctgctgttgtgatatcagtgtgggtatcgaatgtttgtatatctctatctgggtaaatagtgtccgccttcgaaaataatacagcaaatgtttgtgtaccaaaaaaaaaaaaaaaaaacccggcagcgaatgcggact

SEQ ID NO: 4063 - DNA, 1820 bp, Zea mays
tcggtaccctgtcctgtgtagcagtattatgttagccgaacgtgtgtgtttggtttcgctggacaatcatatagatagatagatagctgatgcctggctagaagttttgtaccgttttcatcgctggtacggtagcaagcattcttctagtcttggtggtaaggaaacaaacgaagaaatgaatctagtggtgctgttgaatgaggagaggacgcggtcccaactgcccatcttgttcgtcctgtccggtagtaaagaaaaatctagagggttggggctcgaggcggcgggtaggacctatccacatgtcagtcctttcccgaatacccatcattttcctctcttgccttgccttcctcattgccattgtgtaatcctcatcctccgtcgagatcaaggaagaaagaaagcaaccatggcggcaaccggaatgtccccctccccctcggccgcaataactcgccacatccatgctcgtcgttcctgtgctgctgcttccttgtccctccgccgctcgggcttcctggggcgcgtcgtgctggccgcggtgccagtggccgtggacgccacccggcgccgccgcgtctccgtgtcggtgcggatggcctgggacggtccgctctcgtcggtgcgcctcatcatgcagagcaggaacgcgaagctgagcgagaagctcaaggagcacatcgaggacaaggtgggtcgggcggtgtccaagcactgccacctggtccgggaggtagacgtgcgcctctccgcgcgcggcggcgagctcggccggggccccaagacgtcgcgctgcgagatcaccctcttcaccaagcgccatggcgtcctgcgcgccgaggaggacgccgagtccacctacgccagcatcgacctcgccgccgccatcgtcaagcgcaagctccgcaagatcaaggagaaggagacggaggtgcgccgcggcggagacgctgacggcgtctgggacgagatcccgccggccgacctgctgccccccgcggtggccgaggccgacgacctggaggcggccgtgggcgctgaggacgagcagacggtgctcgccaaggtggtgcgcaccaaggtgttcgagatgccgccgctcacggtggaggaggcgctggagcagctggagaacgtggaccacgacttctactgcttcagggacgaggccacggggcaggtgaacatcctctaccgcaggaaggaaggcggatacggcctcatcatccccaagaacgacggcaaagtggataccgttggcgttgtgccaccacccgccgtcgctgcggagccggagccgtcctacgcagtgcacgccgctgacaacaacaactcctgaactgagcactcgtcgacgtctcatccaaccaaaaccaaaacgagagagaatgcttgcttggtactgtaaaaataaaacaaacgcactcgtcgtcgacgtctcatctgcatcagttgcatgcattgctgtgatgaatgtgtctgtgtttgtgtcacccacacaaactgctcatattagctctccatttcatactctccctcctgctattagcaccaattgacacactgccttttggtataatctgtacgagctgtcagtcattagggtatccattaatcggctctgtaccgagattgagttttgtatagcacacaacagctcgcatccttttgatattccagtccaaatgtccaatccaatgtagtctagaatcaagaagcccatgggccatgctccgtgccaagctgtgcactttgcttcacgggcattcttattcttgttccgaggaaacggcccaactccggacttgcagggg

SEQ ID NO: 4064 - DNA, 1935 bp, Zea mays
  misc_feature (1)..(1): n is a, c, g, or t
nttatctatttgatcgacattggagtagaccagattcagaatggaggtatctggtggatgattttgctactacctttgggattacccggccggcattgcttgagtgcctggtattttgtcttctagacgatcattcttcagaagccttgaaggaggcctgctctcttctccccaagatctttagcaaggaaacacatccaaagatagcacaagttcttctggaacgccagagacctgatatggcacttcttgtgctaaagtgcacagggcgtgatagcttctctgctacagagaacttcgaaaaggatggcatttcatctctcagcgaggcagtgactgcggtccgtgttagaattgaatgtggcctcctaacagaggcatttatgtatcataggagctactgctctaaggtgaaagagcaacactcagcaaatatgacacacacggaggatgcattcgaaggctcttggatttatcatgttgagatgatgatggtcgaattttgtactatctgcattgaaagaaatttagttgataaaatgattgatctgccctgggattctgaggaagagaaacatcttcacaagtccctcttcgagtctgctcatgaagcgcccatggatccaattggtagtctgcttgttgtctactaccttcggcgttatcgatatttggaggcatacggggttgatcgtagtcttcagaaatttgagcaaaaggaattggaaaatgccactgaagaggttgcttcaaaaattagagcaattgctcaatggagagaaagtttggttgctaaatgccttgacatgcttccagaggttcagagagagaatgtgaaagccatcaacagtggagaacaaattcagtttgctcgaactgctcaaatatcttctccagctcatgtgggcaaatcacaaaatcctgtaatggacttgagcacaacttttaccagtgttcttcaaaataagtcaagcctcttctcaaaaaacaatgcattgactgattctagtggtctgatccgaagcagccactcagagagaaaggtcccatctgctctgcagaccagggcaccaccccatgggtcacctatatccaatatgagatcaactgtagggggtaagttccccacagtgggccagaatgttgacagtccatttttgaggggggctaaaggtatcagttctagaaaaggagagacgggattcaaagaagggattaaatatgctgatcacgatccactgcctatgtatttgaacttgagttctggtgatacacccaccaaagactaccgaacaagtttgttgaaggccgaggctaacaaaaccacttattttcaaggacaagattctgttggaaaaggagagttccactttggttcacgtgctgtgaagcctttcaacttaaatggaactggcgcaggtcaaaatggcctcgctaagatctcgggatatgctggttttcgtgaggattataaagtaccaactaaggagaacatcttgagctttagcaagaaatcttcagttggtggagcagaagccagcaaaggtgtgtcaaggtggagatccgatgagtctagtgaagaagagagaacaaaccgggagagcggagctcctcttgttactagaaggcgacctagattttcgagaagatgatatatccacatcctcagggatttttttaattgtttgcagctatgccctaatgtgacaacaattgttttaagggaatgtgtatgcgggatgcggctatcatgcataatctacattgccatggccgagatgtagttcaagtgtcactaaggatgctagaaaacaaaatcgagaaggcgtatgcatgtagcattcagagttcagtggctaaattatattttcccaacttttgtgccaaatgcattgtaaatatagtcgtactgaaaaaaaaaaaaaaaaagcggcc

SEQ ID NO: 4065 - DNA, 1603 bp, Zea mays
ttgggtacctcgaggccggccgggtgttgctcttggggctactgtaagtacatttaacactcctggagtgctggagcactgctgctttttgaaggaagtagaggatgctcagaagatacggaagggtgtgatagattgttttgaaaaagcatcacttccaaatattagtgaagaagagaaaaggaaaatcctacattttgtagttattggtggtggacctactggagttgaatttgcagcagagatgcatgattttcttgtcgaagatttagtgaaactatatcctgccattcaagacctcgtgaagataacaattattcaatcggcagagcatatattgactatgtttgatgaaagaatagcttcatttgctgaacaaaagttcaagagggatggcatcgaagtgtgcacgggcttcagagtgataaaggtgtctgatgatttgattacaatgaagagaaaatctgatggtgaggaggtatcagttccttacggaatggctgtttggtctgctggcattggtactcgtcctgtcgtcatggacttcatgcaacaaattgggcagaccaatcgtcgtgccttggcaactaacgagtggttaagggttcgcgagtgtgaaggcgtctatgcaattggcgactgtgctacagtgagtcaaagaaaaataatggacgatatttcaacggtattcaagatggcagacaaggacaattccggcaccttaacactaaaagagatcaatggtgttttagaagatatatgtataagatacccgcaagtagagctgtatatgaaaaagcatgcacatgcttgacattgcggatctaataaaaggcgcagttggcgattctcacaaggagtccatggtggttgacatagaggagttcaagaaggctctgcgccacgtggactcccaggtgaaaaacgctccagcgacggcccaggtcgccgcacagcaagggcagtatctcgcccagtgtttcaacaagatggagaaatgcagagaggagcccgaaggccctctgcgcatggcaggggggtccggccgccacttcttccgcccgtttcgctacaagcacttcgggcagttcgcgcctctgggtggagaacaagccgctgcagagctcccgggcgactggatctccatgggccacagcacgcagtggctctggtactccgtgtatgccagcaagcaagtgagctggcgcacgcgggtgctggtggtttccgactggactcgccgcttcatattcgggagggactcaagccggatctagctgccaaggattctcttctgcacagggggggtttcgttccgtccgaagaataatcggtttcgctgctgctggagcttgagcaagcaaagctgtttcccgtgcccgcgcccgcgcctggccctgccggcgaaactgctgttctttcttctgctacatggtggatggctctcaaagcctcacgccggttattttcactgaggttttagctctggtttatttgatgtccataggttttcttcctttgcttgtgatctcaacacatccatcactatgattcatctgtgtgtgatacatattgcaacttcagttaaaatccaacctttctt

SEQ ID NO: 4066 - DNA, 1971 bp, Zea mays
aattcggcacgaggcacctatgtaaaaaactcggtcgggtccctcgcccccggccgccacgctccttacgccgccgccgttgcccacgagccgggatgctccgcggcgccatctcccgcctcggtgctcgcctccgcctccacgccgacccctctccggcctctcctcgcctccgcgtcctctccacccgccgcggtaaacgctcctcccccaccctgtcgcccgcggactgcgatgacgagggacccctgcgcggcctcttcgtgctatcccgcgaccccgagtgcccaccgcggctgctggtggtgcagccgcgcctccgccccggaagcctcctcgagtccaagctcgccgaggcactcaacctcgccaactccctcgaggagcgccgcgacggcttctaccacagcgagttcggcgccaagggcgcgccgccgcacctcgtcgtccagaaccccgcctcccgcggtcgctcacacgctgatacatattttgggcctggaactgtggataatgtcaagtgctacctgagtgcaacggaatcagaggaagatgtggatgcagtttttgtcaatgcgattctctctggaatccaacagagaaacttggaggttgcctggggattcatgagtggtgctggtgaaacagagcttcaactaaaacggaggagaatccaagaacgccgtgtgagcttgttagctcaaattgaagatgtacgccgcactagagcgatacaacgttcaagtcggaaaagacatggtggctcgtttggtcaagagcttgtaactgttgcagtcgtcggatatacaaatgctgggaaatctacgcttgtgagtgcactttctgaagctgatttatacagtgatgacaggctgtttgcaacagtagatccccggttacgaagtgtgattcttccatcagggagaaaagcacttcttagtgataccgttggcttcatctcagatttaccagtacagcttgtggaagcatttcatgcgaccctagaagaagttgttgaagcagacatgttagtgcatgtgttggattcaagtgcatctaatcttgaagagcatcgatctactgtattgcaagtactgcagcagataggggtttctcaggagaagatcaacaatatgattgaagtttggaacaagattgatcttgtggacgagaatgttaaatctgatgggattgacgatgaagtcttcctgaccgaaggtgaacaggaggatgacatattctctgaagatgatgctccatcagaacaaacatcttttgattctgtagatgtagatgacggagcagattcagaatatttatcagaagaaaattctgaagatagcaatgaactgccatctaaaaagtcatttgctgagccaactgagatgggagcaatgaaagagttgtcatcaaaagaatgttttggagaacttcgtgtcctagatacaaatggacacactttcccacaaccagcttccacttgtcatgtaaaaacttctgctgtgacggggacaggattgcaagagttgttagcattgatagagaggaaactgactgaacaacaaactgtcgtgcaaagaagctatggacctttcgacagaaaatggagacctacctctatggattgtgaaaaggctgcagagccgtaggtatgggattcctccttcccctcttctatatgggattcatccttcccctcttctatatgctgctgagatcagtagcagtaaccagtttctgagtttgcatccctagagatggaaaccacacaatgtgtttgaatatgcgcttgtgcatgatgtatgatgtatcattcaaagagtatcttgatattctttctgcagaacatgaagaaactgtaggaagggaccgtatgagttttgatcaatgtcagtcactttaacagacattttgtactcatgcttcatgttgctagatagcatcttatctttatcttatattctgatgagt

SEQ ID NO: 4067 - DNA, 919 bp, Zea mays
gcacgagctttaatgtgttcattttatttgtcgattttttttcttctgtcgtgatgggcggggtgtttgtttcacgcccacggcccgccaggctcgacgtaacgaggcatcgacactgacagagtccacggcacggcttgtttaccaccaaccatccggcccttccccgaccatggcggcggcaccccctcgctggtggccgctcctcctgcagctcgcaatcgcccttggcatcctgctcgcggcggccgaggcttggacgggggagatccgcggccgcgtcgtctgcgacgtctgcggcgacgcagccatcggcccggaggaccacgccctcgaaggtgcggaggttgctgtcctctgcatcacaaaatctggtgaggttatcaactatcaagccttcacaaactccaagggcgtgtatactgtcgccgagactatgccggagagcgacaggtgggactcgtgcttggcgaggcctatgagcagcttccatctacattgcacacggcggggtgatgctcactctggggtgaagttcacttacaacaaatcgtctgggaacccgcacaccgtcaagcctttcctctacaagccggccaccgtccctctgtattgtagttaaacaacacatcttgctggaacgcagaagatagaacatacaggaagaaaatatgtattcgtgccccgactccatatgaccatatataagtaaacactgtttgatgtaaatcaaagattcagctgtctatgggagctgttctagtgtctggtcacccatacctgcgaggaaacagatgttgcgtgcttaatgttgataatatcagtgtttttcacctgctgtaaatgttttgcgaatgctattattatcttggttatgatgaaaaaaaaaaaaaaaaaacgcgcgcccccccaatggaat

SEQ ID NO: 4068 - DNA, 816 bp, Zea mays
gctcgaggccggcccgggtaacgaggcatcgacactgacagagtccacggcacggcttgtttaccaccaaccatccggcccttccccgaccatggcggcggcaccccctcgctggtggccgctcctcctgcagctcgcaatcgcccttggcatcctgctcgcggcggccgaggcttggacgggggagatccgcggccgcgtcgtctgcgacgtctgcggcgacgcagccatcggcccggaggaccacgccctcgaaggtgcggaggttgctgtcctctgcatcacaaaatctggtgaggttatcaactatcaagccttcacaaactccaagggcgtgtatactgtcgccgagactatgccggagagcgacaggtgggactcgtgcttggcgaggcctatgagcagcttccatctacattgcacacggcggggtgatgctcactctggggtgaagttcacttacaacaaatcgtctgggaacccacacaccgtcaagcctttcctctacaagccggccaccatccctctgtattgtagttaaacaacacatcttgctggaacgcagaagatagaacatacaggaagaaaatatgtattcgtgccccgactccatatataagtaaacactgttcgatgtaaatcaaagattcagctgtctatgggagctgttctagtgtctggtcacccatacctgcgaggaaacagatgttgcgtgcttaatgttgataatatcagtgtttttcacctgctgtaaatgttttgcgaatgctattcttatcttggtgtgtgataaaaaaaaaaaaaaaaaagccccta

SEQ ID NO: 4069 - DNA, 2050 bp, Zea mays
ccccgcgtccgacgcaaacaggtggagaggaaggacacattctacgatttccatctgaacacgtcagccgtcatgtcgacgtcacgccggttccaggtcaccaacaagcagtggcaggacgtttgggtgtgcgctatctgcagttagtcttgagtgatactagctgcaatttaatcagatcgatcaggtggatgggcatcctcagcagccgggaggagtgactccagcagggggttggaaagcttgcaatatggtatggcaggacgtttcgagatggacgaatctgttgaaacgggtcaccttgagttcctcattttttttgcaggttcatttgctgcatgttcatttgtggcacgccttttcgtgttaatggaaattgtgctcaaaccaatgctgtccgttgaaagttttttatggggtttatattatcgtccaatgttgtgtcctttgtttgggtgaacattgtgtggctaaaaccgttctggatggcaatgttaacatggaccttcactgcggacactgtaagttgcaatctctagattgtagagaccgcaatttggacactgaattgtaaggtgtactagtacatcattggaatgacgacagccaatggcatgggggcagcaggggacaatttcccctgtagctcgagttttaacttgccgacagatcgcgcgcagagcactgttttgtttttataatgtagacttgacaacattattgtttttatgaagtggagtttaaaacgagagataaaaaatgattaagccgctagagatagcctcaccggttgcatcatcgacaatcctgtacctctgtcagtctgtatcctttgcattctctggaacatgtatttcaaacgcaatcaacaatcgtgaatcgtgtgttccaaattgaaacacctgcagctgaggaacctcctgtggcctacttcgaagcacgacgtgtacctggtgcagagctactccgtgacgcactggtctgccctgctccggagaggaagagaggttctcaacgtggccggccggttggccccgacccagaacgtgaagggggctggaccgttgtcgagggttcagatcagcgctatggctgtgaaggacaacctcatggtggccggtggcttccagggagaactcatatgcaagtacgttgatagacccggggtggcattctgcaccagcctgaccggtggcagcagttccatcacgaacgccgtcgacatccaccaggcacccagcggcgccacgcgagtgatggcggcgaacaacgactgcgtcgtcaggacgttcgacgccgagagatacagccttctcacgcagctcaccttcccgtggtccgtcaacagcacgtcggtgagccccgacggcaagctgctggcggtcctgggcgacagcacggagtgcgtggtcgccgacccgcagtcgggcaaggcgctggcgacgctgcgcgggcacctggactactccttcgcgtcggcgtggcaccccgacagccgcgtcctggcgacggggaaccaggacgcgacgtgccggctgtgggacgcgcgcagcctgtcggagccgttcgccgtgctcggggcccggatcggcgccgtccggggcctccgcttctcccccgacggcaggttcctggccgcggccgaggccgccgacttcgtgcacgtgtacgacgccgcggccgggtacgccgacgccgcgcaggaggtggacgtgttcggggaggtcgccggcgccgcgttcagccccgacggcgaggcgctgttcgtgagcgtcgccgaccgtacctacggcggcctgctcgagttccggcgccggcgggcggaccgcttcctcgacgcgtgtttcttctgagggagaggcgcgcgcgcgcgccgtcagttgtgtactgtgcatgtgcctgccggcggccggcacgtatacatacttgtgtggtgtgttgtgtagtgtaaaacgcagagttttggtgcgtatcggacagcgtactggccaaaaaaaaaaaaaaaagtttcctctcaagaaagtgggaactgggaggggggaaaggagtt

SEQ ID NO: 4070 - DNA, 932 bp, Zea mays
ctcgaggccggccgggaaaagacggatcgagactacacgacgccgatcctagctagctctcccgtttctgctcgcaagtcacacacagctccggtagatccgcccctcgcctctgggctccaggaagagattagcttcagacggcagggatcgatactagcaagcaagcatggcgcacgacttgtgcgaggacttggagctcgtcgccgacgacggcggcttcgatgactactactgggacgacgacttccatttccacgacgacgacggcttctccgcctcccctacgacccccgccagcgttggtgcgccccgccagcagcagcagcagcagcagatgggtgatatttcagcctcggactacaaagaaggcgaagacatgcaggggataccctgggaaaggctcaactacaccagggaccagtatcgtcggatgaggctcaaagagtacaagagctaccagaacctcacgaggtcgcacagcggcctacaacaacaggaacgcaaacaggtggagaggaaggacacattctacgatttccatctgaacacgagagccgtcaagtcaacgatagtgcatttccaggtcaacaacaagcagtggcaggacgtttgggtgtgcgctatctgcagttagtcttgagtgatactagctgcaatttaatcagatcgatcaggtggatgggcatcctcagcagccgggaggagtgactccagcagggggttggaaagcttgcaatatggtatggcaggacgtttcgagatggacgaatctgttgaaacgggtcaccttgagttcctcattttttttgcaggttcatttgctgcatgttcatttgtggcacgccttttcgtgttaatggaaattgtgctcaaaaaaaaaaaaaaaaaagcttatcgatagcgtcgacctcgagggggggcccggtacc

SEQ ID NO: 4071 - DNA, 2275 bp, Zea mays
ctgcagagccaggcccgtccctcccctcccctctcccctatttaagccccatgagtgcaacccctcctcctacacaacccgcccattgcattgcatcttcctcctcccggcccttgctcttccacttcgttgcgcccatccgtctctcgtctcgtgctcccatcgtcgacccatcacacatccacacacaagctaccctacgacgtatacagagagaggaaaaagactagtggtacggccgtcgctagctcgactagtgatccgatccatcgatggaggcagcagacgcatcgtcagcgccgccgcctgcggaaggtcgggtggtgtgggtgaacgggcccatcgtggtgggcgcggggccggggggcctgtcggtggcggcgtgcctgcgggcgcgcggtgttccgtgcgtggtgctcgaccgcgccgactgcatcgcgtcgctctggcagcgccgcacctacgaccgcctccgcctgcacctgccgcgccagttctgcgagctccccgggatgcccttccccgaccactacccggagtaccccaccaagcgccagttcgtcgactacctccaggcctacgccgagcgcgcgggcgtccagccgcgcttcaaccaggccgtcacgtccgcgcgctacgaccgggccgcggggctctggcgcgtgcgcgccgccgacgctctcgccgacgacgacgtcgccagcgccgcctccaccgagtacatcggccgctggctcgtcgtcgccacgggcgagaacgccgagcgcatcgtgcccgagttcgacggcgcccaggacttcgccggccccgtctcccacgtctccgagtacaagtgcggcgaggcgtaccgcggcaagcgcgtgctcgtcgtcggctgcggaaactccggcatggaggtctgcctcgccctcggcgaccacaatgccctcccgtccatggtcgtcagggacgcggtgcacgtcctgccccgggagatgttcggcgtcgccaccttctccgtcgccgtcttcctgctccgcttcctgccgctctggctggtggacgccgtcctcgtcctgctcgcgcgcctcttcctcggcgacctggagaagctcggcatccggcgccccgccgggggcccgctcgagctcaagaacgccaggggcaggacccccgtgctggacatcggcgccctcgccaggatccgctccggccacatacaggtcgtgccgggcatcaagaggttcttccgtggcggcgccgagctcgtcgacggccgccgcgtcgctgcggacgcggtcatactcgccaccggctaccacagcaacgtccctcagtggctcaagggaagtgatttcttcacgcaggaagggtacccaagggtgccgttcccacacggctggaagggggagtccgggctctactctgttggcttcaccaggagaggcctctccggcgtttcctccgacgctgtgaaggttgcgcaggacatcgccgtggaatgggagaagcaaacctccacaagatgatgacgattgacgacgatgatgacgacgacgatggatgcccatcaacttaccagctcactcatgaccatcgttgacctctcatgcatggacctgctacgacgaccaacagatcgataccttgccatcatgcatagcatgttcagcaaaaagtgcaaaaacttgagatgatgtggccaagagttgccccaggctcaatcccagaaaccaaaagaaccagaggagaagcgcgcgtcgggatccagatcaaggctccgaaaactggagagcgaagcgagcctcctcgacgcttgggcgacaggaagaaggccggactgtgcgcgcgtcatgcagagcccagattttgctgtaccccatgggcccttatatacatgcgtagctatgtacagagtgtttttatgtagcaaagttgtgtacagtagtagcagtgcctctctagtgggttggtagagtgttagcgttgacatgcttgtgtgtttgtgtgccatcgtcgtgatgtctatgtatggagttgacaacgagaaatgacctattctatttaatttttgttcgttattacaagtaacagctccaagaataattaagttgcgccttttctgttcggtccggcccaggcttccgcgcgcgctattcgcaaccaagggaaaaaaaaggaaccgaagattgttcaaggtggtcttcctaactaatcggccactttaaaaaaaaacgcaactaaactgtcaagaacaaatttgacacacggttaggatttcatacgaatactgcag

SEQ ID NO: 4072 - DNA, 1264 bp, Zea mays
acagaatccaaactccgcttaacatccctttcattgcatggcctcccagcctcgtcggccccccccccagaggagtcagtatttgagctttctttgtttgctgagtcattcagtgaaatgcttcaacacagaatgggttgtgttatcctgtcttttcttgagaaattgcacaggcgatatgttgtgaagaggaatcagcgtaagcgccaaagagaggaagatctaaagaaagaagagaaatcttcagagaagcggtctaagactactcatgagactactaaaactgaaagtgttgataatccaggaggcagctttaaaatgacaaaagagggtgaagaaaagatgagcacagatcaatctgcaaatgtccatgctgaactgtcaaaagagggtcagataaaacttggcaccgatcatccaattgctaaccatggagaaccagcaaaagggggtgatgaaaatatggaggaagatcctgaatacgaggaagatcctgaagaagtagaagtatatgaagatgacgaggacatggatgatgctcacgctgaagaacagattgcagaacagaatgagaacacaaacgacagagagattaagccaaaagaagtagcgacaacagatggtggaaataacaaaagtacaagacagcctgaagtagaaaatgttactaatatccatgaaagagctgcttcaatggaagaaaagcagtccgtgccagagataggagatttggtgggaggtggagaaaaggtagttagtaaagagattaagccagcaaaagatgaggtgatcgacaaggacctattgcaggccttcaggtactttgacataaatggagcaggatatctcaaggttgatgatttaaaatgtattcttcacaacatggggaagtttttatcaagcagggacgtgaaggacttggttcaaattgctcttgttgagagcaattctgcaagggacaatcgcataatctatcctaagcttgtgaagattgttgacctgtaatctggcactgcttggcccgcgtcagtccccttgaagttaaccatgctatgatcgttgagaagtcagttatgagaaactattttgtttacttattaatgggttcactgccatttttgtggctacctgtttctacgattatgctacaagcagctgcttttcgtttcgatgaatgttttttgtggaattataagtcatgaacttaatcgatgttgcctcatttcgtaaaagaggtgtttgtgtcacaaaaaaaaaaaaaaaa

SEQ ID NO: 4073 - DNA, 1908 bp, Zea mays
  misc_feature (1282)..(1282): n is a, c, g, or t
gcactccctttaagacagaatgggctctgttttccggtccgggcgcgcgggccggtacaggcgttatgttgtgaagaggaatcaacgcaaacgccagagagaggaagatctaaagaaagaagagaagaaatcctcagagaagcgatccaagaccatgcatgagactgtaattgaaagtgttgataaccttggaggcagtgttgaagtgacaaaagaggatgaagaaaagatgagcaaagatcaatcagcaaatgttcatgctgaactgccaaaagagggtcagataaaacttggcacagatcatccaattgttaaccatggcgaaccagcaaaagagggtgatgaaaatatgaacactgatcattcagaagctgttctcgataaacctgcagctgatgcaaatatggcagaggaagatcctgaatacgaggaagatcccgaagaaatagaaatatatgaagatgatgaggacatggatgatgctcatgctggagcacagaatggagaacagaatgagaacacaaatgacagagatgttaagccagaagtagcgacagcagatggtggaaataacagaagttcaacacaacctgaagtaggaaatattactaatatccatgaaagagctgcttcaatggaggacaaactgtctgtggcagagaaaggagattctgtggaaggtggagaaaaggtagttagtaaggaggttaagccagcaaaagatgaggtggtcgacaaggacctgttgcaggcctttaggtactttgacataaatagagcaggatatctcaagatggatgatttaaaatgtattcttcacaacttgggcaagtttttatcaagcagggacgtgaaggacttggttcaagttgctcttgttgagagcaattctgcaagggacactcgcataatctatcctaagcttgtgaagatagttgacctgtaatctggcactgcttggcccatgtgagccccttgaagttaactacgctatcatcgatgagtcagttatgaaaaactattttctttatttataaatggcttcactgtcattttttggttacctgttcgtactattatgttgtacggagccacttttgctttcttgttgaatatttttttattgtaattgtggagtcattaacttggcaaccaatgcttattgtaagcatcaaggattatcacatttcataaatgagggcacttgaaaaaggcgacgaacattgtattaatgcttattggtcttgtcgtttagctaacgaagctgaattaagaaattcgnatattttgtaaacgttgtgcattgatacaatgtgatgcggggacattttgctttatttagatatgcaaatcgtcatcgttaattctttggccgcaccaaaggccgagggccaaacaatatgtgggtggcggagtcgtttgtttagccgtgagatgtgtagaaaagttgtgatccctatgcggtggaaaagttataagatgtttgatgaaagcataaaatatacctatgtaagggtgcgtttgttgagagtcaactagaatggatgttctatttcaaatttttttagaatggagttgttttattgcgtttggcaagcgggacatagtcgttttatttttatttagttgaagagtagaatagagcagtatcgagcactgtgtttgggagatcgctcgcatctgttttcgggagtggaagcattctaaatctttatgataaattttcttatgaagacttcaagagtcagtctgctcctctttgattgaaaaccaaacatccaaaaaataaaaataatgctgctctattctcctctactcaactaaacacaccctaaaagagtggaaagtagtgttcaaaaaagctttcaaatataccttgtacaaaaccaatagaggaaaagatgttct

SEQ ID NO: 4074 - DNA, 1437 bp, Zea mays
aaacgaggatgtactaatgttgtggtaaataatatggacgatagtcgataacgtgaccagtggtggtgtggtgtatggtctgtattgattacatgcagcctaactaatttgccagcgagtgatgcggtgacgtgctgctgctgttgtagtaggtggtggagcaagcccagtccccaatcccaccctgccacccaaccttgcttcttctccgatagctatttctctgctttctctccaatcttcccgggtttccctgattaaagatggctgaatcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgaggaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggttcattggttgaagcatgatgtaaaccgtaaaggatattcatgaaaactaaggacgctatagagcgaaaaaaaaaaaaaaaa

SEQ ID NO: 4075 - DNA, 1382 bp, Zea mays
gtggtggagcaagcccagtccccaatcccaccctgccacccaaccttgcttcttctccgatagctatttctctggtttctccccaatcttcccgggtttccctgattaaagatggctgagtcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgagaaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggtaaatgtaattgggttagtcacaataagagataagtgtctttgccacaagacttttggttcattggttgaagcatgatgtaaaccgtaaaggatattcatgaaaactaaggacgctatagagcaaatgtaggttgtgtgcatgaaaaaaaaaaaaaaaaaaaaaaaaaaaaataaaggg

SEQ ID NO: 4076 - DNA, 6307 bp, Zea mays
  misc_feature (705)..(705): n is a, c, g, or t
  misc_feature (5814)..(5814): n is a, c, g, or t
gaccctccgctgaccaacaaactgatttcatgaagcagatatccatctatccatgagcatctagctagctttgtacaaaagaagagtgtgagatgtgtggcgtgatactgatttgcattgtgtgcttagcgaattaaaagcgggagagatcagccatgtcgttggttgccatcaaatcatcgtcgaatttcagctagctcgctcagcgtgtgtcttcctatgtcctcccggtccctctctgttgttgttcgagactacacaaaatcgatttgctctgtcgtctccagcaaagcgtcttcatttaatttgtttatcatcagtgtgaattgtgtggatggatatggcgggatgagtagtaagctatcatggtgtcacttggagcaaaaggtaaaatgatgtgctcccacttttgtgtggacaggaggaaatgcaggaaataaaggttggctgattcgtatatgcgacgatgacatcaggatttgctttgccgtagggtttctatgtttgttgacctagttcttgctcaatccacgtgggtgttgttttagggtcttgtttggttcatgtatggtttcccaaaaatcttaagggtgtgtttggttgcgggacaaccacgtcctccaatgtcccctcttatccctccaattttaagtgatagctgaggacaacactaagatagtcctgtcctaacctctaacctcgaancaaacaactttatttaagggatcatctcatcctgtcccgttccgtcattgcatccaaacacaacctaattctagttgtgcgctcttagaaagctactgcgagctgacagttgtgagaaatctcaaatatgatattctgtaaaagagcatgataccttgggatcgaacatgagatgcataattttatgtgtaaaacccttgccgaaaaaatatgtccaacaaccagtttctccatctcatgtcatttaaaaaattaaaatttcaaacatgagaaatttaaacgtaatttttcgtagatagatgatttcaaatggaaaaatattaactacatagttttatagattcttgagatacataacttttgttttggttatttatatatttgagattatttgaaaagttgaattcaaatatgagaaatccaaatgtaattttctttggctacatgatttcaaataaaaaaagtttttaactacaaaattgtataacatcttgagatcaacatattttattttggtcatttcttcattcgagattattcaaaaaatcaaatctcaacacgtaaatttaccgtttgacacccattttagaggtagttctagatccaaccgcctctaaaacttaatttatacacgtgtctggatctagaattgtctttataaataaagtaatttatagaggtggctgaaaatatcatccacccagtaaacccatttctagaatgagctcattttaggaaccacttttagatgtgattttagattgagttgggctaaaaagacatatctatgaatgttttttggtgatgggtagatctaggggctgtcgatcgagcaccacatctgtcgaagctcgaaacaatgtgaagtttaaagggaattcaagagggtgatgatattactaaagtgttctctagagtgtattcttgcttcaaaagttactcacattttctttatcaccttaaagttttgagttatagttgttagggtacacgctaaaggtaaattaagtcatttaaaataagacaaacaatccgattatatgtatatactttttctaagtgttgctatctctaacaccaaaaaactttagaccatagatttcaattctatcaactaacctcaaaagctagactgtaaaactaagaaacgtaacacaaactaagttgataagtatttgattttcaaccaaacttaggtaaaattattctaggcttcatatgtcattgggtaaaaagtatgataaaattttcttaagtatggcttcaaattttcttgacaagtttacctaaggttagttcttagaaattgtggttggtcttttaaccattaaatactgcaacgagatttcaatttaggtctcaaactataaaattgcactatctgaatttctaaaccatacaattaagtaccctaaatacttgtacaaatttaagtaacaatgacataacacgtagttagctcagtatggaatgatatatgggctcgcaggtcataattgtgcaggtggttctaaactatgaaactataaatctagatttgtaatataagtaactttgcttagaaattttatatgaatttaaaaaggagagatcaagtcaatcaaaattttaatggtgacatgattttgaagaggttcgctgttacatggaaaaaaagagaaaagtaaattggataactgacgttctgctatgggccaaatagatagggacgaggacgcgaacggcttgcagttgcagccgatcagactcgaaggtagcgtgagagggtgggtcgagactaatttggcccagcgactaggatgagttaaaaaaaagatttaacttagttttagttttatggagttcaaaaattagtctaattctataaatattaacctaaaaattctataaaaattactagaaatatatcgatacctgagaaaattggatgtgcgatttaaggacttctttataaacatcttggcacattttattacaagctcatgaaagcttgtatgaatcggcatgacgaaaacaaaacaaatatttaagacatttatctaaataatagattattttctttttgaattttgtgttgctacatctcatttatagaatagtttttatctaataaaattcatttctatttatccaagttttgaacatattgctaaatatttgcgaggaatataatggtttagttatgtcttctattcacataacgaaatataataagaaatgacacatgaatacataatatattgtgagaaaattagaaaaaaggtgaaatcacgtagtgctatgcacgtactgaggtagaaattaggggggagtgtgacatttgtgaatatagaagacgatagggaatgttacaattcaaaagtgtattttgactttgatggtcaaatatataaactcatcataacacaccaatgatttaataataatatagctcttgtgtcactgaatatttgtcggagaaggctatacattttgtagtacaacgttctgatgtaataagatactctctgtctcaaattaaaattcattttagtaaaatagtgcattcatttaatatttaatgtacatgttttatagatgtgtttatattcaatatcatctatttgaatttagatataaaaaaagtattcaatatcatttatttgaatttagatataaaaaagaagagctaaaacgactactatattgatatagatggattatataaataggtgtagacaagtgagttctcacgggatgatgccgtcacatggtgaatagtgcgtactccctccgtcccaaaatatagttctttctgacacttttttttcgttcacattcatcctaataataaagaacgtagatatacatacaaactacattcgtagattaattaatgaatatttgtatagtctaaaacagattatattttgggtcggagagctggtcaaatgtccgtagacgatcgaaaaccaggatgccatgcatgttcaccatatgctcaagtgaatattgaactatagagtctagaatggtgtcttgatatttgtatatttttttctgaaagttcggttaaagtgaatcggtgctttcatgtaagggcacttgtagcttggttaaaataatttttttttaaattaggaatgtttggtttctattttaagtcctaatcacgtaatggacgcgaccaacctaaccacgttcctctccggcagcatgcacggcaggcggtcaacgccgttatgggtaagacggcagtagctgggaggcaagtacagcacacctccagttcctttccttgacaggtgcacaaaaccatttcacttcatcccgagcttgctttaaccatctggtcgaaccatcaactataaaaatccttataaccctccatcgtttggtaactgctcccgcaccaccatcgcaatttgcaccaaacatggctcgcgtcctcgccgcaatcgccgtcgcgacggcgttccacctcctcgccatgctccacggtgcctcagccgcgcggccgatgggaaggcagcaggcggccgcattccggacggggacgttggcgttggcgccggctggagatcaaaatcagcagctgcgcacggcagcggcggcggccgccgaggccgggaagtggctgccgttcgcgggcgtgcaccaccacctgccggcgccggcgtactgggcacacaggccggcgccgtgggttggggccggcggcctgggcggcgcaggcgccgtggaaggcgaaggcgccgagggggaggtgctcgtgcgggagcgggagcgacgccagcggccgacgtacgagagcgaagggacgatcactaggcaggagcagctcgcaatgtgggcgtcgctgctcaaccccgaggggaaagggaggacggccacgggctggctgccggcgccgggagctggcgaggtggcctacgaggagccggtcaaggcggcggacgcggttgaaggggcggaggcggacgacccggcagccgacggcgcgcgggccggacagacctattggggaaacaatggcaactgacgacgtagaagatgacacttatgttttgcaacaggaacttataaaatgcagaaatatatgttaggcaaaatatatatattgtgaacgataaaaaatacttacattcgattgcagccgtgattatggccaataggacttcttataaaagcactctataatatctaaatataatctcaaaaggtgaggtatacaaagcgaaaatatattttcctgtacgtcatatacttgtttacttgactttaatctgcatctgctacaatattttatttctatagattagagttgtaacaatctaaacagctgactttaatcaaagcgaataacctgatgatcgagttgtccgacccattcctattgatagccgtgattagttgattaatgattacggccatcagggtcaggggcctgacaaggtttaacaatggtccagcccaacacgctccacctccgccctcagctgtttttttattaaactagatatgtgcccgtgttgctatgagagttaaaaatccatataaaacatagatatgtaacaacaactgtcactatgatatataaatatccgtgtagcaaaatatcaccttaacactaatattatactctaagtatagactaaatgctttggtacctattcacagtcgaagatttaactgggaaaacatgattaatcattcactacctagatgcaactgagaacacagcaagaacccaatttggaaggacgaaaaagaacaaaatgcacacatttcaactcatcattccgaaatgaacatccatcaaagctagcatagcatagctacatgcattgataagtaggttaaactagctcaaacaatttcggagataaataatgtactcctttgaatagctaacacgacatttggtataagttttatatccttacttttcacatatgagcattcatatttgctagttataagcatcacgttgtaaaagtgttgtggaaatgattgagtaaatttgatggtaattgataattagtcaccattttctatatattgtgcaaaaagagtagtacgcctaagaaactgggtatatctattaaaaaaacttgaccaatatagaanggtttttaattaagaacacatgaaaaaatttaccacgacaaggacttggacttgagggcttggatctgggcatacatccatactgtcaaccaactgagctacactcagctccttcaaatttacattttaattaagaacacatgcaaaaatttgcctcgataagaacgcatgcagcgtgagttgagggagccacgggggctggcttcggcggcttgcatgcaacatgagtggatgaggggggtaccgatagcttgcatagttgcatgcttgcatgcagcgtgagtgggagagcaggtgcatgtagagcgtgataagttgagcgggggcacgttttggtctacattagcttcttaataattagtagagattactgtagggtccctacagtggtctattagaaaaggggttgcttgtacattttacatatgtgctactaggtgagtgctcatgtgttacaacgggaacatataatattagataacttatgtataaa

SEQ ID NO: 4077 - DNA, 3367 bp, Zea mays
  misc_feature (3361)..(3361): n is a, c, g, or t
aattcggcacgaggttcggacttcctgcgctccgccaattgcttcctactccacctcctcttctccctccccaagccgccgccgccgccgccgcctcatctcatccccatcacccactcccggcggatcgtcgatggcggcgccggcgatatggcagccacaggagcaggggctccacgagatctgcaccctcctggaggcgcacatctcccccaactccgaccaggcccgcatctggcagcagctccagcactacagccagttccccgacttcaataattacctaaccttcatcctggcccgcggagaggggaaatcaattgaagttagacaggcagctggtctactactgaaaaacaatctgcgaacgactttcatctctatgcaaccttcgtcccagcattatgttaagtctgagctgttaccatgtataggggcaaccaatagggctattagatccacagttggaacagtgatcagtgtacttttccaaattgtacgagtcgctggatggattgagttgtttcaggcactccataagtgtttggagagtaatgacctggatcacatggaaggtgctatggatgcgatatacaagatctgtgaggatgtccctgaagagctcgatgttgatgttcctggtttgtctgaacgaccgatcaatgtgtttatgccaaaaatactgcagttcttccagtcaccacatgcaagtttgagaaaactatcgttgggttgtataaatcagtacatagtagtgatgccatcggcactctacatgtctatggatcagtatattcagggattattcaaccttgcaaaggacccttcagcagatgttcggaaactggtttgttcagcctgggttcagctcattgaagttcgcccatctattttggagtcacatcttaaaaatgttactgaattgattctgcaagctaataaagatccagatgatgaagtcgctctggaagcttgcgagttctggtctgcatactgtgatgtgagcatgcctcctgaaggtttacgggagttcttgccacgcttaatcccgactttgttgtcgaacatggtatatgctgatgatgatgagtcccttgatgatgctgaggaagatgaatcctttccggacagggaccaggatttgaagccccgctttcatgcctctcgattgcatggatcacaaactggagatgatgatgatgatgatgatgctgtaaatgtctggaacctgcggaagtgtagtgctgctgggttggatgttctctctaatgtgtttggtgacagcatccttccaactttaatgccattgattgagcaaaacttggctcgaacagatgacaattcttggaaggagagggaaactgctgttttgtgtctaggcgctatagcagaggggtgcattggtggtctatacccacaccttcctcagattgttgccttcctaatcccacttcttgatgataaatttcctcttatacggagtattacgtgttggacgctctctcgatatagcaaattcattgttcagagccttgatcatccaaatggacgtgaacaatttgataagattctcatgggattgctaagaaggatattggatactaacaaaagagtgcaagaggctgcttgttcagcgtttgcaactcttgaagaggaagcttctgaagaattagtaccccacttggaagtaattttgcagcacctcatgtgtgcctatggaaaataccagagacgaaatcttcggatactctatgatgcccttggtaccctggctgatgctgttggagcagaattaaatcaggcaaaatatctagatatatttatgccgcctttgatcacgaagtggcagcaactttccaattctgacaaagatctatttccactccttgaatgctttacatctattgcacaggcattgggaccaggatttgctcagtttgcggaaccagtgtttcaaaggtgcatcaatcttatccaatcgcaacagttggcaaagattgatcctactgcagctggtgcggtgtatgatagagaattcattgtttgttcgttggacctactgtctggacttgcagaaggtcttggcgctggtattgaaagtcttgttgcacagagcagtttgagagatctgcttttgcaatgctgcatggatgaagcagctgatgttcgacaaagtgcccttgcccttcttggagacctttctagggtttgcccaatacatttgcatccacgtcttcaagaatttcttactgttgcagcaaagcaactgaaccctcagtctgtgaaggatgcggtatcagtagctaacaatgcctgttgggctattggagaattagcaatcaagattggcaaagaaatagcacctgtggtgatcaccgttgtttcgtgcttgattaccatcctaaaatccccagagggtttgaacaagtcacttgttgaaaatagtgcgatcactcttgggaggcttagctgggtctgtccagacatcgtggcccctcatatggagcatttcatgcaagcatggtgcagtgccttgtgcacgatcagagatgattttgagaaagaggacgcgtttcatggactgtgtgcaatggtggcagcaaaccctacaggagccgctggttcattagcttacatctgccaggcctgtgcaagttggactgagataaaaagcgaaggtcttcacaatgaggtgtgccagattctgaatggctacaagcagctgcttggaaacaacggtgggtgggaacaatgcatggccgccctgaaaccagatgttgtgcagaaattagctagatacggagtatgatgagaagcaagctcgtgtggtttattcacctcatacaccgaccatcatctttatggcggagacaagagaggagcagaaaggggtgggggtcgtcgagagtgtctctgctgctgatgcatcatctttacatgtgtggcacttgagagtcgattcggttcgttggtacgccattgtccgttcgttcattgttatactggttggtgcacagcatttccagagcgagagtaggatgtcttggtaaaccccccatgtgtattggttggttgggccagtggacttggttttggtttttttgtcattcctactggcaaacacaacaaggccaccaccctcttgctcgccccaccccggcaacattgagaaaacagaggttttgtagcgtgtaattctctctcttttcttggtttcttattattattaggtgtaggattgttttcgagtcttgtttggcaggaagggtttgtacgagaaatcaattgattgctcactcaccacaaaataataaaaaagatcgatcgatggggcttgtatctcctacggctaaaaaaaaanaaaatt

SEQ ID NO: 4078 - DNA, 659 bp, Zea mays
gagataaaaagcgaaggtcttcacaatgaggtgtgccagattctgaatggctacaagcagctgcttggaaacaacggtgggtgggaacaatgcatggccgccctgaaaccagacgttgtgcagaaattagctagatacggagtatgatgagaagcaagctcgtgtggtttattcacctcatacaccgaccatcatctttatggcggagacgagaggagcagaaacgggtgggggtcgtcgagagtgtctctgctgctgatgcatcatctttacatgtgtggcacttgagagtcaattcggttcgttggtacgccattgtccgttcgttcattgttatactggttggtgcacagcatttccagagcgcgagtcttgccccccatgtgtattggttggttgggccagtggacttggttttggttttttgtaattcctactggcaaacacaacaaggccaccaccctcttgctcgtcccaccccggcaacattgagaaaacagaaaggttttgtagcgtgtaattctctctcttttcttggtttcttcttattattaggtgtaggattgttttcgagtcttgtttggcaggaagggtttgtacgagaaatcaatcgattgctcaccacaaaataataaaaaagatcgatcgatggggcttgt

SEQ ID NO: 4079 - DNA, 3098 bp, Zea mays
gcttttcactagtttggattcggacttcctgagctccgccgattccttcctcctccacctcctctcctcccccagccgccgccgctgctcatcttatctttatctcatccccatcgcccgcccttgctccgcccccgggaatcgtcgatggcggcgtcggcgctgtggcagccgccggagcaggggctccgcgagatctgcgcccacctggaggcgcatatctcacccaactctgaccaggcccgcatctggcagcagctccagcagtacagccagttccccgacttcaacaattacctactcttcatcctggcccgcggagaggggaaatctattgaagttagacaggcagctggtctattactgaaaaacaatctgcgaacgacttacatttccatgcaatcttcatcccagcattatgttaagtctgagctgttaccatgtataggggcaaccaatagggcaattagatccacagttggaacagtgatcagtgtgcttttccaaattgtacgagttgctggatggattgagttgtttcaggcactccataagtgtttggagagtaatgacctggatcacatggaaggtgctatggatgcgatatacaagatctgtgaggatgtccctgaagagcttgatgttgatgttcctggtttgtctgaacgaccgatcaacgtgtttatgccaagaatactgcagtttttccagtcaccacatgcaagtttgagaaaactatcattgggtatcataaaccagtacatagtagtgatgccatcggcactctacatgtctatggatcagtatattcagggattattcaaccttgcaaaggactcttcagcagatgttcggaaactggtttgttcagcctgggttcagctcattgaagttcgcccatcaattttggagccacatcttaaaaatgttactgaattgattctgcaagctaataaagattcagatgatgaagttgctctggaagcttgtgagttctggtctgcatactgtgatgtgagcatgcctcctgaaggtttacaggagttcttgccgcacttaatcccgactttgttgtcgaacatggtatatgctgacggcgatgagtcccttgatgatgctgaggaagatgaatcctttccagacagggaccaggatttgaagccccgcttccatgattctcgattgcatggatcggaaactggagatgacgatgatgatgctgatgctgtaaatgtctggaacctgcggaagtgtagtgctgctgggttggatgttctctctaatgtgtttggtgacagcatccttccaactttaatgccattgattgagcaaaacttggctcgaacagatgatgattcttggaaggagagggaaactgctgttttatgtctaggcgctatagcagaggggtgcattagtggtctatacccacaccttcctcagattgttgcctttctaatcccacttcttgatgataaatttcctcttatacggagtattacgtgttggacgctctctcgatacagcaaattcattgttcagagccttgatcatccaaatggacgcggacaatttgataagattcttatgggagtgctcagaaggatattggatactaacaaaagagtgcaagaggctgcttgttcggcgtttgcaatccttgaagaggaagcttctgaagaattagtaccccatttggaagtaattttgcagcacctcatgtgtgcctatagaaaataccagagacgaaatctccggatactctatgacgccctcggtaccctggctgatgctgttggagcagaattaaatcaggcaaaatatctagacatatttatgccgcctttaatcacaaagtggcagcaactttccaattatgacaaagatctatttccactccttgaatgctttacatctatcgcacaggcattgggaccaggatttgctcagtttgcggaaccagtgtttcaaaggtgcattaatcttatccattcgcaacagttgtcaaagattgatcctactgcagctggtgcggtgtatgatagagaattcattgtttgttctttggacctactatcaggacttgcagaaggtcttggcgctggtattgaaagtcttgttgcacagagcaatttgagagatctacttttgcaatgctgcatggatgaagcagctgatgttcgacaaagtgcccttgcacttcttggagacctttctagggtttgcccaatacatttgcatccacgccttcaagaatttcttactgttgcagcgaagcaactgaaccctcaatctgtgaaggatgcggtatcagtagctaacaatgcttgttgggctattggagaattagcaatcaagattggcaaagaaatagcgcctgtggtgatcaccgttgtttcgtgcttggttcccattctaaaatccccagagggttcgaacaagtcacttgttgaaaacagcgcgatcactcttgggaggcttagctgggtgtgtccggacatcgtggcccctcatatggagcatttcatgcaagcatggtgcaaggcgttgtgcatgatcagagatgattttgagaaagaggactcgtttcatggattgtgtgcaatggtggcagcaaaccctacaggaggcgccggttcattagcttacatctgccaggcctgtgcgagttggactgagataaaaagtgaaggtcttcacaatgaggtgtgccagattctgaatggctacaagcagctgcttggaaacggtgggtgggaacaatgcatggccaccctgcaaccggatgttgtgcagaaattagctagatacggagtatgatggcagtggtcgtgtggtttcatcatctttttacgctggagacagagatcaggatggttggttgggtcacttgctcgtccctcccgcctcccagtcccaggcaaggcgacattgatgaaagaaaggtttttgtagcgtgtaattcttttcttcctcttcctcttagcaggtgagtccaaaattacattaccaattcatttttgcccaataataaaagatgaagatccatgggatttgtttaaaaaaaaaaaaaaaagtcgacgcggccgcgaattcgg

SEQ ID NO: 4080 - DNA, 3415 bp, Zea mays
  misc_feature (2283)..(2283): n is a, c, g, or t
gtacgtgggccagtctgtgggcaccctacagggcagttttccttttttttttcgagcttcactgttactagtactactagtatcactatactgtggtctgtgccgacgagcgatgtctatactgtctactctgcacgaggccgcgtggcagttgcggagagggcagatgtcatgaagaaaggcatgggcgtcagctggctctctctgcctgcaatcccggcgggtcggctcgcgcgggcacgaggggcggcacttggattcccacgttttccacccaccaagtcagcaccagagcatccgctcctccgcggcgcgccgcgtgctccccgcagccccagccaccatttaacgccgcgtcggccccccccagcccgcccgggctgcaccagacgccaatcccgatcaccgccgcccaacctcacctcccctccgtcccccgagccacctctgtaaccctgttcggtgcctctcactccggctgccagatggacagcgccgacgcggcgacggcgctgggcgcgtggatccggggctacttcacgccggccacgttcttcctcgtcgtcaacctcgtcatcggcaccatcgcgctcacctcccgcgccaccaagcagcgccgccgcagggagaactactaccacgacgacggcaacggccaccaggaaacgctgcacccgcagatggagcagccggggtacggccactactaccacccggaccccacgctgtacgcggcgccgcctccgcccgcgccgctcgcgcgcacgtcctctgtcctcgaccgcctcaggtcgctcggcctgtaccgcttccgctccggggacttcccgcccgagtacggcgccacgccgccgaaccacgcgcaggatgtgcccgctccggtggaggaggaagagacgatcgcgtcggcgcactacgcaaggagccggtccgagccggcgcctgctgcgcgggagggtgagaggaggccggcgccgcccagggtaaagaagtcgggctcggaggtgaggaagtcgcaggtgtcgcgggcggcgcccaggatcgtccaggcggtcaccgaggacgacgtctccgtcgaggaagccgaaggcggcggtttcaggcggaggccgtcgccaccccagcaagagtaccactaccggcaagaatacgtcactccgccgccgccggcacccgccccgctgcagcgcacgtcgtccgtgctggacaggctccgctcgctgggcctctacggcttcctcgctcccgacgaacccgccgccgccgcgtcagttccagcgagcgacggcttcgccaccccggcggacgagaagaggcacgcgcacacgcactacgacatcggccggtccgagccggcacgggagcagcaggacaagaaggagaagacgcaggggggcaactcaacaagggccaagtcgagctcgggggctaggaagacgcccgctcagaggcaggcggaggccggcgccgagtgcgtggacgcgagggcggaggcattcatcgacagcttcaggcagcagcagcaggtgcaccactaccaggaggaggaatacgtcccgcctccggcgcccgcgccgccgctgtcgcgcacgtcgtccgtcctggaccgcctccgctccttcggcctgtaccgcttccgctccggcgacctcggccccgaccttccctccgccaccgccgccacggagacggacaaggagaagcagcaggcggcgcactacgggcggagccggtcggagccggcgcgggagcagggcaagaagcaggacacgaggatgaacaagtcgagctcgagcggcgtcgtggcggaggcggacgcgcatcagtgcgtgaacgcgcgcgcggacgacttcatcaacaagttcaggcagcagctacagctgcagcgactgaactcgctgctcaactacaaggagatgctcaaccgcggcggtgacaagcagtagccggagcgtgcaaggcggagggagaagggtagctagctgtaggatccaatccaaaaccatactgaaaaaaaaaatcgatctttggtccatcaaccactagacctcgagtgtggattatgcagtgttgttcttattagcatcgttatgtaagaatcgctattttttcagcttgttaatttcaattggtttgtgttgctggcatcctgctgtgctatggttcatcattcatagtatgttcgtcaccgcaaaggtacaaggcgtaagcctaagacgttaatgagcggacagtgatgttaattggaatggcgtttgtgtttcggacgtcagagtccgtccntctgcctccagatctttcctgcttctggccctgaccgttgatcttgacctcatgaatgaactaaaaatttggtactgtgagcgttctcgtcttctccgatcgcaggatggcccatgcaaacgacggtgccttcttgccgtttttattttattttagccttttttctaaaaaaatgtgtttagacgactagtacaactaagatattttttagagcagtgctatacgtacaaccgggttgtacgactctcattcgaccagggtgtgcaacgataaagaaatactagttggtccacgtgggttacgttggtcgtcaattaacaaaatcgattataaaaaatgattaagtctatttctctttcaagatggtcaaataggttgtgtctagcgagccggtccgaggcacaacccatttttagtgtctgagccaacccggcacgtgcgtcgtgcggtgcttaggccgtagcctcagctcgtagtcctggcccgacccgacacaattatttttttttattttataaaaaatcatatatacatatgtacaatttatattcaatattataaacacgtgagcataatgtttctgctgtttagacaactttgtctagtgttttttcacccttcttccatcagggtgcgggttcaaagttcaaagcccaacttctacagtgatttttaacattttacgctaagctgatttagaagaaatatagaaactttttttgtaaaaagatgatcgttgaaactagtgctttaagtatagtagagaattagcttctacattaaccatagtagtatgcatgggttggatatatacaatttttaatttttagacccgtaggagccggcactacatccgttcacaaatatatgacaccgttgatttttttaaaaaaaactttaatcactcgtattattcaaaatatttttcaaaaaatgtaaaattttaaagcaagcacaaactaccttaagtaataaaataaatcacaaaaaagtaaatgataactcgttttttaataagacgaatggttatagttttttttaaaagttaatgttgtcatatattcatgaacggatggagtatgacctatagcatccagttataggtctaagggcttgttggatagaagggaat

SEQ ID NO: 4081 - DNA, 1341 bp, Zea mays
gatttggccctacttggccgaggacaagtttggcaggattcacgagtgctcgtagcaaatctacaaattccccaaccgccccccaacaaagtcttcccacggaggtacacagctacgcgcaaaccgcgtctcgcgcgaagaatccgcatttccccttccccgcaccgcacccaacccccgtcggagagagagagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaatttcgttttcctgggtctgttcacgttgtgcttgagcttcagcatcggtgtggcttgtgctaacacccaagggaaaatcgttctggaggctttagtgctgacggctggcgtggtggtttctctgactgcgtatgccttctgggcgtcaaagaagggcaaggaattcgggtacctggggcctatcctgtcttccgcgcttactatcctcgtcctaactagctttcttcaggttttcttcccactgggacccgtgtcggtgggcttgttcggtggtctaggggctctggtcttctcaggcttcatcctgtacgacaccgagaacctgatcaagcgccacacctacgacgagtacatctgggcgtcggttgggctgtacctcgacatcctgaacctgttcctctccatcctgaacatgctcaggagcatgcaatccgacaactagccggtcaaagcaccgcaccgcggcctcttgatcgaacacggtatacccccatggtaaatgcggtcctgtgctctggttgttaagaggacgggatcgaagtgcgacatatgtattgtctattgtgagagcccactcgtgtcaacactgcaaacaattgtgctctggtcatgtcaccttgtatgttcttggtcactttgcaaacaattgtaagtacctcacagggcggccgctcggcgccattcgcgctaaagcgcccaatgatccagtaacaggttgtcatcacagttttctgcacatgattcattggactatgtaaagttggatttgaaaaaggaaaactgttgag

SEQ ID NO: 4082 - DNA, 1300 bp, Zea mays
caaaatcccaaaccgcctctcaacaaagtcccgccacggaggctacacagctacgcgcaaaccgcgtctcgcgcgaagaatccgcatttccccttccccgcaccgcaccgcacccaacccccgtcggagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaatttcgttttcctgggtctgttcacgttgtgcttgagcttcagcatcggtgtggcttgtgctaacacccaagggaaaatcgttctggaggctttagtgctgacggctggcgtggtggtttctctgactgcgtatgctttctgggcgtcaaagaagggcaaggaattcgggtacctggggcctatcctgtcttccgcgcttactatcctcgtcctaactagctttcttcaggttttcttcccactgggacccgtgtcggtgggcttgttcggtgggctaggggctctggtcttctcaggcttcatcctgtacgacaccgagaacctgatcaagcgccacacctacgacgagtacatctgggcgtcggttgggctgtacctcgacatcctgaacctgttcctctccatcctgaacatgctcaggagcatgcaatccgacaactagcctcttgatcgaacacggtatacccccatggtaaatgcggtcctgtgctctggttgttagaggacgggatcgacgtgcgacatatgtattgtgtgagcccactcgtgtcaacactgcaaacaattgtggtcatgtcaccttgtatgttcttggtcacttttcaaacaattgtaagtacctcatatcgttttgcgctcgtgctattcgcgctaaaaatcacaatgatccagtaacaggttgacatcaaccgcggccaaaaaaatttaaaggaggggagttaaaaaaaataaaaatacttttttataaatttaatataataaatataaaaaatatattaaataaaattttataataattatccaaataaaaa

SEQ ID NO: 4083 - DNA, 1223 bp, Zea mays
aaggattcacaagtgctcgtagcaaatctacaaaatccccaaccgcctctcaacaaagtctccccacgggaggtacacagctacgcgcaaacccgcgtctcgcgcgaagaatccgcatttccccttccccgcaccgcaccgcacccaacccccgtcggagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaattccgttttcctgggtctgttcacgttgtgcttgagcttcagcatcggcgtggcttgtgctaacacccaagggaaaatcgttctggaggctttagtgctgacggctggcgtggtggtttcgctgactgcgtatgctttctgggcgtcaaagaagggcaaggaattcgggtacctggggcctatcctgtcttccgcgcttactatcctcgtcctaactagctttcttcaggttttcttcccactgggacccgtgtcggtgggcttgttcggtgggctaggggctctggtcttctcaggcttcatcctgtacgacaccgagaacctgattaggcgccacacctacgacgagtacatctgggcgtcggttgggctgtacctcgacatcctgaacctgttcctctccatcctgaacatgctcaggagcatgcaatccgacaactagccggtcaaagcaccgcaccgcggcctcttgatatcgaacacggtatacccccgcggtcctgtgctctggttgttaagaagacgggatcgaagtgcgacatatgtattgtctattgtatgagcccactcgtgtcaacactgcaaacaattgtggtcatgtcaccttgtatgttcttcgtcactttgcaaacaactgtaagtacctgatatcgttttgcgctcgtgctattcgcgctaaaaatcacaaaaaaaaaaaaaaaaaa

SEQ ID NO: 4084 - DNA, 1202 bp, Zea mays
aagtttggcaggattcacaagtgctcgtagcaaatatacccagtccggagccgccccccggcccgggcccccacggaggtacacagctacgcgcaaaccgcgtctcgcgcgaagaatccgcatttccccttccccgcacccaacccccgtcggagagagagatggcatcggtggcggagatgcagcccctcgcgccggcggggtaccgccgcgcgccggagatgaaggagaaggtggaggcgtcggtggtggacctggaggccggcaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaatttcgttttcctgggtctgttcacgttgtgcttgagcttcagcatcggtgtggcttgtgctaacacccaagggaaaatcgttctggaggctttagtgctgacggctggcgtggtggtttctctgactgcgtatgctttctgggcgtcaaagaagggcaaggaattcgggtacctggggcctatcctgtcttccgcgcttactatcctcgtcctaactagctttcttcaggttttcttcccactgggacccgtgtcggtgggcttgttcggtggtctaggggctctggtcttctcaggcttcatcctgtacgacaccgagaacctgatcaagcgccacacctacgacgagtacatctggggcgtcggttgggctgtacctcgacatcctgaacctgttcctctccatcctgaacatgctcaggagcatgcaatccgacaactagcctcttgatcgaacacggtatacccccatggtaaatgcggtcctgtgctctggttgttagaggacgggatcgacgtgcgacatatgtattgtgtgagcccactcgtgtcaacactgcaaacaattgtggtcatgtccccttgtatgttcttggtcccttttcaaacaattgtaagtacctcatatcgttttgcgctaaaaaaaaaaaaaaaaaaaaaaaaaaaaaaaaactcgagggggggccca

SEQ ID NO: 4085 - DNA, 2416 bp, Zea mays
cgaccgcgcgctgtggcaggcccccgccgcggccgccgggatcttcgcggacaaggtgctggaggtgatcaacccggacgacgacttcgtgtgggtgcacgactaccacctcatggtgctccccaccttcctgcgcaagcgcttcaaccgcatcaagctcggcttcttcctgcactcgccgttcccctcgtccgagatctacaagacgctccccgtgcgcgaggagcttctgcgcgccctgctcaactccgacctcatcggcttccacaccttcgactacgcgcgccacttcctctcctgctgcggccggatgctcgggctctcgtacgagtccaagcgggggcacatttgcctcgagtactacggccgtacggtgagcatcaagatcctgcctgtgggggtgcacatggagcagctcaagacggtgctcgggttgccggagaccgaggccaaggtgtccgagctgatggagatgtactctggaaaggggagagtggtcatgctgggcgtcgacgacatggacatcttcaaggggatcagcctcaagctgcttgccatggaggagctgctgcggcagcaccccgagtggcgggggaagctggtgctggtgcaggtcgccaacccggcgcgagggagggggaaggacgtcgccgaggtgcagaccgagacgtacgccatggtgcggcgcatcaacgaggcgtacggtgagccggggtacgagccggtggtcctgatcgatgagcctctgcagttctacgagcgcgtggcctactacgtcatagccgaggtgtgcctggtgaccgcggtcagggacggcatgaacctgattccctatgagtacatcgtctcccggcaggggaacgagaagctggacaggatgctgcggcaggggaagccagaggagaagaagagcatgctggtggtgtccgagttcatcgggtgctcgccgtctctgagcggcgccatcagggtgaacccgtggaacatcgaggccgtggctgacgccatggagaccgcccttgtgctgcctgagaacgagaagaggctgcgccacgataagcacttccgctacgtgagcacccacgacgtcgggtactgggctaacagcttcctcctggaccttgagaggacctgcaagtatcattctcagaagaggtgctggggcattggcttcggcctgcggttcagagtggtctcgctcgacctgaccttcaggaagctttccttggagaacatccttatggcataccggagagccaagacacgggcaattctgctggactacgatggcacgctgatgccacaggcgattaacaagagcccgtccactgaatctgtgcggatcctgaacagcttgtgccgagacaaggacaatgtggtgtacctatgcagcgggtatgaccggcgcacccttcatgagtggttcccttgtgagaaccttggcatagccgcggagcatggctacttcctgaggtgtaagagggacgcggaatggaagacctgtgtcgctgccacagactgcagctggaagcagatcgcggagccggtgatgtgcctgtacagggagacgacggacggctcaaccatcgaggacagggagacggtgctcgtgtggaactacgaggacgcggaccccgacttcgggtcgtgccaggccaaggagctcgtcgaccaccttgagagcgtgctcgcgaacgagcctgtgtcggtgaagaccacgcctcactcagttgaagtgaaaccgcagggcgtgagcaagggcttggtggctcggcgcatgcttgtgtcgatgaaggagcggggccagtgcccggacttcgtcctgtgcatcggcgacgacaagtccgacgaggacatgttccagctgatcgccaccgctgcctgcggggactcgctggcgtccaaggcggaggtgttcgcgtgcaccgtcggccgcaagcccagcaaggccaagtactacctcgacgacgcggcggaggtggtgaggctgatgcaggggctctcctacgtctccgaggagctggcgctggcgaaccagcgggatgaagacgaggactcctctttggacgacgtgtgggaataggaaggagcgttcccttcccgtgctgctcctgcggtaatgtctgtttgtgttgttggctcggctggagctttcgccgagtagtttaggtgtgtaaatgaggtatgcttttcagcgtaatgtattgccagtggtctagtctcgagagctggcttgaatctagtgatgctctagtactttggtttgtggtgctatttacctgatccgtggaaggcagtactatgagctatacaagatgcagacctgaaatctcattcatctgaagaccatgacctttctcctaggcgtgtgtatacgtctttggattttggaactaaaaaaaaaaaaaaaaaaaaa

SEQ ID NO: 4086 - DNA, 1660 bp, Zea mays
aagcatagcagcagcccattgcctgcctttcggcttaccctctctctctctctctcacacacacacacaaccactcacactgccggttggtttcccttccgttgtggttggtgcgtacttagtggcggccggccatggcgcggaggaggggcttctcggcggtggtgccgccggcgtggctgccggcggtgctcctgtgcctggcaggcgcggcgtcgggcgagccgctgccgcagtactacaatgccatcttcagcttcggcgactccttctccgacacgggcaacttcgtcatcatcaactcgggcaagctgcccaacatgcccaagttcccgccgccgtacgcgaggtgctccaacggccgcctcgtgatcgacttcctggccgaggcgttcggtctcccgctgctccctccgtcggcgaacaagggcaccaacttcagccagggcgccaacttcgcggtgatgggcgcgacggcgcttgacctcaagtacttcaaggacaacaacgtgtggagcatcccgcccttcaacacgtccatgggcgtgcagctggagtggttccaggaggtgaagcgcagcatctgccccgacgaccccgccgcgtgccgcgccctgttcgggagggccctgttcgtgttcggcgagttcggcggcaacgactacagcttcgcgtggaaggcggactggtcgctggagaaggtgaagacgatggtgccggcggtggtggcgtcgctggtgggcggcgtggagcggctgctggacgagggcgcccgccacgtcgtggtgccgggcaacctccccgccggatgcatccccatcacgctcaccatgtacccgtccgaggaccgctccgagtacgacccgcgcaccggctgcctcaagaagtacaacagcgtcgcgctctaccacaacgccatgctccgcgtcgcgctcgaccgcctgcagcgccgccgcccggagtcccgcgtcgtctacgccgactactacacgccctacatacagttcgcgcgcacaccgcacctctacggctacaagcgcggcgctctgcgggcttgctgcggcggcggcgggccgtacaactacaacgtgagcgcgtcgtgcgggctccccggcgccaccacctgcgaggaccccgacgcgcacgtcagctgggacggcatccacctcaccgaggcgccctaccgcttcatcgccaacacctgggtcaagggcccctacgcgcacccgccgctcgccaccgtcgtgctcgaggacatggtcgactgatcctcttgtggtttggcacaagggaagagctgatatgtaacgtgaattccattcgttcatgtccatgtatattgggtactaccggagcggagtaacaaaaaaaaatatatatgttagtcttttctgtttttttttcgtcgtgcacctgtgtgccgtgcagtcgcatagatcaatgaagaaaccactccagctgtttttgatgattggtttaggcggacttgcaagcggtcgagcctgcttatgttgggcagtgtactgtacacgctaaggccttgttcgtttctgtcggatcggtgggtcggaacgattccaaaccggattgcttctctaatttatataaactttgattgagtggaacgattccaagaaaaaaaaaaacccacacccaagcc

SEQ ID NO: 4087 - DNA, 5540 bp, Zea mays
  misc_feature (96)..(96): n is a, c, g, or t
ggccgtactttaaatatcgcttggtctcgcgtgcatttcctctcttttttttcgctacccgcatgcgacagaaaaggaagtgttgggtgacagtgnaatctactaccaaggatgaatatatggctgtaaatgtgttctgaagatgcgtgtggcagttcagttacaacgatcatctatctatctcgttacacagtttatgatttatttaaacctgggaatttatgtatgttttttttctccttccaactgtcctgatacgtggtatgattttcctgtcacctcaacggctacttgattaaacattccggctggcagtgatagatgtccccaggcgatatgacaccggacgccctgcacttgcacagagaaggcagggcagcccactaagcaagcaaggcatgtgtgccatgtccaaccaccactccagctaccttcccatcaaagtcacccaaaaacaaaccttccgttcctcgtccccatccatccaccaaggccatggcgcgccatgctctccctgcacagcccatccatacgccggccaatggccatggccagccgcaaacaaatcaaacggtgttgaatggactgcacgtagagactagagagagatttattatttattttttttaaaagaaaagaagtataaagggcctaccccagaataaacaaacacagcaatcaagcaagcaaacagaggcataattagcaccaccgtgtagcaagttgcaatccatgtgcccctgctatataacaatccaacccctctcctcagcattgtcgtgcgtagcatagcagcagcccattgcctgcctttcgccttaccctctctctctctctctctcacacacacacaaccactcacactgccggttggtttcccttccgttgtggttggtgcgtacttagtggcggccggccatggcgcggaggaggggcttctcggcggtggtgccgccggcgtggctgccggcggtgctcctgtgcctggcaggcgcggcgtcgggcgagccgctgccgcagtactacaatgccatcttcagcttcggcgactccttctccgacacgggcaacttcgtcatcatcaactcgggcaagctgcccaacatgcccaagttcccgccgccgtacgcgaggtgctccaacggccgcctcgtcatcgacttcctgggtaagttacaagtctcgtctcgtctcgtcgccggatagaatcgattgatttggtggctggctgcctggctatattaattaataattaactaacgaaccgcagccgaggcgttcggtctcccgctgctccctccgtcggcgaacaagggccccaacttcagccagggcgccaacttcgcggtgatgggcgcgacggcgcttgacctcaagtacttcaaggacaacaacgtgtggagcatcccgcccttcaacacgtccatgggcgtgcagctggagtggttccaggaggtgaagcgcagcatctgccccgacgaccccgccgcgtgccgcgccctgttcgggagggccctgttcgtgttcggcgagttcggcggcaacgactacagcttcgcgtggaaggcggactggtcgctggagaaggtgaagacgatggtgccggcggtggtggcgtcgctggtgggcggcgtggagcggctgctggacgagggcgcccgccacgtcgtggtgccgggcaacctccccgccggatgcatccccatcacgctcaccatgtacccgtccgaggaccgctccgagtacgacccgcgcaccggctgcctcaagaagtacaacagcgtcgcgctctaccacaacgccatgctccgcgtcgcgctcgaccgcctgcagcgccgccgcccggagtcccggcgccgtctacgccgactactacacgccctacatacagttcgcgcgcacaccgcacctctacggtcagtcgcttcttcgatcgttttgatttgattctattctcttcttttctcttctcttctctcataggaccaggaagatctatctgctctgctctgctctgctttgctgctctgggcctctgccacgagcagagcactggtcctggtccaccactaatcactgaccgaccaaccgaacaatcgcgtgaattctccctcccgcctgtcgcgggggacgctcgtacgccagccacagccaggggacgggtgagagagctagggtcatggcctacgctggcgaggtgtgtcagggtttgccagagcaactttggtgtgagtgtgagcgggagttgagttcaccaacccgcacagcagagcagatcctggcacagcctgtgctagcagcacggcgtaccgaacgcccatctcccgtccccccctcggcttggctccacctccactccactccaccccgtccatggatccttccatatacggcccgaatggccaccaggaccaacttggcaccgtgctgccacgccacgacaagctatctgtcctcccgaaaatttgctaggggtggtgggtggaggacgcgcatcggacctgattgtactcaactcgtaaatacaggctacaagcgcggcgctctgcgggcgtgctgcggcggcggcgggccgtacaactacaacgtgagcgcgtcgtgcgggctccctggcgccaccacctgcgaggaccccgacgcgcacgtcagctgggacggcatccacctcaccgaggcgccctaccgcttcatcgccaacacctgggtcaagggcccctacgcgcacccgccgctcgccaccgtcgtgctcgaggacatggtcgactgatccctcttgcttctgcaggattggtttgccacaagggagtagctgatatgtaacgtgaattccattcgttcatgtccatgtatattgggtactaccggagcggagtaacaaaaaaaaaatgttagtcttttctgttttttttttcgtcgtgcacctgtgtgccgtgcagtcgcatagatcaatgaagaaaccactccagctgtttttgatgattggtttaggcggacttgcaagcggtcgagcctgcttatgttttgctatgttgggcagtgtactgtacacgctaaggctcaactcgatggttggcacccagacaacaccagcccaaaaacgcactacacgtctctgcgtgtccatgagactatgaaccgtgcgtgcggcttgggtccggtcggtcccgggcggtggtgctcgtctgcccgagcggaggcgcgccaggacagaactagagctttcggcgccgaccggacggacgctcaaactttgcgaggtgcgtgtcagtccgtgactgtgcgcggcgaccccttatcatcaggccaagattattgcgtactgtactgtacggccgaagagccggctccagcagataacaaaatttgccgaggcggtaggcgtaggagggagggaagaacaagacagcgttgcctgggaggctggaaccagcaacgcacatatgccgtggcccgctcgagggaccagacgccgccggacgtggcgcaagcgaagccgagctggctcgcagtcgcaggaaaccaaagcgctttttggacgcctccgcccttggcagcttaacacgccgtaatcattgccgcctttttcacgtatacttacgagtaccactaattgtttgaccatggcgatcggcaacgcggtcattattactaatactccgttgccgagacaagaggccgcaacaccgtcccggcgcgccgaggcatcgaccggcggtgggggatccaccgcttcgctcgccgtgcgtccgccgcccggcagtccgcgcagccgcgcgcgcatcggtggtggcactggcagtcagcgggcgggggtccgggagaggaggggggacgcgcggacgccgtgcgctgcttcgccgcctcgcatgctgccgaggaggccggtgcggtgcgaggcggtgcggcgcatgtgcgcgtgcccgccccgagacaggccgtcacgtgcgcgcatgtgggctcgcctctcgcgtcgcgcccgcgttcgatggtgcgttcgtgttggggaccgactcaagcacaagagacgatgaccccatgggcagacgcatcacaaggcttacacgtggattctgaggatcagttttagcccgaactgcccgcttagataaatcgggcgttctaacaatccaccgaccgaacgccgctccacggaatgtggacgccgatcgggtcaacgtgcacctaaacatgaagcttagataaatcaatccgttcttttgttcgtccattacaacccttcaaaaaaacgctatcagtctcatcagtatgtccacttttatcctcgcacattgaagcttcattaaaaaaaatcattgactagattgacaaatatagaagaagaaaaaaattgtctttgaaagagctaaccaggaatcaaagcaaccctcaaagtattcataacccatggtttgtatgtcaaaggcctcgaagaacccacaccgaattccctttgttaaacaccttcttaaattcttcaattgcattgagatgccttgggttactctaatttggtaaagttattagtaacccaagttttcctgattcatcaaaaagctcattttcatgataaaactaagaattcgttattacataatattgtaatttcaaatataatttagtaacaatggtgatggtatatatatatgtcatggtcaatatgattctcacagtgcaaactatcaatgttaatttttcaattcgtcgatagcccggcaatactttgttgggaacaccataactccatctgaagcgactttgaggtccatgagcactcgataaaatcttattcgatagatttgaaatagatctagtcctacatcaatatcacgtcagcaaggttttcaaactgacacgacaatttgctactatttctgtatgacactgtcatgggctagtcatttaaccttagaacccagaccaaagttggagcatgtcccaaataaatggagaacatgaaaaataagctttcgtacatcctccttcttggccaacacttttagaagtcagcaaggacgtccatgcataggtggagtcccaatccaagtcaagttcgagtccttctcggaatccagaactagctagcaataaatggatgcccggtacaaatacgaactccatttttgacgatccacatatggatgcaaagttatgaagataagatttccaacccaagtggtctcacctcgattttttcggaattaattgaaatcatcaaaacaagtgatgattagacccgtgatttgcaaaaggcattagccaattctcgatagaacacaattcccatgcatgatacccattcaatatgcgaaagggtctctagttgatttagttaaatggtcttaggaacagtcctcaggttctgaatttgacttccaagaaagtcccctatctaatttggtttccattaaaagtgttagattatatgtatatgttgtttcctgttgtaataggcttgttttagggttaggttttccaataaatgggggattgaatatttacaaataacaaggacataggcccaacaaaagaaagaagaggaa

SEQ ID NO: 4088 - DNA, 2172 bp, Zea mays
aatattttagtttctatatttaataatttaaaaactaaaataaaatgagagactaaaaattagtcccagcaatccctaactttttcttatttcaatattcgtgtcaatggcgttgccgcccccctcgtccggtcagttttttgggtccacaattccgcattgccatctagtccagttccagtccgagcagcagcaagcggcggcggcgatgggctctggatccaactccaaggagggagaggagcgggtgctgagccacggtgacgtggtgctcatccgctccgacctcgcaatccttcgcggtccctgcttcatcaacgaccgcatcattgccttctacttcgcacacctctccgccagcctccaggacgacgacctcctcctgcttccgccctccatcccctacctcctctccaacctccctgactcggccgccgtcgccgccgtcgccgagccgctccgcctcgcctcccgccgcctcgtgctgcttcctgtcaacgacaatcccgatgcctccatcgccgagggcggttcccactggaccctcctcatccttgataacatcactagcccctccgtgccccgctttgtccaccacgacagcatcgctggagcgcccaacctcccaatcgctgcccgcctcgccgacgcactccgccccctgctgtcaggcagcaattccaagagggatactgttccgcttatcgaggggcccaccccaaggcagaccaacggctatgactgtggtgtctatgtcatggccatcgccagggctctgtgcgcctggtggaagagtggccaggaccaacgaggaggcgattggttccaggcggtgaggagcggggtggacgcccacagcgtcgaggccatgaggaccgacttgctgcagctaatcagcactctcatccaagagaaggccaatgccaattccacacccatgggcgacactgacccagggtcattagaatgataggcagtagattagttgctggtggtgatttctcaaatctggtacctcttcttgatcttaataagttatttcttgctgtttctgcttgtttgggaagaggaggaacagatggagcatacacacttcgtgtaagtaccaaacttttaaggaaaacacgtctcttgtgtgagtcaagtcttggcaaaatccagttgcaactctactattattattgtctatgatcaaaatgctgcaatcaatactgtgcttccgtttgcaagtttgttgagtatggatggattggtgcgagttgtaagcctttggagtttgaatgctagcgcagtgcaggtacttgttttcttttaatgtttgtatgggcagtatggcacttcagatttatttcacagcagacaaatgtttggctgttaattgaacagtttaagcaaagtttcctgtgaacctttgctcactggaattcagaatttaagaactacataacatgtgctttggctggattggtgctgaagttctatgcctttggagtttggttactaaggccaatgcatggacatgtatttctttgtatggtttggaatttaaattgccatttgagagtttaacaagagagagaaatggttggtcgagaagttcatgtgtgatttcttgaaacttcttcactggaattttagaattcaagagctatattacatgtgctttcacatgtccctcttactcaaacgtttcaccgaatatgatattttgttgaggaaaaaacataagctggaaggaaactattataactgtgttatctgcaatagcaatgtggaagaaattgcttttcacttgttctgcagctgcaccctcagtcgagcttgctggcagcacctgggcatccaatggaattttgcaagtgatttcttccagatgttgatacaagccaagcaacaatttctgaatctttttttaatggagatattcatctttgatacttggcggatttgtaaacaaagaaataacttcacctttgataggggtcaagcttgcttagattcttgtaagctcaacttttacgaggaagtttgacttcaggctcataggatacgcgtccttagattcttggaagctcaacttttgtgaggaagtttgactttaggcttggaagctcaacttttgtgaggaagtttgactttaggcttggaagctcaacttttgtgaggaagttc

SEQ ID NO: 4089 - DNA, 1680 bp, Zea mays
cggattcccggtcgaccacgccgtccggggcgcgcgggctgctcgacgcgtcggcgtcggcccccgacccccgtccgcacgagaaaacaaatcgcctcttttccaggagccaaaccaccacaccttatatctgtcatactttctcgccccccgtgagccgtgaccccgtctcgcctcgccgccgccgccgccgccgatgggctccggggaggagccgtcgcagatgcggagggcgctggtggactctctcgcgggcgccatctccggcggcatctcccgcaccgtcacctcccccctcgacgtcatcaaaatccgcttccaggttcagttagaacccacaacctcgtggggtattcttcgaagggatgtgtatggaccttccaaatacactgggcttctgcaagcaaccaaagatattctcagagaggaaggtttaccgggattttggagaggaaatgtaccggctctgtttatgtatatgccatatacagctatacaattcactgttctacacaaactaaaaacatttgcttctggttcatctagaacagaggatcatttggatttgagcccttacttatcttatgtaagtggagctatagcagggtgcacagcaactatagggtcatatccatttgaccttctgaggactattcttgcatctcagggtgaaccaaaggtttaccccaatatgaggtctgcgtttattgatataattaaaactcgtggtgttcaagggctttattctggtctatctccaactcttgttgaaatcataccatatgccggtttgcagtttggttcatacgacactttcaaacgttcgatgatgacatggaacagatataaatattcacatcttagctttggaagcgaggatgattcagtatcaagtttccagctatttctttgtgggtttgcagctgggacattttcaaaggctgcatgccacccacttgatgttgtaaagaaaaggttccagattgaaggactaaaacgacatccaaggtatggtgctccaattgagagcagtacatacaagggcatgtaccatgccttaaaggagattgtcgtaaaggagggatttggaggcctttataagggccttttcccctctttagtgaaatcggcccctgctggtgcagtgacatttgtggtttatgaatacatctcagactggatagggtgcaaggctggagttgagtaagttcttgttggatcatggagctgtcaggataacatgacgaaaactttttgcacaccctggataatggaggggaatggagaccataaggtcactcgtgaagtgcatacaatccctagagatctgattgcatacatgtaaagccttacatagaaaatagctgttttatcgtttcttattcttttgcccaattgcctaatctggtggtcggggtattcgttggcgtctcaaacaaggctgagtaaaactaacatagtgatcgtaacacagcatacatgacggaagtcaaaagcagccggcagttttgttgggatcgtgttacgaatattttttttccggctgaattcatgttatatatctactactacagctagtacgagtaacaatgtatgccactcagatggcgtatgtttaatggcagtcataatttttccataaaaaaaaaaaaaaaaaactcgagggggggcccggtaccc

SEQ ID NO: 4090 - DNA, 1656 bp, Zea mays
aaagccaaaccaccacaccccctaatctctcgctctcttcctttctcacccccgtgaccctgtctcgccccttctcgcctcgccgccgtagccgatgggctccggggaggagccgtcgcagatgcggagggcgctggtggactcgctcgcgggtgccatctccggcggcatctcccgcaccgtcacctcccccctcgacgtcatcaaaatccgcttccaggttcagttagaacccacaacctcgtggggtattcttcgaagggatatatatggaccttccaaatacactgggcttctgcaagcaaccaaagatattctcagagaggaaggtttaccgggattctggagaggaaatgtaccggctttgttgatgtatatgccatatacagctatacaattcactgtcctacacaaactaaaaacatttgcttctggttcatctaaaacagaggatcatttgcatttgagcccttacttatcctatgtaagtggagctctagcaggatgtgcagcaactatagggtcatatccatttgaccttctgaggactattcttgcatcgcagggtgaaccaaaaatttaccccaacatgaggtctgcatttgttgatataattaaaacccgtggtgttcaagggctttattctggtctatctccaactcttgttgaaatcataccatatgctggtttgcagtttggttcatatgacactttcaaacgttctatgatgacatggaacagatataaatattcgcatcttaactttggaagcgaggatgattctgtatcaagtttccagctatttctttgtgggtttgctgctgggacattttcaaaggctgcatgccacccacttgatgttgtaaagaaaagggtccagattgaagggctaaaacgccatccaaggtatggagctcgaattgagagcagcacatacaagggcatgtaccatgccctaaaggagattgtcgcaaaggagggatttggaggcctttataagggccttttcccctctttggtgaaatcggcccctgctggtgctgtgacatttgtggcatatgaatacatctcagactggttagagtcgatactgatgtgaaaatcttcaatgcagatagggagcaaggctggagttgagtgaggtcttgatggatcatggagctatcaagataccatgacgagaactttttgcacaccgtggacatggaggatggagaccggaaggtcaatcgtcaagtgcatacaattcctagagatccgatacatgtaaagccttacatagaaaagagctgttttgtcgtttcttattctttccccaattgcctaatgtggtggtagggcattcgttggcttgtaaaacaaggctgactacaactaacttagtgatcgcgacgcgtcatacatgactaagtcaaaagcagccggcagttttgctgggatcgtgttacgaatcttttctcggctgcagtcatgttttccttgcggcttgttggggctgcgtcttctacagtcttttttatttatatggattgcacctgcaacagactgcagcagctacggttgtagggcagccgaacaaatttcatggatgatggcagtcgtaatttattcaaaaaaaaaaaagaaaaaaaaaactagagggggggcccggtaccc

SEQ ID NO: 4091 - DNA, 6025 bp, Zea mays
  misc_feature (385)..(385): n is a, c, g, or t
accgaaatcgaacttataccttgaaatatagcacatataagaatcgaaccaaaaaatctgatggtgatgactcgggtctattcgggtttcgattttaaaatgaccactcctaagatcacaagcgaaaatctacccagccgtatcgtggtgactccggtctgccactctgtcacccccatgcaagccgcccagccgctcacatcagctgtgccagtgctgctgctgccttccgccgagcaccacaacctgaccgtctgttctctctcactcccaggcggccaggctaccagctaggctcggctgtggcaccgcctgcctgcctgctcgtcgccgagtcgccgaccgttgcgtgggtccgtagtccgtcctcttttaaaaaacaaanaaatgtgctatctcaccgagacactaccagcacagtaactgacatatgggtctagcaaaactttcggtcccatctatcagtgggcatcctcgaagacaacgagtggccgcgggaaagacctgcggcctctgctacctttccctcttcccctcgcttggcacagattcccagcgctgccaaaagcaaacaacagcctcctctcccctcccgccattactcaccggacaccgacgcatcctttgcgacgtctggctggcatgatggccccacaccagcttacataccatgcctctcggctcgctgcctctccctcgtcgaccagaggcggagagcactatagtcacgagctccacagtccaagttcgcactcgcgagtgctagcatctctcgggaatggcggagtcgcgtggcttcgtgatggcggctgtgatggtggtggccgtggtatcggtggcgccgcgcggcgcggaggcgaagacgacgatcgagccgtgctcggggtccgactcctgcccggcgctgctgggctacacgctctacgccgacatgaaggtgtccgaggtggccgcgctcttcgccgtcgacccggcggcgttgctggccgccaacgcgctcgacttcggcgccccaggggcggcgcaccgcatcctgcccatgggcctcttcgtgcgcgtgcccacccgctgctcctgcgccgacggcgtccgcaagtccgtctccgtccgctacgccgcgcgcccggccgacacgctcgccaccgtctccgacgtcgtcttcgcggggctcgcctcctccgaccagatccgcaacgagaacggcctcacctccgccgaccccgacgcgccgctcgacgccggccagaagctcgccatcccgctgccatgcgtctgcttcaactcgtccgacaacaacctccccgcggtgtacctctcctacgtcgtgcaggtcggggacaccgtgcccgccatcgctgcaagctacgagaccaccgtcacggatgtcatgaatgtcaatgccatggggagtccagtcgccgcgccaggcgacattctcgccatcccattgccaggtaggagtacatgatatgcccagacggagcatttgctattttgtcactctcaattgtggacttctctattttaacaccagaccacaaattatagacacaaataatctacaagtgatagacatatggtcacataatagcagacagcccacgttggaagggccaaaatagcaattttttctgcccagacggatacatgtatggtgaaataggcaactccatcgtcttatataatgtcattttcaaaagacgtatatgatgacattttcagctttcgcgagaattataatggcactgatatagtttcacgaatagttatggcgtgcatcgtgcttcaaaaacaataaaactataatggcgtgtactaacccttatttcagctatactatagtttactaggcgccagcagtatgcattcgccactatgttggaagcgcatgcagtgcttaaaaaacaagcatgctaacgtgggtctcaagttactagttgttgatttgaggcatgaatagtgtgttagatgcttgcctccctatctttaatggagtcatttacttgtagcccatatatatctattatgtcgattattttgctgcagatcaaaacctgttcaacagtccatctcagatgattgtaattaaaagcaatccaaaaaagtaggccgtaattagacattgtccttgaacattgcaaatagcaaggttaaaaaaaatccacctttcatatttatgtaagaatcacgaaaagcagcagagtcagtttgtggaagttatcttcaattcgattgttacccatttccaaaatgaaggcgtcattaccctaccgacagaaatcttagttttgaagttggttagttggtaagctagcaaatctagcccattatgctgaacgctgacatgtttatatgttccttgctattcagttttttttttagtttcagtgtagtgtgcccagtacaaaaaacataagcaccacgttctggtgaacgatgagttattcagtacatgtctatttgactatttcttatcgacacctgcattgaactggttcttccatcgcagttcacagaccctcttttttttttgttcttttctgaacatcagctgttcctaccaattattctgatggttgttgtttatttcagcgtgtgcgtctgcatttccaaaatccgcatcagaccacggactgattgtagcgaatggaacttacgcccttactgctagcaactgtgtgcagtgtagctgtggacctggcagcctcaagtaaattttaaaccagtaacatttcattcttcccagttcttagctttactgctggattaacctgtgcaacctgttctgtcagtctatattgcacgccaacttcactgtcgggaacctgtcctagtatgcaatgtcctaacagcgacgtgatgcttggcaatgtgagcacccatccaaccggtgctggatgcaacgtctctgcttgcagctacggaggttttgttaatggaactataacagcttcgtaagcaacgtgtcgcccaacattctctttcctttttattccgacctactagtataaggtttcttaccccttgtttttcctgtgcaggctaaccgcaggtctccaagccagatgcccaggtaactattgttactgtccctgcagaattgggtgtcaaggcagttgtatagctatactgcagccttcggtctcagccccctgtgtcttgatattcacactctgttttgcatcccctgatcgtttgaaatctattcttgaagtaacttaaacacgctttctgcatgatgactgcaccaagaatttagctagcccctctgctttttctatgtatggcattgcattgttgaggttggtgagctcaaaactgaaataacaaacgtcggtatatagaaaattcggaaagagtgctttagtaaaatgtaacagattgttcagtaatatacctgtgacataacctctacagttgaacaatctagaaattaggcccatccctatattttctgctcatgatcatgtgctacatctcgttccagcacagtgcttctgaatgtttcttcatgcaggaccacgccagtttcccgcactgacggaaccacctaccacggtgagccacgactccacgtaccttcctccgttatcagcgcctggtccagcggaagctggtggcgtcatgcctgagccaggctcgccagggccaggcgcctcggtgcaagcagggcccttcacgctcccgaaagtgtctaaggccaatggccccgctggcagcgtttcagcagctccgttggtgggtgaaccacttcaaatcctacccgtcctgggctcctgcctagccttctacttgcagctctgagtgaacccacgtcgcgatgaattctttagctttgtcctgtccccgcagcctagtatatgcttttgaagcaccacgggacatcattgctcgatcaaactccctctgagttgttgttctagctttgtttcgcgaaatctccccggcaaaactgcgcgcctaaacagcgtatctgatgatgtgttcgctgcttttgtacaaaaaaagacatggccctgtgtaaagcagtaaaagtggtagctattgttcttctccgcaaggcatcctggtccaggagctgcgttttttatactgagttgttctggcttgtttcgcgaaatctctcccggcaactgcgcgcctaaacagcatatctgatgatgcgttcgctgcttttgtacaaaaaagacatggcactatggccctgtgtaaagcagtaaagtggtagctgttgttcttctccgcaaggcatcgtggtccaggactaggagctgcgtttttatcctctttgatttgatcacatgggacgaccgaccctggctggataggagctttcctctaaccccttctttagcagtctccagcagaagatattcctcggttgcctgctatgtctggcgtggtctagaaatccaaagagacaaagggtggaagagaaggagaaaaggcatcagcaagcctcagtatcagaatgaagctttcctctcttctttttttcttttgcaaggacagaaggaagctttcagttgagcacaatttctagcgtttgtcatgcgagcatatagctacttgggcaggagcagagcatcacaattgtgatctgctgatctgcagagcttttttttttcttccatgcatccataggactagagctcagggcaggagggagatgccctttcagcacaggtcacgcacaggggggggcctcacaaatgcgctcttcgcgtttcgctttcgcgagcatctgggccggattggaattcggaactgttgactctcggtggcccaagatgcgcgcctctcccgttccaagcgtcgcccgcgcccgccgtgccgctttctctgaagaataacgctactggcggaacggagcacgttacgcctactggctggcgcgaatcgctccgcgtagacacgctttagtaagtgcgtttatgagatcgagatgccgccacaccacacgtggtccttatccccaaatttgctgatgctaacgaacaacttatcaacaagctgaagctggtgtgtgtgaagcctttcttcgcgggtttttttttggggggtgggggggctcttcctccctgtcccggccggtcgttaacctgcacctggcaatcctgcaaaggtagtacggacgacggcacttggagttctcgtcggtgcgatcgagttgctccaaacttgtcttgtgaagacacgggcgattagcagggtggtccgagtccgatcctttggttggatgccttgatcacagctagagaacgcagttgccatcatcttgaactccaactgaagttcgatgctcttgaaatgattaaaccatgtaaaagcatttccattctctcctttcacgtcggcactaagtacatattcgctaacgagtacacaaatggtacaaatagaaattcgtttccctagattaagattggctgcgcaatggcgtctggcgtgccacgcacgctagccgggtccccaaactccgatctccacttgtgcagcaactaaaaaaaaaggccgctcgtgccgtcacctctgtgctgtgcctgtgtgtcgatcgacgtcgacgacgactcggactccgactttacgctgcatcgctttgtccagtcggcagtgaaagatcatatatggatcagaaaccaccgcagccagctactagtggcgcgcaaaaacgcatgcgggtgcggccatcatcgcctcgccgcctctttggcaaaagcaaaaaaaaaaaagccttaagagcatggcgatgcaagcgacccggttgaaagctggggtgagagtgagtgagcgaggcctgcactctacctctacgtgattcctgggctagcaaaagaacctcatcccgtcccgtggttgtttttgtttagtgcgacaaaaagggagggtgggtatcaactaactctctaaaaaacgcgtgcacgttgggattaatatatgatatcccatgtcagtgcgagtgagatacgtacgggcatgtacgtgctatatatacttgtgctttgacagtgggatcagatcagtt

SEQ ID NO: 4092 - DNA, 1602 bp, Zea mays
ttttgggaccctcggggaccagaggcggagagcactatagtcacgagctccacagtccaagctcgcactcgcaagtgctagcatctctcgggaatggcggagtcgcgtggtttcgtgatgacggctgtgatggtggtggtggtggccatggtatcagtggcgccgcgcggcgcggaggcgaagacgacgattgagccgtgctcggggtccgactcttgcccggcgctgctgggctacacgctctacgccgacatgaaggtgtccgaggtggccgcgctcttctccgtcgacccggcggcgttgctggccgccaacgcgctcgacttcggcgccccaggtgcggcgcaccgcatcctgcccatgggcctcttcgtgcgcgtgcccacccgctgctcctgcgccgacggcgtccgcaagtccgtctccgtccgctacgccgcgcgcccggccgacacgctcgccaccgtctccgacgtcgtcttcgcggggctcgcctcctccgaccagatccgcaacgagaacggcctcacctccgccgaccccgacgcgccgctcgacgccggccagaagctcgccatcccgctgccatgcgtctgcttcaactcgtccgacaacaacctccccgcggtgtacctctcctacgtcgtgcaggtcggggacaccgtgcccgccatcgctgcaagctacgagaccaccgtcacggatgtcatgaatgtcaatgccatggggagtcccgtcgccgcgccaggcgacattctcgccatcccattgccagcatgtgcatctgcatttccaaaatctgcatcagaccacggactgattgtagcgaatggaacttacgcgcttaccgctagcaactgtgtgcagtgtagctgtggacctggcagcctcaatctatattgcacgccaacttcactgtcgggaacctgtcctagtatgcaatgtcctaacagcaacgtgatgcttggcaatgtgagcacccatccaaccggtgctggatgcaacgtctctgcttgcagctacggaggttttgttaatggaactataacagcttcgctaaccgcaggtctccaagccagatgcccaggaccacgccagtttcccgcactgacggaaccacctaccacggtgagccacgactcgacgtaccttcctccgttatcagcgcctgggccagcggaagctggtggcgtcatgcctgaaccaggctcgccagggccaggcgcctcggtgcaagcagggcccttcacgctcccgaaagtgtctaaggccaatggccccgccggcagcgtttcagcagctccgttggtgggtaaaccacttcaaatcctacccgtcctggtctcctgcctagccttctacttgcagctctgagtgaacccacatcgcgatgagttctttagcatagtatgcttttgaagcaccaagggacatcattgctcgatcactccctctgagttgttctggctttgtttcgcgaaatctctcccggcaactgcgcgcctaaacagcatatctgatgatgtgttcgctgcttttgtacaaaaaagacatggcactatggccctgtgtaaagcagtaaagtggtagctgttgttctcc

SEQ ID NO: 4093 - DNA, 1868 bp, Zea mays
ctatagtacgagctccacagtccaagttcgcactcgcgagtgctagcatctctcgggaatggcggagtcgcgtggcttcgtgatggcggctgtgatggtggtggccgtggtatcggtggcgccgcgcggcgcggaggcgaagacgacgatcgagccgtgctcggggtccgactcctgcccggcgctgctgggctacacgctctacgccgacatgaaggtgtccgaggtggccgcgctcttcgccgtcgacccggcggcgttgctggccgccaacgcgctcgacttcggcgccccaggggcggcgcaccgcatcctgcccatgggcctcttcgtgcgcgtgcccacccgctgctcctgcgccgacggcgtccgcaagtccgtctccgtccgctacgccgcgcgcccggccgacacgctcgccaccgtctccgacgtcgtcttcgcggggctcgcctcctccgaccagatccgcaacgagaacggcctcacctccgccgaccccgacgcgccgctcgacgccggccagaagctcgccatcccgctgccatgcgtctgcttcaactcgtccgacaacaacctccccgcggtgtacctctcctacgtcgtgcaggtcggggacaccgtgcccgccatcgctgcaagctacgagaccaccgtcacggatgtcatgaatgtcaatgccatggggagtccagtcgccgcgccaggcgacattctcgccatcccattgccagcatgtgcatctacatttccaaaatccgcatcagaccatggactgattgtagcaaatggaacttacgcgcttaccgctagcaactgtgtgcagtgtagctgtggacctggcagcctcaatctatattgcacgccaacttcactgtcgggaacctgtcctagtatgcaatgtcctaacagcgacgtgatgcttggcaatgtgagcacccatccaaccggtgctggatgcaacgtctctgcttgcagctacggaggttttgttaatggaactataacagcttcgctaaccgcaggtctccaagccagatgcccaggaccacgccagtttcccgcactgacggaaccacctaccacagtgagccacgactcgacgtaccttcctccgttatcagcgcctgggccagcggaagctggtggcgtcatgcctgagccaggctcgccagggccaggcgcctcggtgcaagcagggcccttcacgctcccgaaagtgtctaaggccaatggccccgccggcagcgtttcagcagctccgttggtgggtaaaccacttcaaatcctacccgtcctggtctcctgcctagccttctacttgcagctctgaagtgaacccacatcgcgatgaattctttagctttgtcctgtccccgcagcctagtatatgcttttgaagcaccacgggacatcattgctcgatcaaactccctctgagttgttgttctagctttgtttcgcgaaatctccccggcaaaactgcgcgcctaaacggcatatctgatgatgtgttcgctgcttttgtacaaaaagacaatggccctgtgtaaagcagtaaagtggtagctattgttcttctccgcaaggcatccaggtccaggagcctgctttttttatcctctttgatttgatcacatgggacgaccgaccctggctggataggagctttcctctaaccccttctttagcagctccagcctccagcagaagatattcctcggttgcctgctatgtctggcgtggtctagaaatccaaagagacaaagggtggaagagaaggagaaaaggcatcagcaagactcagtctcagaatgaagctttcctctttttttttttcttttgcaaggacagaaggaagctttcag

SEQ ID NO: 4094 - DNA, 1680 bp, Zea mays
acccttggtattcttccagcttccaggctctacgccgcttctagcgccccgatacgcggcgccggcgcaggcgtgcagccatggcgatgagctggatccgatcggttgttaggagggccctcatcgctccgaagccgcggggctcccgccagtttactgtcaccgccgccggcggcggcgcgacgcagaccgaaagggtggcggcggagatggtccgctacgccctcggcggcgccgtgcaccggagctcgccaggttcccccttcgccccttctatttgcgctagtgtggaggcgatgcggatactggagcaaggcgcctcgaacctgcagggaggaggcgagggcagtgccgaagctgttgggttgctcatgctcgctatgtccacgctgctttaccggagtggaagacgtcaagacgcagtggaaaagctcaaagcaacccaacaagttgccccttctgcagtttttagagttgcagcgtgggaagcactaatgggattacacatggaggcagggcaggagatgtcatacttgatttccccaaatgattcagttgatctgtcaatcaaatatgatagcaaatggtctgatcaggaccatcttaaatttcgggttaatgctgtcagaggacttgttacacttctgaatggagaaacagaatcagctgcccagctgttcgatggttggtgcagagacttttctagaggcgaaaaccaaacagaaaatgctgccgtttcatacggtgaatatttgcattgtgttggggattttcaaatggcagcacaagtgtatgagaaaattctcgaggcattttgcatggatgatatgtctggaaaccttttagcagctggaaacatggttcccgaggaggcttctcttggggccacttgctcatatggccagcttttatctcactctgggaagtttgctgaggcagaggattatctcacaagagctctacagaaggctgaagaacaatttggtgcaaaccacccaaaggtcggcattatattgacctgtgtagctagaatgtacaaactaaaggcaaaatctgaaggttctacttcaattatggtccaggaggggctgtacaggaaggccctagaagtattgaaagcccctgctattaattctgagggtaaaaacaacgatctcctatcaatgataaggtgagtacgcggagctgttattaattcagtctaataggaaggcggaaggtgaacggatgaagcagtgggcagaagatgcttggaggaaccgtaggctaacgctagcacaagctctagagttttcagaaccttcaaagccgactgtcgttgttgacacccgaatcggcagggtcgtgtagcttcagtcaacaatctcgtgagatgcacaaatgaagcaatccgtggatgcacctcgtgtcgtgtatattttcgaaagtgttgctccttgcgggctgcatccggtttgatccgttcaagtcccagcacactcgcctgcttgtttttcatatcacctttttgaatagggggacattcgaggatcacaaagcttgtgcatgtgatcactttaaacatttaatagcatatgtatatgttattgtacacagaataacaccacttaaagcatctttacattttgattgcgaaaaaaaaaaaaaaaagggcgaccgcatacatgtagctcttatatt

SEQ ID NO: 4095 - DNA, 2274 bp, Zea mays
ttgcagtgcaaagcatgctacgatgtttcatttttctttcgagagatcaacggagggaggagggatgagtgtccctacctgaaagttttcccacagatgttggcaaaaagccagtgatagagggtatcggtataatgttctaatagtatactccatcacaaaaaatgtgcacttctatttacattgctttaagtcaaacaatcttcggttttaccaacttttttactacaaatatataaaagttatatgataccaaataagtaccattaggttcatcatagaatatagttccatcgtatacttatttgtaatattaagtgttgatattattttgacaaacttagtcaaacttaaaatagttttacttggaccagatctagaggtgccctcttttttgaggaagggttgggggaagtgggagtagtaatggtagtttgaatctgttgtggtgcggtgccgagtcaaatgccaccggctgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagccgcccgcatgttcagcgagaacaagcgagagtacaaccgcaaagttcgggaggtcgtggagcagagctggacggcggactgatgatgccctgtgttgcgtcgcgctgtgctgcgcagctgctcactgcgccccgcgtccgtccattccataccaaaaaaagaaaatggcaaagccgaactcagctgttgctgctttcgttgccctgtgtcaagacgactgcttctctatgaacattttaccttcctgtgctgtatctggaatacaaacttaattatctctagcactgtggcaacatcttatcttatatgaaatttcctccgggaaaacgagaatgatttgcttgggtgattatttcatgaccagccaggttgctgtactaaactatggtacttatttcagctaattttgaatttgaactgctctccgtcttaaattacatgtcattctagcggccatagcatatgtatttgatgtcaatataatcaaacttttttgagatagttgactctctaagaagggaagtttgagtagccaggctgctgtaccgttctctgcctcgctggtgatctcgctctcgccacagagcacacgtctccctcgggggcggaccagacaaaaatatgagtggggcctaagcttaaataaaagcctattaacaaatgagcctttttagatgtactaaataacataaaaaagtccactagaataagaaaattgagtggggcctatgccctcactaacataacgtaggtccgcccctgctccccgtgtcattagcagccatgtaatgtaagaatgctgggatttgtttgtaaatgtagcagcattgacgattacaactatcaccgatgttgtttgctgatggcaacacgtgacgtgattctttttttttttgatcggatagacaatacgtgattctgaaatgacatggattcacaagcagcggcagtttcggctacagtttggatggacggatgttatttgctggcgacgactagaaaatctacaaaatcttgatgggatcaacattacatatgtttctaaatactccctccgattttttatatttaacgtttcttagtataaaattaaattatccagcatcaaataaaaaaatggaggtaatatcaatgaaaataagattatttataagtttgttttccctattttaaatgtttatcttcttcatttgttatttattttattcccctttgtcaaagcttccttattgtgctaaaccgtctcctccttgcgatatcattagttcatctacttctagatatctttgtgttaatacttcttcccctttatcataaattatcataaacatgatagcatggtggaaaagatggaacatataaaatatgagagatgttatacagatggagatgatttaagtaaacttccttcaaagtagcaattgatgtcaagatcatctcagtgtagtaagtgtatatccaagtttgtttcttagtggcttgaattaaactatgtttgtgaatcatgcaactcggcttatctttcttgaagcttcttcacatagtttgcaatagttatcttgttcaagtggagttatatattttgcaaataatggcttagactatgcctataagcactaaccatgta

SEQ ID NO: 4096 - DNA, 1060 bp, Zea mays
ttgggtacctcgaggcccgcatctaaaaaacacctagcggaaaaagaaaaggaaaaaagtcgcccctccgttgggacctaattcacgcgtttcagggctcctcccatttcgtcggcttcgtttgtcgtcgtcgtaagctgcagctagtgtggactggagatccaccactccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagccgcccgcatgttcagcgagaacaagcgagagtacaaccgcaaagttcgggaggtcgtggagcagagctggacggcggactgatgatgccctgtgttgcgtcgcgctgtgctgcgcagctgctcactgcgccccgcgtccgtccattccataccaaaaaaagaaaatggcaaagccgaactcagctgttgctgctttcgttgccctgtgtcaagacgactgcttctctatgaacattttaccttcctgtgctgtatctggaatacaaacttaattatctctagcactgtggcaacatcttatcttatatgaaatttcctccgggaaaacgagaatgatttgcttgggtgattatttcatgaccagccaggttgctgtactaaactatggtacttatttcagctaattttgaatttgaactaaaaaaaaaaaaaaaaaaaaaactcgagcccgg

SEQ ID NO: 4097 - DNA, 1505 bp, Zea mays
cccgagttaaataagaatgccggtcaatcatgaacaaactgagtattcttgaagcccttttttattgatgacatatttcccattttacagagtacattatcgtcccgatagcttttgaagtacagctaggggtaaaacttcctgaggtgttctatattccaggagttcccaatttctgtgccgtccatttgagtgagacgatatgatcccggccgagtgacttctgctactatgaatggtccttcccatgagggtgacaacttgtgtcgtccctcccccgttagaattcggcggaggacgagatctcccactgaaaaggatcattgtcgtacgaccttgtcgtgatagcgtctcagagtctgctggtatcgtgctgattgaattactgcattcagccgttcttcttcaagtacatcaatgtcctccagcctagtagcttcggcttctgctatgctttcgaagaccaaccttggcgccccaaacttgagatcagcgggtaatactgcctctgacccatagaccatgaagaaaggagtgtttccatgcagagctcggctaggttgggttcttaggctccaaacgacgtagggcaattcccttatccactttcctgcgaacttttcatttttatcgaagacctttttcctgagtgcctccaatatcatcccgttagctcgttcaacctgcccgttggctcttgggtgtgctaccgaagcatacttgatctgaatgcttttttgctcgcagaaatcgaagaactctgaacttgtgaagttggatcctaggtcagttatgatactgttcggtatcccgaatctgaatattatgtcttgtatgaattccacggccttagctgaggttaaagaagcaatgggtttgaactctatccatttagtgaatttgtcgattgctaccagtacatgagtgtatcctccttgagctttcttgaaaggtccaatcatatccagtccccagcatgcgaagggccaagttactggtatggtctgcagttgctgtgctggtagatgttgttgctttgacaagtactggcaagcttcgcacctctgaactaactcggctgcgtcacttttcgctgttggccaatagaatcctgacctgaagaccttcccgactagtgtcttggatgctgcgtgtattccacattgcccagcatggacctcatccagaagtcgcttcccagtagatgagagaatgcatttcatgaggacgcctgatgcaccccttctgtataatgtctccccaatgagtgtgtagtgagctgactgtctagcgatgcgctcggctgcatttttgtcatctggttcctcttcattctttatatatctgatgatcggccttctccagtcatcagagtctgactctggttgattcacgatattacactcttctgcctgatccattgagatgcttggctgtggtatttcttgtacaaagactccaggtgggacctaagttcgactggatcctagcttggacaatacatc

SEQ ID NO: 4098 - DNA, 1696 bp, Zea mays
gctagggatagaacttcctgaggtgttctgtgttccaggagttcccgacttctgtgccgtccatctgagtgagacgatatgatcctggccgagtgacttctgctactatgaagggcccttcccataagggcgataacttgtgccgtccctcccccgttagaattcggcggaggacgaggtctcctactgagaaggatcgctgtcgcacggccttgtcgtgatagcgccttagagtctgctggtaccgtgctgattggattaccgcattcagccgttcttcttcgagtatatcaatgtcctccagcctggtggcttcgacttctgctatgttttcgaagatcaaccttggcgccccgaacttgagatcggcgggtagcactgcctccgacccatagaccatgaagaaaggagtgtttccatgcagagctcggctgggttgggttcttaggctccaaacgacatagggcaattcccttatccactttcctgcgaacttttcattcttatcgaagacctttttcctgagtgcctccagtatcatcccgttggctcgctcaacctgcccgttggctcttggatgtgctacagatgcatacttgatctgaatgcttttttgctcgcagaagtcgaagaactctgaacttgtgaagttggatcctaggtcagttatgatgctgtttggtatcccgaatctgaatattatgtcttgtatgaattccacggccttagcagaggttaaagaagcaatgggcttgaactctatccatttagtgaatttgtcgattgctaccaatacatgagtgtatcctccttgagctttcttgaaaggtccaatcatatccagtccccagcatgcgaaaggccaagttactggtatggtctgcagttgctgtgctggcagatgttgttgttttgacaagtattggcaagcttcgcacctctgaactaactcggctgcatcactcttcgctgttggccaatagaatcctgacctgaagaccttcccgactagtgttctggatgctgcatgtattccacattgcccagcatggacctcctccagaagttgcttcccagtagatgggagaatgcacttcatgaggacgcctgatgcaccccttctgtacaatgtctccccaatgagtgtgtagtgagccgactgtctggcaatgcgctcggccgagttcttgtcatctggttcctcttcattctttatatatcttgatgatcggccttctccagtcatcagagtctggctcgggttgatctataatgttgcactcttctgcttgatttattgagatactcggttgtagtatttcttgcacaaagactccgggtgggacctgagttcgactggatcctagcttggacagtacatcggctgctgtgttccgatctctttctacgtgatgaaattccagaccctcaaatttatcttccagctttcggacagcagcgcagtattttcccattgaatcgctcgaacaatcccactccttgtttatctggctaatgactaccagagagtctccgtataccatcaatctcttgatgcctaatgagatggcgatgttcaatccatggatcagagcttcatactcggttgcattgttggaggccggaaatagcaactggagggcgtcgaagagaatccctgctcctgctccctgtagcctcagtgagccatcaaaat

SEQ ID NO: 4099 - DNA, 2493 bp, Zea mays
tgcaccgccttaagtcgttgccgacttaagtcgattgctccgtttgtagggcatagtggtcaccccgagttaagtaagcgtgagcatgttgcaccgccttaagtcgttgccgacttaagtcgattgctccgtttgtagggcatagtggtcaccccgagttaagtaagcgtgagcatgttgcaccgccttaagtcgttgccgacttaagtcgattgctccgtttgtagggcatagtggtcaccccgagttaagtaagcgtgagcatgttgcaccgccttaagtcgttgccgacttaagtcgattgctccgtttgtagggcatagtggtcaccccgagttaagtaagcgtgagcatgttgcaccgccttaagtcgttgccgacttaagtcgattgctccgtttgtagggcatagtggtcaccccgagttaagtaagaatgcaagtcaatcataaatgagccaagtatctttgaaatctctctttattgatgacgtatttccattatacagaatacatggtcgccccggctgttttgagatacagctaggggtaaaactttcggaggtgctctatgttccaggagttcccaacttctgtgccatccatctgggtgaggcgatatgatccgggacgagtgacctctgctactatgaaaggtccttcccataagggtgataacttgtgccgtccctcccccgttagaattcggcggaggacgaggtctcccatcgaaaagaaacgttgccgcacagctttgtcgtggtagcgccttagagtctgctggtatcgtgctgattgaatcactgcattcagtcgttcttcctcaagtacgtcaatatcctccagcctagtggcttcggcttctgctatgctttcgaagatcaatcttggcgccccaaacttgagatcagcaggtagcactgcctccgacccatagaccatgaagaaaggagtgtttccatgcagggcccggctaggttgggttctcaagctccaaacaacataaggcaattctcttatccattttcctgcgaatttttcgtttttatcaaagaccctttttctaagtgcctccaatatcattccgttggctcgctcaacctgcccgttggctctcggatgggctacagatgcatacttgatctgaatgcttttttgctcgcagaagtcaaagaattctgaactggtgaagttggatcccaagtcagtgatgatactgtttggtatcccaaatctgaatattatgctttgtatgaattccacggctttagcagaggttaaagaggcaatgggctggaactctatccatttagtgaatttgtcaattgccaccaatacatgggtgtatcctccttgagctttcttgaaaggtccaatcatatccaatccccagcatgcgaaaggccaagttactggtatggtctgtagctgctgtgctggcatgtgctgttgctttgacaggtattggcaagcttcgcatctctgaactaactcggctgcgtcgttcttcgccgtcggccaatagaatcctgacctgaaaaccttcccgactagtgttctggatgctgcatgtactccacactgccctgcatggacttcctccagaagttgcttcccggtggacgggagaacgcacttcatgaggacgcctgacgcgcccctcctgtataatacctccccaatgagcgtatagtgagctgattgtctggcaatgcgctctgccgagttcttgtcatctggttcttcttcattctttatatacttaataatcggttgcctccagtcatcagagtctgactcgggttgatctatgatgttgcactcttctatttgatccgtcgagatgctcggctggagaatttcttgcacgaagaccccgggcgggacctgagtccgaccggatccgagcttggacagtacatcggccgccgtgttccgatctctttctatatgatgaaactccagaccctcgaatttatcttctagctttcggacggcggcgcagtattttcccattgaatcacttgaacaatcccattccttgtttgtctggctgatgactaccagagaatctccatacgccatcagtctcctgacgcccagtgatatggcgatgtttaatccatgtatcaaagcttcatactcggctgcgttgttagaggccgggaatagcaactggagagcatacttgaggtgttcgcctccaggtgcggtgaagagaatccctgctcctgctccctgcagcttcagcgagccatcaaaatacattcgccatacttctgccgtttctggattgtctggaacttgctgttctgtccactctgatatgaaatcgaccagtgcttgagttttgatggcagtgcgaggtcggaactcgatatcatgggatcccaactcgcaagcccacttggctattcggccaatggcttccttgttgtgaagaatgtcccctattgaaaaccagtaactactatgactttgtggtcatcaaaag

SEQ ID NO: 4100 - DNA, 3501 bp, Zea mays
ttatgattatttaataagaaaagctgatcaaattttggggtaaaaaattaaacgtattataaattgtaacagaggggatttttaaaagtcgtgcagaaacagagggagggagtttatcatcagtcaacatcatcttcgttgcaactatattttgtccatgtgtttggactttggagagttgcacagaccctcggcgtggaccaggggcatcggcatattcacttcatctgcttcgtccgtttctggtgctccgagcaagcggaggcgcaacctttttcgtatgaccgtatgggtgggatgtcctctgctgtgcccacgaccttttatgatctgcaaagtttagctgacggtgatgtcgtaccgacaacacgatcgcgtcatgcaaatatattacatttttccagctctttcacgcgtctgatatggaatcatttggtcctgttggttggcgatttggccatcgtggcccatgagttgcggtaaagtgatggcaaagttagcgctggtccctccctattgatggtaatcgtgcttactccgtatttcgctgtcaaacactcagtcccaatcgtgcttctgttagccgctggaatcaattgtttatggttttgttaaaaaaaaagtgttgttcttctctcgggtctttctttctttttcttttttacttttcctgtttgatcgaggtaataagaaacacttgctacttgccatgttggagtacgatgcttgcaagtttaaactcatagtgtaagccatgagtactcattatgctatttatgtacattccgtgtgccctttgggcaccgacaccttctctaccaggtaacagcgtggcagtggcgaggccgcagctttcggaccccagtcgctgctactgctaggcgataacgcagctggctttactagactgccgccgcctgccgctgctgcgcccgcgcttctccggcgcagacgagcggcctgccgagccgcctgtcgacgcggtaccagccgccgtggctcacctcccgctccaggtggcggcagtagctccggaacacgccggcgcacacgttgagcctgaactgcatcaggaacaggaagtccagctccagggcgctcagctccgccgccgccagcccccccaccgccgcgaagtaggagttcctgtagttccggtcctccacgaacttggacgcgacgaggatggccgtggtcagcaggcgctgcgcgttggcgcgcacgacgcgcacgccggcgctgcggcggagcctgtccaggtacgcgtacgccaccacgtacacctgcggcgacacgtgcgcgtagcgggagaaacgctccaggaacgcgtgcaggctcatgtccagcaccgtgccgccgtcgaacgcccgtgcccgcttcctcgcagccgcggccgccgggtccgagttgtcgtcgtcgtcgcccggtgccgactggtcgaggccgctcgcggccgccatggcccgctcgttgagggcgatgtgccgctccaggatggacgcgagcactgagatcacgaccggcggcgacagcgccggtgacgtcgttccgtcgtccccgcacgggaaggtgaacgcgtccgactccgacggcagctcgctcgttgccatttcttgacttgtcggtcggcggtcaccagcacacacacaatcgactcacggggacctgtactatctatggactggcaaaggttcgctcgcgcctctcgaccacacacgctgacacgcctacacgagctcggtgaaccgtggctacttatacacgcggggcgtcggcggagctcctgataaacaatggtggggctgggccggtggagtgaagttgacacgaggaaggagcccggaagcaaaggcactcgtagttaaattaaaaaagaattcagatggatgcacagcagacctgatcgattgcctcggccggtaccgtggctggggatccgtgatcgacgaggctggatttatgacaaatcatgaaagacaaagcaagtgctgcctgcagatcatcctgtcggcgctggccgtactgcccattagctgtttctcccggtcccagctcgcccgagcgtgtacgtgctacctgcttgccggtctggcacacgagcatatttacgacgcgtggcctgcctggtgaagaaccggctctattttcaatcgcttccatgccggctcgaaatgcaataggttaagagataaacaaacaacatggattactcagcattatactatatctgttttcgtatattttatcgatcgttagtttatttttaaaataaaacgcgataaataaaaaagaacggtgagagtataatctaggtgtctaaattataataattcataagctgatcattagatgcttatataattcgtaatctagattatataatcatagaagtaaacgtagtttacaacggcagttagcaatgatgtttgtttgtttgttcacacgtccaagctctgccggcgggcgacagtcagtagtggcattgtcgttctaaacaaccggtgctcggagcaaaggctcgtactgcagacacgtttgttctatgtagggcggttagggctgacgcggacgttgtgtcttggaagcagaggacaagagcatcgacgagttgatatatggcgattgcgaggaggatacggaaatgcatctgttgaggatgacgcgtaccggcacgcactaattataataatttttatttttaatttctccagaaaacgatgcatatgcgttcgttcagttgcaagttcacgtcgcttgctgagctcccacatccagcatgtacaaacgcaaagaccaaattatctgacaattttgacttatgccttttaaactcacccttcccacttccagaaacttaaaatgctgaagaaatggcgactcaaacctgaccgtaggaaaaatgttagttctggcgctgacatgacacgcatacgcatagggcgtgggggcagaacagaaacacgagcctgccactttctcgacctgctttggtattatatctaccgtacacgatataattagctaaatcccaacattgggactacaaagctattttgataatgtcccacgtctggccagttggatgggccggcctggagataataataataatgtcgctgcgtgccaagcaaagttgacaactctttcgaagcgagacgggaagaattgcaagttggcaaacgaaattagaagcgaccgaaccaataatgatacaagctgtcaatctggtgtgtgcacaaaagcgtttgtttgcttctccgttgatcaccgaaatacttttggcctattgtatcctttgctcaaagtgttcgtagataggtaaatataaaatgaacttattaattaaaaaataaaataattttagaccatatttgaatgcactagacttaagagtaactccaaaaaattagctaaaaagattagccaaatttattggtttagctactctctaaaatatattttacaaaataagtgtaggttaatacagactcggtaagccta

SEQ ID NO: 4101 - DNA, 2975 bp, Zea mays
ttcatcataaatagtgagtactaatataaagaatggagtcatcccaccaaatataagaaataaacctataatatacaccttaatttagatggtatgattccttaaaccaacactccatacgttacacagctcatgtgacacgaggccaagaaaaccagtcaaacttccgcgcactgccgtctgtccactatggccttcgccgcctccccttccctctccgcactcgcttcctcctcgtcgtcaaccgccgccgcccccacgccttcttccaaccctttgcacgagccgaggcctctccacctctcgctcaagcccgtcttacccctccccaaaccgcatgcgctctcctgctccgcgccgcacatcccccgcgccgccgctggggacggatcgggcgtcgggaatggaggcaaggatggaggcggcggcgggggtggcgaggatgaagacgactgtgacgatgcggacttcggtccgctgctcggcttcaacgaggtgctgcacctcgccgcggcgcgcggcgttgcgctcccgggcgacatgctggaggcggccaaggacgccggcatccgggaagtcctcttgctccgctacttcgatctgcaggtcctcgaatttcagggaatttgtatggaagattcaaacgtggccgttttttctcattcctttgatattgatctgcaggccgcgccgtggccactaggcgtgttgatccgcgccttctcgatgctccgcaaccggatgctcgccgacccgtcgttcctcttcaaagttagcaccgaggtggatgcgattggtcagttattattttcaagtggtcagaaggtagcagttcggctgttgctaacaattgcgttctgggctcaatgcagattgtgatcgactcttgctgcgcgacatttgcagaggtgcagaagaggggaaaggatttttgggcagagtttgaactgtacgctgctgatcttcttgtcggtgtagcagttgatattgcacttgtggggctgctggctccatatgtgagaattgggaagccatctgcttcaacgggtctctttggaagattcagcaggatggctggatctttgccaagcaggtgaaatttcgtttccagttgttgtctgtggagctttttactgcaccatgaataagaattgaacttaacctgtataccactcccatgtccgtttcgccatctatgaaattgaaagagaatggagattttgctaaactagctatggagctttgacttaaaaaatctaattctgtatggcactaagatttttaaaactgcagtgtttttgaagctgaaagaccaggctgcagatttacagcccagcaaagaatcggaacatacttttacaaggtaatgaaccttacgtggcaaagatactctcaactttgagccatgtatgattgttagttcaaactacaggagcattgccatgttgtgtgtacaaattatactggcataactgtttgaactgcagggtgtcttgtatgggtcagttggatttgtctgtggcataattggtcaaggaattgctaatatgataatgactgccaaaaggtaatagtgtgccattattcgtgcttctgcacatcaaaatctctatctgctattaattaaatgactaagttcatagttgattacttcccattttggtgttttgttgatccgatcacactattgtattctttggcacatagatttataggtttcctattaatattgtgtctgcttcacccatgctcagtaatgctgattaatctttattttttccctgctatcttgacttgtatactgatgtttgttccttgttcaggagtgtcaaaaaatcagatgaagatattcctgttccaccacttgttaaaagtgcagctctatggggtaagcctattatttgttttccctttcttatcacttttacttggtctgagaatcatttttggctattgcacatagcaagtatggtttgttgtctactaaaatggcatcctgaagataatgtacagcaaaacatatctcatcgatgaatggcttgcagttgtctattttttttaaattttaactatgttttcttcaatatttacatcattatcttggaccagatagtctcagataacgaaagttcacgtaaaaaattcccatttttgctcatgttaagcttatgcaattttatgccgtgagctttgtgatttgtgtcattatgtgctcatataaggtatagtttctcttgttgggttcttccagttaactgagaactgacaaattatgttgacatgtaggtgtgttcctcgctgtatcatctaacacacgctaccagatcatcaatggcctggagcgggtagtggaggcatcgcctgtcgcaagacgtgttccccctgttgctatggcttttacggttggggttcgttttgccaacaatatctacggtggaatgcagttcgtggattgggctcggtggagcggcgttcagtaatgggctcttggttgcagttaccaaaacatcaatacattgtacgttcaaatcttagttgcagtaatcgttcaggtggatccgtgttgttttctcgttacatttcctggtaagtagcggaggctggggcagagctctatgaagttttaactcatttactatgagaaacaaggaagtacttcgcatcatatggcatttatattgctgctcctaattgatcatgtgcacttttgccatactgaatgaatagaagcgttctgactcctgcattgcccccaaaatcattgcctcagtgcgtgtttcagtcagctagtggcgaatgtgaagccgtgggaaagttgtacagctcttcaacgaattttgtgcacaaatgatattgaggactagtttggaaactcgtatctccttttcaattctgaaggttatttgagttttcaaactagccttgaagggaaaaaaatatttagtgctatatcctgatgatgcatttaccggatc

SEQ ID NO: 4102 - DNA, 1508 bp, Zea mays
cttaaaccaacactccatacgttacacagctcatgtgacacgaggccaagaaaaccagtcaaacttccgcgcactgccgtctgtccactatggccttcgccgcctccccttccctctccgcactcgcttcctcctcgtcgtcaaccgccgccgcccccacgccttcttccaaccctttgcacgagccgaggcctctccacctctcgctcaagcccgtcttacccctccccaaaccgcatgcgctctcctgctccgcgccgcacatcccccgcgccgccgctggggacggatcgggcgtcgggaatggaggcaaggatggaggcggcggcgggggtggcgaggatgaagacgactgtgacgatgcggacttcggtccgctgctcggcttcaacgaggtgctgcacctcgccgcggcgcgcggcgttgcgctcccgggcgacatgctggaggcggccaaggacgccggcatccgggaagtcctcttgctccgctacttcgatctgcaggccgcgccgtggccactaggcgtgttgatccgcgccttctcgatgctccgcaaccggatgctcgccgacccgtcgttcctcttcaaagttagcaccgagattgtgatcgactcttgctgcgcgacatttgcagaggtgcagaagaggggaaaggatttttgggcagagtttgaactgtacgctgctgatcttcttgtcggtgtagcagttgatattgcacttgtggggctgctggctccatatgtgagaattgggaagccatctgcttcaacgggtctctttggaagattcagcaggatggctggatctttgccaagcagtgtttttgaagctgaaagaccaggctgcagatttacagcccagcaaagaatcggaacatacttttacaagggtgtcttgtatggttcagttggatttgtctgtggcataattggtcaaggaattgctaatatgataatgactgccaaaaggagtgtcaaaaaatcagatgaagatattcctgttccaccacttgttaaaagtgcagctctatggggtgtgttcctcgctgtatcatctaacacacgctaccagatcatcaatggcctggagcgggtagtggaggcatcgcctgtcgcaagacgtgttccccctgttgctatggcttttacggttggggttcgttttgccaacaatatctacggtggaatgcagttcgtggattgggctcggtggagcggcgttcagtaatgggctcttggttgcagttaccaaaacatcaatacattgtacgttcaaatcttagttgcagtaatcgttcaggtggatccgtgttgttttctcgttacatttcctggtaagtagcggaggctggggcagagctctatgaagttttaactcatttactatgagaaacaaggaagtacttcgcatcatatggcatttatattgctgctcctaattgatcatgtgcacttttgccatactgaatgaatagaagcgttctgaaaaaaaaaaaaaaaa

SEQ ID NO: 4103 - DNA, 2714 bp, Zea mays
cataagttatcgtgttattatacggttccgttgtaacacacaggcactcacctagtaacaacaataagaagaagaagaggaggaggaggagaggagattctccaatgttgtctctcgtctatctacgtttatatcgccttaaaaaatgagaagtaaatcttttatacatctctatcgtaggaaaaaggattaaaatccaaatctgatatctggccgaacgcacgatgtggcactgaggcgcacgcgcacggccggacgctgggccgctgatctgcgggagcggtcggtctgtctctctcttggcatgcggggcgtgcggcatgggcttaaaactcggcctgtttttcgtaggcctaatctggaaacgatctgggctcgatctcttcagtctcacacccgtttgcatttcctctggtcgatctgccagcttttccttgccgagagctcagtgcacgcccagtctgcacgaacctcttaagacctggaattccttttgcttcctgctgcagtgcgtggtatacttaatcaaggtcacgctggtcccagagtggaccaggagatagtcaaatttcttatattttggaacacgaaatatataggcgaggaccagccggtcaatttcaacagcccaaccacttgtgggtgcagtgagtgcagcatgggtttggattgacgaagtgagcttccaatcgaaaagaaaagacacatgtcaagtagatgtagatatcaacctcgctgctttctcccagtttttctcaaccgtcgcatggatccgtgaaccacctccaacaaatccccaacaaacccctgctgctcatccgatcgagagcttcctgctcccttctgttcgcgtaccactcgcaacgtccgtctgagcattactattagtgcgcgcgctatctagctagtgtggagccgtggcaacgagcagaggtgcctagctcatcgatcaacaagtgagtagcaccatggcagacaagaagaaggtggaggtcaaagagacgaaggtggaggtgaagacggccgtctacaaggtgtacgtccactgcggccagtgcgcgcgcgacatccagacgcagttcaccgagttccaaggggcggttgtggcgtgctggaccccgcggcagcgcgctactgcactgcttgtctgcttgttgcttggaagaataatggttgcttgtgcatgcatgataataggcggccgcgcatgtatagacaccggagcatgcacgcgtgcgtgtgtatatgactgactatactgcgccatatactgctggcaggggttgaagaggtgaaagtggacgccggggcagggaaggtgacagtgaagggcttcggctttgatgtcgagaagctgaggaagaaagtcgagaagggttgccggaagaaggtcgagctgattccgcccgcgcctcccaaggacgacatggtcgttgatgtcaagaccaaaaaggaggtaaattgcgtccatgtacatctatctctgatacacacatgcagcatatgtagattagtttctgaccatttcgcctgcctttccatagaccatgcatggcgactgcgcagtgcatgcagtgtctgatcaagaacactgcttcttatgctgggttttaattccgcaacagctcaatcactcatttatttctttggtttgttattaatgccgcaggagctcaaggtcataactgtaaagctgccgttgcattgccccgattgtgcagtcagggtcaaggaggttttacttgagaacaagagtaatctctttctctctcgcacagtgtgtgtatatatacgaaccacctaattaccgctgtagtctcttaatcccatcaatcaatcaatggcgcactgcatgttgacacacgctaatataatatatataggtatctacgaggccaagacggatctcggcaagaacacgtgcaccatcgagggtgtcattgaggaggacaagctcgtcaagtacatctacgagaggatgcgcaagaagggcgttgtcgacaaggtcgagaagaaggtgatcatcaaggaggaaaaggtcttagtgaagaaggcggataaggagaaggagaagaaggagaaggagaaggagaaagaaaaggagaaggccaaggagaaggtgaaggaggctgtcgacaaggtcaaggaggtcatcgccccctacttcatcccctgcacgcacccgaacttcgtcgactactcgcacccctggcaccgcggcggcggcggctactgctcgtcgtacggcgacggttacggctacggctacggcgggggctgcggagggtacccaccgtacggtttcagctacacacactctgagctcaaaggctaccatgacacgtcgttcttgcactgcacacaccccaatgagttcatcagcgaggagaacccctacgcgtgcgctgtgatgtagccttctttttttgcgcttggattcaagtcgaataatttgaacactaagaacaacaccaacgtacggatggctcaaattttctcttttgcttcggctcagatttgttaaaaaaaaaaaaaaaattagctttgcattaattgtgtctgcaaccagtctgaagtctactgtatagtagtaatagtactatactagaccaattacagtagccagctagctatgaaacttgatccttcttccaagcaaatctttcaggttttccggctgaaatgcttacagctggcttatacgacccatgcat

SEQ ID NO: 4104 - DNA, 1129 bp, Zea mays
tattagtgcgctacctagctagtggagccgtggcaacgagcagaggtgtgcctagctcatcgatcaacaagtgagtagtagcaccttcaccatggcagacaagaagaaggtggaggtcaaagagacgaaggtggaggtgaagacggccgtctacaaggtgtacgtccactgcggccagtgcgcgcgcgacatccagacgcagttcaccgagttccaaggggttgaagaggtgaaagtggacgccggggccgggaaggtgacagtgaagggcttcggcttcgacgtcgagaagctgaggaagaaagtcgagaagggttgccggaagaaggtcgagctgattccgcccgcgcctcccaaggacgacatggtcgttgatgtcaagaccaaaaaggaggagctcaaggtcataactgtaaagctgccgttgcattgccccgattgtgcagtcagggtcaaggaggttttgcttgagaacaagagtatctacgaggccaagacggatctcggcaagaacacgtgcaccatcgagggtgtcattgaggaggacaagctcgtcaagtacatctacgagaggatgcgcaagaagggcgtcgtcgacaaggtcgagaagaaggtgatcatcaaggaggagaaggtcttagtgaagaaggcggataaggagaaggagaagaaggagaaggagaaggagaaagaaaaggagaaggccaaggagaaggtgaaggaggctgtcgacaaggtcaaggaggtcatcgccccctacttcatcccctgcacgcacccgaacttcgtcgactactcgcacccctggcaccgcggcggcggcggctactgctcgtcgtacggtgacggttacggctacggcgggggctgcggagggtacccaccgtacggtttcagctacacacactctgagctcaaaggctaccatgacacgtcgttcttgcactgcacacaccccaatgagttcatcagcgaggagaacccctacgcgtgcgctgtgatgtagcctctctttttttgcgcttggattcaagtcgaataatttgaacactaagaacaacaccaacgtacggatggctcaaattttctcttttgcttcggctcagatttgttaaaaaaaaaaaaaaaa

SEQ ID NO: 4105 - DNA, 846 bp, Zea mays
cgtctccagcgtcacgttccaggactacggggtgtcggtggcctactaccggagcaccaacatcctgctcatcgtcgaggagtccgtcggccgggtgctcaagctcgactccatcaccggcgacgcgtggctcggcgccgacgtcctcgtcttcaacacgtggcactggtggacgcacaccggcagggaccaaccgtgggactacgtccaagacggagggcaggtgatgaaggacatggaccggctcacggccttctccaaggggatgtccacatgggccaggtgggtcgactccagcgtcgacacctccaggaccaaggtctacttccagggaatctcgccgacccactacaacggagccgactggggcgagggctcgcggagctgcgcgcagcagacgcagccggtcgccgggccggcgtaccccgccggccccgtcccggcgcaggccgccgtgcgggccgcgctggccgccatgtccaagccggtgtacctgctcgacgtcacgctgctgtcgcagctcaggcgcgacggccacccctcggcctacagcggcggccacccgggcaacgattgcagccactggtgcctcgccggcgtgccggacacgtggaaccagatcctctacgcgtcgctcctcctggcataggaccggggagagaaaaaaaacgcacactgtataccaattggcgcaggctataggcatttcgtatttaaaaattggtgattcgattgtttctttttttcttcttcttcttggaaaatcaatgttatgtcatatcagcatataagaagcagcagcaaacgagtttataatgttgtataatagcaaaaaaaaaaaaaaaa

SEQ ID NO: 4106 - DNA, 3349 bp, Zea mays
tttctgctctttttgccccgacctgccccgccctgcatggatccaggcgcgccgtggcgcgatccgcgccagggttactcctacggggtcggatcggcgatgcagctccagctccagctgcagcagcgggccgacgcggcagccggtggaggagtgctcaagaggagcctcggcgagctggagaggtggcagcaccaccagcagcagcaggtggccgcgcaacaggcgctgtacctgcgcgccgtgaggcagcgcacggctgcggcggtcgatatcgccgccttgctgggaggcaccccggctcagcctctggttctacccgggtccagctttggagggggcctagcgtcgccttcgtcgacgctctcgtcgtcgctcaccaccgcgtccagggcggcggtgccgctgatgcagccgcagctgcagcggcaggtgccgctcacgacgtcctcaccgcagacgcagcccttcgggctgtcgacggcgccgctgcctcagccgtcggtttcgagcgagctgttcattttgcaggagctcgagaagcagctgctggacgacgacgacgacgacgagccggttgcggcgatgagcggcaccggttccgccgtcaccaactccgagtgggaggagacgatacagcagctcagctccatcgcggccgcgccgtcgcccgggctccctgcagcggcgaccccaaacaacaacaataataacgtcgggatgacgaggtcaccgtcaaactcctccacggcgtcctcgtccgcgtcctgctcgccgccgacccccggggccgcgtcgaggcagctattgtctgaagccgcggtcgctatcgcggatggccatcacgaagcggcggccgcccatctggccgccctgaagcgcgcggctaaccagcacggcgatgcggaacagcggctgattgccatgatggtggccgccctgtcctcccgcattgctccggccgcctccgccccatctcaactcctcgccgacctctgcagcgtcgagcagcgcgccgggtcccaactcctacaggacctctccccgtgcttccgcgtcgccctccacgccgccagcgccgccatcgtcgaagcggtgggcgaccaccgcgccatccacctcgtcgacttcgacgtcagcttcccgcagcacgcggctctcatccagtacctcgccgaccgacgcgtgcagggcaggtccctgaaggtcaccgccgtcaccgacccgagctcgccgttcacgcagtctctaaccgcatcgctaccagccatcgaggagcggctgaagaagctcgccgagcgagctggcgtggagtaccgctttacagtggtcagctgcagagcagcagagctggatgcgtccaggctgtgctgcgagccgggggaggcggtcgcggtcaacctcgccttcgcactctcccacgtgcccgacgagagcgtctctccggccaacccccgcgacgagctgctccgccgcgtgcgcgcgctgggcccgcaggtggtgaccctcgtcgagcaggaactgaacaccaatacggcaccgctggcggcgcgcttcactgacgcgtgcgcgcactacggcgccatcctggagtcgctggacgcgacgctggcgcgggagattgcggagaaggccagggccgaggcggccctgtcgaagaaggcggcgaacgcggtcggccgggatggccccgaccggctggagcggtgcgaggtcttcggcaagtggcgcgccaggttcggcatggcgggcttccgcccggtgtcgctcggctcgagcattgccgaagagctggtcggcgcccgcgtcggccatgtaccgcccgggttcacagtcaaggcggagaacggcgtgctccggttctgttggatggggcgcgcggtgaccgtcgcctccgcgtggcgctagaccacggcgggcggccgaccgcccgcccgggccattattgccgtcactaaattgtcagttacataattcgagctattgctttcctcgttctcccttcttcctttttttttaccttgattgggtgaggagtgatgagtttgccatgatctggtaaaaatccttcctagctgtagcgactcataattcttataactgctcatagtagtatatggaaaagagtaagttatatcgcaatctcctcctaattttgtgtggcatgttggtagaagaagataacattctctctgattcattcatggtgatcgtggtgctagcagtattatatttttagacctgtacagtagcggtgctgcctaactagtgggcgcgaaatgtgcagctgggcccgaccccgacccctttcctgtcgattaatatttgtttgccacgtaggagtacaagtgtaggctaggtgaaggtgaagcgcagtcatggtaaggaaattgccacttggaagtagtagtagtttgcggtttggtgagttcttttctttctttgcagcctgctctgctctgctctactcagcccaaccgaacccatgaaattgatcggttaaataaatactggttgcttttgggattaaactaatgaaagcttgggggcaattagagatcactcactacgatgggagagacagaggtgcacgaaacgaaatgccagtgcattgcactacgaggcgtagcagtacagccaccaacgtggtctcgattgttgtcgccgatgcttgctgtcgagatgctgggggttgcgttcgtggggacggaagggggccccgggggcttgtggtggaacaaggaattgtgtgttttgtgcgcttcaagctacggcgaaaacgtacgtggattcagcgcgtgctcgaattggcttccgtctcaaggattccccggttccaatcaagctcctcatggtggattaggctggagttgctctctcccacgggctcacggctcacatcaaatttgacaagcattggattttgttttggaaaggagataagaactcagcttctaggaaagggacaagcatttggactgctatcagattttagtaaagtatgaaattttggcaaggatttggattgcaagcgtattttagtaagatgcgtcctagacgatgcaatccacattcagccctatctacaagagaggacagtgacttccgttcgtttaaaaaagagaatgactttcaacagatcattcagtaaattaaagtttgagactcttgtttacttttgtttttgtctcccactctttatcttacattaatagacacttataggatttggccttccttgtggcacccgaagcaaattatgatttctccttcatcaagctttatttttttgatggtgttatcttgaagaggttagtttagcttcaccttacctttctttttattcaag

SEQ ID NO: 4107 - DNA, 3134 bp, Zea mays
gcttgcatgcctgcagccacaatttctggtaggaggtatggaagatgctgttgcagctgcaacgtacatgccattgattttaaagaagtggacccacagcagagtggtaccaaaattaacatatgggccattgttttcaagttgtccgattaatcgtccaagtttattgagaacaatcacgattaatcactcaaatcatccgacttaaaaacaatgatatgtgcctgcgttgtaccggcaaaaaaacaccgatcaaaccactttgggattaagattagatgcttttggtcttttggatagacgaacagaattcctggttcgctaggttatagtgtgtgtggtcatctactctctaattacataacattacctaagttattaatagttcagaagttatttagatttatcccttctataagtgttataaataatccacaaaaaacgatagctatatatcataccgtatggattgaagattcgacatactgcatcgaagaaaattcaattcaatatataaataatatttgattcaataaataatcatctaactgtgagtggttgctttacaggtgtactgaagatctattgacatggcagcataaatttgctctcctgttcctatttgcgagggaagtacagcatatacacaagcatgcatagctagaacactatacgtatatacgagtaaatttacatcagtgatcggcttcagtcccctttattgccgctccacttgcgccatcattcggatttccttctgcctgttcttgaaactctgatggtgtcttggtgttagaatcaccgctctgggaattgcgtgatgaatctgctcgatcatatcgtgaaaccagtgacctcagcatgttagatctcttgatcagaatgcccagcgcagacgatgctgatgctcgaacaattgcgtctggcgattggctcattctaccaaccaacgtagcaaatacctgacacacaagaatgttagtaaattcattgagtactacgactaaataaaccaccagactttagtattaatacctgggagaaataaggagcaatgaatcgctgatcatccaaaaaggatagcatgcaactcaccaaacaaactgcgtttgctcttatgactggccaaggtgcatcgaatgcctaaaacacaaaaacaagagttggcttgctttagtactctcgattgtacaactttaaaaaacttgagcaacctacgagtagcatgttttccaatgaagaagatataagcatccaaatttgagtctaagaagactcaaacgtgcataatggaagtgtacgccaaacacctcacaccagctaatctaagttcggttcctaacttcctaatgtatgtaggcctaataagaaaacttcacctggatagccgattctaggtagctgtcgactctggcgggagacaaccgacaaagttgtcttgttaagtctctaatgaagtcctcatagtcagaactgagggcaaaaacacactggaaaatgtcacctttaaataaaatatcaaattacagaacaaataggtaggaaagctcaaaacaaaccggcgatcagaagcaaaatactgcttgctgaggagcacagacaagccctctacttccatcaatgtcgcaaggagctggaatgtgttctgtttttcacaaaacaacaaagagtaacatatgcaagttcaagcaaatgtgcggtaagggaagtgttgtagaccatagtgtatatacccgacaggcaagacgaacacttaggtcatcatcgtgaagatggaggatcagacggggaagggtagcatgtatctgtgttgggggtaataaaaattaatacctggagtggtattaaaaacaaccgtagaagggcatacaaccacacatcaaattgtaaattttaccttgcagtttccaaaattaaatgaaaacaaaaaaaaaagtatggatggcagaacaatatcaaacatagtaactgccttgacacttcatgtaccagcaggggcggagccagaacttcgccaagacgggtgctaagtacatgattatatttgattccatatataaatatatttgcattgagctacaaaaacaacatatcattgaacattttatgcactacgaccggtgctgcagccttggcagcaccggccctgtctctgtccctatgtaccagcatctaacaaaggaattacaagataacaatatgcaacatgaagtgactgaagtggaactgtatgctcacctgctcaataaaagcagtgcgctgcaaaccaacaccatatgcacttaaagcaccataagctgcaaacgcattggacctcattttcgtattcattgagacctgtggcacaacagttgcagaataggttaagtcatgagctgtcaatttcaaagcataaaattgcataaatataaataccagccgagtgcttttccctaaaaactaaaaccacatgaatgtaggcaatgtgaaatcccaattggctttagcaaaggaaatccttcacagacttaagatggctcaggatagcaggctgctcctttgcgtgaccaagaacaagaaagtatatacgatatattggtgggttgtgtctttgctaggaacttttggttccagctgcttggacaaatcaatctgcctggttttgctcctcagctgggggaagagagcactatgcagtggtgaagtagaaccagtgagcagctgcagaggattgcaaaaaaaagggcttaattctttaatcaccctcgggctatggactctctggaaccatagaaatgagtgtgtctttgacagaattaaacccagcttggaggtagctataagaagagctgaagaagatattgatttatggaagttcacaggggtcaaacatctagctcttcttacagctcccattccaggaggggtcgggtagagggagcagatgataacatcatagatgaagatgttgtctggtgctgggctggtgtgtcgggtctatgtagctggtggcctttttaggtgttccttcatggatgttttcatgtattctaagttgcggccaccatagggcatcctttctttgtatttgtaattggtctatttttggaccctccttcctctcttaatttaatgatacacagctctcctgcgtg

SEQ ID NO: 4108 - DNA, 746 bp, Zea mays
cccacgcgtccgcccacgcgtccgcggacgcgtggggccgccgtgaagccagaagctacggagtcgttcgacgtgggcggcggtctctctcctcgggcctgcagagccagcggcctcagtcaccatcaccacccgcaccacacacgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgcttggcatgttccaacagctaaagtttgagttaataaattctatcaccctgcatgggactcatgttgtttgcaactggtttagcacgaactggtcttgttactattgtgctaatgtatttgattcgaagtttcagttaatatgctgtggaaaagaatctggtgcacgttgatgttctttatgatctgttgttcagtacattgctctgcttcgttgctacgttaagacttaagaatatatatatatatatatatactaacatcagaaaaaaaaaaaaagaattcccccag

SEQ ID NO: 4109 - DNA, 640 bp, Zea mays
cgagggcccagtacacacgagccagacctttcaagtcctttcatgaacggcagtggtacatgggtgggcttccagatccagcggcctcaccatcaccacccgacacgaggacacgcgacgacagggggagcagccggcgggcgatggtcggcggcggcgcacatggcggcaccacctacaaaggctacaccatcccacacaacaagcgctggcacaccgtcgccggcaagggcctctgcgctgtgatgtggttctgggtcttctacagggctaagcaggatggtgctacgctcttgggtttgcgtcatccttgggatgggcatgatgaccactctcatggtcatggacatgggcatgagggatcgtgacattaagttgcctactctcggcggacggtgatttgatgctttgcatgtcacaacaactaaagattgagttaataaattctatcacccttcatggtactcatgttgtatgcaactggtttagcacaaactggtttcgttacgattgtgcttatgtatttgatttgaagcatcggttatgtggaaaagaatctggtttatgttgatagttcagtacattgctttgcttcgaacaaaaaaaaaaaaaaagcggcctaaaaaaaaaaaagcgggcc

SEQ ID NO: 4110 - DNA, 965 bp, Zea mays
atacacaagcatgcatagctagaacactatacgtatatacgagtagatttacatcagtgatcggcttcagtcccctttattgccgctccacttgcgccatcattcggatttccttctgcctgttcttgaaactctgatggtgtcttggtgttagaatcaccgctctgggaattgcgtgatgaatctgctcgatcatatcgtgaaaccagtgacctcagcatgttagatctcttgatcagaatgcccagcgcagacgatgctgatgctcgaacaattgcgtctggcgattggccccccgggcaggtcaccatcaccacccgcaccacacacgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggatggacatgatgaccactctcatggtcatggacacgggcatgaggcatcatcatcgtcatcttcacattaagttccttactggctgcggacgatgcttggcatgttccaacagctaaagtttgagttaataaattctatcaccctgcatgggactcatgttgtttgcaactggtttagcacgaactggtcttgttactattgtgctaatgtatttgtttcgaagtttcagttaatatgctgtggaaaagaatctggtgcacgttgatgttctttatgatctgttgttcagtacattgctctgcttcgttgctacgttaagaatatatatatactaacatcagaaaaaaaaaaaaaaaaaaagggccggctagattcagaactgggaagatgaatgggcagctatgcctggtgtttccc

SEQ ID NO: 4111 - DNA, 1198 bp, Zea mays
gcagagccgccgcgtggcggtggcgttccaggcgtacaacgcgctgtcgccgctcgtcaagttctcgcacttcacggccaaccaggccatcctgcaggcgctcgacggcgaggactgcctccacgtgatcgacctggacatcatgccgggcctgcagtggccggggctcttccacatcctcgcgtcccgcccgcgcaagccgcggtcgctccggatcaccgggctcggcgcgtcgctcgacgtcctcgaggccactggccgccgcctcgccgacttcgcggcctcgctcggcctcccgttcgagttccgacccatcgaggggaagatcgggcacgtcgccgacgccgcggcgctcctcggctcgcgccagcggcggcgggatgacgaggccaccgtggtgcactggatgcaccactgcctctatgacgtgacggggtcggacgtgggcacggtgcggctgctccggagcctgcgcccgaagctgatcaccatcgtggagcaggacctgggccacagcggcgatttcctgggccggttcgtggaggcgctgcactactactcggcgctgttcgacgcgctgggagacggcgccggcgcggccgaggaggagtccgccgagcggtacgcggttgagcgacagctcctgggcgcggagatacgcaacatcgtggccgtaggggggcccaagcggaccggggaggtgcgcgtggagcggtggagccacgagctgcggcaggccgggttccggccagtgtccctggccgggagccctgccgcgcaggccaggctgctcctcggcatgtatccgtggaaggggtacacgctggtggaggaggacgcgtgccttaagctgggctggaaggacctctccctgctcaccgcgtcggcgtgggagccggcggacgacgctgttgccgcttctgcgcccaccggttaacgagtacaagacaagatttttgcagcaggtagattatgattttggaattcaatttcatgcctgctgccagcctcgcagccatccttggtggactggtcgtcttctcttcttgctgccgccctgctcgtgtaggcgtcttgtgagtttgtttttgtgatataatcgtataggcttcggcattcctttcgttctcctacctccagtatcaattaccaaatcaactttggattttgaatatttagtatactgcagctttgagtc

SEQ ID NO: 4112 - DNA, 1970 bp, Zea mays
cgatgtgtcccgttcattcctttaggaggagccggatccggcgccgcagtcgcccaaggtcccgaccgccgcggcctcggccgccgccgccaaggagcggaaggaggtgcagcggcggaagcagcgcgacgaggagggcctccacctgctgacgctgctgctgcagtgcgcggaggccgtgaacgcggacaacctcgacgacgcgcaccagacgctgctggagatcgcggagctggccacgccgttcggcacctcgacccagcgcgtggccgcctacttcgcggaggccatgtcggcgcgcgtcgtcagctcctgcctaggcctgtacgcgccgctgccgccgggctcccccgccgcggcgcgcctccacggccgcgtggccgccgcgttccaggtgttcaacggcatcagccccttcgtcaagttctcgcacttcaccgccaactaggccatccaggaggcgttcgagcgggaggagcgtgtgcacatcatcgacctcgacatcatgcaggggctgcagtggccggggctcttccacatccttgcctcccgccccgggggcccgcccagggtgaggctcaccggcctcggggcgtccatggaggcgctcgaggccacggggaagcgcctctccgatttcgccgacacgctcggcctgcccttcgagttctgcgccgtcgccgagaaggccggcaatgttgacccggagaagctaggggtcacgaggcgggaggccgtcgccgtccactggctgcaccactcgctctaccccgtcgcggccgccgactccaacacgctctggctcatccaaaggctggcccccaaggtggtgacaatggtggagcaggacctgagccactcgggctccttcctggcgcgcttcgtggaggccatccactactactcggcgctgttcgactcgctggacgcgagctacggcgaggacagccccgagcggcacgtcgtggagcagcagctgctgtcgcgggagatccgcaacgtgctggccgtgggcgggccggcccgcaccggcgacgtcaagttcggcagctggcgcgagaagctggcgcagtccgggttccgcgccgcctcgctcgccggcagcgccgcggcgcaggcgtccctgctgctcggcatgttcccctccgacgggtacacgctggtggaggagaacggcgcgctgaagctcgggtggaaggacctctgcctgctcaccgcgtcggcctggcgccccatccaggtgccgccgtgccgttgatgagacctctgcctgctcctgcttgcgttgagaggccgccactccacttgttttgcatctgtagctgctcggtttggtcatcagctgggagataagaaaagcggaaacgtactaattgctctggagtagatccatccattcacagtgatagttactgatgtactaagctttaattagttcaatgctagatcgttcttgttcaggtgtcgatcgcgtatccttgtccttggtctccttttcattttggtgctttgtctagtcgctttcccgactaatgccgtgctcttcatgcgcgttctagtgaagattcttgccgagaatattagcatagttttcatgtaaagtagccatcaagcaagtattaatttgtggctacttcaatgacatcctaaggccatgttttgaacaccttttgcatcctaatcctagaatccatgtctaaaactgaaactgctgtgctactactccactgttgctgctgattatagcagagagtgatgagtatttgtgcagcggtggtttatttcggtgttcttgacttgacattattacttttcttgggtggagttccaccctttcacatgtgtgggcatgcgctctgtctactttcaacatcaccttttatttttatttttgtatttccctctaatcctccatgggctgaggtcattagcttgtcaattcttgcgtcttgacattctgaccgccgttc

SEQ ID NO: 4113 - DNA, 2979 bp, Zea mays
  misc_feature (22)..(22): n is a, c, g, or t
  misc_feature (2608)..(2608): n is a, c, g, or t
  misc_feature (2612)..(2612): n is a, c, g, or t
  misc_feature (2614)..(2614): n is a, c, g, or t
  misc_feature (2616)..(2616): n is a, c, g, or t
  misc_feature (2623)..(2623): n is a, c, g, or t
  misc_feature (2627)..(2627): n is a, c, g, or t
  misc_feature (2633)..(2633): n is a, c, g, or t
  misc_feature (2640)..(2640): n is a, c, g, or t
  misc_feature (2643)..(2647): n is a, c, g, or t
  misc_feature (2655)..(2655): n is a, c, g, or t
  misc_feature (2658)..(2661): n is a, c, g, or t
  misc_feature (2663)..(2663): n is a, c, g, or t
  misc_feature (2672)..(2672): n is a, c, g, or t
  misc_feature (2674)..(2674): n is a, c, g, or t
  misc_feature (2678)..(2678): n is a, c, g, or t
  misc_feature (2681)..(2684): n is a, c, g, or t
  misc_feature (2687)..(2687): n is a, c, g, or t
  misc_feature (2689)..(2689): n is a, c, g, or t
  misc_feature (2691)..(2691): n is a, c, g, or t
  misc_feature (2693)..(2693): n is a, c, g, or t
  misc_feature (2696)..(2696): n is a, c, g, or t
  misc_feature (2699)..(2699): n is a, c, g, or t
  misc_feature (2701)..(2702): n is a, c, g, or t
  misc_feature (2705)..(2705): n is a, c, g, or t
  misc_feature (2708)..(2708): n is a, c, g, or t
  misc_feature (2710)..(2712): n is a, c, g, or t
  misc_feature (2715)..(2715): n is a, c, g, or t
  misc_feature (2719)..(2719): n is a, c, g, or t
  misc_feature (2721)..(2721): n is a, c, g, or t
  misc_feature (2723)..(2724): n is a, c, g, or t
  misc_feature (2726)..(2726): n is a, c, g, or t
  misc_feature (2728)..(2729): n is a, c, g, or t
  misc_feature (2735)..(2735): n is a, c, g, or t
  misc_feature (2737)..(2737): n is a, c, g, or t
  misc_feature (2740)..(2740): n is a, c, g, or t
  misc_feature (2744)..(2744): n is a, c, g, or t
  misc_feature (2747)..(2747): n is a, c, g, or t
  misc_feature (2749)..(2750): n is a, c, g, or t
  misc_feature (2752)..(2752): n is a, c, g, or t
  misc_feature (2755)..(2756): n is a, c, g, or t
  misc_feature (2758)..(2758): n is a, c, g, or t
  misc_feature (2762)..(2766): n is a, c, g, or t
  misc_feature (2769)..(2769): n is a, c, g, or t
  misc_feature (2772)..(2774): n is a, c, g, or t
  misc_feature (2778)..(2778): n is a, c, g, or t
  misc_feature (2780)..(2780): n is a, c, g, or t
  misc_feature (2783)..(2784): n is a, c, g, or t
  misc_feature (2788)..(2788): n is a, c, g, or t
  misc_feature (2792)..(2792): n is a, c, g, or t
  misc_feature (2800)..(2800): n is a, c, g, or t
  misc_feature (2803)..(2803): n is a, c, g, or t
  misc_feature (2806)..(2808): n is a, c, g, or t
  misc_feature (2812)..(2812): n is a, c, g, or t
  misc_feature (2815)..(2815): n is a, c, g, or t
  misc_feature (2818)..(2818): n is a, c, g, or t
  misc_feature (2821)..(2821): n is a, c, g, or t
  misc_feature (2823)..(2824): n is a, c, g, or t
  misc_feature (2829)..(2829): n is a, c, g, or t
  misc_feature (2832)..(2832): n is a, c, g, or t
  misc_feature (2835)..(2835): n is a, c, g, or t
  misc_feature (2839)..(2839): n is a, c, g, or t
  misc_feature (2844)..(2844): n is a, c, g, or t
  misc_feature (2847)..(2849): n is a, c, g, or t
  misc_feature (2852)..(2852): n is a, c, g, or t
  misc_feature (2855)..(2856): n is a, c, g, or t
  misc_feature (2859)..(2860): n is a, c, g, or t
  misc_feature (2862)..(2862): n is a, c, g, or t
  misc_feature (2864)..(2864): n is a, c, g, or t
  misc_feature (2867)..(2869): n is a, c, g, or t
  misc_feature (2871)..(2871): n is a, c, g, or t
  misc_feature (2873)..(2873): n is a, c, g, or t
  misc_feature (2875)..(2875): n is a, c, g, or t
  misc_feature (2877)..(2877): n is a, c, g, or t
  misc_feature (2879)..(2879): n is a, c, g, or t
  misc_feature (2883)..(2884): n is a, c, g, or t
  misc_feature (2890)..(2890): n is a, c, g, or t
  misc_feature (2894)..(2896): n is a, c, g, or t
  misc_feature (2902)..(2903): n is a, c, g, or t
  misc_feature (2907)..(2908): n is a, c, g, or t
  misc_feature (2910)..(2911): n is a, c, g, or t
  misc_feature (2916)..(2917): n is a, c, g, or t
  misc_feature (2920)..(2921): n is a, c, g, or t
  misc_feature (2925)..(2926): n is a, c, g, or t
  misc_feature (2929)..(2929): n is a, c, g, or t
  misc_feature (2931)..(2931): n is a, c, g, or t
  misc_feature (2934)..(2935): n is a, c, g, or t
  misc_feature (2938)..(2938): n is a, c, g, or t
  misc_feature (2945)..(2947): n is a, c, g, or t
  misc_feature (2951)..(2951): n is a, c, g, or t
  misc_feature (2960)..(2960): n is a, c, g, or t
  misc_feature (2966)..(2967): n is a, c, g, or t
  misc_feature (2969)..(2970): n is a, c, g, or t
  misc_feature (2973)..(2973): n is a, c, g, or t
tacccttgtggtccggccgggncgatgcgtcccgtccttcctttagaggagccggatccggtgccgcagtcgcccaggtcccgaccgccgaggagaccgccgcggcctcggccgccgccgccaaggagcggaaggaggtgcagcggtggaagcagcgcgacgaggagggcctccacctgctgacgctgctgctgcagtgcgcggaggccgtgaacgcggacaacctcgacgacgcgcaccagacgctgctggagatcgcggagctggccacgccgttcggcacctcgacccagcgcgtggccgcctacttcgcggaggccatgtcggcgcgcgtcgtcagctcctgcctaggcctgtacgcgccgctgccgccgggctcccccgccgctggcgcgcctccccggccgcgtggccgccgcgttccaggtgttcaacggcttctgccccttcgtcaagttctcgcacttcaccgccaactaggccatccaggaggcgttcgagcgggaggagcgtgtgtgcatcatcgacctcgacatcatgcaggggctgcagtggccgggcctcttccacatccttgtctcccgccccggcggcccgcccagggtcaggctcaccggcctgggggcgtccatggacgcgctcgaggcgacggggaagcgcctctccgacttcgccgacacgctcggcctgcccttcgagttctgcgccgtcgccgaggccgccggcgacgtcgacccgcagaagctgggcgtcacgcggcgggaggccgtcgccgtccactggctgcaccactcgctttacgacgtcaccggctccgactccaacacgctctggctcatccaaaggtcctccattttccttctctgcctttcttccatgtcaaatcttgatgcaatcatgaccacttttcagctgctgacattggataatgtgagctttacggcaagcatcaagtcgtggtagtacatccattacagctatttctaaaatattcttcggaggtttcctgctcatagtaaaaaaatcgcgttttgaagctcaaaaggcgatttcttccgaggtttgctgttgagcgctattttggaaaccccattttctcaattgatttttattttttaaagaaaaattagttcatttttctcttgtgaaatggagtcccaaactaaccctaatattaaaaaaaatcacgctttggagctcaaaacgctcgttgttatgaccaaccagctttataggtttaaaaaggttgaatcttgacaatgcttttgaaaaggttgaatcttgacaatgcttttgagatgatactgtagtgtagtctgtagtggagcatcctccatggtctttggtgatccgagaaccacaaaagatagatttcgcttgcatttgatttgtggatcactaagagggagctgaaagttgttatcatcatggccaactttccatgccaaaaggtttctggttccaagtgccaggacgaccatggttactgactgaatggaacaactgtcatcttctactactaatcatcatttgtttacacgctactactcggtcatcatcaggaagctacactcagaaaggcttgtcaaaggctagtcttttctccaatgactgccatgccagattgccaacagcgcacacatatctcatctgaagcatgagataaacatgtaccctgaactgcaatgcccttgatttgatgcataattaaaaatgctagcattgtcgttctggtacagtggcactggcactgccaccagcgattacagaaccgaatggttgtcacaaaacgcacatcctgactgactgacggctcccgctgtcggttggaccacaggactgttgatcgattgcttctgttcgttcgtccacctgcaggctggcccccaaggtggtgacgatggtggagcaggacctgagccagtcggggtcgttgctggcgcgcttcatggacgccatccactactacttggcgctgttcgactcgctggacgcgagctacggcgaggacagccccgagcggcacgtggtggagcagcagctgctggcgcgggagatccgcaacgtgctggccgtgggcgggccggcccgcgccggcgccggcggcgccaggttcggcagctggcgcgaagagctcgcgcggtctgggttccgcgccgcctcgctcgccggcggcgccgccgcgcaggcgtcgctgctgctcggcatgttcccctccgacgggtacacgctggtggaggagaagggcgcgctcaggctcgggtggaaggacctctgcctgctcaccgcgtcggcgtggcggcccgtccagacgccgccgtgccgttgagagctgaaatcgttgttggttacccagccagtggtagatcttcttcgtactatactcctgcttgagtttcttgtgccacttcttttgcatctgtagctagctagctggctgctcgatttggtcgtcagttccgagatgggaaaacgaaaacatctcttctcgtcactaatcgctagatccattcacagtgatagttactgatgtaagcctactaattagtttaatggcagatcaaccttgtttagcctaattagttacttggaactactgttctttcanaaanananataaccnaaancaaatncaaatanaannnnnataatacnatnnnnancccattccntnctanctnnnnttnangngngcnctncnnaanacntnnnctnacancncnncntnnataatntnacnatcnccncnnanttnnanattnnnnnaanaannnatcnanacnntcantatnaaaattanatncannncccnctnttnaanannaatanacnccnaacnatctnacnnnacnccnntanncnancannnanananancntggnnatcgcnaacnnntatacnnattnntnncttannaannccannaantntcnnacnatcgctnnntccncttaactcnatcttnncnnccntaatac

SEQ ID NO: 4114 - DNA, 1591 bp, Zea mays
agcgtgtcttgattttctcgataagttcaagacgccagtcgttactggtgatgggcctccccgaggcccctccggcccgcgcgcccgaacaactcttaggacaaagttgtatgaagggctggctgatcagttgactgatattgttgtgaatgcagttctctgcattcgcaaaccagatgaaccaattgatctgtttatggtggaaataatgcacatgcgccacaaatttgatgttgacacccgtctggttgagggtctggtcctggaccacggttctcgtcaccctgacatgaagcgcagggcagagaattgttacatcttgacctgcaatgtctcattagaatatgagaaaagtgaaatcaatgcaggatttttttactcaaacgcagaacaaagagagaagatggttgctgcagagagacgccaagttgatgaacgtgtcaaacagattattgaattgaaaaataaggtttgtgctggaggcgataaaaactttgtggtgatcaatcagaagggcattgaccctccatctctggatctccttgctagagcggggattattgctcttcgaagagcaaagaggagaaatatggagaggcttgtgctagcatgtggtggtgaagctgtcaattcagttgatgagttgactgaagattgtctaggctgggctggtcttgtctatgagcatgttcttggagaagaaaagtacacatttgtggagaatgtgaaaaatcctcgctcttgtactatactgattaaaggacctaatgaccataccattgcacaaatcaaggatgctgtccgtgatggtctaagatctgttaagaacacagttgaggatgaagcagttgtgctgggtgctggtgcttttgaggttgctgcaaagaagcatcttatcgacaatgtgaagaaaaccgtcaaaggacgagcacaacttggggtggaggcgtttgcggaagctcttcttgttatacccaagactttggctgagaactctggtttagatactcaagatgtgattgtttctctccagaatgagcatgaccgtggattagttgtggggttgaaccatcactctggggatccgattgatccccagatggaaggcatcttcgacaactactctgtgaagcgccagatcatcaattctggacccatcattgcatcccagttgctgcttgtggatgaagtgatcagggcaggccgcaacatgaggaaaccgacttagatttttgtcgccacctagccgagacttatttgttctaccttttgttttggttttgtgcctagtagtgatctggatgatacgtttgacttgagttggtcccatttcacgaagcaggtcgcattcgctttttttttttgggattactgcgtgcttccattttaacatgggattttagttttatcgatggttttaacatcctcctatgaggaaacaaagcctctagagagacgaggttgccttcccgaagttagtgccaccaaacttgctgcatggaacatgaagaagcaatgtttataacaatgttattatcaagtaatccgatgtgatggataaaataatggtacaaacgtttttcctcttacc

SEQ ID NO: 4115 - DNA, 1250 bp, Zea mays
ccggacgtcttggtcttggtcctttgggtgacctcgaggccggccgggaccgaaagcacatatgctgtccgtcaccgcgcgcgcctccttgcccttcttcaccctttcctcccggacccggcgtctccgtgcccgtgcgtgccttctccggcctgcggtctcctccaccggccaccgctgcctcgcaattgggcaaggcaatcagaccgctcccatcaaccgccctgaccgcgcgagggagatcaaacgcggaggccgtccgtccctcccgcgttatcgtgatgccaggcctcgccgcagccgagcaggacgccgtctcgctggtgcggcgcgtcgcccgcgctctcaaccgccgcttcaccgacatcgtcgcactgctcttcagccacaagggcgctggatcgctcggcgccgtcgcggggttcgccatcgccgtcgtgttcgcgtggaagttcctgcgcccccgcagacgtgctcccaagcggcccccacctacccctgcagcggctcccgctgcgactgtgcctgatgcggccgagcctatcggtgactcaggcaaggtagtaacacgggaaattgtggtgaagcgactgaaaggctgcagaaaggttacatgccaacttctcggtgttgtttttgaggaaaaaattcctgaggagcttcagaaacatgccacagttagaccctccgtggtagagctgctactggaaatatccagatattgtgatctctacctaatggagactgtaattgacgataagagcgaggaaaatgctctcatggccctggagatctctggacttttcagaactggtggcctgatgaaagagaaggtgctcttttgcagctctgaagttggtcgaacttcatttgttcgacagttggagtcagattttcacatagacacgagccttgacatagtttctcaactatctcggttcattcgatgccaactatttatttccacggtggaaggagaacagcttgcaggcaacgtattcaattctccaagtcttgagcagttcttctcttgatggcgggacgcaaagaaaggccttctgcactccaaacaaatgtgctgatttcacaattgtgacttgtgagttgtaggcttgtagcgcccccaaccaaggcctggacgcaacaaacaccctactcctgttggagttaagttgtgatcatgcaagatgtatattaaacagacaataataagttggtaaaaatattcatatttaaaaaaaaaaaaaaaa

SEQ ID NO: 4116 - DNA, 836 bp, Zea mays
  misc_feature (99)..(99): n is a, c, g, or t
  misc_feature (167)..(167): n is a, c, g, or t
ggacagagaagcccagcccagaatcggagtacatagctatcagggctccgctgtctccagttattcttccggaggccgggcgcgcgggtgacccggggnagctcatatgaggtggtgactgagtgtctaaaggatgaacctgaggagccaaccttgggcgccgtggnagaaaccttaccaggccccctttgctagggtgacatcgctggcgaatgcatcagacagcagtccattacctgaatcacttgcgcatgcaaatagcattaaggctcgagtgcctgagcctgtgtacacagtttcagttgagggccatgtggtaagtgaaaagcctcgaagcaaagagccaaaaggcttgaggaaacttttgaaatttggcaggaaaagccatgctgagggcgcaatggattcatcagttgacgaagcctcagcaggagatggttcgatgctgaagaatctcatttctcaagatgactctggtgcgtcttcttcaaaagcttctcggtccttctccctactgtcaccgttccgcagcaagcacaaggtgattgttctgtgagcacaaggtaatcaatttgggaggagaggaatataatggcgcagcacagtacatacttttggtttttcccttctagtatatatttacacacacgtatacataaatacatacatactatatgatggacttgtcattagacagcctatgtgaaggctgtgtgtggcgatggatggttgtttgcccttgtggttttgtaccctaactatttgtgttgatatatatggtgatactttttgttccagatttactattcaaatgttggcgcgccgccgactattga

SEQ ID NO: 4117 - DNA, 2773 bp, Zea mays
  misc_feature (1441)..(1441): n is a, c, g, or t
  misc_feature (2190)..(2190): n is a, c, g, or t
  misc_feature (2241)..(2241): n is a, c, g, or t
cctcgaggccggccgggtgtctgctctgcactcaaccaccacccgcgctccccaccccacctcccctcccctcccccctacagattttcactttccaattcctatttatctcttcttttgttctttaatttggttcgtacgtacaagacttctcggatcactcgtcttctttgattgcatcatcgagacctgcattttcccttccaaattcgtcactcactctggttggccgccttctgtcttctgatccaatccggttgaaatcctccgtctccttccagcaagatctggcacataaggagaatcggcaagaaccattctgcaaatgaggccggatacgcggcttgaatcggcggtgttccagctcaccccgacccgcaccaggtgtgatttagttgtggtggcgaatggacggaaggagaagatagcctctggtctgctgaacccattcgtcgcccatctcaaggttgcacaagaacaaattgccaagggaggctattctatcacacttgagcctgacccagagattgatgcaccctggtttaccaggggcacgttggataggtttgttcgatttgtcagtacaccagaggtcctggagcgggtcacaaccatagagtctgagatattgcagatcgaggatggcattgccgtccagggcagtgacagtcttgggttgagatctgtggaatactataatgggaaataggtaaaaaaaatggaaggtgaaatgctgacgagcatttctttatttcaccacgagtcatagaacaaacagcatatgtgccatctgtggagtctttgttttatcacctaagtaatgagcaatgtttatttgttaccaaaaaagaactttccgtatcttcatggaccatgatacttggcaaattgctatgcaatatttactttagcatttaatcattataaagtttggtgtaaatgtaaaatcaggcaatgctgttggatcttttacaggcagatagtttgttttcaacatactgggctgcacaaggaaatcccaatgtatatgcatggagtgacctttcctagttatatggattcttaaattaattgttttagttttagctttagctagctcattggaagttatgcattctgagatggagctagctatcacgtcgtgcattttaggaagagatcactctcatagtctcatctactttaaaaaagctacatttttcttgaaggatgaatctgaggtgcaacttgttttggcgacagttcttgtattcttctgccctgttgctgaatgtccctgacccatctacttacaggtagtaaggcaagttacaatcctgatgcagatagggcacttgttccatacaaggtgaatttgtacagataaacctgcctcttctttctgcaaaagagtaatggtatatgtgcttatcatgttctgagattccatattcttggcagnctggtacacaaccaattccaccattgcagaatcatgatgctacacaggaggagaattcaaagtacctatgtctaaagcagcatgttttgttttctgtaatgtagtacttaacgatgccatggatgacaattggcagtaaaactggtctacatggataccaccgtgatttaactagaacttattttcattatggagtaacatatgctccatttcatgaagatatgcatagatttctggcgtgatcatcatttgattgttctattacatcatctgtttactttttggatgacttctttatgtgtgcgttttctctggagaagcattcgtttgtatttttattttcgtggtgaatttaactgcattatagaatgttgttcatacaatcatctgatcacatacttcatattttgtagggatcaattgctcagagtgctagagactcgcaaaacagtcttacgtaaagaacaggctatggcctttgcacgtgctgtagcagcaggatttgacatcgacaacttggtgtatctgatcacttttgcagagtgttttggtgcttctcgcttgatgtaagtgttagatagaacagaaaaccctaaccctaattgatgtgacttgatggtcgatggcgactggatggtgcaccggtggctcggcatggggcgactcgtcggtagggtggaccagtggactgggccacacatgttgccggtagatgtgggtgggatcgacaaaacgagccacatgtgccnagaagtatagtaccgcgcatggcgcgatcggaaacgattgggccacacatngcacgggcgaaggcgacggacccacgcatggcgtaggcgggggcgacggggtcgtgcgtcgggaccgggggtaggggaagaggagagatgttgacaggatcgacatcgagggaatcaaaatcgaaaggtggggaggagccactaaggggaaacattctcattgaaaacaacatgacgagagatgatgatgcagtggatgagaaagtcaaggcatcggtatcccttgtgatccgaggagtaatcgaggaagagacatcgagtggaacaaggcacaagtttgtgggaggcagtggcagatgtgttgggatagcaagcacacccgatgacgcgaaggtgctcgtaggagggtgccaaagagggtgaagaacccactgatcgcctgggagggaagacggttgaggaggtaggcggcaatgttcaacacctcagcccaatagtgggcaggaagagaagtttggaagaggaggcaacgaggcatgttggtgcatgcgatcggctcgaccgttctgaggggaggtgtgaggacacgaca

SEQ ID NO: 4118 - DNA, 1076 bp, Zea mays
ggccgggactgctcgagctcagctcaagtaaccacagaaaatggcgtcacttctccgccctctcgtcctcgtgctcctgatcgcctcctgcgcagcgcagcagtcaccgccggcgcagcccccgccaacgccgaacgcgccaccggccaactcgccgccccaggcgcctccagccggcaacccgccgccggcgccccaggcgccgccggcaggcaacccgccacctgcgcccaccgccactccacctccggccccgaccactccgcccccggccccgaccacacctcccccggctcccacaacgccgcccccggcgccgacaactccacctccggcccccaccacgccgcctccgtccccaccggcgtcgccaccgcccgctcccaccactccgccaccgtctcccccggcaagcccgccgcccgctcccgccaccccgccaccgtctccgcccatggcgccacctcccgccacgccccctccacccgccaccccgccgccaccggccgcgcccacgccggccccgagcgtggccccgactcccccgcccgtggcgacaccggctgcgtcccccaagagccccaagacgccgagccccgccgccgcgacgtccccggcgccctcgctctcgcccacgggcacgccgacgaacgaggactcgggtgcaagcgcgcgcgcggtcggcttcgccacggtggtggcgttggcgggcgcgggcctcgccgtcctgctttaaaaactagactccgactcttcctcctgtcctcacgccgatgttgtcaccccctccccgtgcctcgacgttgctgctcgctccatttcagtttcatcttttttttttttcctttggtgttgttatttaattttaccggccctacgatcgattcttgatgtacacgatgatgatgcattggttgctttggatccgcgggcgggtggtggttagtgttctgcccgcgggtgtcgccatgtacttttaccgcactacattttggttctatagagagaggatttgtgtatattctcgtggattatttctatggccgttgaataaaatctctgtgcagattaactcg

SEQ ID NO: 4119 - DNA, 5181 bp, Zea mays
  misc_feature (3591)..(3591): n is a, c, g, or t
  misc_feature (3901)..(3901): n is a, c, g, or t
  misc_feature (4488)..(4488): n is a, c, g, or t
cattgggtacctcgaggccggccgggccgccactcgtagtcgtaggcactttcatctgtgccctctgcgttcgagatcgatctcagctggcaccgtcccagttcgccatggcggaggaccggagccccaagcccatccactgcaaagcggcggtgtgccgagccgccggcgagccactcaccatcgaggagatcgtcgtcgacccgccgaaagcgtacgagatccgcatccgggtcatctgcacctcactctgccacaccgatatcaccttctggaaagctaaggtggcaccggtgtttccaagaatactagggcatgaggcgtacggggtagtggagagcgtgggggagcacgtggagggcttcgcggcgggggacaccgtggtgccgacgttcctggggcagtgcgagcgctgcgccagctgcgcgtcggagcacagcaacgtgtgcgacgcggtgccgttcgtcatcggccccgggatgcggcgcgacggcaccacccggttccgggacgcgcgggggagcccgctgcacgacctcctcgccgtctccagcttcagcgagtacaccgtcgtggacgtgaaccaggtggtcaaggtcgaccccgccgtgccgcccaagctcgcctgcctcctcagctgcggcgccggcaccggggtaggagcagcgtggaggtctgccaaggtggagccaggatccactgttgcaatctttggcctcggatctgtcggtttggcggtggtccaaggcgcgaaaatgtgtggcgcatccaagatcatcggcgttgatctcaaccctgacaaggaggaagtagggagatcgttcggcgtcacagacttcgtcaatccatcgcagctggacaagcgttccgtcgtagaggtgatcgttgagatgaccggcggcggcgtggactacagcttcgagtgcatcggcgtgccgtcggtgatgaccgacgccttcagatgcaccaagatggggaagggcaagacgatcgtgctggggctggggagggacagcgacgaggtgtgcctgccgtcgctggagctgctgttcgggaggtgcgtcatggggtcgctcttcggcgggctgaagcccaagacccacatccccgtcctcgccaagaaatgcatggacaaggagctgcagctggacgcgctggtcacgcatgagcttggactgcaggacatcaacaaggccttcgacctgctcctgcaggggaaaagtctgcgctgcatcctctggatggacaaggacaagtaacggaaggagaggggcggccggaccaatccttcctgtctctgaataaatttgccctgttttttcagcgaggcgtcgctgaaagctggtgttagcggcgaccaagactatctgttcctgaaagccggtgtatcagtatcgtttcgttgtctgaactgattaaatcctaatatcgatagattagactctccccagcaaccgctttgtcccctgaataaagtgattcatcatctcttttttacatctagcaaaaaaaaaaaaaaaatccctacaagacagcgaaggttaccgtctgtccccttgtgtcgtggtttcggaaatctgacacacgggattatattgattcatgcccggattatagtacagtgtagtactgatcgtagaattacagtagattgtgttataaattgtgtgctcgtgtgtagaaaaaataaagagtttcccttttatactttaagggattaaccttacatccgagagagaaacttggttgtcatgacgtgccattcatgggccctatgtgcagtcggactcttggcgtggcaccattcgccatttctgtccctgtagcgagttcgcagctgacacctcgtgcggtagtacgtggcaggtcccatgggtcagtctcggggcatcttcacacgtggcatggaccctcctttcgtcacgatccttgcgtcactccccatcatgttgctggccatcttccggtatgggtgttatctcgtccctttcaataaatgggtcactgtttggacttccgatgccacagtgctaccttgactaggctcgaatggccccacagggcagtgtgagtatccatgcgaccgtacattaagatgtacagtcgtggctgatggagacttcccgtcacgccctcgatgtgtcgtacacacctctcgatgtggcctagggatggcgcgccttatcgccgctgacgtgggccagcgacgcggggggtcgggtctgcgcctcacagacttgctcgtcaattgtttggacgtccgctccacctcatagtcttgctcgttagcgacttggtcgtccgctccgcctcgcagactcactcgacagggacttggttgtccgcctcgcctcgcagacttgctcggcggggaccgagtcatcagtctcgcctcgcaaacttgcttggtgggacttggtcgtccgtctcgcttcgcagacttgcttggcaaacggaccgaaagaggttatgagccttaccttgggtaccccgttcctacgtacccgatagcagcccccgagctttcgggccactcattggagtcgcacggaggcttatgctcggtggcctatacgcttaggtgtgtgcaagcgcatctgctagatgtagcccccgagccctcgtgtgatccatgtcgattgcttagggggcttacttggtgataatacatgcgattgacgccacacgctgggcgtgggtccatttccctttagtgagggtggaacgctcggatgcatgtaaacgcatctgttagatgtagcccttgagcccctgagtaatccatgtggattgcttgggtttacttcgtgataatacaatttagggatgggcccttcatgcgattgatgccacgtgctgggcataggtccatttccctttggtgagggcggaatgcttgggtgcgtgcaagcgcatctgttagatgtagcgcccaagtccccgagtaagccatgtggattgcttgggagtttacttggtgataatgcagtttagggacgagcccttcctgcgatggtcgtcacacgctgagtgtgagtccacggttcccttgtatttatcccgggggagtgacccctttgagcaggtcgtcgcttcgtcatcctcccttgccgggcgtgtccattcgccatctaatgcacgcatctccctttcgaaggatatgttaggagctcctcctttgaagggaggatctccccgaccgactgggtctacgcggggaaggaggtcgttgagctacaaacgggttatccaagtaagatacgactatcccttcacagtgcttggactcggtgagcagtcccactagggggctcgacccactgtgggcatcttattaagtccttccttattctatctcgtattggccctcctgtcaatctggtcggtcggatggggccgtggccaccccgtcagccgcgttgccacaggagaatgtgaggtacgaccttagatgtggaatcaagcaaatgacctatgggccggtcacatgacttgcgaatctctaggagcttgctcagcccacccctcactctacgcgagggagttggaagtgaattttggtttttacctggagtgaggcagtttatggtngcgttgcggtaaaaataggagttatcatggcttcgctcggcgtggctggcttgacgagacgcgaaacgacccactcaccgtgtcatgcacaagtgacgtgatggtgcggtaaaccaccctatccgttactgacgcctttccccgtgcgctccttggtgcttcgtctgaggcgatgcgaaccttgcaaaacgtataatcttcctcgcggcgcacgaggcgggggataccgatgcggtaggatctcctgtgttgtccgcgagggtccacctttcaagcaccgctttgcttccctgttcctatgtatagatangacacagaggcattcggggtcggttccgcttactgtgctttctcgcccgagcatctgacgcccctttcccttggagatcttctcgcgcccttgtgccaacctcccttctgtgctcttcttccctggcctcatggacacctttcccttgtgctccgctaccagggaacgcctcgaggacctggagaggaatgggttcctccctcctgagtcagtcttcggttggcatctagaggagggcggtgctttagcgccgcgtgatggtgaggtcgtggtgctggcctccttctatgagcgcatctttgggcttcccctgcaccccttcgtgcggggtttgctcttctactacggttgggtgctgaaaacccttcatctgaacatgatccttcacatagtgtgcttcatcacgttgtgaaaggtctacctcggcgtggagccccactggaagttgtgggtcgcgggtgatgtgtgcgaccatctctcccctccaacgccatctgaggcgcttttggctgatcggttgtgggtgttgcctaggcacgtggagcgtgtggtcttcgaaggtgcatacttccacgagatcaacgacnccgtgatcgcgaagggatatgccatcgaacggagtgaggaggaactagacgccatcgatgaataggttcgtcttcacactcagtcgcttgcaagtcgggtcgatgtgaagctcctcctgaccagttccttgagtctggaagcttccggcgatgatccgcctacccccgcctagattgtgctttcccttttagatgtaatgaacttttgagtaacttgcaagacgcttccatatgtgacattatttccgtctagggtgttggaaggtgttcgttccctagcccatgagtaggacatgtcgaattggttagcaggtgctgattgcatgtgaggaaaggagggaaaatcgcttagggatagaatttcctcaggttttcgatgttccatgcgttgttcaggagattctcatcgccatccttgagtcagtaagccctcgatcgtagagcctaggcaataatgaaaggaccctcccaaggtgatgagagcttatgcttgtccttggtggccatcactctcctcaaaactaggtcgtcgacgttgaatgacctacctcacacttgtctatcgtggtaccacagtagatcttgctggtatttcgcggagcgtatcacgacctcatctcatatctcgtcaaggagatcgatagagagttgcgcatctgtcgttgcccactcgccttcgtaggcctcagttcg

SEQ ID NO: 4120 - DNA, 1193 bp, Zea mays
caaaagcaagagtgacgagttccatgaccaaaaaagatgcgatgaagcaaggctgaatgctctgtcagaagaaatggacctactcaatgccaagatcgacgagctatccagcgagagaaacgacctctctgaaaagaacgcgcagaaagacaaggaactggccggaatcagtgaaaaggacatgcagttgcaagacaagactgctgagatcacttcactaaataaggagcttgtatctctcaaagaccaagtgaagacgcatctggacgaactgcacgatttaaaatgtctgaaggacaggaaggaggagacaattggaaaactgcaaatagatattgggtcactgaaactccagtgcgacaacttgaagacttcgctgtccaagaaggagtccgagaaagataaccttgcctctcaggtgctggagctgagaagatcccttgagacccgggaagaaggggcaaaggcaaatggccaaaattcagacgcgaagaacaatccgcatactaataataagcgcatgaagcacaataccggctccaccgggagcattgctgcactgccaggcaccaacggacagggtgaagacgatggtgactgcaatgggcatgacatgaggaacgccgcagcggacggggcagcgaaggagctggcctcgctgaaggagagcagcaaggcggtggaggaggagctgaaggagctgcacgagcggtactcggcgattagcctgaggctcgcggaagtggagggcgagcggcagcagctcgtgatgaccgttcggtcgctgaagaactcctccttgcggtgactgatgcatctccacccaaattgctgtagctaaaaggatttagacgataggtttgtccgtgacgtggttttgtccgtcagagttacagtacacagcatgtagatctcgtcacagtaaaatgtgcagtaatatagccataagttgtaatagttgtcttaccctctctacagtgtcagtgtgtcgtgctgtataatttccgtggcgtcattgtgttgtgaagtaaggaaaatgagaaggaaaagagtggtctttcagtttaatctcaaaaaaacttgcgctgtgttccaagttcctgggtgtacagttaaaagcttgttgggttatttccaatacacatagattggatgagaatgaaaaaagttaagaagaagtttaacttgtttgg

SEQ ID NO: 4121 - DNA, 510 bp, Zea mays
cggctcgagcatcgctgcactgccaggcaccaacggacagggtgaagacgatggtgactgcaatggccatgacatgagaaacacatgaaccacggccatccgactgacagacatgtcttgccaggaacgccgcagccgacggggcagcgaaggagctggcctcgctgaaggagagcagcaaggcggtggaggaggagctgaaggagctgcacgagcggtactcggcgattagcctgaagctcgcggaagtggagggcgagcggcagcagctcgtgatgaccgttcggtcgctgaagaactccctccttgcggtgactgatgcagctccacccaaattgttgtagctaaaaggatttagacgataggtttgtccgtgacgtggtttgtccgtcagagtcacagtacacagcatgtagatctcgtcacagtaaaatgtgcagtaatatagccataggttggaatagttgtcatcccctctctacagtgtcagtgtgtcgtgctgtataattt

SEQ ID NO: 4122 - DNA, 1517 bp, Zea mays
cattggctccccgggactagctccactccaccacacacaccgcgcagctagctgtcaccggagcaagaaggaagaaaaaccagcggcaccgatcgatcgacgacacgcgcgcgatcgaggtgaggagcgaaagaaaaggtggccttttcgaagccgccggacggagtgtagcgctagctagctccccaggccggagaggaggatggtgggacgaggagcggcgacggccctcgtgtgggcggcggtggtggcggtcgcgacggtggtgtcgcgggcgcagcagctgcaggtggggttctacgacacgctgtgcccggcggcggagatcatcgtgcaggaggaggtgagcaaggcggcgtccggcaaccccggcgtcgccgcgggcctcctgcgcctccacttccacgactgcttcgtcagggggtgcgacgcgtcggtgctgctggactcgtcggcgggcaaccaggcggagaaggacgcggcgcccaacgccagcctgcgcgggttcgaggtcatcgacagcgccaagacgcggctggagcaggcctgcttcggcgtcgtctcctgcgccgacgtcctcgccttcgccgcccgcgacgccctcgcgctggtcgggggcgacgcgtaccaggtgccggcggggcggagggacggcaacgtctcctcggcgcaggaggcgggcgcgaacctgccgccgccgacggcgagcgcgagccagctgacgcaggcgttcggcgccaaggggctgagccaggccgagatggtggcgctgtcgggggcgcacacggtgggcgcggcgcgctgcagctccttcgcgccccgcctctactcgtacgggcccagcggcgcggggcaggacccgtccatggaccccgcgtacctggcggcgctggcgcagcagtgcccgccgcaggggaccggcgccgccgacccgcccctccccatggaccccgtcacgcccaccgccttcgacaccaactactacgccaacctggtcgccaggcgcggcctgctcgcctccgaccaggcgctgctcgccgacccggccaccgccgcgcaggtgctcgcctacaccaacagccccgccaccttccagaccgacttcgtcgccgccatgatcaagatgggtgccatacaggtgctcaaccggcacagccggcaccgtccggaccaactgcagggtggctagctagctagctcatccatgagaatgtacctgtagactcatgtgcttaaaatcatacgacgaaactgtacgtacggcgtagagtggtgtggcggggtccaatgattcagattgtacgtacgtgtccatcgatccaactgtagttgtgtacgcagtacagtacgtgctagctacggatcagttgcttatatatagcttgtgcgtttttttacactttcttttgtccttttggtttataatttttattaagatatacaaatatttctcttcagattcggatcgaatacaaatattaaaaatggttcgttctttttcaaaaaaaaaaaaaaaa

SEQ ID NO: 4123 - DNA, 3567 bp, Zea mays
  misc_feature (3543)..(3543): n is a, c, g, or t
acagatatagccttcagtgttaaactaaacatgctgcttgctcgaagttgctgctacagtttttttcctttttcttttttgttgggaaccatcagctcagcaggcgagaggagagtgaggtcggtgtcacaccgtcgtcactcgtggcagttgcaggtagcccagagagcgtagcgtaggcagcagaactttccatttcccagctgccaaacagagcacgccgctatacctgacacggaaccgtcgcgtcgagccagccaccgtgacaatacggcggcggtttcacgtccgtgtctcgtgaccgggagggagaggcaggagcgaaagctacgagactactaccactaccagcgcggcggcctcgggaacgcggcgtgggcacgtcgggcgcatggttctagtacgtggatccgacgcgcaccccatgtgctctgccctgcccgggcccggcacgcccacatgccctgccgtcgcggtctcgcccgccccaccggacgttccgggtccgcacgcacgtgccacctcagctggcgttcgcgtcgcgttggctgccttctcttgctgacgcttctgtgttggtctctggctgcgtttgttgcaggtcgggggcgacgcgtaccaggtgccggcggggcggagggacggcaacgtctcctcggcgcaggaggcgggcgcgaacctgccgccgccgacggcgagcgcgagccagctgacgcaggcgttcggcgccaaggggctgagccaggccgagatggtggcgctgtcgggggcgcacacggtgggcgcggcgcgctgcagctccttcgcgccccgcctctactcgtacgggcccagcggcgcggggcaggacccgtccatggaccccgcgtacctggcggcgctggcgcagcagtgcccgccgcaggggaccggcgccgccgacccgcccctccccatggaccccgtcacgcccaccgccttcgacaccaactactacgccaacctggtcgccaggcgcggcctgctcgcctccgaccaggcgctgctcgccgacccggccaccgccgcgcaggtgctcgcctacaccaacagccccgccaccttccagaccgacttcgtcgccgccatgatcaagatgggtgccatacaggtgctcaccggcacagccggcaccgtccggaccaactgcagggtggctagctagctagctcatccatgagaatgtacctgtagactcatgtgcttaaaatcatacgacgaaactgtacgtacggcgtagagtggtgtggcggggtccaatgattcagattgtacgtacgtgtccatcgatccaactgtagttgtgtacgcagtacagtacgtgctagctacggatcagttgcttatatatagcttgtgcgtttttttacactttcttttgtccttttggtttataatttttattaagatatacaaatatttctcttcagattcggatcgaatacaaatattaaaaatggttcgttctttttcattatttcttcttcgtttccatacgattcatcttcccgtcacttcctcctccgtatcctctcattcagtcattcgcccacgcccgcccataaatccctccatgtttttttctttttgattagagaaagaagaaggaaccagacctacgaatttcatactcaaattggatgtgggtctagaactctagatatgaaactccacatgaacccaaggaacatacaatctgggctacatttgttcatgtcgggactttatgggcctcaagttgcgccagcagtctacaagcccagcgggctactgaacaccgtcggtagagtgggctgtgtacatctacaagtcatgacccgttcgaagcaggcctcgtgcttccctgcacgagatatctgggcctgggctgatcggtgcgcgtctgttccatgaacgcggaacatagtctgtgctgccatgtgctgatgcgcaacgcaagcttgcagcagcacagcacggagcatccatggagtccccgggcgtagaagatcagcggcactggctcgtgctcgtgccgcatcctcttcctccgcccacccagacgacctgacccacccgcccgcccatgagggccgtggcccacccgtgccagcacgcttcgcggagaaaaaggctatagctgctctgctgcccggccggccggccggctctggtctgggtggtccaggccggcgcggcaggcgcccggccgtccccgccggccactgttgagcgtggagtagcacagtggccggctacggctacagcagcaggccagcgggatcggtcgtaccgctaccacaccgcccgacacacgcgtaacgcaaacggcgccgatgggcagcgcggcagcagccagcagagcgcagacctgcatgcatgtccggcgtccgtaccggccgccaccaccaccgcccaggccagcgcacgccgctgcgcaacagcgcaagtatggtggtatgattcgtcgtggcgtcacatgcttgcagcctgctgcatgccgtcgccggcagccacacccgcgcgcagcatgcatgcatgatacacagtgcagtgcagtgcagtgcggtgcggtggctggcagtgtgccagccatggatcggatcgcgcgggcgattggtgctcgcctgcggtgcggtggggatcgatggctgcctgcctgcatggccgcatacagagatcgatacagtcgcagtacgtcccttggctagcttctgctggtcgttgttgttcagacgcgacttgaattcgtcctgcctgcgttatccgccaccgctgtacgttgtctgcgtctgctactgtcgccggtgcttttggactcggaaactgaaagcagcagcagcagtcgacaccgatgcgtcgagccgagaacgtacgcgcgcgcggccctagccatcatcagctacaacagctaggtaggctagggtccatctctccagccccgcgcgcgcgcgtacacaccactgtacatagctgtgtatgttgccttgtacgacacagagaggttgcgtctactgctcgctctcgctgctggtcagtagtcagtacgtacctaccaaggcaatcatatatccaccacgcgcacaaaagtgccgccccgccggagccgggactgactctctctctctctcaagtcgtctgatcgatcgatgttccggccgggttttgctgcttccacggagacacctccctgaagatagcagatgcatggacttacgtactctataatgtgcgtggttggaaaccctgaaagctgcatgtgtggaaggaaaccgtgccgcgtgcgtgcaggaacgacgacgacgacgaccacgtactgccccggccggcggcccatgtttaccgaagagaccattagcgtgcgtgcgtgcgtgcattaaaaagatcggtccgtctagctccccgccgaatccttccagatgccacccacccaccccgtccgcggcgtctccgtcgagcgagacatacatacagtctgcagtttggcctgacctaacgagcagtgacgaccaattcacacagcgatgaacgcatgtgctcggtcanggggatcaaatcatgcgtctgtcg

SEQ ID NO: 4124 - DNA, 2466 bp, Zea mays
  misc_feature (824)..(824): n is a, c, g, or t
tttgaccgtttcatagggtttcgccatgagtctaagttagagtcgcccaaagagccatgccaaaggagcttatactgtctagcacttgagtgcgtgcgagtggcatcgggtaacaccgctaggggtgtaaatggtacgaatattaccggtttgtattcgaattcggtccgtctaagagggctgagatcctatccgtatccgaatccggatactcagtatccgattcgtatctaatttttatttgtatcttgtatctatattcttaaagttagatatttaagatgttgatgtctattcaaatattattcaacacaacttgataatatccgtatttgattcaaatctaaagaaaaatatggaaacaaatatgaaacaggtaaagcgatacctcaagtcagactaggctaaactaactgcctgccgaggcccgagcgacccaattaatctcgttgtagcccacatccctaggccctactagctcgagagtcgcagacgcgtgcaggtagggatagtaatgggtacccgaaatccgatatcttatgtgtaaaaaccctatagggcatggatatagcaatttttgatacccataggtattttgttgggtcgtttgttatacccatcgggtatggtgggcgtgggtatgttctctcttccctatacccgctactcgatgggaaatccgctaacatatgacatgttggtccagattaaggttcgtgttctctctcatgcatggacttgtatgatgttgtcatttaatgttgaatggtggtaaccttgagacaaaatgttgggttcgataaatttgtcatgctagcacaaangtaatatattattttagcagctttcaatattgataaggtatggagtttcagaattttctatttggtactcttttgtgatacaaatgattacgtttattgtaatgttagtggatatgtatatacgataagtacccgctattcatagtggatatggatatggcgtattttttctatccatgatggatagtgggtatgagtatatagcattttctctggtaggtatagatatgactttgtgtgtctatcaagtattttacccactgtcatccttatgtgtaggcaccgggtgctgccaaacggcctgcacgaggttatccgttttagattaaagccagttatttgtattgttaccctgcacacatcagcgacaactgaacgtccgggaagggccgctcgaccgctccactacaacagaatcgccgtatcagaataattctcagctactcactgcgcaatttaaactcctaatcgagctattgttgccgcaaaaaccaagaatcccccatccaacatgttcaagcaaacaaattccagccattcactaatgcacaaagcaaagcatttcctgcaccatcaatactcatattattaagcaccgcacaacagcatgagcctcttatttcgagcaaatcagacttgcaaaattgacataaagtatttttgaaaacaaagcgacatgaagtattgtagtagtactcaatataaaggcaatactaaaagcaaacgcctggtaaagcataacactcagatagtcacatgctacttgaatgccgtacaccaaaattgtgctgatcgattagtagtgagtcatgatatggcggttatccctgagaaacttgaggggccaacggagtcaacaaagccacggactgagagctctggcacggaagtatccctctcttgcagtaatccgtgatctatgtagacgacaactactgttatgtcatcgtggaagaagcggcgaattcccttctcaactttcctgaggtcatcatacctcatttccctcttccgtgcagcttgtttcaacgctgcccttaccagcctctttgcaattccctatcagcattaggggcgttagattcaagtctttctaaaaaagagaacacaccatttggcagtaaagtgatggagacatactgatcgtggattgctgtggacaatttcaacggcctgttgatttgtcaagtgctcccaaagaccatcagatgcaaaaataataaatttatcttgtgggttaagcacccttgtatagatagatggctctgctgtgagaataggctggcggagaggctccgaaaggcggaaacgagtgatagatggatcaagagcaaattcccgcctcttcaagtaagcatctccaattgttcttgaaacctattagcatcaatcaggaaacatggtaaaaaaatgcatcgttaagtctggcgagatattctctttttaagaagctaaaatattagctgtaggggctattctgtccctgggtctggatgaaagtgcaattgtgattttacctccaaattcaaccttttgattttaggcaccattttttaaaaaaaaacaagtttaggcctgtcatgttagaggcacttgacggtgtaaaatacaggcgcaaaatcataattacataatagctaaa

SEQ ID NO: 4125 - DNA, 1599 bp, Zea mays
ttttttttttttttttggagcaaatcagacttgcaaaattgacataaagtatttttgaaaacaaagcgacatgaagtattgtagtagtactcaatataaaggcaatactaaaagcaaaagcctggtaaagcataacactcagatagtcaaatgctacttgaatgccgtacaccaaaattgtgctgctcgattagtagtgagtcatgatatggcggttatccctgagaaatttgaggggccaacggagtcaacaaagccacggactgagagctctggcacggaagtatccctctcttgcagtaatccgtgatctatgtaaacaacaactactgtaatgtcatcgtggaagaagcggcgaattcccttctcaactttcctgaggtcatcatacctcatttccctcttccgtgcagcttgtttcaacgctgcccttaccagcctctttgcaattcctgatcgtggattgctgtggacaatttcaacggcctgttgatttgtcaagtgctcccaaagaccatcagatgcaaaaataataaatttatcttgtgggttaagcacccttgtatagatagatggctctgctgtgagaacaggctggcggagaggctccgaaaggcggaaacgagtgatagatggatcaagagcaaattcccgcctcttcaagtaagcatctccaattgttcttgaaacctgaattatgcccttgatgcgccaaacaccatgcttgagaaccacaatttgagaatcatctggatgacgggatataagctcctgcctgacctcctccctacttgcattatgatctcttgtgagtggctcagccacgatcttgtttgatctacctagaacgccaataacagccctggaatcgcctagattagccacatatagtgttcctctccatatgacaccaactagacagcaggatccaaccgcagcaatcaaaggctttataaaacgtgttctccgcacgagtgtcaagaagccttcctccgtagcagaaaacgcactccgaacaacatcctcagatattgttccattttcctgagcaagtcgaatgaggtgtgcgaagaggtggtcagatatgaagcgggcagcctcagcgccgccatgaccgtcgtagacgcctacgaaagttgcggcagagcctgtctccacttggctgtggtcctccaacgcctcgttggcctgcacgacggcaaacgagaactgacccgccgcgtggcgcccgaggtcccgcgaccacagcaggtcgtcggcgacgccgcggccattatcgctgtcgtcctcatccttcctcgtacgcgcgcacctccggaccgggcccaagcacgcggacgcaatcttcgtcaaccacgaccacatccctcatttcccacctgcctcgccgctcctcgaaccccagaaccgcaccagatggggtctcttttagcaccacgaattcgccccctcttcctggcaaatcacaccgaaacgaccgcgtgtgcagtgattggaattcacgtttagaaaacctaggagtttttggtttggagaggtggaaccgtggaacaggcggcggctcagcgtgaatttttcccggccggcctcgagggtccc

SEQ ID NO: 4126 - DNA, 2205 bp, Zea mays
  misc_feature (259)..(259): n is a, c, g, or t
  misc_feature (274)..(274): n is a, c, g, or t
caacaaaaaagttgaaacaaacagggccaaagattactttgtttgctcatagcatttttaactctggttggttggatttcaaggactattgcattatttcagcttcaattttctagtttcaccataaaaaagcttcaacaaatcactgaggtgggtttcagggagtgtttgacttgcacatggactcgagcttctctaacacaattgatttgtgtcagcttacttgattacctttaatgtttagtggttgtcacgaganaaccaaagcggtatnttgtgaaaccgatggcatggtgggtattttttgtgcaactttataaagatgtataaaaacagtgtttgtgaagcatccatttatgagattcataagttttatgaagttgacctttagtttcaatttttcttttaagttagagctcgtaaactagacctgtccggatggaagaagatataacgaatctgaaaattttgaagtgaagccctccaaaacagaccctatcaactgtttgatgaaatttgatcaaactttatcctacccgttagcaactattcattagtttatggaatccaaacaggtgttaagaacttaagatggtaaaattgactttatcatgaagaggatggtgggttgttaacgtttatggacctgcccgtatattggctttaggcttttttcccacagcccataacctacgggtcgaacccatatagtggtttaggccttttggcccacaggtccccgctgttcctatctcctccgcggtgccagtcactcagtcagcctctgcgagcatccaacgccgaccaaccaccaccacaagttcaccgctaccaccactgcacggagtcacggcgatgacgccgcctcaccaccccgtaaacttcgccgtccttctcctcttcctatgcctcccggcagtcccacccgccgccgccgcggccgacccgaccccgaccccatggcccccgcagttccacgcgacgctggtgatggactaccacggcaacatgtccgtggccgacctctggtacgactggccgggcggccgcaacctgcacgtcatccgctaccagctcgccgccgacgcgccatactacgacaacgagtggaacaacggcacctccttcttctacacgccggcgctccgcacctgccgctccgccgccgtcggggtcggcatcctccgcccggactggctccgccccggggccgtctacctcggccgccgcgacgccggcggattcgactgccacgtctgggccaaggccgacttcatcacctactacgaggacgtcaacaccaagcgacccgtcaagtgggtcttctacacaggtaacttgtggattgcattgatttctttcacttatcgaacacaattggcgtgtcggtttgaatgcctcaagagcggatttggacaatgctacctgcgacgttgagctatacatagggcctgatcgagtagctaaagtaaactgactaagggcatgtttggattcaggagttaaagcaaactgactaaaattttagctcctccttatagactaaaagtgactaaaagaatatatttttattattttggttaattttagttcttcatattttgatctttaatctataaagtgaataaactttagtcacttctccctggatccaaaccgaccctaaattttgccgcctccttaggagctaaaactgactaaaataattcaaacttgtaactcattctgtttagatctttagctcttaaagtgactaacttttaatatttttgttaactcctaggaaccaatcagacccataatctctattttcgactaaggtctttttcggttgcatagaaattgaagagggttgagagcatatttcagagcaagagctaaagattgaagtgaatttttctattcacttcaagtggagttgaagggtttaaaatcttttttctattcaattttgaatagaaagagaattttagtcctctcaatcaccttcttgttagcaatccctaggaagggaatggagagaactagaagaagagctcggtaggttggaatatttagagaggaaagtgctccgctaggaaggatacttggagaagaaggaaaatgaagatagagcacaaaggtttctcgatagagttctgggacttctggtatttctttcttgatgtcctttacacatggctcagcatgtatttatatctcctt

SEQ ID NO: 4127 - DNA, 1769 bp, Zea mays
gcactaacttttttcagcttaagtaaaaagaagggaagagataatgaggagtcttatgcggtagggtctaccatatttagttgtgaaaattaactttatgggctaattttcactttggcccagaatgagttgacattccgctatttagcttgtgtttctatgcttctgatgcaaaattttttctttttagggtgaggacctcaggggcctagatgttaaagttcttgaagaactacaaaacttccatgtagaagcactgtcaaggatctgccaagaaaaggtatgccattccacctgggagcgccaaaggccacggcccttgcgcacacgtactgtacatatggacacgtcatgctcccattggtttgaggaaagctggtatcttttgaacgggaaaatattcagtggaatgaaacccctgcaaaacatacttcggagtttttttttaaataaaacaaagcacattcatagtgcatctaatagtgtgcattattacataataatttgaggttcaaacaccatccacaaaaaaaatcatatgaaaagaacaaattataggcgcatatgcactacaagctaaacgaaatctataggaatttgtcttactccctccatttcaaattataagttactttttttgagagttaaatcatcttacgtttaactaaaattatagagaattaaaaagactcatgacatcaccgtaaaaatatgattagattgagaacttaaaagacttatggcatcaccataaaaatatgattagtgaataatctaatgatacttactatataaatttggttaaacttgagatgttttgactattcatttatccaataaagttggaatgacttgtaatttggaagggagagggcagtccataagcacgtggaatttgttgtttgcgaatactttcccttttaacataatgaacatgctttcactccacacgcgctagtatgtgtttcccttgcttaacacacctatgtcgtgctctgcagagaactacaaaacttccatgtagaagcactgtcaaggatctgccaagaaaagatggcaagtcaggcgctatagcaaaaacctttcctgagacgagtagccgctttcatgcaggccagagcttatttctcagatgtcccttcaacttcatgcccatctctctgaagttccactcacaatttcacatagttgctgctactgcaaccgggacaaccttgattagtccgcctttggacactgattcctgcgtttaaccgacagaaaacgaagcaaaatgcggttagatagcaggcgctaatggtcactgagtagttagcatgcagatactcccctcctgtacagctttttattaaagatagtagcagtggtattgtaggagtacccggattgtatttatactggtaatatatgagccggtaaaacccgaaggtggtgtttctgttatacctggaccgtgctctgcccttcaaaaactgtagtaaacccgaacggacgctgatgtagctttggcaaacttgctgttgatgtgatgcatgactgccgtgcacctgccgccgtgcccgacgatggttgactccacccaatcagccaagagcacggcacggcagcgatgtgttggtgttgccacacggatctgcgattattaagctacggattatcatgtggggtgtcactacgatgtcccactagactgcgcggcgcatggcgttttcgtgttccgaatcttcgccattacaagctacccgtaactgtggatcctgaccagggta

SEQ ID NO: 4128 - DNA, 4299 bp, Zea mays
  misc_feature (265)..(265): n is a, c, g, or t
  misc_feature (444)..(444): n is a, c, g, or t
gcgttctagtcttcctggtgatgtgatgttcctggctgcttttgggatctatcctttgtagatattcagtgttatctgttagactgtcggtcttttgttggttggccgtattccttctgctgggtttaatacttttgtgtagctgatattgtggtaggcttatcggcttgtgactgttggtttgtcgtgaatcctgtaagaactatgtttggtttctatttcttaatgaaatagggggtatcccattgtcaaaaaaaacagcggncaagaggacagttcgttcgttgtgtgctcatgcatataagcaaaggaaacgaagcaaagcaaattgcgtgattgtttacgataacaagacatgaggttaccgtgtgcgtgtaagcgtggcacggccggcggcagggctgcggcagccggccaagtggaggagcgcagcgccggtggacntcctcagtcgtcgccaccggtgcaatcgcgaagcgagcgaggtcagcagaagaagaaaaaccccgggtcgcggtcaccacgtccacgccccccaccaatccaatcgccattaccgtcctggttcggttggaagtaagttgcgagctgggtccgccaagtgactgtgccaccactaaactctcgctcagcagggtcgctgagagcgatgggatgggcgagagagagagagagaaaaatctatctccgtggaaatttcgagcgcttgtgctgtcgagcggatgcccgttggcctggcccgctgctgctgccggcttgccgcaagacagttgacagggcgagagcgagagtatatggccgcaggagcgggcgaggagagcatctcgctctcgcagattgtcaggggctgtgccgatgtgcgctcctgcgccaaaagcttgtgcgacgatgtcgatgatgcagcgtgaagaaataaaaatccgagccggcacggaagcctatgtcctatggcaccagccgacagggccaggggagcttcaagagctagatgatgatgttcatttctcctatgcctctgccaggtaagagtcagagagaccatttacacaaagctgcagttggtgtcgcaggcacaaccaaaaccaagggaggagctttcttccaacgagttgttggtgttcccacatcttttacctcacacacagagtgactattaatcataataactagcctgtcattagcttgtatagtttacatctagtcctgacttagcatccaatgctaatttttaaccgccgagattcaaacatgctctaaactggggcgggctgtcaccattccgctctcctaaagtaagtaaccacatcatgtcgttacgggtcacaacatgtgacgtaaccaagggtgcacgcaacatgcgcctgtccaactgcaatgtgccctctccttccttgggcgacattttctaccttctcaattccaacaccagcaccagcaccagccactcctacacctagcttttttttttttttttgaaataaaaactgactttataaatgcttgctaggaattaaagttctgcgctagttgctgggccgcttctgccgccgcagtagaaccctaaccggaaccaaagctaaacctgacctgacctgacctaatcgagactcctaaactctaattaataacccagccgggggattacgacgacgatactagcaagagaaagggagggtagttcaggtacggtacaaggctattacgtccggggaaaaaaaatgtacagccaccgctgcgtggccagcctccatgccgccctccttgcggctccttcgctgacagggtgggcacaagcttagaacgacgccacggccggcgcggcggtggcaaccatgccgccctccttcttgcggcgcatctcgaggaccttgcggtgggagttggagtggatgctgctcacgaacgtggggctgcacgccgggcggtactcggggaggagccggcccgacttgtagcggacgccgcacgcgttgcacagcgtcttggcgccctcggggcccgcacgccactgcggggtcttctgcacgccacagtggctgcagcgccggtcgctgggcccgggctgcgacgcggacgcggccgcggacgggtggggaggggggaggtgcttcggcttccgcccccgcttcttgggcctgtgcttgctgcccttgccaccgtgcttggacttcttcgacggcggccgcggcaggatgtggccgtaactgaaaaggccctcgccgagctccagcccgccgccgaacggggacgagtctagacggaggaacggcgagatggaacctgacgaggagcacgaggaagtggttgtggtcgacgaggacgaggccgagtcgggcaggaacgaggcgcccggccgcgaccaccccgggccccgcgaccgcttgctgcgcttcgccttcaccggtatcatcgcctccgttgacagcgcgcatatggtcggcgtccgctgcgggccggcctgcggcggcgccgacgccaccgcccggtatgcaccgtcgtgcgcgaacggacgccgctgctgcgccagagggggccgcgctgcagacgacgcgaccacagcagcggccggcttcggctgcgcctggggctgcagctcggagagcgagtcgtccatgatacgggagacccactccagctcctcgacgtcgtgcgactgcgggaacgcaagagcagcataaattaatcgcagtttccgaagataaccctgtggatacgacgacgcctttccacacgaatagaagcggtcaagggacggcgcgcctaaacaactcaccggcaggtcaaccatctccggcggcggcggcagcagcggagggaggtcgtacttcacgaccgacgacggctgcgagtccgctttcgacctctccgcggccgcggcggctgccggtggcgcgtcgtcatcctcgcgttcggcgacgtccttgtcaggctcggcgaactcctccaggtcaagcaggtcctcgaccgagaacccgtctttctccacgaacgccccggcggcgtccgcggcggtctcctccggcaggacgctgttgttacacttcagcgcgtccatcctgccatcgtccttcaccggccggccggaaaaacacgcatacacgccgtgtgtcaaaatcacaaatccccaataccagaagcagaaggcaaccagggcggtccgtccgtctctgctttgtgtgtgtgtgtgtttatctctcaggaagaaaaaaaaataaaggaagccaaacaaaaccatccaaagaatctcttcccgtccccctcaatcatctatcggcaacccgggccggcagtctttcttaccagagggctgctacggtggtgcgcgtacgacggcatggcagaggcgcctcgcaggaaggctggggtgcaggaacctccacccggagccggggctgtggtggcggcgtggaggaaaggcgaggaggaggcggcggagacggagggagggatgagcgttgtttggtggagcattggatggctgccggactccgtgggctgctgcctgaaacaagtgacgcgccgtgccgtttcaccctcgccccctccgccttctccgatattcacacccttcgtcgcgcgccgttcctcgccactttggcgcgttcgcccccccttactttattttcacccccacggcgatatataattatattattttttttctattttatttccggcacttcgctaggctctttttgtataggcgcctccacttttgaaaagaaatggagccaagcaaaaagaggggaaaggtaaaacggcgcgtcgtgatgcgcgctggcaccgcggacggcccggatggcgtggcgtgcattagatagagatgagcgagggagactactgggtggtgcggcagggccgaggggcacgtggtgggtccgtggtcggcccggcgccccgctatggttttttgaatgcatgagaggatggctagctggggcctggggttcgaactggacccgcgcagggcaataatccacgcagggcgcatgggcatgggcttcccgatcacgactttgggtctgctgtggatgcagtattgcagtggacggcgcagattcatttattattcattatttatttgtagtaaaaatcgtgttgaaaatcttttggaaggaaaacgggaatttgttttttttgttgtatcgttgcgtgtcgatgctggtggtatctgaatgggggtatgcggtggtatgtggatacggcgttccatgtacaccaaaagcatcatagcgcgtgcattacattgatccttgtccatacggagcgatacagtatcggctaatgctatggacgtag

SEQ ID NO: 4129 - DNA, 1151 bp, Zea mays
  misc_feature (1)..(1): n is a, c, g, or t
  misc_feature (29)..(29): n is a, c, g, or t
  misc_feature (44)..(44): n is a, c, g, or t
  misc_feature (49)..(49): n is a, c, g, or t
  misc_feature (51)..(51): n is a, c, g, or t
  misc_feature (54)..(55): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (68)..(68): n is a, c, g, or t
  misc_feature (74)..(74): n is a, c, g, or t
  misc_feature (77)..(77): n is a, c, g, or t
  misc_feature (94)..(94): n is a, c, g, or t
  misc_feature (100)..(100): n is a, c, g, or t
  misc_feature (166)..(166): n is a, c, g, or t
ntgcggggtcttctgcacgccacagtggntgcagcgccggtcgntgggncnggnntncnacncggacncggccncgnacgggtggggagggggnaggtgnttcggcttccgcccccgcttcttgggcctgtgcttgctacccttgccaccgtgcttggacttcttngacggcggccgcggcaggatgtggccgtaactgaaaaggccctcgccgagctccagcccgccgccgaacggggacgagtctagacggaggaacggcgagatggaacctgacgaggagcacgaggaagtggttgtggtcgacgaggacgaggccgagtcgggcaggaacgaggcgcccggccgcgaccaccccgggccccgcgaccgcttgctgcgcttcgccttcaccggtatcatcgcctccgttgacagcgcgcatatggtcggcgtccgctgcgggccggcctgcggcggcgccgccgccaccgcccggtatgcaccgtcgtgcgcgaacggacgccgctgctgcgccagagggggccgcgctgcagacgacgcgaccacagcagcggccggcttcggctgcgcctggggctgcagctcggagagcgagtcgtccatgatacgggagacccactccagctcctcgacgtcgtgcgacggcaggtcaaccatctccggcggcggcggcagcagcggagggaggtcgtacttcacgaccgacgacggctgcgagtccgctttcgacctctccgcggccgcggcggctgccggtggcgcgtcgtcatcctcgcgttcggcgacgtccttgtcaggctcggcgaactcctccaggtcaagcaggtcctcgaccgagaacccgtctttctccacgaacgccccggcggcgtccgcggtggtctcctccggcaggacgctgttgttacacttcagcgcgtccatcctgccatcgtccagagggctgctacggtggtgcgcgtacgacggcatggcagaggcgcctcgcaggaaggctggggtgcaggaacctccacccggagccggggctgtggtggcggcgtggaggaaaggcgaggaggaggcggcggagacggagggagggatgagcgttgtttggtggagcattggatggctgccggactccgtgggctgctgcctgaaaccaa

SEQ ID NO: 4130 - DNA, 660 bp, Zea mays
gggcggcggcgccacggcccggtacgcaccgtcgtgcgcgaacgcccgccgctgctgcgcaaccgggggccgcccagccaacgacgcaaccacagcggggggaggctgcgcctgcggcggcagctcagagagcgagtcgtccatgatacgggacacccactccaactcctcgacgtcatgcgacggcagttcaaccatctccggcggcggcgacgggaggtcgtacgtcacgaccgacaacggctgcgagtcgtctttcgacctctcctcggccgcggcgggtaccggcggggcgtcatcgtcctcaggctcggcgccgtccttgtcaggctcgccaaactcctcgaggtccagcaagtcctcgaccgagaacccgtctttctcgacgagcgccccggcggcgtcggcgtcctccgcggtctcctccggcggggcgctgttgttgttacacttcagcgcgtccatcctggtatcatccagagggctgctatggtggtgcgcgtatgacggcatggcggaggagcctcgcaggacgggtggggtgcaggaacaacacggggccggggctgtggtggcggcgttggaggcgaggaggaagaggcggagacggaggccgagaatcaggaaggggatgagcgttttgttggtggagccttgaat

SEQ ID NO: 4131 - DNA, 1075 bp, Zea mays
cgagaatcagttgatatgcacgacaactttgaccaaataggtcttgcccagaagcttgagaagcatgaattgctggagatgaggaggattgctgcctacatttacaagaaggctggcacgtggaagcaatccattgctctatcaaagatagataacatgtacacaaggattgtatggagacatgctcacaatctggtgaccgtgaactgtcagaggacttgcttgtgtattttatcgagcagggtaagaaagaatgctttgcttcttgcctcttcatttgctacgacctgatccggccggatgtcgctcttgagcttgcgtggatgaacaacatgttggactttgccttcccatacctgttgcagttcatccgtgaatacactagcaaggtggatgatttagtgaaggacagaattgagtcacagaatgaagaaagagtcaaagagaaggaggagaaagatcttgtggctcagcagaacatgtatgcgcaattgcttcctcttgctttgcctgctccgccaatgcctggcatgggtggccctccacctccgatgggtgggatgggcatgcctccaatgggtggaatgggtatgccgccgatgggccctggtccgatgccagcattcgggatgccagcaatgggaagctactgagatgtttttgcagagagcttagacgatgatttgaatcgtccctgtgtaagcgaaggtggaaacttcattggagttgtagatggttacagtttggaattaatattctttatggtaccagaatttttttggcaagtgaaaccttagccagagtctgagaattgcaacctgttataccgtaggatcggataggatgagggtgattaggttggttgagcgagctgttgaaagctggtatcatttgtatagtgtgatgaaaactttgtagacattttgcttgtataatactcctacttgttggcacagtgaaggacaaacaaatgtatgctgacttgttatgtcctcctgattgcaatttgttagtatgtgttttcttgaagaagacagtaacattcgacagatactcgtgtctgtccatttttatg

SEQ ID NO: 4132 - DNA, 765 bp, Zea mays
cggatggcgcccttgagcttgcatggatgaataacatggtggactttgccttcccgtacctgttgcagttcatccgtgaatacactagcaaggtggatgatttagtgaaggacaaaatcgagtcacagaatgaagaaagagccaaagagaaggaggagaaagatcttgtggctcagcagaacatgtatgcgcaactgcttcctcttgctctgcctgctccgccaatgcccggcatgggtggccctccacctccgatgggcggaatgggcatgcctccgatgggcgggatgggcatgccgccgatgggccctggtccgatgccagcattcgggatgccaccaatgggaagctactgagatgtttttttttggcagagagcttagatgatgatttgatatgttcctgtgtaagcagaggcggaaacctcattggagttgtagatggttacattttggaattaatattctttatggtaccaggaaatttttggcgagtgaaatcttggccagagtcatcggataggacggggatgattaggttggttgagcatgagctggtgaaagctggtaccatttgtatagtgtgatgaaatctttgtagacattttgcttgtgtaataataatacttgttcgcacagcgaaggacaaacaaatgtatgctgacttgtgacgtcctgttcattgcaatttgttagtatgtgttttcttggaagaagccaaaaaaaaaaaaaaaaaaaaaaaacccgagaaaggggcccggtcccc

SEQ ID NO: 4133 - DNA, 773 bp, Zea mays
gccttcccgtccctgttgcagttcattcgtgaatacactagcaaggtggatgatttagtgaaggacaagatcgagtcgcagaaggaagaaagagccaaggagaaggaggagaaagaccttgtggcccagcagaacatgtatgcgcagctgcttcctctcgctttgccggcgccgccaatgcctggcatgggtggccctccacctccgatgggtggaatgggcatgcctcccatgggcatgggcgggatgggtatgccgccaatgggccctggtccgatgccagcattcggaatgggaggctactgagttgtggttttgcagggagcttagatgatgatgtgaattgttccattgcaagcataagtggaacctcattggagctgtagatggttttacagtttgggaaatcaatattctttattgtaccaggaaacttttttttgggcgagtgagtgaaatcagcctgacccatagtttgagaagggcaacctgtgatatgttttacgatggaatcggaaataggatgattaggttgtttcagcatgatctattgaaagctggtaccatgtgtatgtatagtggtgtgataaaatcttttgcgtgtcggcagagtgaagatagacaaatgtatgtttccttgttacgacctgttaatctatatattagcccgacttgtagttcaaatgccctacattattttcttctagctcctccaacttgtagttcaatcggtaatactatatttattaataaattcaatggctatgttctct

SEQ ID NO: 4134 - DNA, 1729 bp, Zea mays
gtcgtcgacctaaggaaaatacacccttataggctgcctttgctgaatacttcccattggcggcgagacgaaaaaaatgagtggcattcacttcaggtctaagctgaaccgaggtgacaatatcccatagagcgaggtattcagatatagccccaaccgtgagagctccttgtatgtctgaaatccaagtctgattacagagcatcccagacagttctcttgttaattcgccttttaatcactggattgagctcccttagtccactgcccaaaatagtgtgcagcattttgtggagctgtaattccagtacagatttcgactaatcaccaaagaaatctagcaaagcaacatttaaagaaaagatgatcaatgctttcattgtagctacaataacaacattttaaactacctatccagttcttttaactagattatcattggcaagtgtaactccttgatggatatactaaagaaacacgttgatcttcggccgtaattccagttacattacatctcaaagtaatgtaacattattaaacctctaacaaattcattaccttcagttacattacatctcaaagtgtgactctgcggcaaaattttcagtgagtcaaatcacagaaaggagaaaacattgcaaagtcaaagtcaacttgtcagcagtcacagcttaagcatgagcaacacctgaaaagcatgagcaaccgattcaccctgcagatgtagaacccctaacagtcttactcatgtgactgcccctcctaacttccaccagaaaaaacaatgcaggaccaagtaaagccaccggattccctagaacatcctaatcgagttccaaattctcactacttaaacccctgaaaacgccataggaaccatcccttgataaaaaacccacaggccacaacaccaagaaactagcatcttctgcagctctgaagaaaactcgatcaccatggacatgccttctcttgttctcctcctgctcgtcttcattacagcaggcagccgcgccgcggggcaggtgttctgccgctcgcagttcaacctggccaacgaggcctgcagcctgcgcaccttctccgggcccaacccggcgcaaccgctgcagctgcacatcaacggctcctcggcgtcctacgagacacaggcggaccaccacgagcacgagcacagccacgagcacgagcacgagcacgagcacagccacgaacacgagcacgagcacagccacgaacacgagcgcgagcgcgagcacacgcacagccggcggcacggtttcgggcacggcggccgcgacccctacgacaccgcctgctgccgccgcctcatgggcatcgacaacgcctgcatctgccaggccatgtccttcctccccgtcttcatgagcaaggtcaagcacgccatcaagctcagccccgtcccgggctgcgacgtctccttcgagtgcggcgccgtcaactgaactgacgccgcggaccttcaccttcttgctgacaaaaacttttcaaaggaaataaactgttgggttgggtacattacatggaaaatcttcagcctttttggactagaattttcttagtgttacgtatatgtagctcctacactacacatattgaagttttggagcttgaattgtattcataagaatgtggattccaatcttggatatttgagagcaatgcctgactgaaacatttcagaactctagcaaaaaaaaaaaaaaaa

SEQ ID NO: 4135 - DNA, 3941 bp, Zea mays
cattgggtacctcgaggccggccggcccgggccgccccccaccacgagattggactgattgaccgcaccgattccgcgatacgttcccgaatccaacccatcttcgtccgctccggccactcgtttcgccgccgtcggtcgccacccgcaaggtttggaggataagattcgggagggatggcttccggtgggcagccgcagttccggtacacgcagccgccgtcgaaggtgctccacctgcggaatctgccgtgggactgcactccagaggagctggtcgagctggggacccccttcggcaaggtcgtcaacaccaagtgcggcgtcggcgccaaccgcaatcaggcattcatcgaattcggcgaccaaaatcaagctattgccatgatatcatattacgcatcgtcaacagagccagcacaggtaagagggaaaaatgtgtaccttcagtactcaaatagacaggagattgtcaacaacaaggcaactggggaaggttcaggcaacgttttgcttgtgggaatggagggtgttgcaccagattctgtcagcattgatgttctacacgtggtaaggatgttaacagttgcatcgagatttatgttatttaggccaactgattttatctgcaggaatactttgatgtgccaggactgtcttagtaacttctagcacattgttttgcatgtccgcacggggttagcaagccgttgtcacggagtatcatggcgggaagcatctggaacacatgtctgtgtttgtttcctctcccttactcatcgctgccctactcctcccctaccctccctcccctgcacctcttctccctacctttcccctcccataccctttcatccaagtaccctcttagggttggtcacatctaccttcgtcgatgtccgttttagttgttattataagttgtatctagttagtgcctaaggttggtggatgcatttttctcaatggaggtcgtttctgattggttacattggtagctggcatatttgtatgattattatcaagtgctcttctctggatttagtaagggaaaagaaagagaaaaggaacataaaatgtaatgcatcaataatagtaaataaatattcttgttttcactaacgccccgtttggatcctcggaattgaattccattctaataatagtaatttaggcaaatatcaattaagctagtatagttttatgcaaaatatatttgtatactattattactttattagcaatatgtgggagatatttatgtgctgcatttttactacagaggagtgagtagaagagtgtcttataagttgcagagtagaaacatattccactgatacaccaaatcattttctatcctccacccccatgaatttgagatagtcttatatctgaactgtggaaagtggcggaatatcaaattccaagccaaatagactactctattaagtaaatttcaattccttcaaaatgaatagatccaaatggcccataaggtaaatataatgaacttgattggcacaaatttgtcatttggttgcactgatttgtgtaacggtttaataccatctttcaagcaggattttagctccttattacagatctgcaagctaccaactcgagttatttgcatctgtatgttgattaaaagaattactttacaatcttctacatgatgattagattataattcttttgcaatcttttatgtgttaattacaagaactatcttgtgtttatcctccatagtgtcatttggttgacgcacctttaatacgctgttaaggcgagcttcaaaattggaacatgtggattatcagttcataaagaaacatctgtctgaacagtttaatgagtttcactcactttccactgtgaatattgtagatttgatcactttgttactggcgcatgaatgaatgcttgttagctgtgctcgtttctgatctctttctctagacaatccttacaaagcctagaaatgcattgattgatttgattctaatactttaataacagcttgatgtcacaattttacccaggagtgatgataaattcatctgcattatctgtactagcaggttgaaaggttttgaacatgtacagttgtgtgctagtctgctagtacccttgattcattgttattggctattgccgacaaaaactttattgtagttgtaagcttttctgtatgtttgtataaatattaattttgtttggcgtagagatcagacaacctttggctgccactttcaatttaagatcatttcactttccagatatattggtgcatgcatttggttttactataatgtttcacatgtggtattaacagttgacgtatgtgtgcacaggtattttctgctttcggatttgttcataagatcgctacctttgagaaagcatctggttatcaggctttgattcagttttctgatgctgaaactgcaacatctgcaaaagctgcactggatggtagatgcattcctagctatttgctaccagaactggatgtggcctgcactttgagaataacctattcagcacacagtgttctcaacgtcaagtatcagagccacaggagtagggacttcactaatccttaccttccttttctggactctgctaaagatggctctggaccggatggaaaaaaacaggaagcagagagcaatatactgcttgcttctattgagaacatgcaatatgttgttacaatagatgtgcttcatgaggtcttttcagcttttggatttgtacagaagattgctatttttgagaagaatggctttcaagcattgatccagtatccagacattcaaactgcgtatgcagcaaaagaagcactagaagggcacagcatctatgaaggtggctactgcaaactgcacctcacattttcacgccatactgagcttaatgttaaggttaacaatgagcgaggtagagattataccaaggggaatgccactccaagcagtgatcaaccttccattcttggtcctcagccaataccaagcgttggtgctgctattccaccagcacagggtagtgttccttctgcagccaccaattcagtaatgccaccaggggatccatcagttgctctaccttctaatccttccagtgagccactcctgcaagcacctgttgtttcctctggagggcctccgcattaccctaatcaggccatcctacaaggcccacttggtgttgttgcacggttcccaggctatggtgccctgcagtttgctcagggctcagctcaagctcaaatggtgcagccttcaggccaaggaagtcaacatatgtcaggtcatgtaaattatcagctacctccaggttcagcccaattcatgcagtatctcagcaacggaagccatccacttccaaacgcacctgggccacagacaatgccttaccctgccctcagtgggcagcagctacctccgggtcttcagatgatgcaagctcaaggttttggaggcctgccgttttcacagggtcctggacaaccaatgccacagttcccaatgtatggcacccagcagtttcctccgggtatggagcccaagatgatgcgcttctctgagcagggaggccagcagtttacatttgcgccgcggggtccaaatagtcgttagcaaatttgaacttagcaacgttagatcgttgatggtgatgaatggatgtcaagccttctatgttgctgttttctaaggtgaataccgatgctgttccattactaggatctatacttggtttatctctcgtactgtggccaaaacaaatgtctaatctgaggtttcgtagccttgtatttgtatcgatttcctcacgcccgcagcttctgcctgcactgtgttacattacggttatactgcagtagtggaagcaaatgtaaaagaaacctagagaccaaaaaagagatataaaaactc

SEQ ID NO: 4136 - DNA, 1406 bp, Zea mays
tagaaacgggaagttgaagtcgtcgtcgtcaggttacgagccgacgaaactgacagactgtagcaataattggtcgctccccgatccatctgggtttcgcctgccagcggcgagatgtccttcttcttccgggccgcatcgcggcagcgcccgttgccgcaggagatcgcgcgctccatcaaggactccctcgttgccctcgacaccaagaccggcgccaaggctcttgaggatgctgagaaaaacatacttacattgaggcatacacttgctggtgatggagaagtggaaccaaatcaagagcaggttttgcagatagcccttgagatttgcaaggagggtgttctttccctctttgttcagaatcttccttcattgggttgggaggctagaaaggatcttgtccactgctggtgtattttgttgagacagaaggttgatgaaagctattgttgcgtccagtatattgaaaatcattttgatcttttggatttccttgttgtttgctataagaacttggaagtcgcgttgaattgtggaaacatgttgcgagaatgcataaaatatcctacacttgcaaaatatatattggagtcaagcagcttcgagttgtttttccagtatgttgaattgtcaaacttcgatattgcatctgatgctctgaacactttcaaggatttgctaaccaaacatgaagatgccgtctctgaatttctgagctcacattatgaacagttttttggactctacacaaaacttttatcttcaactaattatgtgacacgaagacaatcagtgaagtttctttcagagtttctgttggaggccccaaatgctcaaataatgaagcgttacattttggaagttcattacttaaacattatgatgggcctgctaaaggattcaagcaaaaatatcaggatatgtgccttccacatttttaaggtatttgttgccaatccaaacaagcctcgtgagattattcaggttttggttgagaatcacagagaagtgttgaagctactccacaatctccccacaagcaaaggtgaagatgaacagcttgatgaggagagagatttaattatcaaagaaatcgagaagcttgtgcggttgtcagtataaaccctcaggaaattcgaacgtatccttgaagacatactgtgcaatatgctgccttgtatagagcttgtttttcatgtatggaaaaaaaagtttggccacaaattgcattcttcgcgagaacacttagcatttctgtcagaaaattattgtcgtgtagcagaatttgcaacaggaataatctgcattatggtgtggtgttgataccattaaggattggtgaaagtgcctgccatttgaaatgggtacgcttgtcatgtttgttttgatgtctaaaaaaaaaa

SEQ ID NO: 4137 - DNA, 2837 bp, Zea mays
tgggattctcattcaaaattgaatgtccaattgaatagaattaagctagccaaataacaaaataaatagatgtagaattatgcacctcatgaaggagttcttgcatttgtacctttgtactcgaaattttgagacaggtttaagttggaaaagtagaatttgtagcacccaaaatcctattttggaaactaaaaaaagttctccagagatttccttttgaattaaacatcatacttaccttattcttgaagttaacctctcttaaaacaaatatagttctaataaaagatttaataaaagtacccctatatgaatttagttatccctgtgctgaaatagacatttataattattctcaaaaggattttataaactagagattttaattcttaaaatacatattctctattttagcgtgtatgaatttcatatttaaaatcatttgtttaaatagtataataaataaaataaactaaaaaaatcatattcatgtgggagtacttttatttgtgcatttatttttgaagatgaaactcagacctaaattcaaagtacaatttgaatttgaaataaaaaggaagaacacataaatagaaaagaataaaacacataaatagtaatcgctttagaatgtcaatgaattcatacaatatttgataaataatatttaatgaatgtgctttatatatgtgtctatattcattatcatccattttaatatggatataaaaataaacaaataaaccaaataatattgtagaacggagggagtactacaagggagtactacacacggtaagtactgaaatctggtgaaatttctcgttctcggtgctaagcgagacaaaaaataggtccgatttttggtgtattctgattttgaatttaaaaatataatagtcaaattttggtcaacaaaacggtttttagaaaatataaaacgaaattgtaatcctgctacacaacaggaagtttacgcgaccaccggttagaaacgggaagttgaagtcgtcgtcgtcaggttacgagccgacgaaactgacagactgtagcaataattggtcgctccccgatccatctgggtttcgcctgccagcggcgagatgtccttcttcttccgggccgcatcgcggcagcgcccgttgccgcaggagatcgcgcgctccctcaaggactccctcgttgccctcgacaccaagaccggcgccaaggtatatgcgcggctctccagcatgtcgctcccgcattctcatccgctccgtggcccgcccgatccgcgcgtgcagggtccccgctagcgtcttgtccaccccaaccgggtcgccttgggtgttgtcaacgattttgagttgctttgtttgtggacttagtgcggagtaccctggatccgtcgcgttatttttgtagactccctgatcttggtgacagactgacagtagtactccagttctctggtagttgacgaatgttgcttcgcaaccaaccagaagtagagattctgctggtattggcggggcattgcctgatagtttgttaactgtcagggtggttttcggtggttcgtctgtctctttagaatgtcgctcaattttgtctctttagcattattgtttcagaaaagtactgacttgtgggttgtaatggggtccgtggggttgcaattctcactggattgcacattttccccctccatgctggtggcggtaaaggcatgctgaggtgaattaaatcgaaaaacggtaacttaacctgacagtttgtttctaccttgtgtgaaggaagtttggtctataggtatacaaaggtactttttttgcgatagctatacaaacatacattgattaagcagatttcactcatttgttagatgtagctatcaagttattaatcatgacacccatggtttttaaagcggtatggcgagacaaggcgttgaactgcagtctggatgcctaggcgttggaccatcgcctggacgcctaggcgacgcccttaaaacagtgatgacatcaagaggacactttttcttacttgttcatcaaatgtataacagtataagttagcagttgggatctgtttgcacatagcattgagctttgacatacaataactacaagagccagatcacttctgaatctgcacttctgtcatttactcattttcttctttttaacacttcgcatagaaatagagatgtatgctgagcctgctttaagctagaacctgtttacttatttaatttactgttttagttgtcctctgattgatgtgttgtgcccgtatagaattcttgtgcacactgaacaccatggtacaaaaggcatgttgctcatgaatttgtgtgtgagctgttaggctcttgaggatgctgagaaaaacatacttacattgaggcatacgcttgctggtgatggagaagtggaaccaaatcaagagcaggttttgcagatagcccttgagatttgcaaggagggtgttctttccctctttgttcagaatcttccttcattgggttgggaggtatgctacattcacgaattgaatgcgataacctttttttcactcagttattagcctttttggttctatgttgcaggctagaaaggatcttgtccactgctggtgtattttgttgagacagaaggttgatgaaagctattgttgtgtccagtatattgaaaatcattttgatcttttggatttccttgttgtttgctataagaacttggaagtcgcgttgaattgtgggaacatgttgcgagaatgcataaaatatcctacacttgcaaatgctctttcagatatatattggagtcaagcagcttcgagttgttttt

SEQ ID NO: 4138 - DNA, 926 bp, Zea mays
cccacgcgtccgcccacgcgcgggccgacactagactagagtctcaggtctcaagtctcaactcttgagcaggggaaacgagagatccttggagtcagcaatggagtctaccgcgctaatgaccgcgagactaccactgctgacctctggctcccgttccaaacccctcccctttgcttccttcaccacggcggcttgccgtctcgcctccgccccctgctccggcagcggcagcgtcgtcctgctgtcgcgccggagccgcgattatgctggcgttggttccttggtctccgccgcggcggctcctggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcgtgtggacaacagatgaggccaaggggacacaaggttggcagaagcagtatggagagaagcttgctaaacaccttggcacttgcggatttgagtctcgcctacaagagtaaggtgaagccgaaccgatattgaagttcagatgttcaccttaatgatcaatttgtaccagcatatatgttaaatattttgtctctgtggattgcagttaggagtagtctcggtgctagtctggtggcataatactacatacctacctttcacatgatctttagctaggttgtttcgaataggatgatgtttgtcctaaaattgtaggagtaggccactgttgcgagtgaggagtttgcggctgggctattgttaaatccggtcttcccgttgcttcgaagatataaagtgatactacctctataactcaaaataaatcgattttttaaaaaaaaaaaaaaacccaaaaaaaaaaaaaaa

SEQ ID NO: 4139 - DNA, 969 bp, Zea mays
ccggccgggaagcccttcttccctccagagaggcagagagagactcgagtactagactagagtctcaactcttgagcagggaaaacgagagatccttggagtcagcaatggagtctaccgcgctaatgaccgcgagactaccactgctgacctctggctcccgttccaaacccctcccctttgcttccttcaccagggcggcttgccgtctcgcctccgcccccttctccggcagcggcagcgtcgtcctgctgtcgcgccggagccgcgactatgctggcgttggttccttggtctccgccgcggcggatcctggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcgtgtggacaacagatgaggccaaggggacacaaggttggcagaagcagtatggagagaagcttgctaagcaccttggcacttgcggatttgagtctcgcctacaagatgatcaacgaacgatcacgtgaagttacatgctagaagccaaagagtaaggtgaagccgaaccgatattgaagttcagatcagatgtcaccttaatggtcaatttataccaggatatatgttaaatattttgtctctatggattgcagttgtaggattagtctcggtgcttgtctggtggcataatactacatacctacctttcacatgatctttagctagattgtttcgaataggatgatgtcctaaaattgtaggtgtaggccactgttgcgaggaaggagtttgcggctgggctattgttaaatccggtcttcccgttgcttcgaagatataaagtgatactacctctataactcaaaataaatcgattttttaaaaaaaaaaaaaaaaaaaaaa

SEQ ID NO: 4140 - DNA, 2294 bp, Zea mays
  misc_feature (18)..(18): n is a, c, g, or t
acgacaagctgaagccgncggccaagagggatcgggaaagaaagacgcggcggtggccacgacagcccagtcagccaatcatgccgccggcggcccggcgtcggagccaccgccggtggacggctacgatgccctgcaggcgacggccgtggcgcggtgccgcagcctgttcagcctcggcatatcgctggcggtgggcgcggtggcgtggtcggccgacgcgccgtgcctgccgctgctggcggggctgttcgccgtcgtggccgtgtccatgcgcagcgtgtcgcggctgcgccggcgggccggggacgacggcgccgtcgcgctgctcggcctcaactggttcctcctcggcctgctcacctcgcccatgctgccggccgccctcggccccgcgctcacgtggctcgccgcaaccgcgcccctgtgacgtcccggccccggcccgctatttccgtttccgttcgatacacgtgtctgttgtaacttcttcacacgtactgtgctactgctgcctgcagtgtactactactgcatctctctttttcaagattccactggacattagcagcggttgaaccgcacccggccgccggttcaactgaactggcccctttttctcagccccgtgggacggattataaaccttgctctccctcactctcattctatgaacctccagctttctctctctccttccctcctctccagttccacagaaggctccgtgcctagatcccgtggagaatgtgttggggatcaaggagtggttgattggatccatcccctcacgtgcttccctcatcaagtttcaaatccccatctgcgcgaggaactcctctctcaaggtatctttcctcgatctacctttctagcgagtttgggttgaatccctttggagtaaataaacgaaaggttcatactgccttattctctaatggattcattatttggtttgaatttgataatttgggggaggggaaatcgctcgtaactgtgcaaacacttgttgctcgacccccctcaatcaatcgagccgtggtgtttgttgtctctctctctttaagatggttgcacggaggaatccatccattattgaagaaggtagtggatctgaagaaatccaggtggagcgtcctcgccgctcccagaccggtcatggtagaggccaagctcggggagatgttggtgggagtagttctcaacaacctgaaatcgtccatgccgctcgaggtgagagacttccttctcgccggccgagggcaacatcctggtcgtgttgcaaatcctaatgctgataacctaataataacgagtgatgcctcgatcttctttatcagaagaacctgtccctcagccacctctccatccatcttcatcacgggctgctgcagctgccgcctctcgccccatgagccgtggtaagagaagcaagaagagaggtgttcgtgcgctcatcaggggtttaaatggaatctatgctatctgtcgtgagagttatgttcaaatcgccgagctaaaaaggaaaaatgtcgagtacaatgagaactttaggagatttatgttagagtcggacaactttaggcgttatgttggtcgtgtacctctgcgtcctgctccaccatacaatcctccgccgcctatgcccgacactctggatcagtgggttcagcagacatatggtgttcctttcgacgaagatatctctgatgatgaggaagaaatctctgatgatgaagatgagtccttctggtgaacatggtcattatggtggcttcttcttcttcttggttcttgttgctaaaagggagagaagttcgtgacatttgatctagtcttttgttgctggcagttgtgagagtgagaacctaaactatgtgggatgtaataactttatgattatgttgtctcaaaacacctggcctgtaatagataattaggtgaacttgttcttattatgctactactcgtttcattatgccgtgaatcctctttatgctaagctttatgtatattgttactgtatcatttgggatatactattcttccgcggtattttacatgacactttgttgcatccctcgatacatgtgtattgtgtgacctttttacttaacttaccgtaggaattcctacagcatttttatttcagagaaggatttaccagggttaattttacaatgcttgtaaccacgttctaatgtcttgtgctagctgatctctcgttctatatgtgataaggagcaactcctttttttgacataactttccataactgtgttgttggagggata

SEQ ID NO: 4141 - DNA, 1295 bp, Zea mays
cattgggtaccccggggccggccgggattctatgaacctccacctctctctctctctctctccttcccagttccctccgtcctctccagttccacagaaggctccgtgcctagatcgtcccgtggagaatgtgttggggatcaaggagtggttgattggatccatcccctcgcgtgcttccctcatcaagtttcaaatccccatctgcgcgaggaactcctctctcaaggggaaatcgctcgtaactgtgcaaacacttgttcctcgatcccccctcaatcaatcgagccgtggtgtttgttgtctctctctctctttaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctcaaatcgtccatgccgctcgagaagaacctgtccctcagccacctctccatccatcttcatcacgggctgctgcagctgccgcctctcgccccatgagccgtggtaagagaagcaagaagagaggtgttcgtgcgctcatcaggggtttaaatggaatctatgctatctgtcgtgagagttatgttcaaatcgccgagctaaaaaggaaaaatgacgagtacaatgagaactttaggagatttatgttagagtcggacaactttaggcgttatgttggtcgtgtacctctgcgtcctgctccaccatacaatcctccgccgcctatgcccgacactctggatcagtgggttcagcagacatatggtgttcctttcgacgaagatatctctgatgatgaggaagaaatctctgatgatgaagatgagtccttctggtgaacatggtcattatggtggcttcttcttcttcttggttcttgttgctaaaagggagagaagttcgtgacatttgatctagtcttttgttgctggcagttgtgagagtgagaacctaaactatgtgggatgtaataactttatgattatgttgtctcaaaacacctggcctgtaatagataattaggtgaacttgttcttattatgctactactcgtttcattaaaaaaaaaaaaaaaaagcggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaacgaaataagcatttttttttt

SEQ ID NO: 4142 - DNA, 1061 bp, Zea mays
actgcatctctctttttcaagattccactggacattagcagcggttgaaccgcacccggccgccggttcaactgaactggcccctttttctcagccccgtgggacggattataaaccttgctctccctcactctcattctatgaacctccagctttctctctctccttccctcctctccagttccacagaaggctccgtgcctagatcccgtggagaatgtgttggggatcaaggagtggttgattggatccatcccctcacgtgcttccctcatcaagtttcaaatccccatctgcgcgaggaactcctctctcaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctgaaatcgtccatgccgctcgagaagaacctgtccctcagccacctctccatccatcttcatcacgggctgctgcagctgccgcctctcgccccatgagccgtggtaagagaagcaagaagagaggtgttcgtgcgctcatcaggggtttaaatggaatctatgctatctgtcgtgagagttatgttcaaatcgccgagctaaaaaggaaaaatgtcgagtacaatgagaactttaggagatttatgttagagtcggacaactttaggcgttatgttggtcgtgtacctctgcgtcctgctccaccatacaatcctccgccgcctatgcccgacactctggatcagtgggttcagcagacatatggtgttcctttcgacgaagatatctctgatgatgaggaagaaatctctgatgatgaagatgagtccttctggtgacatggtcattatgggggcttcttcttcttcttggttcctggtgctaaaagggagagaaggccgggacgtttgatctagtctttgtgctgccgtttgagaggagaactaactatgtggatggatacttatgattatgtgctcaaacattgcctttc

SEQ ID NO: 4143 - DNA, 815 bp, Zea mays
tcgacattgggcacctcgaggccggccgggattctatgaacctccacctctctctctctctctccttcccagttccctccgtcctctccagttccacagaaggctccgtgcctagatcgtcccgtggagaatgtgttggggatcaaggagtggttgattggatccatcccctcgcgtgcttccctcatcaagtttcaaatccccatctgcgcgaggaactcctctctcaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctcaaatcgtccatgccgctcgagaagaacctgtccctcagccacctctccatccatcttcatcacgggctgctgcagctgccgcctctcgccccatgagccgtggtaagagaagcaagaagagaggtgttcgtgcgctcatcaggggtttaaatggaatctatgctatctgtcgtgagagttatgttcaaatcgccgagctaaaaaggaaaaatgacgagtacaatgagaactttaggagatttatgttagagtcggacaactttaggcgttatgttggtcgtgtacctctgcgtcctgctccaccatacaatcctccgccgcctatgcccgacactctggatcagtgggttcagcagacatatggtgttcctttcgacgaagatatctctgatgatgaggaagaaatctctgatgatgaagatgagtccttctg

SEQ ID NO: 4144 - DNA, 2055 bp, Zea mays
acacaagactttagtccttgttcgtttgcgtcggattgcacccggaatcgttctagctaatcaaagtttatataaattagagaagcaatccggttaggaatcgttccgacccatcaattcgacacaaacgacaaggccttagctggaacgatttcgagtataatccgacacaaaggaagtgaaattccccaatactccatatgcgatgccaacgagaccaaaagtgaaaaattccccactcatgtttgctatatatatacattgcctcccccgtcccccccccccgtagtcccgtctcctccacctttcactttccagttcaagtcaaaccacgttcctcgcggtcgcggaggctcacgccaagctcgctaaccgctcccctcctccctcactccctcgtctctccctctccccccgaatcctcgacacccaaagcccaaaccctagcacgggcagcggagctgcgtcgggcgaatggacctgcagctgcatgtcttctacagggcgctcgggctctcgttcgtcggcggcctcagcaccgccatcggtgcactgtttgtcgttttgaatcctgcccctaaccttaaagtgctcgggcttctacagggttttgctgctggacttatgctcagcatctcctttctagacctggcacacaatgccctgaattctattggcttcttgaaggggaacctctggttttttgcaggggttcttttcttcggtttcattattaagtttatcccagagccagatttttcgccaccagctgatccaagcgagaaagaggctgatgatggtgtatcaggtaaagatatgatgagaaaacatcgccggcaagtgctattcagtggtattatcactgctgttggaattagcttgcataatcttccagagggaatggctgtatttcttggatctgtcaagggtcttcatgtgggcctgaacttggctgttgctattgccttacataacataccagagggggttgctgtagctcttccaatctattttgctaccaaaagcaaaaaaaaggcattttatacggcagcattctctggtttggctgaaccactaggagtggttgctgtagctttgttgtttccaagcagtttgaatcctgacattcttgaaggcctacttggatctgtgggtggtgtcatggctttcctcactttgcatgaaatgctgcctcttgcatttgactattgtggccagaagcaagctgtcaaagctgtctttgtgggcatggcctgcatgtctgcaagcttgtacttcttggaagtcagcttaccaaaggagataagcttgtagcatcgcgctgcaggtactgggaggccatagcctgtcagtagatcctgaattctaggaggaggaacagcacaataaaaccatgaacagtgactactggtgtgccgccattgatattgtccatcttaccgtgaaaggagggagaaactgcatttccccagaatgtattccccagattcctcgtgggaccatatgaaagaattgaaaaatgtactgtagtactctgtcgtccggcaatggaagcttcgaagtcgtcaactaaactatttctagcactctcgtcggttgacaatggaagattctatgtaaaaacccatcagatagatgttaacctttaatctttaatttcttaaaagtacattgaaataagatactttgctttcaaacaccccctatatttagtttgaaccagtacacatctcccttgtctgaattgaaacacgtacaagctgccaaaggtcactcaatctttgggactaggtaaacaagctccccgaagtagatttgcccaaacgtcgggttcagatcgtccaggttggatcatgagttatttggcatgcttgtgctaagtcagcatcaggttggtccgtatctccatttgatgtatcaggtcgagttttttttcgtagggtcatgtatttttagctttgaatcagattttggatagctcatggattattacagattaaaaactatagtctataattacccattgcattagtcgggattttttttagattgatc

SEQ ID NO: 4145 - DNA, 818 bp, Zea mays
  misc_feature (727)..(727): n is a, c, g, or t
  misc_feature (779)..(780): n is a, c, g, or t
  misc_feature (795)..(795): n is a, c, g, or t
acacgtttctttatcgtggcttcctcgcggccggccggggaaggcacacagccgccgccgtttcttctcccatcatcttcctcgcagcgccggcgctccctctcccgctcccttccttactcgcgctcggcacacaggcggcggcgctcgggctctcagcgacggcgtcagcggcttaccctcgcgccctcgcctccggtcctccgcacaccggccggtgaccctgcgtgcgtgcctatctctctcatcccgcccccggtggatcgtcaacgccaccggccccgccagctgcgccgcgcgcggcctgatggctgcgggagccagcagccgctgctccaccaaggcgttcgcgccgctttggtagcgcttatgccccaaagcgaagcgttacccgtcctcctagcgcttcagcgcgctgaagcgtgcgcttagtgccgccttttggaaccctggcctcttcgcatttgcagggagaagactcagtttatcccttgccctcccttcccagaccccactcatgtagagcctccggcactgggtctgtcattgcatctgaactgcattggatcctaagagatgatggatgagtcttttcttgataggatggtttcccaacttcggtcaacatgcaagtactacactggatatcccaaggacttagggcgatcaagaattataccattcacatctgagcgtcagtttgtgcagctattacatgaaggcaggnctgtagtcgttgcctttactattaagtgcacatatacacagcatctttgatnnaagtctggaagaggncgcagctaaattttatccacata

SEQ ID NO: 4146 - DNA, 1327 bp, Zea mays
ccggccgggacacatccgccgccgtttcttctcccatcatcttcctcgcagcgccggcgctccctctcccgctcccttccttactcgcgctcggcacacaggcggcggcgctcgggctctcagcgacggcgtcagcggcttaccctcgcgccctcgcctccggtcctccgcacaccggccggtgaccctgcgacaacattgcatctgaactgcattggatcctaagagatgatggatgagtcttttcttgataggatggtttcccaacttcggtcaacatgcaagtactacactggatatcccaaggacttagggcgatcaagaattataccattcacatctgagcgtcagtttgtgcagctattacatgaaggcaggcctgtagtcgttgcctttactattaagtgcacatatacacagcatcttgataaagttctggaagaggccgcagctaaattttatccacatatcaagtttgtccgagttgagtgcccgaagtaccctgggttttgcctcacaaggcaaaggaacgaatatccatttgttgaagtattctacaacccagaacaggctgcaagcccaggaaagagcgtggatcctaacatcaccaagtattctgtaaaagtgctaccgttcaactatgaccaaagcgtgtatggatttcgagaatatttcaagaagcatggtttcaagtattctgaaacaaactagatctgttgttaaagatctgcctcgagagtagtcctagggacttgagtagcatgtggaggcagttgttgtatggagttgaaatggcgtgaggctctaatgggaggccttgactagttcattcgagaatgcctgtcatgtattcatttgtatacgggctactgctcatgcctagagatttgcttttccgtacctatgaaccattggatttggtaatgttttacctctcaaagcccggagtgagcaatttgcatcattttttcaagcactgtcgaaaaaaaaaaaaaaaatactagcaaatgtgctcatgcgttgcagtggaatgtatgagttatgggtttaagtcccatatatacaaatatatgaagaaaaataatgatagcataaggccttgttccgatagttagaagtaggagggacaaaaaaatggattacatagcgtttggggttaattcatcaaatgttttgcaccaagcatcagcgagtctttcgtcggagatctgagctcatatgagttgaggacaagctaagccgacgcttacctttgagcctgtggtttttcaccagttatttacccttaccctggtgaaaacttgtgcaacgcttccaacttgccctt

SEQ ID NO: 4147 - DNA, 1542 bp, Zea mays
ggaccgacatgttactttaccctaaacctttgcagtttgcactgccaccgcgaaggcacacagccgccgtatcttttacttgcgctcggcacgcaggcgacggctgcggcgctcaggttggggttctcatcgacggcgtcagcggcttcccctcccgcctctcgtcagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgacgacaataacgggcttgaaccaggcagaggtggtcttgttgcttctgactccagtgacagatccaaagacaaacatggagatcaaaagacattgcgtcgccttgctcaaaatcgtgaggctgcaaggaagagccgactaaggaagaaggcatatgttcaacagttggagaatagcaggctaaaacttacccaactagagcaagagctgcaaagagctcgtcagcagggcatttttatatctagttcagttgatcagtcacactccatgagtggaaatggggcattggcctttgatatggagtatgcgaggtggttggaagagcacaatcggcaaattagtgaactaagggctggtgtcagtgctcatgcaagtgatactgatcttcgaagtgttgttgataagatcatgtcacactatgatgagatttttaggctcaaaggcaatgcagccaaggcagatgtttttcacgtcttatctggcatgtggaagacaccggcggagaggtgttttttgtggctaggaggtttccgaccatctgaggttttaaagcttctttcgacacaacttgaacctctcaccgaacagcagctgtcagggataagcaaccttcagcaatcttcacagcaggctgaggatgctctttcacaaggaatggaggcccttcagcaatcattggccgaaaccttggctgggtctctttcgtcttctggatcaacaggaaatgtggcaaactacatgggtcaaatggccatggctatgggaaaacttggaacgcttgagaatttccttcgtcagactctacaacagatgcaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatactatgacccaaatggaaggggatgttcatgtagcttaggctgcttagctttgtagttaagtgttgttgatgtattattaccaactgctgtaaaattctcactctgtatgcccctgatttgcagcgaaccattagaatgcacattgatgatcacctgtcgacttttttgttcactcttaggaacactagcgtaaacataa

SEQ ID NO: 4148 - DNA, 953 bp, Zea mays
cctcgaggccggaaggcacacagccgcccgccgcgtcttttccccatcatcttcctcgcagcgccggcgctccatctcccgctcccttccttactcgcgctcggcacacaggcggcggcgctcgggctcgggctctcagggacggcgtcagcggcttaccctcgcgccctcgcctccggtcctccgcacaccggccggtgaccctgcgacaacattgcatctgaactgcattggatcctaagagatgatggatgagtcttttcttgataggatggtttcccaacttcggtcaacatgcaagtactacactggatatcccaaggacttagggcgatcaagaattataccattcacatctgagcgtcagtttgtgcagctattacatgaaggcaggcctgtagtcgttgcctttactattaagtgcacatatacacagcatcttgataaagttctggaagaggccgcagctaaattttatccacatatcaagtttgtccgagttgagtgcccgaagtaccctgggttttgcctcacaaggcaaaggaacgaatatccatttgttgaagtattttacaacccagaacaggctgcaagcccaggaaagagcgtggatcctaacatcaccaagtattctgtaaaagtgctaccgttcaactatgaccaaagcgtgtatggatttcgagaatatttcaagaagcatggtttcaagtattctgaaacaaactagatctgttgttaaagatctgcctcgagaggagtcatagggacttgagtagcatgtggaggcagttgttgtatggagttgaaatggcgtgaggctctaatggggggtcttgactagttcattcgagaatgcctgtcatgtattcatttgtatacgggctactgctcatgcctagagatttgcttttccatacctatgaaccattggatttggtaatgttttacctctc

SEQ ID NO: 4149 - DNA, 1718 bp, Zea mays
aaaaaacacgccccgcgcagagctgaacacaaacacccgcatcaatccaagccgagcctcccctcggggacagcctacgcgagcgagatccaacccaagtcccgacgccgcgggcgagggcgaccagatccacctcctcagtcgtctcggatggcggcagcatcgacgtcggtacgggtgctccccgacggcggtgctgacgacgaggagcgctggctcgccgagggcatcgccggcgtccagcaaaacgctttctacatgcaccgtgccctcgattccaacaacctcaaggacgcactcaagtactcggcgcagatgctatcagagctgcgcacctcgcgactatcgccgcacaagtactacgagctttacatgagggcgtttgatgagatgaagaagctggagatgttcttcagggaggagactcgccgaggcagctgctctgtggttgatctgtacgagcttgtgcagcatgctgggaatgtcttaccgagactctatctcctgtgcacggtggggtctgtgtacatcaaatcgaaagaggctcctgctaaagatgttcttaaagatctcgttgaaatgtgccgaggcattcaacatcctcttcgtggcctttttttgagaagttacctttctcaaataagcagagacaaattgcctgatattggttctgagtacgaaggcgatgtggaaaatattaacgatgcggttgaatttgttcttcagaatttcatagaaatgaacaaactctgggtccggatgcagcatcaggggcctgcccgagaaaaggaaaagcgtgggaaggaaagaaatgaactgcgtgatctggtaggcaaaaaccttcatgttctaagccagattgacggcgttgaccttgatatgtacaaagaaactgttcttccaaggatattagagcaggtggttaattgtaaggatgaccttgcacaattctacctgatggactgcataatccaagtctttccagacgaataccatttacaaacattggaaacgttattgagcgcatttccccagcttcagccaagtgttgatataaaaacagtactctctcacgttgctgtcggattgtctaactatgctgcctcaagtcctgaactgttgccagagttcttgcaagttgaagcttttgctaagttcagtaatgctattggaaaggtgatagaagcccaacctgacatgccagttgttggagccataactctatatgtatcacttctgacctttactctccgtgtacatcctgatcggcttgattatgttgaccaagtgctgggtgcatgtgtcaagaaactttcaggcaaggcaaaacttgaagatagcagggcaacaaagcaaattgttgcacttcttagtgctcccctggaaaaatatagcaatattgttacttcattagaactttcaaactatcctcgggttatggattatcttgataatgctacaaccaaagtgatggctgtggtaataattcaaagcataatgaaaaacacaacctgcatatctacttctgacaagattgaggcactattcgatttaattaaggggctgataaaggatatggatggagctcaagatgatgagcttgatgaagaagactttaaggaggaacaaaactctgtagcgcgtctcattcacatgctgcacaatgatgatcctgaagagatgctgaagatcttatgtactgtacagaagcatatact

SEQ ID NO: 4150 - DNA, 3058 bp, Zea mays
ttggccggcaaaaaccccacatcgatccaacccaagccacgcctcggcgacaggccgacagcccacgcacgagaccattacctagaacatcctaatcgaaaagatcagatccacctcagccgtctcggatggcgtcagcatcgacggcggtgcggatgctccccgacggcggcgctgacgacgaggagcggtggctcgccgagggcatcgccggcgtccagcaaaacgccttctacatgcaccgcgccctcgattccaacaacctcaaggacgcactcaagtactcggcgcagatgctctccgaactgcgcacctcgcgactatcgccgcacaagtactacgagctgtacatgagggcgtttgatgagatgaagaagctggagatgttcttcagggaggagactcgccggggcagctgctctgtggttgatatgtacgagcttgtgcagcatgctgggaatgtcttaccgagactctatctcctgtgcacggtgggatctgtgtacatcaaatcgaaagaggctcctgctaaagatgttcttaaagatctcgttgaaatgtgccgaggcattcagcatccccttcgtggcctttttctgagaagttatctttctcaaataagcagagacaagttgcctgatattggttccgagtatgaaggggatgctgaaactattaacgacgcagttgaatttgttcttcagaatttcatagaaatgaacaaactctgggttcggatgcaacatctggggcctgcccgagaaaaggaaaagcgtgggaaggaaagaaatgaactgcgtgatctggtaggcaaaaaccttcatgttctaagccagattgagggtgttgaccttgatatgtacaaagaaactgttcttccaaggatattagagcaggtggttaattgtaaggatgaccttgcacagttctacctgatggactgcataatccaagtctttccagatgaataccatttacaaacattggaaacattattgaatgcatttccccagcttcagccaagtgttgatatcaaaacagtactctctcaacttatggacagattgtctaactatgctgcctcaagtcctgaagtgttaccagagttcttgcaagttgaagcttttgctaagttcagtaatgctattggaaaggtgatagaagcccaacctgacatgccagttgttggagccgtaactctatatgtatcgcttctgacttttactctccgtgtacatcctgaccggcttgattatgttgaccaagtgctcggtgcatgtgtcaagaaactttcaggcaaagcaaaacttgaagatagcagggcaacgaagcaaattgttgcacttcttagtgctcccctagaaaaatatagcaatattgttactgcattagaactttcaaactatcctcgggtcatggattatcttgataatgctacaaccaaagtgatggctgtggtaataattcaaagcataatgaaaaacacaacctgcatatctacttctgacaagattgaggcactattcgatttaattaaggggctgataaaggatatggatggggctcaagatgatgaacttgatgaagaagattttaaggaggaacagaactctgtagcacgtctcattcacatgttgcacaatgatgagcctgaagagatgttgaagatcttatgtactgtacagaagcatatacttcagggaggccccaaacgtttaactttcactgtgccttctttagtattctccgctcttaagctggtcaggagattacaaagccaagatggagatgtcactggggaggatgttcctgcaactccaaagaaaatattccagatattgcatcagactatcgacgcactttcttgtgttccttccccagagttagctctgagactatatttgcattgtgcagaggctgccaatgactgtgatttggaaccagttgcttatgagttctttactcaagcgttcatattatatgaagaagaaattgcggattcaaaggctcaaatcactgcaattcacctgataattgggacccttcagcggatgaatatatttggggtggaaaatagagacactctcactcacaagacaacagggtactcagcaaaacttctcaagaagcctgatcaatgccgagcagtttatgcgtgttcacatcttttctgggctgatgaccaagatgggataatggatggtgaaagggttctgctttgtttgaaacgtgccttgagaatcgcaaatgctgctcaacagatggctagtgctacaaggggaagcagtggatccgtaactctatttattgagattttgaacaagtacttgtacttctttgagaaaggaattccgcagatcacaaataccgtgattcaagatttgattgaattgattagaacggagaagcaaagtgataactctgtagctgatccatctacagaggcattcttttctagcactttgcggtacattgaatttcagaagcagaaaggtgggagcataggcgaaaaatatgaacagataaagacgagttcatgagtcagaactagcgcggcgccacgactggtttcgattttgttgagaattgggtcgtttgtttggcatggttcagtgaaatagaaaccataagttttagctcgctccatgtaaaagatgtttatacgagctgttaattctcaaatctcacggtctgagcgggtctgttcgcccattggcaacactttcaggtttagtcaggtggcaataagctgtgtcctttggggagcacaggtctgtacaggattacttgtgttcgtgatcagttctactgctacctgaatttcatcgttgtatatttccgccccttatgcgaagcttatggattttagatctctgtaacattcggagtacatgccttcatttctgagttctgactggacattgatgattgtttcagagtggccagtgcaggacttgaacattttggatgcccgttcgttgacattttaatgttacccattactctgctgtgtggccaaaaaaaaaaaaaaaaaaactcgagactagtctcctcgtgc

SEQ ID NO: 4151 - DNA, 1565 bp, Zea mays
  misc_feature (14)..(15): n is a, c, g, or t
  misc_feature (28)..(28): n is a, c, g, or t
  misc_feature (46)..(46): n is a, c, g, or t
gctgagactatatnnttgcagtgtgcanaggctgccaatgactgtngatgttggaacccccacgcgtccggttctttactcaagcgttcattttatatgaagaagaaatcacggattcaaaggctcagatcactgcaattcacctgataattgggacccttcagcggatgaatatatttggggtggaaaatagagacaccctcactcacaagacaacagggtactcagcaaaacttctcaagaagcctgatcaatgccgagcagtatatgcgtgttcacatcttttttggactgatgaccaagatggtataatggatggtgaaagggttctcctttgtttgaagcgtgccttgagaatcgcaaatgctgctcaacagatggctagtgctacaagggggagcagtggatctgtaaccctatttattgaaattttgaacaagtacttgtacttctttgagaaaggaattccacaaatcacaaacactgtgattcaagatttgattgaattgattagaacggagaagcaaagtgataactctgtagctgatccatctacagaggcattcttttctagcactttgcggtacattgaatttcagaagcagaaaggtggaaccataggcgaaaaatatgaacaaataaagacaagttcatgactcggaacaaacacgtcacgatgactggttttgattttgttaagagaattcgatcatttgtttgacatggttcagtgaaatagaaaccgtcagttttagtagcatccaactaaaggatgtttacatgagctgttattctcaaatctcacggtctgagcgggtttgctcgcccattggcaacattttcaggtttagtcaggtggcaataagctgtcctttggtgagcacaggtctgtacaggattacttgtgttcgtgattggttctactgctacctgagtttcattgttgtatatttccgcccctcatgcaaagcttatggattttagatttctgtaaaaaaaaaaaaaaaagcctccatttctgagttctggctggacatttgatgattgtttcatagcatttgaacattttgtttaaccactactcggctatgtggcgtgttactcttcactcgttcttgctgagaacaatcacaagcactgaagcacgtgtgcccatttggccatttcaccttttggagtactttgagtcctgcttgaaccagtgatagattaccgatacacttacctagagtaaagccctggtgtttgtagtcttgtacccctgtccacaaaacaatgcaactatctggtcatagaagaatgtaactatggaatttgtgctggtcgaactgactcaaatttataataaataatatcactagcatttatgtttttaaataaacgtattataaaaaatataatttataaccaatctaataatgcttattttagtttataaatgttaatatttttaatacaaatttagttaaatttgaactgtttgactacttaaaaattgagaatcgcatccttcatttatttggacagatagagtaacccaaaaatgtttgaagggaggtgtaaaa

SEQ ID NO: 4152 - DNA, 856 bp, Zea mays
cattgggtacctcgaggccggccgggcagctgcagtgtcaatccctcctctccgccgcctacagctgcggggagctcgccagtcgccacttcgccagtcgccacttcgccagaatgttccatcagtaccaggcagcgggtcgcgcgctgccagtccccgctgatgagcaccccaagatctaccgcatggagcttgcgctaccaacgaggtctgctccaaatccaagctctggtactatctgaggaagctcaagtctcaagaaggtttaagagcaacggtcagattctcgccatagacgagatctttgagtgtaaccctacaacaatcaagagctgtggcatctggctgtgttaccagtgcaggacaggttaccacgacctgcacaaggagtaccgtaataccaccctgaatggtgccatggagcagatgtacaatgagacggcttcctgtcatcgtgtggtcaccctacatacagatcatcaagacggcaacaatcaactttaagctttgcaagagggacaacgccaagcagttccacaattcaaagttcaagtttcctttggtttactgcaacaagtcaggccaccaaataggaagctgaagaccaccttcaaggctttaaggcccaacttgttcgtgttatccaacttgccctgacaccctcccaaatctgtgaggctgtcagtctggtggtttgctagttcagggtaatgcaatctacatgcaacctattgtttctaagttctagttggaggtccatgaaagggttcttagtgtgatggcaaaggcttccgagtagcaccctagtgacccggggtctggtgggttgctagttcagggtaactcaatctacatg

SEQ ID NO: 4153 - DNA, 819 bp, Zea mays
  misc_feature (784)..(784): n is a, c, g, or t
cccacgcggccgggccgcccgcgtcagtgtcaacccctcctctccgccgccaacagctgcggggagctcgccagtcgccacttcgccagaatgttgcatcagtgccaggcagtgggtcgcgcgctgccagtccccgctgatgagcaccccaagatctaccgcatggagcttgcgctaccaacgagatctgctccaaatccaagctctggtactatctgaggaagctcaagtctcaagaaggtttaagagcaacggtcagattctcgccatagacgagatctgagtgtaaccctacaaaaatcaagaactgtggcatctggctgtgttaccagtgcaggacaggttaccacgacctgcacaaggagtaccgtaataccaccctgaatggtgccatggagcagatgtacaatgagacggcttcctgtcggtcaccctacgtacagatcatcaagacggcaacaatcaactttaagctttgcaagagggacaacaccaagcagttccacaattcaaagttcaagtttcctttggtttactgcaacaagtcaggccacaaaataggaagctgaagaccaccttcaaggctttaaggcccaacttgttcgtgttatccaacttaccctgacaccatcccaaatctgtcaggctgtcagtctggtggtttgctagttcagcgtaatgcaatctacatgcaacctattgtttctaaagtctagttggaggtcccacgaaagggttcttagtgtgatggcaaaggcttctgagtagcaccctagtgaccggngtctggtggggtgctagttcagggtaactcaatct

SEQ ID NO: 4154 - DNA, 938 bp, Zea mays
  misc_feature (882)..(882): n is a, c, g, or t
  misc_feature (885)..(885): n is a, c, g, or t
ggcgattgggatcctcgaggccggccgggcagtgtcatcccctcctctccgccgccaacagctgcggggagctcgccagtcgccacttcgccagaatggttgcccacacggtggcttctcctcgctttgttcctcctaccggcgtggctgctgatctcggccgcttttgtgtaatttgtttggatcccgcagttgcatcagtgccaggcagtgggtcgcgcgctgccagtccccgctgatgagcaccccaagatctaccgcatggagcttgcgctaccaacgagatctgctccaaatccaagctctggtactatctgaggaagctcaagtctcaagaaggtttaagagcaacggtcagattctcgccatagacgagatctgagtgtaaccctacaaaaatcaagaactgtggcatctggctgtgttaccagtgcaggacaggttaccacgacctgcacaaggagtaccgtaataccatcctgaatggtgccatggagcagatgtacaatgagacggcttcctgtttgtcaccctacgtacagatcatcaagacggcaacaatcaactttaagctttgcaagagggacaacaccaagcagttccacaattcaaagttcaagtttcctttggtttactgcaacaagtcaggccacaaaataggaagctgaagaccaccttcaaggctttaaggcccaacttgttcgtgttatccaacttaccctgacaccatcccaaatctgtcaggctgtcaagtctggtggtttgctagttcagcgtaatgcaatctacatgcaacctattgtttctaagttctagttggaggtccacgaaagggttcttagtgtgatggcaaaggcttctgagtagaccctagtgaccggnggncctggtgggtttgctagttcagggtaactcaatctactgcaactaatcgttct

SEQ ID NO: 4155 - DNA, 1104 bp, Zea mays
agtcagctgcagtgtcaatccctcctctccgccgcctacagctgcggggagctcgccagtcgccacttcgccagtcgccacttcgccagaatggttgcccacacggtggcttctcctggctttgttcctcctaccggcgtggctgctgatctcggccgtttttgtgtaatttgtttggatcccgcagttccatcagtaccaggcagcgggtcgcgcgctgccagtccccgctgatgagcaccccaagatctaccgcatggagcttgcgctaccaacgaggtctgctccaaatccaagctctggtactatctgaggaagctcaagtctcaagaaggtttaagagcaacggtcagattctcgccatagacgagatctttgagtgtaaccctacaacaatcaagaactgtggcatctggctgtgttaccagtgcaggacaggttaccacgacctgcacaaggagtaccgtaataccaccctgaatggtgccatggagcagatgtacaatgagacggcttcctgtcatcgtgtggtcaccctacatacagatcatcaagacggcaacaatcaactttaagctttgcaagagggacaacaccaagcagttccacaattcaaagttcaagtttcctttggtttactgcaacaagtcaggccaccaaataggaagctgaagaccaccttcaaggctttaaggcccaacttgttcgtgttatccaacttgccctgacaccctcccaaatctgtgaggctgtcagtctggtggtttgctagttcagggtaatgcaatctacatgcaacctattgtttctaagttctagttggaggtccacgaaagggttcttagtgtgatggcaaaggcttccgagtagcaccctagtgacccgggtctggtgggttgctagttcagggtaactcaatctacatgcaacctattgtttctaagttctagttggaggtccacaaaagggctcttagtgtgatggccaaggcttccgagtagcaccctagtgacctgggttatgactcccagtgggagtggatttatgtggactgggtaaaaatatccctttgtctaaccatacgtcaaagcacgatttaaggcc

SEQ ID NO: 4156 - DNA, 1714 bp, Zea mays
actcgtggcccacggacgtgcaggaggggacacgccaccgggtctcacaaaccgcaggttcgggagtactccggaacccgccgccgcatccacacgacgccacgactgacgacggagagccccggtctccttccacggctccaccgccaccaccccgcataaaagtagggaagagagccttgcagcgagaaccgtatcgatctattctcgtctgaagcaattcgcccctgtcgtgagcagaaccctacagctcgtattcgcctcatctcgcagcagcagcagaagaacaagggtatggcgaaggatgggggtcccgactggaacggcctgctcaagtggagcctcgcccacggcgacggcaccaacccgccgcgtgctctcagcgaggaagacagaaaatggttcatggatgctatgcaagccaacacggtagatgttgtgaagaggatgaaggagatcactcaggtgatgaaaactccagaagatgtcttgcagtctcagggcgtgacccctgagaacatcgaagatatgttggatgagctacaggagcatgttgaatccattgacatggcaaatgatctacattctattggtgggctggatcctctacttggttacttgaaaaattcaaatgctggcatccgagcaaaggcagcagaagttgttagtacaattgtgcagaataatcccaagagtcagcaacttgtcatggaatccaatgggctagagccactgttgacgaacttcaaatcagatccaagtacaaatgcacgcacaaaagctttaggagccatatcttctctaattcgtcataaccagcctggagtttccgcatttcgattgggaaatggctatgctggattgaaggatgctcttggttccgatgatgccagactccaaaggaaagctctcaatctcatacaatacttgctgcacaactacaaggcagacaggagtgttgccacagagcttggtcttccgaagctgatgatgcaccttgtgtccagcgatgattccttagtgcgtgaagctgctctaggcggcctccttgagttggcgcgggacaagacatctggtaacgcgctacctgaccaagaaaagctgaaagacatgctcaagagccgaatagaagggatcagcgcaatggacactgacgatctccacgctgctcgcgaggagcggcagctggtggattcactctggaaggagtgctacaacgaaccttcgtctctcagggagaagggcctcgtcgtgcttccgggagaggatgctccccaacagccgccaccagacgttgcagggaagatgtttgagccaccgcttcgtgcgtgggcggctgcaagacctgctcaggaagatgactctgactctggcagcggaaagaaggatccgccattgctgcttaagttttgacggccttcttatgccgatactagttcttaggctccaccatgggtgttgaaagctgaaagatcagatctgatggatgcctgaccttcttcgaacctcagttgtggttcttgtaatttgcaccgcatttctgttctgagtatgtttttatgagaagactgggaagatgacagacagatactgtatcacgtgatgctcgtaaattaacactacctgtgaattctcttgctaaaaaaaaaaaaaaaaaaagggcaaaaaaaaaaaaacaaaataacgacgcggcaaaaaaaaaaaaaaaaaaaaa

SEQ ID NO: 4157 - DNA, 1165 bp, Zea mays
ccggggcgagccattcagaaggcagcaaatctagctatctcctctgcctcctgctggcggtcctgctgcgccatggcgctacagctgcgggccgccgctctctgtccgcccctgccactcaccgccttccatggccgcctcgttgcaccttggcctccgcctcccttggtcagcatagctgtcgccgccgcctccagcccgggcccctccgcgcccctctcctgccgcggcccggcgcctcgctggcgacgttcgagcgtgagggcgcgcaccggggccggcggcggcggcgggcagagggagtccccgtacgaggtgctcggcgtgtcgccgtcggcggcgcccaacgagatcaagcgcgcgtaccggcgcctcgcgctcaagtaccacccggacgtgaacaaggagcccaatgctcaggagaagtttctgcggatcaagcacgcttacaacactctgatgaactcagagtcacgatccaagtacgcgagcagcagttcggattcgtcctggtcctccagctcccgggagaggaaatcagctgctgcagaagagccgttctatggatttgcggacttccttaaagatttgcaagcagaatttcagaactgggaagctgggttgaattcggatcagaaacctaaaagcctttgggaagagttggcagcaattggcgaggaatttgtagagtttctggagaatgagttgaagattgatgactccagaccagaggacgtcactggagatgacccatacacccagtttggacagcaggcaaaaagcgctaaggatgacaagacgtcaacgaacagctttgatgatggtctttctgaaatagaggccgctcttgagaatctgaagaaggaactcggactgggctaaaccgttgatgtggcgactagagctgctgctgctgctactgactttcttgttcatacaaaggtatttcttgtattgtatgtaacgattggtgataacaattagcagttgtgatctatcacattcgtttctgttttgacttttctagatacaagatctggcatatacctagatggctagcaaaagctaagtgccagaaagccaaaacggcctataatttgggatggagaggattatcaatagctcaagagcttctttctaaaaaaaaaaaaaaaagcgtgttcgg

SEQ ID NO: 4158 - DNA, 987 bp, Zea mays
cctcgaagccggccgggagcgcctcctcccgctctccggctcctgtcctgctcgcgctcgtcgcccccctgccgctcggctccccttggcccctccaatgccgccacccatggcactgctgccgctctcctccgcatccgcgtccgccgcgctgccgcccttccgctcctgcccgcccgctgcgatgctgcttcgcctcccctcccccgccccctcccatttcgcccgcccccgcgcggtctccactgggtacgcggcgtccttctacggcggctcggcgatgtccgcggccggcggcgcggacgaggaggaggaggtcggctacgagtcggggttcggcccggggctagggctgggcggcggcggcctcgggatgtcggccgcggaagccgcgctggcgctggaggagcgcgagatgccgccctgcccacccggcctccgccagtacgagaccatggtcgtgctccgccccgacatgtccgaggaggagcgcctcgccttcatccagcgctacgaggagctgctcgtcgccggcggcgccatgtacgtggaggtcttcaaccgcggtgtcatcccgctggcatacagcatcaggaagaggaacagccgcaccgggctgccgtccacctactacgacggcatctacctcctcatcacctacttcaccaagccggagtccatggacgccctgcagcttaagctcaacgccgacgacgacgtcatccgctccaccagcttcaaggtccgccagcggaaggccgtctagttagacgggttgcctcctccgccttcaggccctgaacactgttttgttcacataccatactacaagaaatctgctgtacaagaatccacctttgccatgattgttgagttttttttttttgaatatgtttcttgtcttgtggttctcgaaaatggacgtccggccatcgttcgccagagaaacaccgcgcctcctaaaaaaaaaaaaaaaaaaaaaaaaaa

SEQ ID NO: 4159 - DNA, 2727 bp, Zea mays
ggtggcgtagtgttctttgctctatttagttctccaggtaacatttggagttccagaagcagcagctgttataaagttttcgtcatcaaagatggcaacacaggcagagcgtttgggttatgagtttgcaagattgctcggagtccatacaccacaagtatttccaaacccccaaataatattggacagcttgattatctatggagcaatgatttcttacacagcttttacaacaaatgcaggctagagtagtatataattctagctcagagtggctggcgattaggcatgctgcagaaaatgcacgtacagtagcaatttcaaataatgatgaggttggtgagatgacgtgctcagagttgttagaagctcttgagctaagccgctgccttcttctaatgaggtactgttgcaatgttatcttcttagtacaatcatgctagctataaacattgtctctatgtgatctgatattggagttgaaatttgcggtcccgccggccggccggattcatggctccccactgcttgagagttcaaaggctttccattcacgagaagctgcttgtgttactgcttcatcactgggaagggttttgatgcttgatctgatactgcggaatgaggacagactcccatgccgtcagcttggttggcgtggtaatcctgcaaacctgatgatttcagataaatcatccttacccaatttggacaggttggatgatttcaagagctctacagatagtcccaaccaactaattacacattttttgcatagagagaagcggtcacactctttgaatggaaaatttggttcaccagggttggatcccatgtcaccaaaactagaaccattgataaatgaaaaggaaaatgctgaaagaacaaatggcgattttcgcattgtagcaatcgatactggtgtgccccgccgcccccctgtggggcgacgtgtcaaagatcatgagaggtaccccaaagttgtggaactcattttgaatagttcggactactcagcaagcatcctatatgaaatttctggttgtaagcttggacatccacgacctgatgaggttacttccagtgattcttgttgctccctttctgatgaagataatgctggagtgattcatgaattccgaggatcattccgtgcagctcttagggacctggaggggttccatctatttcttctccagctttaccaaaaactggatggtgttttgcgagttttcttgtccataattactaaaacctctgaagaatctgacaataatgatgctgccctttccgattttccttcacctggagccagctatagtactcctcgccttcctagtaagcatctgaacaatgagcttcatagtgattctgaaatgctgaaatctgcaatgaagtcctcttctgtgggatcccgcggaagctcagattcagtttctcctctgcccagggagagttggaacaacaagtccttcaagggaagtgcagaggctccccgtagtttaagaatgacaatgaaacttcgtgatttttacaaaaccccaaaggttgatcctgaattgctcaaagagattgagcagtggaacgaagcacttaagaatgatgtgatcaaattttgccaagagaacaattttcattctggtttctttgatggaactgaaaacaacatggtagctgatgcctatgaattgaaggtgcgtcttgaacacatcattgaaaggatagccttgatttctgatgctgcaaatacagaacgaccttctcttgttgtcaacaacttgttcataggtggggctctggctgcaaggtctaagtacaccctacagcatttgggcattacccatgtactctgtttgtgttcaaatgagattggtcaatccgattcccaatttcccgatctttttgaatacaagaacttttcaattagcgatgatgatgatgcaaacatcagtgatctttttgaggaagcatcagacttcattgatcatgtggatcatgttgggggcaaggttctagttcattgctttgaagggaaaagtcggagtgccacagtcgtacttgcctatcttatgcttagagagggctttactcttgcaaaagcctggaacttactgaagaaagtacaccgtcgagcgcagccaaacgacggcttcgcaaaggctctcctggcccttgacaagaggctgcatggcaaggtatctatggactggcaacacaagcggccagaaatgaaggtgtgtccaatctgcagcaagaatgttggtctaagtacgagttcactcaagctgcacctgcagaaggcacacaagcgtctatctgcaggcagtgtcgacagcgccatgaccatggagatccaaaaatcgatcgagtcactccagatcagccgaggaggaagcctgagcccgtcccagaagctgaccaaggtgttcagcaatgagctgagcttctgatctgttttcctgtactatagatgaggcaatgtacttggctcacattgtaataacttgtactatcagactgaacttgtgactgtaggtttagttcacacgcctatatgattagcacacgaatgttcaggtgtgaagggtgcaacactaaagaatgttcaggtcttgtatttgttgcctgcagtatgcagttttcttctaaagggatctactctcaatctttgtatagagttactaattttattggtacttttctagtgtaaaaaaaaaaaaaaaaaaa

SEQ ID NO: 4160 - DNA, 974 bp, Zea mays
tgggaccctcgaggccggccggggaccgcgcctcagaattttcagaagagagcagaccgccaccgaagcacacaagcagcgtcgtcagggcgtgaaggcaccaccgaatctcgggagcagcagctatggcgaggttcaacccatacgagaacaacggcggcacgtgcttggccgtcgccggcgccgactactgcgtcgtcgccgccgacacccgcctctccatcggttacagcatcctgtcccgtgaccactctaaaatctctcagctgtcagacaaatgtgttttggcctcatctgggtttcaaggtgatatcaaagctttgcagaaggctctggctgctaaggaattaatctatgaacacaataataacaagaagatgagctgcccagcaatggctcaacttctgtcaaacacactctactacaagagatttttcccatactacgctttcaatgtgttggccggactggacacccaaggtaaaggatgtgtctttacatacgatgctgttggatcttatgagaggacaggctatagtgctcagggaacaggttcagcgttgatgatgcctgttcttgacaaccagttgaaatccccctagtcctctcctactgccagctccggatgcagtgacacccttgtctgaatctgatgcggttgatctggtgaaggacgttttcgcttcagccactgatcgagacatatacactggagatagattagaacttgtggtcattcacagctttgcgcacacaccgagagtgcattgaactgaggaaggattagtgcaatgttcctgtataatggcactctggcactaccgttgttatgcataaggatatttgttctcactgtcaggtttctgtatttgaatttcgtctaaacagaaaggtgcatttgaatttccattctcctgcttctagcaggaaatgattataaagatgtcgtcattcatcatttaaacacaacccag

SEQ ID NO: 4161 - DNA, 1719 bp, Zea mays
cccactcgttcgggtcaggcgcctgaatcgtccacaatgagccacgagatcgactacacgattaaggcccagggtgccgaaacaaactgttgagagtgagaaggccgaggccgacgtgccacgctcggatctcacaactagtcacaagctgcttctccatattccacaatccacacatccggaccgagcgcgaccccacctcccagatctcatctgcgacgacctcctccctcccgatcccgctccgtctccccccaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagaccctcgacgacatcaagatgcacctcaccgccaccgagtacgggccctacctccagaacgaaccttcacccttgcacacaacgacaattgtggagaagtgcactcttaaactagtcgatgagtacaagcacatgctgtgccaggccactgaaccactatctacgtttttgcagtatataacttatggccacatgattgacaatgttgtccttattgtaactgggacactgcatgagagagatgttaacgaacttttggagaaatgccacccattgggcatgtttgacagcattgcatcacttgctgttgctcaaaacatgcgtgagctttatagattggttctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgagatcatgtgtgatctcctttcatttgaagctgacagaagagctgttaacattacaataaatagtattggtactgagttgacaagagatgaccgcaggaagctgtactccaactttggtttattgtatccatatggccacgaagaattggccgtttgtgaagatgttgaccaggttcgtggtgcaatggagaagtacccaccataccagtctatattttccaggatttcatatggagaaagtcagatgttggataaggcattttatgaggaggaagtcaagaggctatgcttgtcctttgagcagcagttccactacgctgttttcttcgcttacatcaggctccgcgagcaggagatcaggaacctgatgtggatctctgaatgtgtcgctcagaaccagaagtcccgggtccatgacagtgtcgtcttcatattctgagaacccccgccactatatatgtatgtacaaaatgcctgctttgatgatggcacaatcgctcgacaattataaatctgggacttattattattcccattccctctgttagacgccggcgtaaaaaatgccagacctggagttgatgtattatttgttttgtagtcaaataaaggtgtgattatctggcacacaaaataaaatcttgtgtattttggaacagaccttcatcgtcaatgcacagtatgctgtcaatgcacaatatgtgtgtgcaaaagcaaaatagatatatcatgcacacatgtagggggagatatctcttaaaaaaaaaa

SEQ ID NO: 4162 - DNA, 1629 bp, Zea mays
ggtacccccggagtccggccggggcacgagaccattacctagaacatcctaatcaaaaaattaaaccatcgaacattctccttggcgaaggctatcatgcaaaattgtccgactttggacttgctaagcttggtcctgtaggcgacaagactcatgtgacaacacgcgttatggggacacatggttattgtgctcctgaatatgccttagctggacagctgacagtgaagtctgacatctatagttttggcgtcgttttccttgagctaattacaggtcgaagaccacaagacactgatcggcctcctgaggaacaagacctagttgcatgggctcgtccattgttcaaagaccaaaagaagtttcgcaagatggctgatccttcgttgtgtggccgcttcccaaagaggggtttattccaggcactagctattgcagcaatgtgtttgcaggagaaggcaaaaagccgacctcccatgagggaagttgccgcagctctctcttatttagcatcacaagcatacgacaggaacaacaacgctgctgctcatcgtaatcgtgccgggccttcaacaccgagagttctggacgaccagattggccaggacacctgcacattggctaatcaacagggagctcagatgtccatgcatgtcgggacagaccacgccatgcctgaagtgaaggaagcttcctgtagtggttcacatcgtggaggacggggcagggttaccccgaatggcgctgatagggagcgtgcacttgcggacgccaacgtgtgggccgaggcttggaggcgccaggagaaggcaagcaagatgcgatagcgaccagagcctgactgcatgagttttgacatgtcactgcaaagatgcttactttgcatacattttgaaagagaactgtgggctacacgaagggttgttagaatagaaagaggaataatgcgcagtggaaatgtagagcttcaccagagtgagcgcttcgaagatttcaccggtgaatctacagtactcagacttgtttcagtgcgtacatggatttagcttactttatacacagacacttcacactccatagatgcatgtaatagctcaataataggcacagtagactacacaatctgtctgtagttcagcggttttggaaaattaataacataggatccgccgttaggttgcatgaaatgctatgatccgttggcgggtcttgcattctctattgggtcaacgtctacatatttgtacatcgttcaaccatttacatgatgaaatatacaattaagacttctaagttggtactgttaaaaataattatgatactgaagacaacaattgatagtacaactttgatagagcttatggggtgtttgatttctagagactaatttttagtctcttttaatccctaaattgccaaacacataaattaaaagaggtattatctttattttagtccctatgtttggtaatttacagaccaaaagagactaaaataaagggactaaaaattagtccctagaaatcaaacaaccccttaattaccggactaaaggtgtctttataatctataccaaaatgttatttaaaacatttggtaactagtcgagctttgtgtctgtcaagatag

SEQ ID NO: 4163 - DNA, 4239 bp, Zea mays
  misc_feature (2854)..(2854): n is a, c, g, or t
gcacccctcgcatttctgacttacgggtccataaacagaagtcacaagaagccccaaacatccaagtggtaggcgcttcgatttctgttcgtgtggacccgtaggtcgaaaatgtgagggtatgcaatagaatgaatttacatccgatatgtagagagttttttttccacggaccaagcacaagctatatgcagagatagaaagggccaacccaagagctagctactctatattgtatatagggattgtcaattagctagctagtaaccgtcaaggcatgcacagagagagagagagagagagaggatcatgtataggcgctgtggtacctagatctagatgttaaggcaaactttgccccaccttctaagcatgcaatgcatatggcccctgatctgagcagagcagcaccatgacaagcttgcaagttctctctctctctccagccctttgcctgtgcccttaacctttgttcttgtagcctcacacacacatgacacctgctgcactagctaccatgcatatctagtactagtaggaaggaggccggactactaataagctagtatacaacacctcacctctttcttgcacatgacattatgcatttatcatctcgtcaagcagcctccttctccttcttcttcttccacctcctcctcatccatcccctctcgctcccactcatcccttactgctgctagtgtgctgctgctatagctccttccccattcccctataaagccctcacttatgtgaccactcatgggctccctctcatctcgatcacccccctccagtagtagtgcctctccgagagacagcagcaactgcatcagcagctagcttctcttgttgctagctagctaggtttacatacagctgcacgacttgggagctcactgcagtgcagtgcgtggtcgctgtacataccaagacaaagctgcgagagggggtctccgggggcggcgctgtccgtgtccgtgggcggcgagccggcatggacaacatcacgcacaactcgagcagcagcagctcatgggatctggacatgagcctcggcagccaccaccacccgctcctcttcgacagccatcacaacccgggcccgccgccgccgccgccattacccttccacctctcctcctcctcccaccaccctccgccgcatcctgcacacccacaccaccaccatcccggcctggatccttcgccgtcttcctccctcttcccacaaccgcaccaccaccaccggctccaccacctcggcctcgacatcgaccccgcctcccattcccaccggcaccacgagtacggcgagcagcaggagcccggcggcggcgccggcgggcacgagcacgggcatcaggaggaggcgaggcagcagcagcagcaccacgaggcgggcggcgggcaggaggaccgcggcgccgaggacgtggaggaggagctcggcgccatgaaggagatgatgtaccgaatcgccgccatgcagccggtggacatcgacccggccaccatcaagaagccccggcgccgcaacgtgcgcatcagcgaggaccctcagagcgtggcggcgcggcaccggcgcgagcggatcagcgagcgcatccgcatcctgcagcgcctcgtccccggcggcaccaagatggacaccgccctccatgctcgacgaggccatccgctacatcaagttcctcaagcgccaggtgcagcagctccagcccccgccgccgcagccgcagcaccagcagtacccggcggcagccggagccgggcccagcacctcggtcgtgggctcggcggcgccagggcgacccggcggcgtgccgccgtttttgccgctgggtccagggccgccttattgactgggccgggctcgtcaggcccgtcgacatccacgggccgacgtcgtcttcgtcctcgtcgtccatgggcggcgcccatgccgccctaggcttcggcttcagcagcgccggcggtggccagagcagccatggaatgcactgatgagcgagcgaccaaggaggggggattaattgaaggtgcttcctttgcttaatttgtagcggatcggattaactaggaaccattaatctatccatgatagatggtggtggatcgatggatggatggatggagatgacgaactagagatcatatcagaggtaattttgattttatcaatcataatataatcattctagctactagctatatacagctagctagccagcactttgtcatcgagggtagtaatctatgtgttatcgatcgatcagttctctctctggtacggtacggtgttaatcctgtcaattcaaaagtaaactaatcattaagtttattagctagggtttgtgccaatttaccgtcccttcttcttcttcgtctcttcatgagatcatcaggccaggtttatttcttgttgtactgcatgcatgctgttcttttttctccccccactccctgattaattataatatacagcatatggcatatccctgaatgttcatcatgcatgtatataacatctttgggaagtttcaaccaacaatatccaaggaaggaataatggacaaacccatgcataatttcaattaaatcttagggacggcgacagtatatatagtactagatgctacacaaatataaaattgcccatgcatgcatgatgtattgttgtgtccttgtactagctagcattgctctggcaaggaaataagcaatgcattccatccatccaagcagcatgcagccacagctaggccgtgcttgttgactacctgctgcatgcttcagctgcacccatagatactccaatgttatagatggatggatcagagactcatgnatgcatggatacatctattggttattcttgttagcactttgtcacactactgactacctttgcattattgtttcagttcactcatttcattaactaattcaagagagcaattttccataaggccattctcagtggggtttcatgagagtttcattcttaataaatagcatgccacataagtaaataggatgacatgtcttgcaatttaatgaagagagatatcagagagttttatgggagaccagaaagttttcatgaggatgaaactctgtatacactatttcctagataattgtttacatggcagggcttaaaaacagtgtcatgaaaacctctattgagaatggcctaaaaatgcaattctaggtctgatcatcaaggtcaaatagtctaagttcaactaagtttatataaaatattagctgcatgcataactttgaaaaggtatatatacgataaaaatatattttgcaaataaaataatgatacttatttagaataataaatattaattattttattttcatataaacttgattaaactgaaaatcctttgacttagggcatgtttggaagtataaggtttttaagaaactagtttatgaaaactgagttagttccaaacatacaagtttatgttccggtttatagaaactagatttccggttaaaaactaagaagctagcaatccctagctaaaactaattttatgaaaaccagttttttccataaagtagttttagaaactggattattaaaaactagcttgatttaataactcgattttagaattgtttttttaatgatgcgggtatacatattcatatatgtttctttaaatatatagtatactagcttgagcgtagtagatatgcataggagcggaggggggaggtggaggttgaattattggtgcaaggtattcagtgccatgatcagtcatgagtggtgaggtgctgaattctatgcatcaagagagagaaggagagaaaaaaaatattgaagattttggttggagagagttcccagataggatcggaccaaaccaaccatcgaaaagctgtgcgtgacgacctctatctacaaacaccgatcgtctgccataggtacctatggctatggcatgcatgatgcctactgtatcacgcttacctcaccaccaccctacctctctagcaaagtccgcagcgtgctgctcttaggctatccgcactcatgaaaccctaaatttctactctaagaggaatatttcatcctggtcagcgagattctctactctattcaacaattctccgcggtcacaattactctatatatctaccctataccccacactattctatcccctcccagcccccaccgcgccagccactgtgcccgggccc

SEQ ID NO: 4164 - DNA, 1471 bp, Zea mays
gcgcgccgccggcccggaccacctgttctagttctagtgatcagaggggagggaaggggaggtgaacggagggagcggaggaagatctcgggctctcagagctgcatcctgaacccatcgcgtaggaaggggcaaaggagtcggagctgatccggcagtcgctctctctcggattgagtacgatttgacgcatttgcggccgagctttcttgcacccaagatgagtgggcatggtgacactgcgacctcagctaagatggcgaaactgaaggagttgttgcaaaagagtgaaaaccacatttgtgctgactgtggtgcatctgatcccaaatgggcatcagctaatattggggtattcatttgcgtaaaatgttctggcgtccatagaagtctcggtacacatatttcaaaggttctgtcagtgacactggacaagtggtctgacagtgaagttgactccatgatagaagttggtgggaattctcaggcaaacgcaatatatgaggcttttataccagagggctaccagaagccacattcagattctacccaggaagagcgagaaaaattcatcaggtctaaatatgagctgcaggaatttctgaagccaagcttgcgcattgtttctcatcagcctagtgactctggaaaacatgccggaaatgcttctcattctgatggttccaagagtcaagtcggcatgatcgagttcattggaatattgaatgtcaaggtgattggaggcaccaacctagccatcagggatatgtcaagcagtgacccttatgtcgtcctgacacttgggcaacagaaagcacaaacttcagtaatcaatggcaacctgaatcctgtctggaatgaagaactgaagctctctgttccccagcaatatggacctctgaagctgcaagtgttcgatcatgacatggtgtccaaggacgacctcatgggtgaggccgagatcgacctgcagacaatgatcaacgctgccgcagcatttggcgacccggagctgctgggcgacattcagatcggccggtggctcaagtccgaggataacgctctcgtcagggacagcgccgtggtggtctctggtggcaaggtgaagcaagggatggcactgaagctgcagcacaccgagtccggcgagctggagttggagatggagtggatgccgcttaacgtgtagaaatctgctcaagttgccacctttataatgggtgtgggatacaaagaatttgttttgcttttgttgccaagagaaattgttatattttggtaattggcaagggctctcttcaaaataaagatctgaatcgctaaaaggtgtgttgtggatactaaaatttgagagatgattcacaagaaactcctttttttctaatctaaattcaaggttcaccatgcagtttataaaaaaaaaaaaaaaaaaaaaaaaaaaaaaaaaaaaaaaataaaaaaaaaaaaaaaa

SEQ ID NO: 4165 - DNA, 805 bp, Zea mays
gctcagtccaagccccccttgccttctttctcagcccacctctctctttcacgcacgcctctctctctctccctctccctatctgtcttcctgcctgaggcagccatttcctcttccgatcgtggagaggcttggagtggaaggaggctgctggttctcggcacggcggagatgtctgaggtgtcggtgataaaccaggcggaggtggaggacgcgggcgccgggcagctgatggacctgccgccgggcttccgcttccaccccaccgacgaggagatcatctcgcactacctcacccacaaggccctcgaccaccgcttcgtctccggcgtcatcggcgaggtcgacctcaacaggatcgagccatgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgaggccgcgcgccgcgcggggagaagaccggatgggtcatgcacgagttccgcctcgagggcaggcttccccagccgctcccgcgctccgccaaggacgagtgggccgtggtgcaaggtgttcaacaaggagctgcaggcggcgaggagcgagccactattggcgcgcggccggcgccgcggagctcgagcgcgtgggctcgctgggcttcctcacgagctcctcgactccgcggagctgccg

SEQ ID NO: 4166 - DNA, 1642 bp, Zea mays
  misc_feature (39)..(39): n is a, c, g, or t
acccggcgatgcataaatcgtgcctagaggtattaatgngaactcgatacccattaacctgtggggaatttctctattaggatataactatgaaacaaaaattgtcctcataggaatgaatatgggacaaaatctccaatcattgaataaacgagtatgagtttgagaagcaataactcgaacctgattatccataggtatttcatacgtatacacatgtcctgtttgtatgaatgggttgagaatgagccagccaccaatcctagtacgacagcgcaccaggccccaagtcctaacccaacaaggcaacacgacaagacaactagcacactagcaaaaaaacaaaatcctaaaataaccaaccatatgttacgccatgtgcagccggccaaccgccgcacacctggacagttgcgctggccctgcacaatagcgactaggagctaggagcttagaacgacggtgacgatcatggattctcaggcgccaacgaactcggatggtgaccaagggaggtgagcagactccatttctctattttttctattggtccaaaagtgctgatttcttttctaatggatggatgaatagataatgatttagggacgagtgcttgctgatttggtgatgtctgaaatctatatagtttatactagcggttagtatctagttatctcttaattagggatggggacctattagaaatccgaaacccaaatgatgatgagtatgtgatgagttttatagctacgatgaatatgggaatttatcaaatttgacggggacagaaatgagatgctatagccgatagaaaatttcgacatctctaatcgtatctggtataccatggtagttccccggcccataatcgctggagaaggaggtccaagtgggccgggtcgaaagaaacttcgactgccctgctccaagcggccctccctcctcgccttaggccgagatccctcgtgcttatccaacgaacgaaccaatcccattccgtcggccatggcgaccgccacgctgctgggctcctccttcgccatgcccgccgcagcccgtagggcgtcctcctctgcctccacctccttgggcttcgccacgtcgcagctcgccggcctctccctctccgcgggcgccgcaactccaaccgccgtcgccttcctcccaaagaggcagcagctccagcccattgtcgcgcggcgggtgtgccctttcacgggcaagaagacgaaccgggcgaacaaggtgtccttctccaaccacaagacgaagaagcagcagttcgtgaacctgcagtacaagaagctgtggtgggaggctggcaagcgcttcgtcaagctgcgcctctccaccaaggcgctcaagaccatcgagaagcacggtctcgatgctgtcgcgcgcaaggccggcatcgacctcaacaagaagtgagaacagccaaactatggtgtggtggcacactggcatcgaccccagtttgatttgtgtaccataccaatcagtgtaggcagatcgaggttgcacatgctgtgggtctgtttagttcagcttttttctggcttttttctgaccaacttttctgaaaatctggctacgaggagaatctggctgtggggggaaaaaaaaaaaaaaaaaagcggcc

SEQ ID NO: 4167 - DNA, 2622 bp, Zea mays
tgcagccgctcgccatcacccgccgcagcctggacgagtggcccaaggcggggtccgacgacgtcggcgagtggcccaaccccaccacgccgggcgcctccagggcgggcggcggcggaggcgggtcctcccccgccaagcccggggaggggctccgcctcgacctctcctcgctccggtcgcaggggcgcaaggaccagatcgccttcttcgacaaggagtgctccaaggtcgccgaccacgtctacctcggcggcgacgccgtcgccaagaaccgcgacatcctcaggaagaacggcatcacccacgtgctcaactgtgtgggctttgtctgcccggagtacttcaagtcggacctagtctaccgcaccctctggctgcaggacagccccaccgaggacatcaccagcatcctgtacgacgtgtttgactacttcgaggacgtcagggagcagggcggccgcgtgcttgtgcattgctgccagggggtgtcacgctccacgtcgctggtcatcgcctacttgatgtggagggaaggccagagcttcgatgacgccttccagtttgtcaaggctgcccgggggatcgcaaatccaaacatgggctttgcatgccagcttctccagtgccagaagcgtgtgcatgcgattccgctgtcaccaaattcagtgctcaggatgtaccgcatggcgcctcactcccagtatgcccctctgcatttggtgcccaaaatgctcaatgacccatccccagccacccttgactctagaggcgcgttcattgtgcatgttctctcgtcgctctatgtctgggttggaatgaagtgtgatccggtaatggaaaaggatgcaaaggctgctgcgtttcaggtagtgaggtatgagaaggtgcaggggcacatcaaggttgtgcgagaaggtctggagccacaggagttctgggatgcattttcaagtatgccacctaattcagatagtaatacaaagattagcaaggaccagatcgattcagcatccaagagtgacccaggaagccggaaaaatgagtcctatgacgctgattttgagcttgtctacaaagcaatcactgggggagtggtccctgcattttcaacttctggggctggtgatgagacccatcttccagctagagaaagtagctggagtttactgaggcacaagtttatctccaggtcgctagctcgtgtttattcagattctgctctaatgaaggattttgatccacgggtacaacacctggctgctgaggcatcaacctcacctcctttcctttctccaagctccttatcatcggattcaagtgtcagctcgaagtatagttcagactcaccctccttatcacctacaactggctctccaccatcatttggcctctcgcctgcttcatctaatctgacacatgctttggtgccatcatccaggtctcccctttctcaatcatctaatgaaggagcttcaaagccttctggcatggaatcaatacactctccttccaagacctcttctatagcagaaaggagaggaggcttcacacttctaaagctaccatctctccaaaaggatcttgtattgccaccaagggtgccgtctattgtattgccaccaagggcgccatctagtattcgcaggaccgaggatgcctcagataatagtacaaatggggttaaacagctgactagtgagttttgctcagaaaaatgcactggtaatagtttgagctcgcattctgaaactagattaattgagcgtactgacagtaactcagaagtctgcagtaatgcacaacttgtagtctaccagtggcccagcatgggaaagctaactacatttgcacgcaaggatcttgacccgaagtcggttttaatttttgttacttcgaatgccatcaggagaggagaagcagttaaaatggtgtatgtatgggtaggaggcgaaaatgagagcagcaagagtgttgactctgtcgattggcaacaggtcactagtgattttcttcatctaaagggcctcagcaatgttcttcctgtcaaggttttcaaggagcatgaagctgagaatcttttggaactactgaatgttagttaacattaggcagtagctatcaggatattgtagttgcttaacaaactcaacgaaggcatgccctccagcatcagtcggtaccgatgattgtcagcgaggtataaagccacagccattcccttgaacataataagctacaaacagattccgttctgcaactgcgcctcatgatctatattttgtccagatggcaggaggctgccatgggcgttgtatcggttgcgaattagcactcgtggtgtaggagcaatcggccgattcggtgtatattatccgctcccctgtaatgtaagctcagatactgggagctggtgtgtcgacagttactttttagcctaaacattcttgtacatctttgaaaggaacagagttgtaatccttttgactatgtaaatggctccattggtcataacttctaaaccatgtggaactcagttgctagctggtaatctccagttccatacaatttactaaatgagctaaactgcagtttctggtaaaaaaaaaaaaaaaaaaaaaa

SEQ ID NO: 4168 - DNA, 1320 bp, Zea mays
ttgatcccgggtagaccgtgtacagcacctggctgctgaggcatcgacctcacctcctttcctttctccaagctccttctcatcggattcaagcgccagctcgaagtataattcagattcaccctccttatcacctacaactagctccccgccatcatttggcctctcgcctgcttcatctaatctgcctcaagctcttgtgccatcgtccaggtctcctctttctcaatcatctaatgcaggggcttcaaagccttctggcctggaatcaatacgccatccttccaagacctcttctatagcagaaagaagaggaggcttcacacttctaaagctaccatctctcccacgcgtccgtgtattgccaccaagggtaccgtctagtattcgcagaactgacgaggccttggataagagttgtacaaatggtgtcaaaaggccgactggtgattttcgctcagaaaattgcactgataatagttcaagcttgcattccgaaaccagattaactgaacgtactgacagtaactcagaagcttgcagtaatgtgcaactgttggtttaccagtggcccagcatggaaaagctaactacgtttgcacgcaagaatcttgactcaaactcggttttgatttttgttacatcgaatgccatcagaagagaagcagttaaaatggtgtatgtgtgggtaggaggcgaaattgaaagcagcaagagtgttaatgctgttgattggcaacaggtcactggtgattttcttcatcgaaaaggcctcagcgatgctcttcctataaaggttttcaaggagcatgaaacagagaatcttttggaactactgaattttagttaacattaggcggtagctatcaggatattgtagttgcttaacaaactcacccaccccacaaattgtcattcaacgaaggcatgccctccagcatcagtcggtaccgatgattgtcagcgaggtataaagcctctaccatccccttcccttgaacataacaggccctacagacagattccattttagtagaagcggtggatcgacaactgcgcctcgttggtctatcttttgtccaaatggcaggatgctgccaatgggcgttgtaagcgcaatcagccaattgggtggtaatgtaagctttagctttagatactgggagatggtctgtcaacagttacttttagcctaaacattcttgtacatctttgaaagtgaacagatttgtaatccttgtggcatataaatggtaacattgttcataacttttaaaaaaaaaaagaaaccactcgcgagggggcccccggttctaatct

SEQ ID NO: 4169 - DNA, 1018 bp, Zea mays
ttttaccctccatctaatgaaggagcttcaaagccttctggcatggaatcaatacactctccttccaagacctcttctatagcagaaaggagaggaggcttcacacttctaaagctaccatctctccaaaaggatcttgtattgccaccaagggtgccgtctattgtattgccaccaagggcgccatctagtattcgcaggaccgaggatgcctcagataatagtacaaatggggttaaacagctgactagtgaactggtaatagtttgagctcgcattctgaaactagattaattgagcgtactgacagtaactcagaagtctgcagtaatgcacaacttgtagtctaccagtggcccagcgtgggaaagctaactacatttgcacgcaaggatcttgacccgaagtcggttttaatttttgttacttcgaatgccatcaggagaggagaagcagttaaaatggtgtatgtatgggtaggaggcgaaaatgagagcagcaagagtgttgactctgtcgattggcaacaggtcactagtgattttcttcatctaaagggcctcagcaatgttcttcctgtcaaggttttcaaggagcatgaagctgagaatcttttggaactactgaatgttagttaacattaggcagtagctatcaggatattgtagttgcttaacaaactcaacgaaggcatgccctccagcatcagtcggtaccgatgattgtcagcgagatggcaggaggctgccatgggcgttgtatccgttgcaaattagcattcgtggtgtaggcgcaatcggccgattcggtgtatattatccgctcccctgtaatgtaagctcagatactgggagctggtgtgtcgacagttactttttagcctaaacattcttgtacatctttgaaaggaacagagttgtaatccttttgactatgtaaatggctccattggtcataacttctaaaccatgtagaactcagttgctagctggtaatctccagttccatacaatttact

SEQ ID NO: 4170 - DNA, 1611 bp, Zea mays
gcacatttgtaagtttctctagccaggcctcaaacaatgatacaacacctcacttacaaaacatgacctttaacgctagcacgagaccattaccgagaacctcccgcccgccagatatagtgagaggaatcaataccaccatactgtgacgtcctctcctcctccgatgagaaagagatgatgagggagggcgatgcatgtgttacgcttctaagaagcaagctccatggcctggtcgagaggaaccgtgctctggaagaggagaacaagcaactgagacaccaagtgagccgactaaaaggtcagatctcttctctcgaaggccaggacactgacaagaggatgctatggaagaagctgctggagagttctgcgaccagcatcagctactccaaggagaagcagtttgtccaaagcaacgatgacgcgaaggaagccacggatctcagcagctcactgtgtcacagaaggcagcagcagttctccagggtagcactcgtgagatcaagggcgccaagggttccgaatccaccgcccaatccgacatgcacccagccaaagacaaccgtccgaaaggaaggatgcatggcccctcctcctcctccaccacctccgctaccttccaagttgcagaggagcgcaaaggcgatacaaagggtgcccgaggtagtcgagctgtaccggtcgttggtgcggcctgaaggcaaaaacgatgcgaagtctggatccgtaggaattccagcagcgacgagcagcagagagatgattggggagattgagaacagatcagcttatgttttagctattaaatcagacgttgaaaaccaaggcaactttgtgaacttcctcgcaagcgaagttcaaaatgcagcgtacaaagagatagctgacgttgaagagtttgtcaagtggcttgacggggaactgtcataccttgtggacgagagagcggtgctcaagcacttccccaactggcccgagaagaaagcagacgccatgagagaagcagcgttcaactaccgagatctgaagaacctggagtcagaagcgtcatccttccacgacgacaggagggtggctacgccgatggctctcaagcgcatgcaagctttgcaggacaaaattgaacaaggtatccataacactgaacgagtaagggacagtgcaggcggaaggtacaaggatcttaagataccatgggagtggatgctcgactctggagtcataagccaactgaagatggcttccttgaagcttgcaaaggagtacatgaaccgcatcgcgaacgctctgaagtcagatccatttgcgaacgacgaggagctacttctgcaaggcgtccgctttgccttccgcgtacaccagcttgctggtggctttgacgaaggatgcagaaaggcgtttcaagagctaaaaacttacgcaagcaagtctgagtgatccgaatccacgcaagttcaaaataaaagctgggatcacgcatagataaatgtgaaacacatagattattaagttttgccgaggataatgctgcatcttttttataaagcttaatttattttgggcaaaaaaaaaaaaaaaaaataaaaaaaaaaaaaaaagtatcgagcc

SEQ ID NO: 4171 - DNA, 6567 bp, Zea mays
cacataagagacaacatggtacacctctgagtgttttgattataaatataactaaaacacaatatatacgaagagcggtgtacttttcgaaaaacttgtctctagaccctataattaataggattatgcacgcagtggcggacccagagaaaaatgagagtgatgacacacttataaagacaagcaccataacattagagtagggggcacctaagttgaaccgagcagatgatcttatctacttgcaccaaagaaatgagcgagggtctgtgccctcactcaagcatacctagccccttatacatgtcaaggtaaacaacgtgtaaatagacatgttggtcgaaatctacaagcacaaagtagcgaacccagccctggtatttagaagaaaaaaaaattccctacacactgcaaatctattttattgtcacccctcacatataaaagctacatgcccacgtggatagaagttgttaggagtcctaagcatttatgacttctgtttatgtggacctgcaaataggtttacatcccgtatacagagaaattttttcctgatatttagggtgtgttagaaaaaatatggcaaactaaatttaggtgtattataaaaataaaatcaggtttaaactatgcctaactaattcaaaatacaacacagcttttctatcgtattcgctatcttatcgtctattttaaatttcactcgacaaacagtgtaaagaacatattttacacgatctcttagaatgtgcggcacaaatttacgagttcaagttatttatttatataaaaaaacaaagttacaatagtcttgcggtgggttctcaaaattgttgctcaaaagtcaaggaagccatgtgtatcctcggcaactcatcctgtgcgattttaatacagattggaccgaaacgactgcaaatttgcagtggtcacagcttcacctcctcggctcctcgcatttatgtgtgtcacagactcacagtgccgctacatctctaatcacagtatcagatacgcgttcaggagctccgaacatgcatctttcatggtccatgcaccatacaaaaaaagtgcaaactggaacttacgagagagtttttggtttctagagactaatttctagtctcttcattttattctattttagtatctaaatcgctaaatacggaaattaaaatagagttatagtttctgtatttgacaatttatagactaaaatagaataaaatagaggaaataaaaattattcgctacaaatcaaacaccacctaaatgcttactagttacgactcaattacttctagttctaggtatcatgcatatgtgttgcttcttcttgagattgaagtagctaaaatccttaccctttaggcctagtttggatactcatgaattagagtggattgagaggtattaagagggattttaatctattgtggttttaaacactctccaatccctccaaaccactcaattcaagattacacaattcccatgccaatcccttctaatttcccttatagggggatcaggacatcaggttaccagaaccaacatcaagctcacctgtgatgttcaactccaaatttcaccatttgaaggccagctagctcatttattatgcaaagttgtctacatatgttatatgttgaaattgaggttgtttgtgataatttcgagctctagagactattctaaacttttccatcataacaatatgcgatctaaatctgaaacctgagacaatgaaatcaatgaactccttcaataattaaatatgcccaacacttccctatacatcagggaacttctcgctataaattggaatctctgtcaccatgttacagagggaaacttattgctgtcagctctgtgttacgctgtgcttctttccatgttgccacctctggcaacagtttcagaatcttaatatgtagggactagggacaccaatccatgtcgccattttccttcataaacagattgacagtgacatgggctgtttcttccaataccaaatgaaaaactctgtttttcatatttccctcctcaaagcaatcaattttcagaaatcaggatgatggtttcagcaaaggtttgctgtaacaatcgctgtagtccagaaattatagacaactgaaaccaacaacctgaaagaatgtaccatctacatgtgttcaagaagtaaacacacataatttaacccatttattctctgttttggtcgactttccttttttttcttcccatgattttaaacttttacttgactgttattagcaaaaaaggcgtccttcgctccggctggtaaaggagctctatctgaactccttttacacatcttgagacaaaagaaagcttaaaaccaaggtttgccgtcagaattaataaaaaaatttggaatcaagaaagcaacataatctctgagaagtgataggctaaaaaacgagagagagagaggagacaccagactagttttcctctttgccagagcagaatgcccgctcttctgcttttgttgcttctgctaagataacataaattcaacttgaatctaagaataaaacaggggtgatttgattcagatgatcaaactggcacaccggaacaatgcaattattgactgcattttactttagggaagttccagagacaagtcagctaccccatagcaatcacttaaaggacaagtaattagcccagcgacagctcccaccaaactcaatgcttcacccgttcttgcttgcacatttgtaagtttctctagccaagcgtcaaacaatgatacaacacctcacttacaaaacatgacctttaacgctaccactatatgagcgagaacgaggaggcaggagaaatatatagtgagaggaatcaataccaccatactgtgacgttctctcctcctctgatgagaaagagatgatgagggagggcgatgcatgtgttacgcttctaagaagcaagctccatggcctggtcgagaggaaccgtgctctggaagaggagaacaagcaactgagacaccaagtgagccgactaaaaggtcagatctcttctctcgaaggccaggacactgacaagaggatgctatggaagaagctgctggagagttctgcgaccagcatcagctactccaaggagaagcagtttgtccaaagcaacgatgacgcgaaggaagccacggatctcagcagctcactgtgtcacagaaggcagcagcagttctccagggtagcactcgtgagatcaagggcgccaagggttccgaatccaccgcccaatccgacatgcacccagccaaagacaaccgtccgaaaggaaggatgcatggcccctcctcctcctccaccacctccgctaccttccaagttgcagaggagcgcaaaggcgatacaaagggtgcccgaggtagtcgagctgtaccggtcgttggtgcggcctgaaggcaaaaacgatgcgaagtctggatccgcaggaattctcagcagcgacgagcagcagagagatgattggggaaattgagaacagatcagcttatgttttagctgtaagtacatgttttttttttctgtcatgttcaagcatattcatgtgtagcgtattgttctacttatctgctgattccttctgtgcttctagttttttattttaataaacaatttcaataaatggtcggggcaatatctatttttttcaatgcatcagctagcagttctttattgtattacagacatcggttaaggatcgtcaaagactgctcatctgaaaatatcatatattctctgtccatccatgtgttactttgacagcagacaacatttggtttgcttctgaatgaggttcccgtggatagaggtttgcctacaaccattttagctgttgattcagagataggctactggtacccctagtcccctaccttgtccatcttggtagcttacatatagttttcagagagttttaaagttaacacttcactacagaaaccatatataaatatatttatgcacattatgtgtttgattttttaaaaagaatcctatcaacttttttaaaaaaaaattgtgatgttactttagagttgacgatagttgacaactctttagtcataccactagtaaaaccgtaatgggtgtagaactaagccatgctttaatgtgtgcgcatgtttgtatagaaagtatttttacatgttagaatgtgaaaactgtttactgggtaccgtcacttattcatgactgttgggagtgacagctattatttcccctaccacgcccttctcagaactaagcctaaaccgccccttgtattttgcatctcaacagatcaaatcagacgtagaaaatcaaggcaactttgtgaacttcctcgcaagcgaagttcaaaatgcagcgtacagagagatagctgacgttgaagagtttgtcaagtggcttgacggggaactgtcataccttgtggacgagagagcggtgctcaagcacttccccaactggcccgagaagaaagcagacgccatgagagaagcagcgttcaactaccgagatctgaagaacctggagtcagaagcgtcatccttccacgacgacaggagggtggctacgccgatggctctcaagcgcatgcaagccttgcaggacaagtgagtagatggccgaaatgcatctaacagaatgaaaattgctggatgcctgcttctttttaaattctacggtgtgatactggatcaagaaatcaacatcatatccacctgactgtgctttcccttgttgtagaattgaacaaggtatccataacactgaacgagtaagggacagtgcaggcggaaggtacaaggatcttaagataccatgggaatggatgctcgactctggagtcataagccaagtacgcattcctaaactcctttcgctcacaataaaggagatgcattttagcatttcacaaagtatgagtccaaatacaaatagtagaaacaaaacatgacacatggtgcatgcccatcctacactaaacagctgaagatggcttccttgaagcttgcaaaggagtacatgaaccgcatcgcgagcactctgaagtcagatccatttgcgaacgacgaggagctacttctgcaaggcgtccgctttgccttccgcgtacaccaggtaacctgctccgaaccacggattattacttggcaacgacacatttgcatagactgattaactgaccgcaccgtccgagacaaaaacttgcagcttgctggtggctttgacgaaggatgcagaaaggcgtttcaagagctaaaaacttacgcaagcaagtctgagtgatccgaatccacgcgcgttcaaaataaaagctgggatcacgcatagataaatgtgaaacacatagattattaagttttgccgaggataatgctgcattttttttataaagcttaatttattttgggcatcagcagcagcaggtgctggtctctcggatacaggttcaggatctgaaagtttctaaacgaatcgtacaaataagcacacacctactaggtctccgttggtatgtagaaattctagaggaataacacatcagttttataggaattagcttattttgatattttcataggcctatataggaaactgaaaaatttctcgcattcctaaagggttcttattagccttttccgtaccgtctagaaacaactaacccaccaacatagaactcccatgagagttgagaaattgagatcgttaaagttctggtcgaccattggatcgtccaaacaaatgcgaagcatgacaaaaagaaagcaggcatagaaatgcagaatcggttcttaaatcactcacacagcagtaacgagggcaacattatatagaaaaattaacctgtgcctatttcagccatacgtgagcccactgcccacgatgtgtgtgtgcgtgctgtgtatggcgcggcatggcggcttgagaatagctctagccaagaacatggagtggtggatgtgttagcaacacagcagtagaagagaggaagggaaggactagcagcaacatggagaggaagaaaggggctgagagcagactgaaactggcgtaattgattcggggtgtgtttggacagtttggttatggaacagccaggaccagagacgtccagacatctactggcgtcctttcttgtcccttaaattttgaggaataactaagggataacactgtgatagttctgtctcaactctttactctgaaccaaacaaccttatttgaggaacatttcatgtcgcctcgtcctgtctttgcaaccaaacacatccctgatctcctgatacagaattacagacttttaaatcagtgcctggacaccatagcccaacatttatagggcccattccagcccactaacgtgacacttcgacgccggctatgcttgcctggtttgtagtgcgacttgctgtgactttatttcggctgggactgcgacttcgactgctgcagctgcggttgcttgttgactgcgatcgggaggggaaaagaaaaggatagccgttggcatattagtctatgatctgag

SEQ ID NO: 4172 - DNA, 2529 bp, Zea mays
ccggcaccttccaaagttccaacctccaagtcacgagaaaggtttcgcttcgaaactcaaccggagatggcgagctctggcggaatctccgaccagctcttcgtctccgtcaagttagagagcccgcacctcgcggagctcgacctcgccccccacctcttcggctcccaccctgtggctggctcgtgggacccctgcaaggccctgcctttggagcgggcggccaccgccgtgtgggagttcagctgcgtcgtgccttcgcagcacgaatcgctggatttcaagtttgttttgaagcgaaaaggtgataatcctcaatacattattgaggagggacctaaccgaccattgggttgccagagaaatgaatttgagatggggaatgcgttgtttaaactcaacgaagggaaggaggtacttgagtgcaaggttcaggttgagacagaaatgttatccccaattgacttggcggctagttggagagctcatcaggagtattttcagccttcaagggtgcgggggactcacgatgtcactatcaaccctgggttagaaggcagggccaagaatggcttcgcttctggtttggagcttgatttagacaagtatgtagttccaacaccaaacatgggctcaggtgttgtttatgcagctagtttgactgaaaatccacgctcattattgcaaactgggagttcctcaaacaatgataccacaaaggacattttgcacaactcaactaaaggcgattcatccttgaatcactatgttaacactatgaagagcacaattggagggcatgcatcgtcactggaagaacaaagggcaatgtttgttgatagaggggttggctcaccaaattttgcaagaccaacaatggaaaccttttcgatgagcaactttaagttggattctgaatcaaagggtatgccagcagcagaaggggctgttgcagcagctgctgtagctgatcagatgtatggaccaaaagaggaccgcaagttggccatcgtattggttggctaccagctcgaggtaagacctttacagcagctaaacttacaagatatctccgatggttaggtcatgaaacaaaacacttcaatgttggaaagtaccgccggctcaagcatggaactaatcagactgctgatttctttcgtggagataacagggagggtgtggaggcacgtaacgaggtggctgcattagcaatggaagatatgctatcttggatgcaggagggtggtcaggttggtattttcgatgccacaaacagcacaagaatacggaggaacatgctgatgaaaatggctgaaggaaaatgtaagatcatctttttggaaacattatgtaatgaccaagatgttcttgagagaaatatacgattgaaagttcaacaaagtcctgattatgcagagcaaacagattttgaagctggtgtacaagatttcaaagagcgattgacctattatgaaaaggtctatgaaccggtggaagaaggttcttacataaaaatgattgacatggttagtgggaaggggggccaactaaagattaatgacataagtggttacttgcctggacggatcgttttcttcttggttaactgtcatctgacacctcgtcctatcctgctaacaagacatggtgaaagtatggataatgtcagaggaagaatcggtggagactcttctttgagtgaggccggtgagctttattcaaggaagcttgcgagctttgtggagaagcgactgaaatccgagcggactgcctctatatggactagcacactccagagaacaatattaacagcacatccgatcattggttttccaaagatacaatggcgtgctcttgatgagatcaatgctggggtctgtgatgggatgacatacgatgaaataaagaaaagtaaacctgaagaatatgaatcacgaagaaaagacaagctgaggtatcgttatccgagaggagaatcctatcttgacgtcattcaaagactagaacctgtgataattgaacttgaacgacagcgtgctccagttgtagtcatagctcaccaggctgtgttgagagcactttatgcatactttgcggacaaaccgcttgaggaagtcccaaatattgagatacctctacatacaataattgagatacaaatgggtgttgctggtgttcaagagaaacggtacaaactcatggatgcaatccatcccacagcggggttgtaagaaataataaatggagctcgccttctaaaagcaatggtagcacaaataaattttgtgatgatatacgtatcacaacattaatcaattagaagctatagttcgaggtggaatgtcacaccactaggtttagctcatagatgatttgccatttgacttacaagttttggctggttgtgtagtgtgtactcttaattcatgagttctgaagcatgtttaattcagatccgagttctgagcaagtttattcaggccaaagctcgcgccaaagacagtttttccaaaaaaaaaaaaaaaa

SEQ ID NO: 4173 - DNA, 698 bp, Zea mays
gccgggccgcgccctttcccctatccacgagcaaggcacagcagcagcgcaggggagtcggagtgacagccgcccgcaggatgccgacactaaacctgagcaccaacgtgccggtggacgcggtggtcgccgccgacatcctcagggactgctccaaggccgtcgccaggatcatcggcaagcccgaatcctatgtcatggtgtcggtcaacgggtcggtgcccatgtcgttcgcggccagcgaagagccggcggcgtacggcgagctcgtgtccatcggcggcatcggccccggcgtcaacggcaagctgagcgccgccgtcgccgaggtcctcgaggccaagctctccgtcagcaggtccagattctacatcaagttcgatgacgtgcggggacacaacttcggcttcaacggatccacattctaagtcgactccagcagaaaccgaagacgatggtcgctgcgtccaaacatccagctcaatacataccaacaccactacatcaataaacgctgatcatgtgtcatccatcacccgcacctccatggaaaatcccgctcgagcacgagacgcaccaccactagtttatgggctttgtactttcacctgaaagcatgcagtgcatgatggcatgtatctgattccaaattttattgaacttcattttttcagtaaaaaaaaaaaaaaagaggcgcc

SEQ ID NO: 4174 - DNA, 810 bp, Zea mays
cgtaacactcctaagggcgattgggactctcgaggccatataggccttctcgtctcgtcatccacccgctcgccctttcccctatccacgagcaaggcacagcagcaggggagtcggagtgacagccgcccgcaggatgccgacactaaacctgagcaccaacgtgccggtggacgcggtggtcgccgccgacatcctcagggactgctccaaggccgtcgccaggatcatcggcaagcccgaatcctatgtcatggtgtcggtcaacgggtcggtgcccatgtcgttcgcggccagcgaagagccggcggcgtacggcgagctcgtgtccatcggcggcatcggccccggcgtcaacggcaagctgagcgccgccgtcgccgaggtactcgaggccaagctctccgtcagcaggtccagattctacatcaagttcgatgacgtgcggggacacaacttcggcttcaacggatccacattctaagtcgactccagcagaaaccgaagacgatggtcgctgcgtccaaacatccagctcaatacataccaacaccactacatcaataaacgctgatcatgtgtcatccatcacccgcacgtccatggaaaatcccgctcgagcacgagacgcaccaccactagtttatgggctttgtactttcacctgaaagcatgcagtgcatgatggcatgtatctgattccaaattttattgaacttcattttttcagtaatgcaattctacagccctaaaaaaaaaaaaaaaaaacctttgccgcggcccaaaaaaaaaaaaaaaaaggggggggcc

SEQ ID NO: 4175 - DNA, 534 bp, Zea mays
gacattcagcttattgagggcattttcaattgttacatacaatctattgcgcgttcgagagagaaaaattgttacatacaataattgtaatcactaattcttcttacgacagatagagtgacaacacttgctcatgtaaattgagacagattgagtgacaacacttgctcatgcaaattgaggaattaactgcttcaggacagagtctaaagctgcagcttagtgagttaaagtctaaattagcatctgaaaataataaaggagcaccagagcaagtgttcctctacttgaatggccttgctcctccaacagatggatttcagagcctatgtgatcttgcctccaccagctttcaaaccaaatacgcgtacttaaatggcctgagcaacgacatatggcattgcagagtacatcccagcagcagccctctctctgtagaagatcgtcctctcaattgaaacaattggctgcgcatttgaacaattgttgatgccgacaaacatcacaattgtgtacctgcccgggcggccgctc

SEQ ID NO: 4176 - DNA, 1925 bp, Zea mays
gccggcccggccggggccgccgtccgtttccgcatcggtgtatcttcgcccccggcgaaggcgctatcctcccgaccacccggcggtgccggtacgccggtaaggcaggttgccagaccccgcgaccccgatcccgatcggtcgctggcgaggcggcgtgacctaccccggctcatcctctcaagccagacggtctggctgctgtgcatccccgttttggcggctaccttacctctggcaaggcaatcccccctcacccctggcaagcacgggagaacatggagagtgcttcagatgtacaaatgcaacatcgtgctgaagattccgagactacaattgagatcaaaatcaagacattggattcccagacatacaatttgcgtgtgaataaatgtgtgccagttcctctgttgaaagagaaaattgctactgtaactggaatattgtctgaacagcaacgcttgatttgtcgtgggagagtcttgaaggatgatgaactcttgtctgcttatcatgtcgaagatggtcatacattacatcttgttgttagacatccaggccagtcagctacatttggaaatgcagcaaccgaagctaacacatcaaattctggccgtcgtcatgggcccacagtggcaagaagtgtagtacttgaggctgttaatgtggatcctgggagcagtgaactcccagcttttgttgcgcagattctccaaagtgtgcttggaacaatcagtgcacaatctacgcacaatctacgatccttcacaatcttccatcccaaatactataagagttgaactcgaccagcaacaagctcctctgctttttcagtctgaacccgcacatgagtcgtctcaaccaaatgtcatccctgatgctttgacaactatgtctcagtacattaactttatgagggactcatttaggagggagggctttagtcttaatggacaaacagagggtaatgtggaaaacagaactgcagagcctgaatcagcttctgtgcttgggcttcataatgcatcattgctagctgaaaatatgcactctactaggcaaattattgttgaacaggctggtgcattgctgtctgtaagtctcatatttcaaaatcttgctggttccagttagctaatcttagtttatcttcttaccgctttatttaacgtcttctgttcattgctattgacttgatgatgtttgtgtgttacttgatctttgctgataggaaacctcatatatttctgacagtaaacatgtaaatttgcatttgctgcaaaaaaaaaaaaaaaagttatctgcattattactttggtactgcaagatttgtgttttgtagatccatggaccctcaatttccatcttttaaaatccagtcaccaatagtaggatcaaatcggatgctctacagtggcatccaatccaatgattgcaagtcgcctggttgctccccaggattgaccaggtgactaatcgcgattaggcgacgaccagggcgactagttgacccctagtcgtcctagaccttttagacttgtagttacacttatataggtatatacatatataaatatacctatatacattatataaattagaacaaacagctacataaacaaaatagcagtttgcaaacagagacataagtacaagtcactactcatcagtcatcactggcttaggattacgacagcaaccatccgggagagggggggggggggagcaggaggaaccttgagatgacgagctcatcaagtcaatggtgctggagtagccgctgatatctggactggagcaggcgagcagccaagcaggcagaggggcgcaggcgccgttgaatggagcaggacagcagggggtgcaggtgagcagccgccggtgctggagttctgcaattctagggcagctgcaggcatgaaagc

SEQ ID NO: 4177 - DNA, 1449 bp, Zea mays
gcacgagaccattacctagaacatcctaatcgaaaagtttacaccgagggttctctctttgtctgttcactgttctactgggacgaccccaaatccccaaatcgaaaggggccgtccggctcagggtttctcgacggctccttgccctctccgccatggacgcacagcgagccctccttgacgagctcatgggcacagctcgcaacctaacggaggaggagaagaaggggcacaaagagctgaagtgggacgatccggacgtgtgcggcccttacatggttcggttctgtcctcacgaccttttcgtcaacaccaagagcaatatcgggccgtgctcgaggatccacgatccgaagctcaaggaaagctttgagaagtctcctaggcacgatacttatatgcaaaggtttgaggcagagcttgcacaacaatgtgagaaattggtaatggacttagatagaaagataaggcgtggtcgagaaaggctggctcacgattctgctgtgccaatgccaatccctggaaaattagctgagctgctttcagtgcgaaaagaacaggtgaagaagctgctggagcaaattgaggagcttggtgaggctggtaaagtggatgaagctgaggcacttatgagaagggttgacattttaaacgctgagaagacagctttagctaacgaagcagacaacaaagtagctatgcttgagaagaagatggaactttgtgaaacatgtggatcattcttagttgctgatgatgctcttgagagaacgcagtcccatgtgactgggaaacaacacattggttatggcatggttagggatttcctggcagaatacaaggcagcaaaagagaagacaaaagaggaagagcggcttgcaagggagcagaaagcagaggagcatcggaaacagaggggaaaagagtatgatagtgggggcagggatagagataccagaagggagaggtctggggagcgtgactttgaccgtgatcgtcagtatgagcgaagcagaggaagagatagggtttatgattacagggacagaggatcagaacaccgaagcaatcgctacagaaatgggagggattctgaaagaggtggacacagatacaggagtggtggtatgacaaatgaccgagggagaatgaggagcagatcacgttctccaaccaggcatggctatggaagatctagaagtccagatcattagctgcctagctggacatttagatagttttattcacagttgggactcatgaggtagacagttcccttctgctatttattactgtacaatgggttttattgaagtgtcgcacttttttaagtctctgatctgttgtaacagctctgttggaaccctacagtctccctattttgcatggggaaaaattcccaggtcggtgggtatcgattgccatccccacattttttgtgtttctggc

SEQ ID NO: 4178 - DNA, 1114 bp, Zea mays
ggggaccctcgaggcctgccgcggcattgggtacctcgaggccggccggcacgatttagaaaccctcacctcttcccttcctccccgccgccgccaccgccggaaggagaaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcaggaaccgggagcgcagggcggtaaagcgccagcgcatccgcgacgagcacaaggtcaccgtaaggcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaaggagcctttccctcttaccagtaacgatctaattgagaaggctcttggagatcacggcatcatatgcttggaagacgttgtgcacgagatcgccacggttgggccgcacttccgagaagcatcgaggttcctcatgcccttcaggctcaagtgtccggagaggaggctgcagatgaagaggaaaccctacaaggatggcggcgactcgggcgaccgtggcgacaagatcaacgaactaatcgagaagctgaactagaagcgcagaccttgcctcctccggctgtcgttttgcgttggagcgatggatctgttattaccttgtcggttttgtaatagcattagctgggtgtaccttcggctttgaaaccttacctgcgcttgtgcgatcaggtcatgaaatagcaggcgcttctttggtccaaaaaaaaaaaaaaaaaactcgaagggggggcccgggtaccccaa

SEQ ID NO: 4179 - DNA, 998 bp, Zea mays
  misc_feature (916)..(916): n is a, c, g, or t
  misc_feature (926)..(926): n is a, c, g, or t
  misc_feature (945)..(945): n is a, c, g, or t
  misc_feature (973)..(973): n is a, c, g, or t
cccgggctgcaggcggcacgagccagatgggtcttggtcgtctcacactgttcggcccagaccacatagtgcccttaactccccagcaaccagcagcagcaaaaatcttcaccggccgggccgggattcttcaaattcacgattgagaaaccctcacctcttcccttccttggttcctccccaccgccgccaccgccggaaggagaaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcagaaccgggagcgcagggcggtaaagcgccagcgcatccgcgacgagcacaaggtcaccgtaagcggcctgaggacttcgttgccgcgttccggaacaaggaacgcgacttcctgcggatgaggacccgcctcaaggtccgcaagcagccgcccgccgaggcgctcggctccaagctcgtcttcgcaattcgcatccctggctgcgtggacttgcatccgaacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaaggagcctttccctcttaccagtaacgatctaattgagaaggctcttggagatcacggcatcatatgcttggaaagacgttgtgcacgagatcgccacggttgggccgcacttccgagaagcatcgaggttcctcatgccctttcaggctcagtgtccggagagggagctacangatgagaggnaacccctacaggatggcgncgactcgggcgaccgtgggcgacagatncacgaactaatcgagaagctgaact

SEQ ID NO: 4180 - DNA, 825 bp, Zea mays
ggtacccgcccggttgggcaccccaaatccggacctcgacaagtccagaaaatcgccgcgtggtcggtccatccggggcgacttgacttccctctgcaacctcagaacccagccaatccgctgatctcaactgccgggcactccgatccggcgacgatggaggggagcgccgactccttcgggtccttgacggcgccgcttgcctggcacgacttcctcgagcgcatgcgccagccttccgccgccgagttcgtcaagtccattaaaagctttattgtgacattctcaaacagagctcctgatccagagaaggatagtactgctatccaggagttcctggaaaacatggaaggggctttcagagcccacaccccttgggctggcagttcagaggaagaactagagagtgctggtgagggacttgagaaatatgttatgacaaagctgtttaatcgggtattcgcatcagtcccagaagatgtgaagagtgatgaagaactttttgagaaaatgtctttgctacagcaatttgtaaggcctgaaaacttggatataaaaccagagtaccagaatgaaacatcctggctgctcgcacagaaggagctgcagaaaataaacatgtataaagctccaagggataagcttgcctgcattctgaactgctgtaaagttataaataacttacttctaaatgcttcaattgtgtccaatgaaaccccccctggagctgacgaatttcttccagtccttatctacgtcaccataaaggctaatcctccgcagctccactcaaatctgttgtacatacaaagatatagacggcaa

SEQ ID NO: 4181 - DNA, 4850 bp, Zea mays
cctaagttgttgcgatgtcgctgttgaagtaattccctcaatgaattctcctttaagcatagcagtcttccaagtgtgggaacagccatctccatctgtggtggtggtggccttacattacatgtcaagatgtgttgagcggtgcggagcctcggcctccgacagatgggtgggatcactcgctttcataacggctgtgacctgaagaagtagagaggacaacaagagctaaagcaatggctcaccagatctacttagacttgctgctgctgcttgtctaagccgccgacaggaacacttcttcgtcttttttttccccttccttacaagaacaacagcaaccgtgtgaaccaggtgtggttcaaaccctgtctcgtatagattctgttttgggttctcccattggcagctatagatcggccttctctgcatctttgcgcctcgttttgtattgcttcgatagatcgtttgatcatctgaaaagaaaaattttggaattagggttacagcaggcgtgcacgctgcaccacaatgggggtctcattattcgttaagcagaacctggaaccgtgttgctgccttttgagcaggcacggagaagcatcatctcagctgggtcgcggagctacaccacaccaaggaaaaggaacggccgagacttatacacataataatacacgcgtgcgtgcgtgtacagagattctggacgaactaaacaagtgttagttagagcgttttttatgtataaggatatggcaaagatggggggcgttgtcagatggcaataactccccccggttgcctgccctggcccaccaaccggatcagattacaaaaatggtagtaaagctaagctcttccttgatgcccaagcggatggccccccgcagttctgacaaacacctctgtgatatggtaccagcagcagccacaaggaaggggggagtcgtcattaccgccttttccccgggcaccaccaccaccccccccagccgcacagctcactccagccgaaagcacaagcacgccatggcagaggagaagaagaggcacaagcacaagcacaaggagaaggacaagcaggcgggcggcggcacggagcaggcggcgcacttcaagccgtgcggcgacgtgaagggcatccggttcgggggccagttcatcgtgaagtcgttcacggtgcggcgggcgtcgcccctggagctgctgcggctgctgggcatcccgccgtcgtacctgagcgagtgccagagcctgccgttcccgtccaccaccgcctacatgcccacgggcttcaccatcctggcgcaccaggcgtggcacacgctgacgctgggcctgggcaccaacaagtccaaggcggcgctcttcgtgttcgagtccgaggccatgaaggcggccgtggaccgcctgtggcccgccgtcaccccgctcggggacgtcaacaggaggctcatccgcggcctcacgggcagcgagatggcgcgcttcaagttccgcaagggctgcctcaccatctacgtctacgccgtgcgccggctcggcgccgccgggttcatgcgcaccgacgacctcaggcgggtgctgcagtccgtcgtcgagctcaaggacttcctggaccacacagccatgctcgccatcccgagccagaagagcatcaccctgcagtcccggacagcggtggctcactgagaggagatcgtcgtcacagggcatctcacctccagagcctcgagtctgatctgattctgatgacgccgcaagaacctcgatcggttcagcatcgcagaacagcctgaacaggtatggtcgtcggtttgtagctgtaatcttcagagggcctatctcattttttttgcccccctctccctctctcggttggattcgtttgttcagtgtcggtggtgcaagtgttcgcctcctctgctgggagagcagatgtatagatctgttgagcaaaaaaaagaagaagaagtgttcccgcaaatcaagcatagtttttattatatatataaaaaaatcccaaaggaaatttcccttcaaaaaaaaaaaaaaaaatgtccgtcaaatttcagtgaaggcatctgttcttgtggcactttctgtccgtactgggcagcactttgctgccggctgctgtaggcagtagctagctacggtacagtacagtgcttggaatttctcgcgctcctaccgtgccgtgcctttttcctctctactacatccactgtttccacagcatcgcgaactccttttgtttttggtactagaatcgcacccaatatataatttcgtgctctctctattgctgcacagctgtgtgtttcggggttactgttgcttgataggattggcaaatggagctgtcagtgttcacttgggagaacattgtgattagagtgttttgaagggatcggagaggatataaatctgaggatataaatcccaaatagatcaaatactctctcaatacatgtcaatctactccaatctcactcattattagagtatccaaactaagcctaaagtggatgctattatcacacacacactcgtcaacagctcttatctttttatgtggaagtaaccatcatgtaataactggcacaagaagatgaacgtatgctgctaccttttgacctgtttggaggggaggggaggggagacaccaatcttttcgagcatttgctgaaaattttgaccgagagcctccgatagaaataatatatggggcgggagggacagatgctgtcgccatgatcatgggggaggtaaagttagttgggcaggcaggagaggacactcgattcagtgacgtgcatgatgagtggttgagcggcatggcatggcatgggccacccacgccacgcccgcccctaaatcatgagctgcaacaaaagccgtctccgggtcgccagacgcgaaaggaccgtgcagtccctccctactattctgcaaacctttggatccgctttggtgccgacgaagcgccaagacaagactgtgctgcaaaaaaaccatcgcttgttttaatctaaaacatctgatacggttcgagatcgttgtcagtcctccctccacagcgagaggaggagcgaacgcagcgaaacatctcggcgtgatgacagtgacggcagctagcgccacgttaacttggcagctaaggatgtgtttggttgcttggtctagcctgagccaggctcagtgagaggaccagactcaagtgagctcgtatgtacagagacaacccaaaatgtttggttgcctcatcaaaatgagccaggcccatatgacacattgtttggttctcattttttagcttgacctaattaggttgccgccagttttgatgtgtaaaatgcagctcccaccaaatttcaaaatttaactaattgcaatcatctaaatatgaactaattacaatagatttgaactaaaaatatgattacagcagattctagatgcttttcagattatagctcaaaaatatgaactaattgcaatcttctaaatatgattacacccagcggaccatgatagttccgactgccatgctttgagctgggacgaacatcaacgattccccgcttccccagattgttgtcatttccttcccctgacagtgctggaacctagtgatttttttaaaaaaaaatgaaagggagacaaaagtttagaacccgacgacaccaacctgattgactcgcggtcgcggtcccggccgcgtgcgctggatcatcgtcgatcgaccgtggcgatcggcgagctttcaatcatgccgccgaccgggcaaggaaagcagatcgagacgtatttatgcgctcatgtggcggtgctgtgcatgggcgaccgccttattagtgcctccttggcccttggctgccgcgtcgccagcgagcccatggccatgcctgttgcctggtgcctggtggtggtggtggtggcacgctcgcactggcgcacgcatgttctggtgctggcgcgatccatcggctttcgcaggcgcgcccttccaatcgcggaagacttttctgcctgcctccttgttctcgtgctgtttcgggggtcgacaacggattctggtacggttggtgtgctggcgtagcggcgtagagctggggcctggggcgggtgcgggtgccccaaaaaaaatcatactagctgcgtctgcgtggagcgttgcggcgcgcaacgggggatatactgggagtctgggactgcgattgtcacctcggatgggttgtgacttgtgagggcttctccagtgaagaaaaaaatacacctacacgagcattaagcagtttgaacaacgcgacgcccttcagtccggcgcgcaccattgcagacaacgacggtaagctcctgacagcctataccacatgtccacatcatgtgagcgaatgctggggcagttagcacttggcaccagagtcgacttcgtctggggcagcaaagcccctctgagagtctagttctttggatggcttgtgtcccggagccgaattcagttccaatcaaacaacttgtttggtcagtggtagattgaagggattagaggggacttatccgtgtcaaaccgaacaaagaatattgtctaagacgtcaggtgcgagatatgtggcgaagcacctgaagacacgagacatactttttgtgttgttcgttcgccgttgcttcgggcaggtgttaggagtaacaatagcccctgagatcgagggcgttctatctacttccccttaccactacaacacctccatcctcctttgctattagcccctctagaagaggcgaagtaacgtggtgttccgcgacgagacttcttcgctgacaatgacccttatgttgtgccg

SEQ ID NO: 4182 - DNA, 1930 bp, Zea mays
aaacgcatgcaatctatcaccgcctcagctcgtgctctctgctctgcactatctactaccaaagaaagatgaaggacttggcggggctggggcacctgttcgtggtgtccttcctgttccacttcgcctccttcatggtgatcccggcggtcaccgacgtcaccatggaggccgcctgccccggccgcgacgagtgctccgtcgccatctacctcagcggcttccagaacgcagtcaccgggatgggggcgctcgtcgtcacccccatcgtcgggaacctgtcggacaggtacggccggaaggcgctcatgacgctgccggtcaccgtagccatcgcgccgctgtttatactggcatgcggccgctcggaggtgtacttctacgtgtactacgtggccaagatcatcgccggggtcttctgcgagggcaccatgcattgtctctgccttgcctacgtggctgaccacgtgggccccaggcgtcgcgcggcggcgttcggcctcctctccggcgtgtcggcagccgggttcgtgtcggggaccttgaccgcgcgcttcctcccgaccgcatccaccttccaggtcgccgccgccgtggccgtggcggcagcgctctacctcagggccttcctccccgacgctggcggcagcgtctcctgcgccgacgaagcctgcgaccctctcctccaggattcgtcctgcgcctcttccacatcatcctccgatgaagagctctcgcctcggctgccgccgcataagagaggcctgccgtctctgtccgacatggtcgcgcttctcactggcagtctggccttgtcaggggcagcaaccatcactttcttctacagtctaggtgaacatgggcttcagactgcattgctgtactacttgaaggcacaatttggttacaacaaagatgagtttgctaatctacttctaattgtcggtgctgccgggatgctatcacagctcactgtaatgcctatcttggctccgattctgggtgaagagatgctgcttattgttgggcttctaggtggatgtactcatgttttcttgtatggcattgcatggtcatattgggtaccttattttgctgcggcatttgtaattttgagtgcttttgttcacccatctataagaaccaatgtatcaaaaaatgtcggatcaaatgagcagggaattgctcaaggatgtatatctgggattagttcttttgcaagcatattaggtcccctcatctttactcccttaaccgcgtggtttctttctgaaacagagcccttcaacttcaaaggtttcagtattttgtgtgctggcttctgcacccttattgcgtttgttatcagtttgaggatgcctggtgctcgatctagtacgtgcaagaagaccgcagttcagcatgagcaagcatgacagaatatagtatagtgccacctactcttttttattctgcccaagtgcatagacagaaaaggacaggatgggaaaaaagtgacttcgagaaaaaggaaaaggtatagtgacaggaagtgctggagaaacatgctcgatttcgtatgttcaaagagaaggggttatcctatgcaactagacatttttatccttcactggaatgttgagcattgcagaattgacaattgctatgccatcgagcaagttcagtcgtttgtaaatatgctcctagtaggaagtaactgaattattcgcaaaaaaaggaagtggctgaactattgtgccttttgcacgatgcttcgtttcaaggattagccatgaattaacgtttatgtactctaagaggaggtgatttgcatctcaactaaacatttgagtatgcagttaagttgatttgtccagttaaatatgtagaacatgttcctccttcataggtcatccttttgagttctactttgcgaaaaaaaaaaaaaaaa

SEQ ID NO: 4183 - DNA, 1616 bp, Zea mays
  misc_feature (1551)..(1554): n is a, c, g, or t
  misc_feature (1566)..(1567): n is a, c, g, or t
  misc_feature (1579)..(1579): n is a, c, g, or t
  misc_feature (1585)..(1586): n is a, c, g, or t
  misc_feature (1603)..(1603): n is a, c, g, or t
gcacgagaccattacctagaacatcctaatcgaaaaggccacgtcccccgccgagcctcaccaatcgccctctgcaggcagggaagggcggggcggggcggggcggagatctgctgattgctctctttcttatcttctcgcctcccctcccctcccctcccgttctcccaattccaacctgctgctcgcggtcgcggtggccattgcctcgctcgcgtctccttggccgccggcggatccggccgcatcctgctgctgttccccattcgtcggtcgttgccagtccatggattcttaaccaattcttccccaagcttcttccttgcctgggagcagctagctgcatcctgttaaataatagctctagcgtgcggggggaggccgcgatggcgtccagggacttcctgcgcgtcttcggggcaggggcgggccaccaggacgacgccgccgccgccgccggccggacagacgacgtcgagctcagcctcggtctctccctgggcggccgcttcggcaccaccgacgccaagcgcccgcgcctggcgcgctcctcctccatcgcctccgtctgctccgtctcctccctccacgccgacgccgacgccgcgccgctgccgctgctgcgcaccacctcgctgcccaccgagaccgaggaggagcgctggcgccgccgcgagacgcagagccgccgccgcctcgaggcccggcagaagcgcgtcgagcgccgcaactccatggcctccctggcgcccgctgtcgtcggcgggaccgggaggaggtccaacgcctcgcaggggagcaactctgccagcaccacggagcaaggtattggtgggagcgcgactaaccaatccacagacgcgaggagtccatcgtcaacctctgataataatacaaatcaaaacaacatgcttcctccgacgactaaagcagccgagaagccactaaacggcactgcgacagagcagccgcagccgcagactcgcctgcggacgcttgggtccctgacgacgcggacgagcagtaccggcgacatcaggaagctcatgatggaggacatgccgatggtgtcgtccaaggtagaggggcctaacgccaggaggatcgacggcttcctgtacaggtacaagaagggcgaggacgtgaggatagtgtgcgtctgccatggcagcttcctcacccccgcggagttcgttaagcacgctggcggcggtgacgtatcgaacccgcttcgacatatcgtcgtcaaccctgcgccgttctcgtgaagagggagggttacgctgttgctgctggtatcgatcgtgctgtaacatgttgtagtaggctccttgtttccgggagttcaatggaaggtctctctctatatttgacatggattgagtgtgacagcaaatccaagagaaacatcatctacaaatgttagacttgtctacaaattgacaaggattcaggttgctggcttacagcatttgcctgttctttgtcattaaaaaaaactccaaatcactttaattttcacaaagataatgtaccctttttaaaaaaaannnnaaaaaataaaannaaaagaataatnaaaaannaaaaaacaaaaaccaanaaaaaaaaaaaaa

SEQ ID NO: 4184 - DNA, 2628 bp, Zea mays
cgtcggggcggtggcccacagcccactcaacagcaacacgtgtcggcgcggtccggccagacacgtggtcgcccccctccttgcccgcccaccaaacacccgacccagccagctaggggagccacagcaagaaatgcaggccttcccttttgctgcccaaccccaatcatagagcggaacggacggagtgggtgcaaatcggattagacggccacgtcccccccgagcctcaccaatcgccggccctccgcaggcagggaagggcggttgggcggccggccggccggagatctgattgctcttatcttctcccctcccgttcatccaatctgctgtcaccatatctgatctccctctccccctgattgcccgcggtggccattgcctcgctcgcgtctccttcgccgcgcttctaggaagattcggcggcgtgcccatttgtcggtcgtagccttaaccagttcttccccaactccgagctccttccttgcttgggagcagctgcacacacatccgcccaggatattagttagcgtggaggatggcgtccagggacttcctccgcgtcttcggcgccggtgagggggcgggcccgccgggggacgccggcgccggccagcccgacgacgacgagctcagcctcggcctctccctgggcggccgcttcggcaccgacgccaagcgcccgcgcctggcgcgctcctcctccatcgcctccgtctgctccgtctcctctctccacgccgacccgtcccccgccgcgccgctgccgctgctgcgcaccacctcgctgcccaccgagaccgaggaggagcgctggcgccgacgcgagatgcagagccgccgccgcctcgaggcgcgccggaagcgcgtcgagcgacgcaactccatgggctccgtctccgtggcacccgccgacgccgtcagcgggaggaggtccaacgcctcgcaggggagcaactctgcaagcaccacggagcaaggtatacacgaatggatcgtcgtatcatgtcctcaactgctgcccttcaattgcttgtgtttgcttaacatgcttctcatgttcagctacagctaccatggttttctagttgctgctgctgctgctgcttcatggctccagtgcttgttttcaaaacatcacggcttgctatgctttagtcagcaacttagtgttctacaccatatttcggcaggagaacggttaaaaaatccgactcaagcaaactgcatgcttggttgttctgttgtggatatcttggatttgatcctgtaactacacctcgattgccttaaggataaccacctgcaccctcaatttacttagttttgcttggatcacagttgtaggatgtgttaacatgtgatccaaaaaatttaatctattgcctggaagctcttgtcaagttcataagcttacaccatttgcctaggttagctgaactctcagtacttggttatctgacatctgtcccctttggagacagtctcctgggaattcagttactgtttggctatctctggtcttgacaaagggcatttagatttaaattaatttgccagtgcgaattggtccaacagtctgcgggcaattatcttgatgtttgccatgtaagactggaagtgacgctttaacttttggtcaatatagtcactgttttctgaatcatggtaagctaatacacatacaattcaaaacttccacatgcctgcatttgcaaactgcttatcaaaagttccattcatttaaaacgttgacctgttaattctttctgaagtttgttgttgaagtacaacatggtatttcgattgacattccaatctattgttagtgcttggaccaaatagttctgcattattcttgcgatgcttgtgccgttgataaaaaggagaacaaatgccgttgataaaaaggagaacaaactgttcctccaggttctgcttgcattttctccatcaaagaatatcaaaacatttgctgttgtattcccaggtattggtggaagcatgtttaaccaatccgcagacgcgaagagtccatctacctctgataatagaaatcaaaacgacatgcttcctccgaccaaagcggccgagaagccactaaacggtactgcgacagagcagcagcctcgcctacggacgcttgggtccctcacgacacggacgggcagcaccagtgacatcagaaagctcatgatggaggacatgccaatggtctcatccaaggtagaagggcccaacgccaggaggatcgacggcttcctgtacaggtacaagaaaggcgaggatgtgaggatagtgtgcgtctgccatggtagcttcctcactcccgcggagtttgttaagcacgcggggggcggtgatgtgccgaatccgcttcggcatattgtcgtcaaccctgcgcccttctcgtgaagagagagggttacgctggtgctgctatctgctgtgctgtaacatgtaggctcctttgtttctgggagttcaacggaaggtctctgtatttttacataaatcgagtgtgacagcaaattcaagagaaaaaaatatcatctgcaaatgttataggcttgtctaaaaaatgacaaggattcagtagcaatgctttgctagctggttttaaca

SEQ ID NO: 4185 - DNA, 1115 bp, Zea mays
gggtacctcgaggccggccggggtccagctgcaaataacggggcctcccgccacgcaggccggcccaacgattccacccacaccgaatcttgacggaacgattccaccaagaaccgcgggcaacaattcacaccgcgcttctcttctccagcgatgcagacgacggcggcggcggctgtggcatgggcgcctggcccatcggcgtccacctcgtcatcgtcctcgccgtccaccttcagggtgggggttgcgtcgacggccgtgcgggcttgttccgcgcccaggcttgttgcgtcctccgcgcccctgggctgtcgacggctgcgacaagtggttcaagctgttgccaatccagaccctgcgatcgagcttccattgactgctgaaaatgttgagatggtgttggatgaagtaaggccgtatcttatggcagacggaggcaatgttgcgttgcatgagattgatgggaacgtggtaaggttaaagctgcaaggagcatgtggttcatgcccggcttcagtaacaacgatgaagatgggtattgaacggcgcttgatggagaaaataccagagattgttgcagttgagcccattgctgatgaggaaactggccttgagttgaaccaagagaacattgaaaaggtacttgacgagattaggccataccttgctggcacaggaggtggcgagctcgagtttgtcacaatcgaggagcctattgtcaaggttaggcttacaggcccagctgctggtgtgatgactgtccgagtagcattgactcagaagctccgtgaaaaaatccctaaaattgcagctgtccagcttttgccataagattagaatcttttagaagccaggcaccagtcacagttgataatgtaaatgaactaccgcaataaatttaaggagttgtaatgtgtagcctgctgagcatttagctcctcttcagcgatattatgatcatcgatacacaatgttcaagtaaaggtgttcgttggatttgtaaccagagttttggtttttgtctgtatgacctgtattctcgttaatcacgatggaagaaactaaatcaggtcaaaaaaaaaatccgtaaaaaaaaaaaaaaaaaagtacct

SEQ ID NO: 4186 - DNA, 2685 bp, Zea mays
  misc_feature (1958)..(1958): n is a, c, g, or t
acaactagaacatatgtgtgatgcatttaattgagaaaaatacacataaaacatcacatctagaacttaagcgcctagagctttggaataaaaacatcaatgacttaaactaaaataatcaattatataaaaaataaattataagatcatggtgtgtgcattattccaaatatctctcctgaagaacattcctgaagaacatgccctttgaaagtaattctaaccgtctaatccaatccactaatcttatgcttgaatagatgagatcatctcctgaaaaggcatctgttagtgaagaggtgtcgtttcacaacaatatcaaacacatgtactgaagaaaacgaatgttgggttgacacttctattgcaacccatgccacagatgggttagggtctgtttgtcttagcttataatctgtccagattatacaatctggcttaaataatctagactcactacctatagcaacttcagaagatattactcaccattgtcactccttacctaaaaaaatgtttcatctatttttttcttgctcccaccacgcaacatatgactaaaatcaataattgaatttttcaataaactaggttgccaaacagctacacccaaataatctaatctagattatataatccagatcctttaatctcatataaatctataaactgaaacaaacagacccttaatcctgcacatctacttaaggaaacaaatgtctggactctggatgacactggttcctgcagcccatgttgcagcctttgcagcacatctactgaagaaaacgaatgtctggatggcacttgttcctgcagcccatgtcgcaggcgttgcagcagatggttaatcctggctttcgctccagaacctccgcaattgtcaggctgcagccacgacgttgagctacattcttaccgatgccaagccaccgcagtcctcggaacagcggcggctcaaagtgtctcaggaagtttcgagacagtttgctgcagtaggcaagatcaagcattctcagggggcatttactggagtcgcatcccatagaacctagcacctcgagagatgaatcggttatgaggaggcagttccgcagacacaggctgcttatctgctcacagttcttagcaatcactgtcacagcccgacatgatattcttggcacatttccgatgtcaagcgaaactaatgtcttgttgatggtgccagccccgcacaacagtgaagctattccattactgctgatccttctgcaacctctcaagcacaaagaagatatcaagcacctcccattaccgagtgccgataaacccacatcagtaatgtcagctccagcaaggtccagtagagttaggttgggaagctgtgagatggaaaccaagccagagtctgcaatgctcttgcaacccgaaagatcaagaacctttaagttagtgcagggtgctagagatatggctgtatcactggttaggagagcacagttaagcaacctcacttctgtaatatttggagctgccttatcaagatctaggcatgccaagtctgacaagcaccagccattgctgacctcaaacttcttcaggtcctttccagagtggagaagggctgcataccctgcatcacttactttagaaaacccaccaagtctaatggttctcagttgcttgcatccgtcagcaagcatcagtatcccaaagtcgtttacccgtctgaagtcataggaacgtcgtgtcagagacaaatgtttcaagttgtggcacaagccaagtgcttgaagccccacattggtcaaatcttcaggcaaatttggttgggtatcaggttcatcttccaggcatagctcagacaacttatggacattactggtgatcaacataacgagttcatccgttaccatgtcaagaactaaagagagtgattccaagttgtcagtgatgtgtttgttcagagatgtggnttttcaggaagaccgtctttgccctagaatgagatacaggttgtagcaacaggtccttgatgttactaggaatgagaggtgatccagccttgtaactgcgaaaagtggtgagtggatctagcagagggaacttcacccaaagagtctgtattgaacattggaaaaaaaaaatactgcttagaccaagcagccaaatgctcaataacattattcaaaggctacagttaatcatatgcagttccatgtaaagcttggaaatcgaaagacaatgaaagcaaccaattatttctacaaaattgccatgtttctaggtgaggaagaatatcatatccatatcagacaaatatctcacctccaagtgaacacatcccacgtagacaggtgctaggcaaggatatagagtgtatggacaaaccgccatctccagcttcaacgatctacattcaaacttgggttaaagaatgcttggacttgtcaatcactatggcttgaaagcaatagcccaaactccagaccattacttgtatagttcaatttcataacttgcatccgcgtgcatacacaaaaacatgaaccagaaagtgctgaagaagcacaccttaaatcgtggcatgccccaccaagagccacaaagaagctcatcgagaaggagcatttgagcagcgagaggtcgcgcaggctacccctggcgatgacggaggcggcggagtcgtcgaggaggctgcag

SEQ ID NO: 4187 - DNA, 1922 bp, Zea mays
  misc_feature (1872)..(1872): n is a, c, g, or t
  misc_feature (1896)..(1896): n is a, c, g, or t
cagagttagaaaaaaacgaatattccttgtcctgcgaatattccatgactgcgctgccggagttgggatactacattttgcctaacttttctgcctaaggttagttcttcaattcaaacgactaaccttagacaaagtgtgacatagttagccacgaaccaaacaggccctacaactcgtagtacgtgtttgctgacattgttcgtgctcctcggtcggttcccctctcccggtcaccgtgagactagacctatagacgtacgaagtactacgcgtctcgggttctcggcggttcatgctgcgtttgcgctggacgcagctgcaaacgaggccttcattccattccattccgcttcatttacatactcgccacgactaggccagggtggttggattcaccaccggtattcgtttttattgccacatgtgtgtatgccgccgcctgacgaaccttttgcggccatgcatggacagccatgacctgcatgcagcccttgaagcacctctcccccccggaccgctctcatctgcataatacacttgcggtactgagagcaactccaagagtttagatataatcttagctaaatttagagttttatgagcgcccgcatgaaagaagggagatggcgaggcggacgagctagccaaagatgccgagtgaactggacaagataccgagtagaatagaatagcgaagaagaaggatagcttgttggattgagttttgaacatcatttttctacttgtactgatgcttatcaatttagttaatctcttggagttgctcttataaatgcgcggcgatcaacccatgaagcaaacctcgcatgcatggtggcgttcacgtggttgttggcgcggccatgatgctcttgctggacgaggagctggtcagcctcagtgccctcatggtgctcgctagcacccaagcctagctccagtggctccacgagccggtgccccttgtgctcccgccgttcttgtcgttgggtgccgagagccagtaggatgacgaaggcggggccgcagtgcctaggcagccaccgaagaactcgacgcacttgacgcggtggtgctggtcctgttcgtgttcctcgccgacgccctggtagcctagcgcgtccgcggccttgggcttggccgcttgggggcttgcagtgagactgtgggagtcgacgcggtggagcgtgcagccgccaaagccgatggagaggcgctccaggccaggaagtctcccgagaagctgtggctgtcgcagccgactgagcgcgacctcgccaccttccgtccgaaacgacgggcgatgacaacgagccctcggcccctcgctgcggcgggagggtgtgcgagaacagaaatacgtgagcgcccgcatgaaagaagggagatggcgaggcggacgagctagccaaagatgccgagtgaactggacagataccgagtagaatagaatagcgaagaagaaggatagcttgttggattgagttttgaacattatttttctatttttactgatgctcatcaatttagctaatttcttggagttgctcgattgtccattctctgaatgccaagtttcctttttttttcccaggtggtccctgatcgccggtcatttgcctggccgaactgacaacgagatcaagaaccactggaactcgcacctgcgcaggcgcgggcgggcgggcgactcccgcgacgacggcgtcgtcgtcaacatcgacctcgtcaagctgcccggcggccgccgggccagcagccgaggcatcgtggccgcggccaagccagctggaaagaacaaggagaagaggaagaacggcaaagggcaggaacaacgtagcagaagcggagcagcagctcgaggaggangacgccaacgtgtcaacaactacnccgaggactcagtctcactgcgcctc

SEQ ID NO: 4188 - DNA, 637 bp, Zea mays
cccaaactcaatccctctctggattcaatccttctctggaatgaaaacctgtcaaccgaacatggccggacggggcatccgaccgcgacgaatctctggcctcccaccgccgccgctacgaatctctagcctcccactgccgccgcgacgtccagctctgctctgctccgacgcccagctctggcttgccgtcctccgcgcgtactccgcgctactggatctctggcttgctcgtaccggatctctggtgtgtacaggatcgcaggacatccactgctcgtcctccgcgctactggatctctggcttgccgtcctcagcgcgtcgtccccatctctggcttgagtgtgttaagtggaagcaacacatgaagcggatatggagaaggaagctggtatgaaactaaaacgcattaagttgacatgtggcgtgcatgttttagatgtcttattctactgccaaacttcctaatactccatttttatattataatgtctatctgtacgtgtgaatggagataatgatattatgtgatgtgatgatggatagattagcttcgttgaatattacatgatattatgtgatggtgatattaagtggaaaaaaaaaaaaaaaaaaccgcccaaaaaaaggccccta

SEQ ID NO: 4189 - DNA, 4702 bp, Zea mays
gtctgcggtatgggcggcaaacttgcctgcacggcggcaagatgagcatgtgatccaccagatcacgagatgattgattaacaggcaacttgccactggatgcctttgcttgcctccaaccccaggttcccaagtagttgcatataatcaccccgatacaatataatcatgtcattgcacggttcatctgtgaaaataatgatagtcctgctgtcatgtctcggctctgaatcaataatgcatcttctgcccaagcatattgagaacgagagcatgcaaagtggccagtaggatttttgcttcgtcgaagaaaaaaacattaagtcaaattatatgaaagaataaaagaattgcagtctagagagtggttgttgaaagcctattttctcatctacccatatgattttatgtgatcctccaaaggatccaccaatctttttttttcatgcaaaaaggattcgctaatcatataaatagatgttaaataaacagggcaggaaatgtacatagcaactttaaaatgttcagagaagttcgtatgtatatacataccatagttactttattatgcatgtgtgccagtgtgcggcgttatggctgttttgattttctgggactgatccattcactcatgaaagtatgaaacaaggacgtacggatgattgagcaaggattcaaatggaccatggtggaaacacagcaacagagagaaaatagcagagtggagcactgtttttgcttttcttttcttttccatacttcctttccctcttcatttcaagcattagagctggacagtgcttgcagcctgtcttcctgtctggccaattcatgttgcgaaatgccaatgttgtccaacatcaaccccacagaaaatgtggtatgtcctaacaaaagatgcaactgaaacatgacagcaatgttgtggaagcataatgtgcacgtagatgtaacccaaactacatccttgtgtacttgtttgcctccaacaatcgagatatgacaggctcatacgttatttattgtctgaaccgacagactattcagaataaaagaatcaacctgccgcagagatggacagcaagctcacaagcaaatggactggcatgattcttcttgtctgctggttcaactgtgtgttgcttccacttctttcattatatatagagagagaagcccacggagagtagacaccattagagcagcattcctctcccctccaaaagaagagagcgctgcatttttcgccccaagcatggcttaccgtacaagatctgcgagtgcgccttccagccgttgctccaacgaacccagcatcgaggatcagctgcagattcattaacgaaaccatccgaggaggcttggaagtgtgtctacaacgacatttaggagatcatgtgcttgactagcaaccaagtcagcctgtgccaaccaaagcaaaggaaagcagtggaggacgaggttgagcgcgcgctccctctctctctcctgttgcttgatttcttcggtgccatgcaagagagcaagctcgagcattcaggagacaggaggtgcaactgattatcaaaaggggagacgttgaagccaagattcagtttcgaaccctaaatatgctttgtaaagaagatgcagagagctggaggaggttcaagaagattaacaataggtctaccttcagctaaccaggagagctgcagggtggtcaagctgttgggtgaagctagagatattgctgtctcaattctcgagtcctcgtcacatttcctgtcaaagcagattgcagcaaagttctagcaagtggtctttcaaccacaagacatttcctaaagagaagagttctatgtgaagtggatcagttacaagcctaaagccttggagttggacattgtatatcttcagtgtagatttgggactttgttctaaaaaaaaactatccaaagcagagtttcccttctcaacactctcagcttgtagatagatgtaccaactcaaccctttggcaccccccttttagatgatcagctggtcactgcacatatatgagaaatattgtacagaaaaacagtcacttggaaacagaaacgtaattttgaacttgttttatgttataaaccatatggtacaatgacccaagtttgtagcatccatcaagaaaatactttattaagaacaaatgatgctccaaaggtgctcaataccagtgacagttattaaagtagctagttgttagggtgcgttcttcaagttgataattgcatgtctttattatgacatgcccacgttgctgagatgcaatatgttgcctcagcaacaagcagcagatccttgtccagtggatcttgctaactataactaaaacaaaccagctcctgcacacgaggtagagcgtgtaagtagcatgagccatgagttgcgcagagtaaaatacctactgccatctgcgactgcgcagcaaccatacaacacgtacttcaccaataatacttggtctgcgaccactaaactaatcccaggagcatgcaattgtgtcaagatcaagattgtccagtggagtaactaacctgttgattcttgttgccgccattagttggagcatggcaatgtgatagatcactgggagagtgggagaatagctggcacactaaaaagaatgataaacacacgccgcgtggtgaaggaaacagattccttatgctgctgccagatctcaaaccttgagagacaacactgaggagatgaaatggcaggattctctttgtctaccattcaaaagatgctgcctcataccctctgtctataaatagggtctcgccagagcctgccggcatcaaccaaagattttcgcttctcattacttcacctcatttcaatatacatccagccagagactagagatcgacatggcttgccatcttaggtcgataagcttgccgtctaggcctcagtccggcgaagccgcagtgcagcaagagctgtgtattctagatgcaatcatctcctcgccatcaacatgtatcgtcacgatgtgtgacggtttgaggaggcttggagacatctacaacagcgttgtggagatgactcacttgccaagcaaccaagtctgctcttcccagcaaaggaagatgctggatggagaaatcgaatcttccctcgagctgctggatctctgcaacaccatgcaagagatctttgttgagttgaaggccatcatccaagagctgcaagtggctctaagaaaaggggatggcgcaaccgtccaagccaagatccagtcctacagccgcttggtgaagaaggctaagcagtctttcaagaagtcaagcaagaaggccgtttctgacaaggcagactgtgcagtggtcaggctcctgaccaaggccagggagatcgccatctctctacttgagaccacggtgcagctcctgtcaaagcaaattgaggtgccgaagcagtcacttgtctcaaaggcgttttccaagagaaaagcagttgtctgcgaggaggaccagttacaggcgttagagtgcagcgttggagatctcgagagcggagcgtggacacctgttcaggatattggtccagagcagggtctctctcctgaacatccttagctcatagacactccttgttgctcttgacatcctgtgattggcatccgcgtttttgaggattagctaatcttgatgcagttttgtaatatgtatagagtacaaatgtatagggggggaaatcggaaaggaaaaaaaaagacacagttttgatccaattcatttttgttgacgtgattttgtgcattcagtaaggattgctttgttttcggatgcttaatttgtggatcttgccctgcgtacaagaagcatgccagatcacagccacaatggttaagctgaaatagcagaataaattaatcatccagattccccctaccacgttggtgcagtaaaccaaatttcagccgccctaaaccagctgaatcagccaagttgaaggcgaggcaaaggtgcgtgtcgcccttacagatcgggaggagccaaatggcatggtccgtaccagacggagttgtgtagggactagggagctttgggggtcagtgatagaattcaacttcccgtcccctgaattggctccgccgcggctttcgaattgtagagcgctcctcgcggtcctcccacccgtttcgtcctcgtcgtcgggcgtcggcgaccccgccgccttctccacctcgaggccacggactcggctactcagcgttgcattggtggtggggtggcaccggactttatcccgccgccgccggacggcgactgcccgacggtcctactcgctgcgaatgtgttccctgaaaatgagattccatccttagtagagtggtagagcgatgattttgatggcaacgtgtaaggttcaggagatgttcctcatgtcaaatcaaacaaaaaatggaggtgaaagataccatggcaatagcaatgtggtatcaggctgcctattcccaataccatcaaaaacatctcggaacaaggttcgtgcgtgatgcgagagcaaagcataggtagcatgaccaaaagtgaaccaaccccttggtctgctacgaaaaacaccatctgatttcaaagtagctcgatctaattcaaaaatttcccctaattgagcacgctgcgcatatttttttttacagtagtaggatcagaataacttactc

SEQ ID NO: 4190 - DNA, 2290 bp, Zea mays
tgcttttaatagggtggcaaaagctttgccatagatttattagaagaataacataaaaagaacatagcagaatggagcactgttcttctcacattcgctttccctcttcatttcaagcatcagagctggtcagctggacagtgcttgcagactgtcttcttatctggccaagccatgtcgcgaaatgccaatgtaggtccaacatcagccctgcagaaaatgtgcccaggcatgcatggagatgctgaaacatgacagcaacgttgcatagcaatgttagctatcctgaaatgttgaagcatcatgtgcacgatgtagatctgatccaaaaaatgcatcttgtgtacgtgtttgcctccaatgattgagacatgacaggcttatacactatttagatgcctgaatcaataaattatccaaaagaaaataatcgtcctgtcgtagagatgggcagcaaagtcacaagcaactcaaccggcaagattcttcttgtctgctgattcacgtgtgtgatggttctacttctttcattatatatagagagacaccattagaacaccatacccttaccttcttctctagaaggaagatagcactgcagtttttgctgcaagaatggcttgccatctaagatctccaagtgcgctttctagcccttatatatccagagacaccattagagcaccatacccttcccttctctaaaaggaagacagcactgcagtttttgctccaagagtggcttcaagatctgcaagtgcactttctagcagttgctctcgctccaatgaaatcagtgttgaggaccagttgcagagcacaaggaaactgtatcttcagcctcttcaaccattgcaacaatttacgtgttttggagaggtttggaagcgtgttcaacggcattgaggagactatgtccttgcctagcagccaagtcaaccctcgccaatctaagaaaaggaaagcagcggaggatgagctcgagcactcttttctgctactcgatctttgcagcgccatgcgtgcgagagagcacctcaggtattaaggtgggtggccatgaaaaacaattggttgtaaaaagaggagaaaacgcagaaattgaatccaacattcagtttcagtcctatatccgctttgcaaagaagatccagaagcagttcaagaagatcagtgaacagtctacttcagccaaccaggagagctgcaggatactcaagcgggtgaaactagagacactgatagctcaaatcaccagccctactcacatatcatattgaatttaattgcagtgcaaagttctagagtggtctctcatcctccataagacattccaggagagcagagttccatgtgaagtggagcaattagaggtcttggagatagaaattgttgatctggaggctttgttcacaaagctgatccaaagcacattttcccttctcaacactgtcagcttgaagatagtcgtatcaactctgagcctgtcacatctgatttgaggattagctgatccctctatataagaagaattgtacaacaaaactgtcatttttttccaaattagggtctcctttccatcactgaatgcaaaagtcaattgaaaaaaaacattttggatgtgcgtgcgcgagtgtgatacaatgacccaaataagcatttgttcagatttttttaaatgctactccaaagatgcttgacatcagtgattgttattaaagtagttagggcgcactgtccaagttgatatttgcatggctttattatgagatggccacgttgctcagatgcaacatgttgcctctgcaacaagcagcagatccttgtccagtggatctggctatctacagccaaagcaagccagctccaacacacgaagtggagcgtgtaagtagcatgagctgtgcagaataaaatacctgctggcattggcgattgcgcaactacgtaacacgcacttcaccagtaatattgggttagagatcaataaactaatccgtggagcatgcaattgcgtcaagattggccagtagagtaactaatctgttgattcttgttgccaatagttggagcatcacaatgtgatagatcactgggagaatagctggcacactaaaaaattgataaacacacgcgtgatgaaggaaacagattccttatgctgctgccagatctcaaaccttgatagacaacactgaggagatcaagatggcaggattctctttgtctacccttcaaaagatgctgactcataccctcgctctataaaataggtcttggcaaaggcttg

SEQ ID NO: 4191 - DNA, 4185 bp, Zea mays
  misc_feature (858)..(858): n is a, c, g, or t
ctgtctggttatttgttctctgcacataacaatatcatacacccatactctgctcttcgatcaaagactacagtaagtctgttgagctactagcagtagcacagtgagatggccgcgtgaaaatatagagaacatatcatgagatgaatttaagatgtgattatgttagcttcttaaaaagggtgtgcatgataacttttatatacagaaactaagtgtcagtacacaggttttccaacaggtgtcagtacactttagtttttcttacactttagtttttcttaggatggactctaatcaggatagcagcctgcagtaggagttaaaaaaacgccatacattatttcattcatggccaaatgtgttttcaaagttttttaaatagttgacaaagacagttagatttcagaatgggtagagttggcctacctcttgctcaaaaatacagtcagcttgaaaacagatacacaatttcggaccacttcttgttgttttactgttataaatcatatgatacaatacaatgacccaagcttggagcatccatccagaaattctttattaagaaaaaaaatgatgctcctaaattaaagatgctccatactgggggcagttattaaagtagttagggcgcgctgttttcaaatacctactgcatgcgcaataactgtataacacgtatttctccaataatacttggttagcgatgactaaactaatctcaggagcatgcaattgtgtcaagattgtccagtggagagtaactaacctgttgattagtgtcgccaacagttgaagcatgacaatgtgatggatcactgagagaatagctggcaactctaaaaaaatgatgaacanacgcggcgtgatgaaggaaacagattccttatgctgctgccagatctcaaaccttgagagacagcactgaggagatgaaatggcaggattctctttgtctatcattcaaaagatgctgcctcataccctctgtgtataaatagggtctcgatcggcagagacttgaatcatcaggcaaaaaagttcgcttctcatattacttctacctcatttcaaacacacaagaacttccagccagagactacaggtcgatatggcttgccatcttaggtccataagcttgccgtccaggcctcagtccagcgaagccgcagtgcagcaagagatgtgtattctagaggcgatcatctcctcaccatcaacatgtatcgtcacgatgtgtgacggtttgaggaggcttggagacatctacagcagtgttgtggagatgactcacttgccgagcaaccaggtttgctcttcccagcaaaggaagatgctggacggagaaactgagtcttctctcgagctgctggatctctgcaacaccatgcaggagatcttcgttgagttgaaggccattatccaagagttgcaagtggctctaagaaaaggggatggtgcaaccgtccaggccaagatccagtcttacagccgcttggtgaagaaggctaagcagtctttcaagaagtcaagcaagaaggccgtttctgacaagacagactgtgcaatggtcaggctactgaccaaggccagggatatcgccatctctctacttgagtccacggtgcagctcttgtcaaagcaaattgaagtgccgaagcagtcacttgtctcaaaggcgttttccaagagaaaagcagttgtctgcgaggaggaccagttacaggcgttagagtgcagcattggagatcttgagagcggagcgggacacctgttcaggatattagtctagagcagggtctctctcctaaacattcttagctcatagatactccttgttgcttttgacatcctgtgattggcatcatccgcatttttgaggattagctaatcttgatgctgctttacaatatgtatatagagtacaaatgtatatgaaaaaatcggaaatgaaaaaaaggacagttttgatccaattccttttttgttgacgtggttttgtgcattcagtatggatcgctttgttttcagatccttggttagtggatcttgtccttcatacaagaagcatgccagatcacagccacaatggttaagccgagatagcagaataaattagtcatccagatccaagtatgtaaacagcaatacgaagggcattcgagtctgtaaaatatacgatgatacccaagtctgtaaactgaaaggcattttgtaacttgagatagtacaacgatgttgctattttgagtgctttgtaaattgtaactgcgaatgaagacttctaaacagactggatgcaattcagttaaaggaagatgatgtgactgaatgcaattacaatttccgagtttcagtttcttgctcctgctgtgcctcctcaacgccttgcataactgtaacggcgtcgtgatcctgtgcctctcccatgccttgcacgaacgcaccgatctggtgccccttcatctcctccatgccttgagtgatccttgctgctcggactgtggaacaccggggccatcgctgccccacacatgcccaccaaggacgatcgctgcctcaacctgtagcccatccgcggcataacaagaggtctccatggccgctgcaactgttctgcgggatctgtctccagcagcaggggggcttcgaaggagttaggacaggcggcattcgaagcgatcaatcaccaaaggaagcgctaggtagtagatcatccattaaatgtatctttggtgggataaaatttgatattgatagcatggcaccaaatggtagcaagagctatcaacgtccaacttatcactcaaagagatacgttcttttagtccttacagaaatatgtataaagcctttatcgctccacatattgtacaacaaaatcacctcatctgaaagctaaaattacctttgaaaattaagatattcatgtggtatttcatcaagaacattgctctaactaaagatgatctagcgagaaaacattggaaaggaagtatgaagtgttgtggatgcagtttaaatgaatctgttcagcatctcttcttggattgttctattgctacatgcatttggagaggggtacaaatcttctttaacatatcaccacctttaagcatacatcatatgtttagaaattggttgaatggagtggatgatacacttaagtacaaaatctgggaaggagcatgcaccttgtgttgggtaatgtggctatatcgaaatgacatgatttttaggacaggtgtacgatatacgtataaccatctgtcttcatttatgtgatacttgtattgtgtcaaggaatttgtatagcgcccgatagggcgctacttattctagtggaatgttgagggcccatccagtttcgtcggcggccatggctggaaaggaggctggaggagaggaatgacaggcgggcccgttcgtcagtgagtgataaactgggccgtgtgggctgtggcattgagagaaggtgggatgaccggatgaggacgcggttgggctgtccacctatgcggcggttgggccagcagtccgaaagggagagcacgcgccattggccttggtgggcagcgcagctgggctccatcttaggaagaagaacgaaactggaccgcctgttagcgagccgagctagaccaggggggaggatggaaaaataaaagaaagataacataagggctaatttgggaaccatttttccaagagaaaatatttcattttccctcgagaaaataaaaatccgttagaaaaatagaattcccaaactagtcctaaacattaaggttttgggttgtattttgaaatgatttcagcacaagagaagttttaacctttttataggttttgcaaaatagttttctaacacaattaaaagtttgaggtttaaactttttaaaataaagtaaactattttaaagaaatcttttgaaactttttaagtttaggatatagagaaaacatatttgtggtttaaatgaatttttcaatatattttgcagttaattaaataaatttcaccaacatgaatgcaacatctcttggaaaacctttataatacattttattacaaattaactaaactttgaaaaaaggaaaattattaaatattttatttaaattagcgttttctaaatctctctctcccacgcgcgcatatatatatatatatatatatatata

SEQ ID NO: 4192 - DNA, 527 bp, Zea mays
  misc_feature (516)..(516): n is a, c, g, or t
  misc_feature (522)..(522): n is a, c, g, or t
ttttctcccctctccggtgtcctgtccttccctccctgccatattttaagcagggccgaggcgagctcccagatgcaaacatcctcctctcctcgcagacatcttatcccctcccgatcgaggcccccgtttcctcctcctccggccaccgcacctagctgtcttaacttgccgttcgcagcctcacgcccatggctaggaagtgctctagctgtgggaacaacggccacaactcgaggacctgcagcgggcacggcgccgggggcgggggcgtgaggctgttcggggtgcagctgcacgtggggtcctcgcccgtggccatgaagaagtgcttcagcatggagtgcctgtcgtcgtcggcgtccgccgcgccggcgtactacgcggccgctctcgccgcgaccaacagcgcctcgcctgtcggcctcctcctcctcgtcgctcgtctcggtggaggaggcccccgagaagatggcccacgggtacctctccgacgggctcatgggcagggcggcncaggangagga

SEQ ID NO: 4193 - DNA, 1172 bp, Zea mays
cgaccctcccccgcctctatataggccatgggtggcgcactcggggccgagcatcagctgcgctgctcaccaggaaggccatctcatccatccttcattgtattgtagtggcatcaccaggaacagcccagccgcaagaagacagacgacagcagcgagtggggatcggaagaaagaggaagcggagacgaaggtgagagagagaggcaaaagggcagccatgacgatgaagcagtcgaggttcaagaggatctgcgtcttctgtggcagcagccaggggaagaaggcgagctaccatgacgccgccgttgagctcggcaaccagctggttgcccggagcatcgacctggtgtacggcggcggcagcatcgggctcatgggcctcgtctcccaggccgtctacggcggcggacggcacgtcatcggggtcattcccaagacgctcatgacaccagagataagcggcgagacagtcggggaggtgcgggcggtggccgacatgcaccagaggaaggcggagatggcgcggcagtccgacgcattcgtcgccctgcctggagggtatggcacgctggaggagctgctggaggtcatcacgtgggcgcagctgggcatccaccacaagccggtcgggctgctgaacgtggacggctactacaactcgctgctgaccttcatcgacaaggccgtggaggagggcttcatcaaccccagcgcccgccgcatcatcgtgctcgcgcccaccgcgcaggagctcatggacaagctcgaggagtacgagccttaccacgacagggtggcgtccacgctcaactgggagaccaccatggaccacctggcctactgacgcccacgccgccagagccgccagcagacaactgggacatctctgatccatcggtggcattcaggaaacatgcttttagcttgccgtcagattgggacttttgtttcgtttttaactgcatgcagatcggtttaatttggagtgccggagggagagaaaaaaaaaacaggttgattattcggttcgcgtagcaggagtacgtagtacgtgcttgttttgtgtatatggtgccttgtgtttgcttcccgccaacggggatgattgatggcttgcagtgttgtctctgtaccagttcaaaaaaaaaaaaacccgaccggtttcccct

SEQ ID NO: 4194 - DNA, 2715 bp, Zea mays
aaattccacatcatatgtttcttctaccacgccagtggcatggttgaatactcgatatgctttggactttaatgaataacccaaaagaaaaccaatatcacaacgtctttgaaacttccctagatgatggcgttttttgtagatgtagcatttgcacccaaacacccggaagaaagagacgtctggctttttcccatttagcagttcataaggagtcttcgcaagtagccggtgaggaaatagcctgtttgatgcatagcaagcagtgttgacagcttcggcccaaaacctctccggtgtgttatactcatcaatcattgttcttgcaagagtgatcaaggtcctatttttcctttcaacaactccattttgttgaggtgtatatgtggcagatacttcatgcttgatcccaatttcatcacagtactcatgaatgttggtgttgtcaaattctttgccattgtcacttctaatcttcttaatcttgcaatcaaattcattttgtgctttcttggcaaacttcttgaatatagatgcaacttcagatttgtcatggagaaagaacacccaagtgtatcttgagaagtcatcaacaatcactagacagtagaggttgccaccggcactgacataatttgtaggtccaaataaatccatatgaagtagttccagtggccttgatgttgacatgaaagctttagtgggatgtgtattagcaacctgctttccagcttgacatgcactgcatggcttgtctttttcaaataccacatcctttaatcctctaaccatatctttctttaataccttcttgagtgtgctcatcccaacatgtgcaagcctcctatgccaaagccatccaagagaagctttggtgaagaggcaagttcttaagtctgcatcttctgaagtgaaatccactaagtagaggttgttgtatctaaatcccttgaataccattgattcatcatccatttttgttacaataacctctgatggagtgaataagcattgaagtccaagatcacagagttgtcccactgataataaattgaagctcaaaggtgcaactaagagaacatttgatattgataagtcatttgagattgccaccttgccaagtccttgcacttttccttttgagttgtctccaaatgtgattttatcttgaccatcaacattctcatctaatgaggtgaacatccgtgggttgcctgtcatatgttgtgtgcatccactgtcaataacccaatggctcccaccggtcttgtagttcacctacattcacagacaattcaagcttgagttttgagggccctatattgcataggaccagtgactctctcaattaaggactttgccacccagatttgtctaggtctactcttatttggtggacctaggaatgtaaccttaatctttccatttgcaacctttcttagaacatagtgagcattgaaagcaaatggtcttgagtgcttaggcaagggagttggtggtttagctttgcagttgtgggcaaaatgaccttcatttccacactcaaagcatttgataggcttgtgagtctgctttggcttgtattgagtgatagctttcttttgcacaaaagcattgtatccaataccactcttgttatttttcataacagtgttcataagcagctcattttggaggtattgacccttgttgaacttttgcacacttgttgcaagatgttcattttcactttttagtttcttgacctcattcttaagcctttgattatccactgccaactcattgttgaaatcattgttctcaatagcaacttttcctctagtagttgcatcagtcaagtaattcttcaatttttggttgtctaaagtcaggacttcaactttttcagtcaattcagcatgtagactagtttgctcttcttgaatcaaatcatcacatgaggttgctacatcaagcttaacaacagggttaatagcctcatgtgttttgcaagataaaagttcattttcaacaagaagattgtcatgatcaaatttaatttgagtatagtcttccttgatctttactagtctattttgcaactccctattagcttcatttaatttgtcatatttttccttagcatcttttagggagtttgtgagctcatttacagttgatgacatagttttattttcttcttttatttcatcactagcctttataactatgtcatacttggcatttaaagattcattttcatttttcaacctatcacatttagcttttgactttctaatgatttgagtatattctttaagtaagtcagctaactcatcatatgaaggtgaagcaaattcttcatcactatcactatcactatcatcatcaatattaatatcattttgtaccttccgttcacccctagccatgaggcataggtgagaagtggatgatggcgatggtggtggtgaagagaagtccccggcgatggcggcaactttttcatcattctcttcttcacttgaagaagacccacttgatgattcgatgtcggtgagccagtcgccaacaatatatgcctttccattcttcttcttgtggaacctcttttgctttccatccttcctcttgaagaatttcttttccttcttttcatcatcgctgtcatcttctttcttgccccttgaacttgttcttcttgggcttgttacattgatgagcaagatgaccaag

SEQ ID NO: 4195 - DNA, 3016 bp, Zea mays
ctgacatcgggcgccatgccgccaccaccaccaccctgcgctagcctaggccactggcacccacgccgccaaggccagctgccgacgggcgctttgccaccgtcgccaccaacccacgcaagcctaggacacatgttataaacatgatggaattctctcccgcaatatattcttgttaggctagcacatacaacatattataaacatgatggattatgctttgcgacaatctttacagtgcaacttaagaatgctatgctctaactttatacatttcaactgtctataaatatttaatcaatataatttcattttagtacctaaagtctctgatcttagttgttcaatgaatttaatgtgcatttatcctctgtgcatgtaacgcacaataactgtagggccattttctttcgttgcacaaatgcacacagaatattctgaaattcggtaccccccgtgtcacccagggaaaaagactgggaaggccccatggtcctaggttcaaaatgaagcctcaacatttcatggcttatgtggaatgagtaatgtagtgtagaagatctatctcttggctggcaacaattatctatgtacagactacaaaacgtaacattgatatgacgatatgttaactgagatactcctgaagacaaggtcattggggctgttctgacacaagaaactgaggggaaggagcatgtggtgacatatctaagccgaaggttggtggatgctgaaacaaggtacacttttattgaaaagttatgcttatgcttgttttatgcatgcaccaaatgtagatgttatttactgtctagtcattgcactgtttctggtcaagccgatgtgatcaaatacatgttgcataacccaattatgagtggtagaattggtaagtgggcttatgcactcatagaatatgacttggcctatgaaccattgaaatctatgaaaggccaagtcatagcggatttcattgtagaacatcgggttaatgatattcatgaactagacatgtcatacctcactattactccttggactttatattttgatggatcggtttgcaatgaagggcaaggaattggcattgtgcttgtttcaccaagtaatgtctcctttgacttctctagccgattgaaaacttattgcactaataatcaagctgaatatgaggccctcctattcggtttagaacttttaaatggtatgggagtaaaacatgtgaaggtatttggtgattctcagctggttgtccaacaagtgttagaagaatatcaatgtcttgatggtactctaaatagttatcttgagaaatgttggagcataatccattcttttgacgaattcagtattcggcatatctctagagttgagaatcatagagctaacgatttggcacaagatgcatcaggttatcggataaagagagggaaatttcacaaaactgaaaatctgataaccagtgcagagccaaattcccaggtcgcggaccgtccgcgtgatgacgccggaccgtccggggttaccagaaatgttctcttaatcgattcggctgacaatgaagccgatgcaagtgattggaggacacctatacttaattatttacgaaatcccaatatcaggacagataagaacattcggcgaacagctttcaagtatgttttgatgagtgatgaactttaccgccgaacagtcaatgacgtcctgcttaagtgcttgggcccagatgatgctatattagccatggccgaagtacatgaaggaatttgtggtacccatcaatcagctccaaagatgaagtggttgttgcgaaggtctggtttttattggcctaatatgatagctgattgtttcaagtactacaagggttgccaagtgtgtcaaaaattcggcgacctacagttggtccctgcagccgaattacatcctatcatcaagccttggcctttcagaggatggggattagactttattggagaaattcatccttcatcatcaaaggggcatcggttcgtgttagttgccactgactactttaccaaatggactgaagccgttgctctgaagaacatgacacacaaggaggtaattgagttcataactgagcatattattcatagattcggcattccccagaccttgactacagatcaagggacttcttttatgtcaaaggaggtacgtgaatttgctgaattatacagaattaagctgcttaattcatctccatattatgctcaggccaatggacaggccgagtctagtaataggacattgattaatttgataaaaaagaagatatctgataatcctaaacattggcataagattttgtccgaagctttatgggctcacaggatatctaaacatagtgctactaaagtgtctccttttgagcttgtctatgggcaggaagcagtgttgcctgtggaaataagtttgaatgctgtcaggttcgccagacaaaatgatctaaccatcactgattattataattcaatgatggataatattgatgaggtgaccgacaagagggtgatagctttgggagcaatagaaaaggacaagatcatggtagccagggcctacaacaagaaggtcaaagcaaagtcatttcaagtaggggacctggtgtggaagaccatcctgcctctaaggaataaagaccggaagttcgggaaatggtcgccaagctgggagggtccttataaagtaaaacaggtgatgtctggcaacgcctatttgctacaaacattacaaggcaaggatttgcctaaggctttgaatgggcgtttcctcaaacagtatcatcctagtatgtggcaagatgcctaagagaaccgatgtaatctcatcgagttagttgcttttggtttgctcagctccaccaaaaggcaggggggcatatgttgagcaccgaaatgaggcgcggacggtccgcccctgtgggccggacggtccgcgctcccgccggtccgcgcctgtgggccggacggtccgcgcatgcgcagag

SEQ ID NO: 4196 - DNA, 2579 bp, Zea mays
gcagctcgactctttaggatccccctgaagataaagttattggagtttttctgacacaagaaaccgaaggaaaggagcatgtggtaacctacctaagtcggaggctagtggacgctgaaacaaggtacactttcgttgagaagttatgtctatgcctgttttatgcctgcaccaaatgtaggtgttatttgctttctagtcattgcattgtttctggccaaactgatgtgatcaaatacatgttgcaaaacccgattatgagtgatacaattggtaaatgtgattatacacttatataatatgacttggcctatgaaccattgaaatatatggaaggtcaggtcatagcagattttattgtagaacatcggactgatgatactcataaactagacatatcatacctcactgttactccctggactttatattttgatgaatcagtttgcaatgaagggcaaggaattggcattgtgcttgtttcaccaagtaatgcctctttcgacttctctagccgattaaaaacttattgcactaacaatcaagccgaatatgaggcccttttgttcggcttggaacttttaaataatatgggagtaaaacatgtcaaggcatttggtgattctcagttggttgtccaacatgtattagaagagtgtcaatgttttgatggtactctaaatagttaccttgaaaaatgttggggcataatccattcttttgatgaattcagtattcagcatatctctagagttgagaatcatagagctaacaacttggcacaagatgcatcgggttatcggataaagagagggaatttcacaaaactgaaattctgataaccagtgcagagccaaaatcccaggtcgcggaccgtccgcgtgttgacgccggaccgtccgaggttaccagaaaggttctcttaatcgattcggctgacaatgaagccgatacaagtgattggaggacacctatacttaattatttgcaaaatcccaatatcaggacagataagaacattcggcgaacagctttcaagtatgttttgatgagtgatgaactttaccgccgaacggttaatgatgtcctgcttaagtgcttgggcccagatgatgctatattagccatggccgaagtacatgaaggaatttgtggtacccatcaatcagctccaaagatgaagtggttgttgcgaaggtctggtttttattggcctagtatgacagctgattgtttcaagtactacaaggggtgccaagtgtgtcaaaaattcggcgacctacagttggtccctgcagccgaattacatcctatcatcaagccttggccattcagaggatggggattagactttattggagaaattcatccttcatcatcaaaggggcatcggtttgtgttagttgccactgactacttcaccaaatggactgaagccgttgctctaaagaacatgacacacaaggaggtaattgagtttataactgagcatattattcatagattcggcattccccagaccttaactacagatcaaggtacttcttttatgtcaaaggaggtacgtgaatttgctgaattatacagaattaagctgcttaattcatctccatattatgctcaggccaatggacaggccgagtctagtaataggacattgattaatttgataaaaaagaagatatctgataatcctaaacattggcataagattttgtctgaagctttatgggctcataggatatctaaacatagggctactcaagtgtctccttttgagcttgtctatgggcaggaagcagtgttgcctgtggaaataagtttgaatgctgtcaggttcgccagacaaaatgatttaaatgctactgattattataattcaatgatggataatattgatgaggtgaccgacaagaggatgatagctttgggagcaatagaaaaggacaagatcatggtagccagggcctacaacaagaaggtcaaagcaaaatcatttcaagtaggggacctggtgtggaagactattctgcctctaaggaataaggaccggaagttcgggaaatggtcgccaagctgggagggtccttataaagtaaaacaagtgatgtctggcaacgcctatttgctacaaacattacaaggcaaggatttgcctaaggctttgaatgggcgtttcctcaaacagtaccatcctagtatgtggcaagatgcctaagagaaccgatgtaatctcatcgagttatttgcttttggtttgctcagctccaccaaaaggcaggggggcatatgttgagcaccaaaatgaggtgcggacggtccggccctgaggccggacggtccgcgcctgtgggccggacggtccgcgcacgcgcagagtagattagggttccgagttttgtgctatgtttgttagctatatccgcggaattagctcggaatccggtcgtgtaaagggtccagcccccctcctctataaaaagagaggcctacggccgatttgtaatcaacaatcgaatcaatacaacttctatttcgcattttatcctaggagtagttctagtctagtttaggtttag

SEQ ID NO: 4197 - DNA, 1794 bp, Zea mays
caagtcaagctgagtttgagggcccttatgcatagggaccagtgactctctcatcaaaggactttgcacctaaatttgtctaggtctactctgcttgggtggacctaggaatgtacttttgacctttccattggctactttattagaacataatgagcatggaaagcaaatggccttgagtgcttaggcaagggagttggtggtttggctttgcagttgtgggcaaagtgaccttcttttccacactcaaagcatttgatagacttatgagtctgctttggcttgtattgagtagtagctttctttgcacaaaagcattgtatccaataccactcttgttgtttttcatgacagtgttcatgagcaattcattttggaggtattggcccttgttgaacttttgcacacttgttgcaagatgttcattttcactcttaagtttcttgacctcatttttaagcctttcattatccactgccaactcattgttgaaatcattgttctcaatggcaacctttcctctagtagttgcatcagtcaagtatctcttcaatttttggttgtctaaagtcaagacttcaactttttcggtcaattcatcatgtagactagtttgctctccttgactcaaatcatcacatgaggttgctacatcaatcttaacaacagggttaatagcctcatgtgtattgcaagataaaagttcattttcaacaagaagattatcatgatcaaatttaatcttagtatagtcttccttgattttcactagtctatctttcaactccctattagcttcatttaacttgtcacatttatccttagcatcttttagggaggttgtgagctcatttacagtggatgacatagttttgttttcttctttcatttcatcactagctttcataactatgtcatatttggcatttaagattcattttcatttttcaacctatcacatttagcttttgacttcctaatgatttgagtgtattctttaagcaagtcagctagttcatcataggaaggtgaagcaaattcctcatcactatcactatcactatcatcagtaatatcaatatcattttgtaccttccgttcacctctagccatgaggcataggtgagaagtcgatgatggcgatggtggtggtgaagagaagtccccggcgatggcggcaactttttcatcattctcttcttcacttgaagaagatccacttgatgactcaatgtcagtgagccagtcaccaacaatatatgcctttccattcttcttcttgtggaacctcttttgcttcccatccttcctcttgaagaatttcttttccttcttttcatcatcgctgtcatcttctttcttgcccttgaacttgttcttcttgggcttgttacattgatgagcaagatgaccgagctctccacagttgtagcaatccatctcagaaatgggctttcttttgttggaaaagaatttcttctttcttgaatcaaatttgatgccttctctgttgagcttcttcaacatcttggtggtcttcctcaccatcaaggcaatgttagcatcaaggtcatcatctcttgaggattcttcctcaacttgtacttttgcttttccttttctttcttgatttgctttgagagccaaatcctttcttttggaagatgactcttccttgtcgttgatgtgcatgtacatctcatgagcattgatctttccccaatatctgtgtaggtgtggtaactgaaagatccatttgatgcagcaccagtgacaattgtgtccatattgttc

SEQ ID NO: 4198 - DNA, 1315 bp, Zea mays
gtctttctgaaattgcgtaaatttttcgtgctacggtggctctttttttttaagcctaaagcatttccattatagaatgtcaactgaaggtccagctagaaaaaattacaagaaagaatgcgcatttctgccatttcatggggatcttgcctagggagcacaagtggtgtctctgttccctgtgcggcgagcagtccccatttttggttctgaagatcagcggtctgttcggttcatcaggattgagcaccagagtcattccagcttataaagatccaaccgtgaattattccaggcgctcattccggaggaaccgaacgagccttaaagaagctggcgaccccgcatccatgcatcctaggcgcagaggatgaacttgccggagggcaaggccgcggcggcgacggcgagcaggcaggctgtgacgacgttctgccggaaccaccggagcggcgcccacaggcccgcgccctccacgctggcgcacttggccctcgtcaccccgtactgcggctccttggacaggtcgaacgcggcgcccttcaagcgcagctcctgcacggcccgcgcgagtgcgcgcgcgtcgccgcggtcccggcgcagccgcgccgcggcgcgccagtaggcgcccacccggagctgcacggccgcgccgagcgcgagggacgccgccagggacagagacgacggcgcccaccacctcctgcacgcggcggagggggaggtggcggccgcggcgaccacggacgcggcgaagaggagcgcgagggaaaggccgtgaaaggcgaggaaggccgcgcagaggtagaaggcgtcccggcgcgccgcgtccatgcgcgcctccagcgcgcacgcgcggcggcccaggcggtcctcctcccgctgccacagcttcagcagcagcaggtgtccctcgctagccgcgatctccccgagcgggtgaccctcgcccgccgccgccgccttgtcaagaaaggcctcctcgcctccggaggcttcgccgccgtcgacagcgaccgggatctccacgacgtgggcctcgttcttggccggctccgccatgtgccaaaggttggttcttggtttctttctttccttgtctatctaggaagaacggatctttgtcggaatcggaaccgggctgggggaggaaagaaacagggaaaacgacgatctctcagggaaagacccgagttgatgtgagattggagccgggaaggggactcgcagatggaaaggcgagagtggaagcacgatgatctgccggccgtcgtgggttgggcgcggcgcggcttaaggccgagcggatggcgct

SEQ ID NO: 4199 - DNA, 2328 bp, Zea mays
aagttgtacgagtgtttataaatagatgaacagtacccctgtactattcaggctggattgtaatcgcactcgcgtcattaccttcaagcaagacgaaggtatcgatgtaatacaaactttgataatatcaatatattcattatgaagtaaatatgtgacatgatattacacttgtaattatgtttttatatttatgaatgatgagactcattctatatgaccttcgtctaacactagtacaaagaagctctatactgacggttgtgaacctattttcactggcgtttcttataaccgtcgttgctagtggccaataaaaaataattatttttactggtgggtaactgaggaccgcgagtgaaaatcgattttcattggcggttgagttaacaaaaccgcaagtgtaaatcgatttccgctgccgatcgacataataaaactgctagtaaaaattattttcagaaacattaaatgggttttaaaaacagaaaaaaaactatttaaagagaggactcaggccatgcaccccacccgcccgtcactatagatttctacatgtggttccttaagtaaaccgtcactagaaatcatatatttttacaagcggttttcttaaggaaccacatgtagaaatacaatttttagtggcggttttattaaggaatcgacactaaaaatagcataggcagttgataatcgaatccgcatgtaaaaatatatcgcatcgcaggctttgagactttttctactagtgtaatattcattatgtccgagaggtaataatgcttcgaaggacgaaagtctttgatatataacaaatgcgttgctttgctcttgatgcacatcaattgagaacaagtgaccaacagtaccatctcatcttggatgaagtggtttttcaaaccaaacacaaacaccccttagtagtgacctaacgaaaatcttatattttcagcactctagttagctataggcagtttgttgcctataaatgcctggacctcccggccgggccgggcgggacacagcaaccagtaagccatcgctcacacagtcagaccgacggactcattaacacacacacggacacacaacttctccatacacgccgtagccatggcttccgctgcgcagaagaagatggcaattgtttgcttgatgctgctggccgtcgtcggccaaatcgtcgctgatgctgatgttaccgtagaacatcccagccgcatctgcaccgaaacggtgattgatcctcgtgttcccaacaacgagtgcatctgctccaagaactgcgcctgtgccggcaagtgcatccttgagtcgcctgatgctgtccagacctgctttgtcgactgcgtcctcaagaacgactgcatctgcagcagcaagatcatccccggcgctgacgacccaaaggctaatgccaagtgaagtagtactgctatcatcatccccaataatggcgtacgtacctaaataaacgacctcccatgcatgcaccaacggggagagttaagtgtgtaataattaacggccggtatgtctgtacgacgacgcgtcttgtttgtaataataaaccccttgttttgtacgtgtaaaaataaaccactgtccacgcgccttacacgtaaattcatgtataaatggatccaaaagggcaaaaaaagcccccttgcgccaaaaaaaacataatattattgcctacagttgagacgactgatatataatttccatgagcgcttaattaaactacaaaaattaagccaaagtagtaataataataaaggtaattgttgaggcctgtcttaccgaaggtcctcaagacatctttatttcggtgtaagcaaatgtgtttcaagcaaatagtaaagaatgaatgaatgtagccttttcggttgaagcagcttataaaagaagcttcgactatacgtgcgtgcagcgaaggtgcaagccgaggtcactagcctcggcgtggagaaagcttcgaccgcaaagcgaccaagggaaagaagctgaagacttgtgcagaaaaaaatagaaaagacagtgatgcccctatattatttgtaaatcatgtgtgtagactttgtggacatgtttgtaatttcatacgaagctctacaactttcatataagtaagtgaatagtgacatgcataaatttaccttttgagggcactaagcttcgttttcgttagcctttgaagtaccttcgaactggttcctatgactgtttgtaatctcataagaagaagaatgtaatgaaaaatgctaaggcatatgtgaagagtaatataattcatcttttcattatattcttacacctttttac

SEQ ID NO: 4200 - DNA, 721 bp, Zea mays
ttgggtccctcgaggccggccgggccgggatttcaaaaagagtggacgctccccgccggccgggccgggcggacacagcaaccagtaagccatcgctcacacagtcagaccgacgcactcactaacacacaacttctccatacacgccttagccatggcttccgctgcgcagaagaagatgacaattgtttgcttgatgctgctggccgtcgtcggccaaatcgtcgctgatgatgatgttaccgtagaacatcccagccgcatctgcaccgaaacggtgattgatcctcgtgttcccaacaacgtgtgcatctgctccaagaactgcgcctgtgccggcaagtgtatccttgagtcggctgatgctgtccagacctgctttgtcgactgcgtcctcaagaacgactgcatctgcagcaacaagatcatccccggcgctgacgacccaaaggctaatgccaagtgaagtagtactgctatcagcctatcatcatccccaataatggcgtacgtacctaaataaacgacctcccatgcatgcaccaacggggagagttaagtgtgtaataattaacggccggtatgtctgtacgacggcgcgtcttgtttgtaacaataaaccccttgttttgtacgtgtaataataaaccactgtccacgcgccttacacgtaaaaaaaaaaaaaaaaaaaaaacaaaaggccccaaaggcccctagggcc

SEQ ID NO: 4201 - DNA, 3232 bp, Zea mays
atttttaactaaaatttgcagggacagaatgaaaagacattttattaaaatgaacaaatggtgcagaaaaaatggacagtattcagtaacagagtaacctctatttctatgcccaaccaatgatcccactcacggttgatgttgtttagcgcctgtatgaacgcagttggataaggtagatgaatacacactgacactggttgtggagtctggagttggcgacgggacatactcatccgtccgccgcccccaaatcgcagagcgcgaaaacgaaggagcaacccgcccactcgacactaccacccgctcgaatgaggacacctgctgcagcaggcgagtaccagatgtcatcgctcgtgctgatgccgcagccatgggtggaagaataagggcatgtttggtttgtggctaaatgtgtcacactttgcctaagattagtcgttcgaattgaataactaaccttagccagaaaagttaggcaaagtgtgacaactgaggtagtgaaccaaacaggccctaactgcacccctccgtctcttcccccacaattcgactcctgcaatttagaatggagcgctcgctcgcggttctctctaatcgcgcttactcttgctggggttgcagtccgacgaggcacgtcaagaatttggctcaccaggaagaggtgaatcgggtgctcgctagaagagtccaggggcatgtggagaagagcgatgctcgttgttcccatgtcgttgctaagaaatcgaacgggacataattgtcctccctgctccgggctctattatatagtaatttctggattaaattaaaataaaaatatctaaattcttaatgtagtgacctcggggcagctcgcggcaacacggtaggaaaaaggggtcggcgcctggcgctctgtggctctgtcacttaggtagctcagcattcggaacacattatttattttggtgtcgaaacgaatcttactaattgactatattttagaatatgacattttactaattttcaaagttatcatataagcttatctaagatttatggaacgagagataaaactgattttatagatttacatgttatttttttcgatgtacaacttacagcacactcttttacttgcttcgctataacataaatatattatataattatctctcacgtatgatttagtataatatatagatatattatatttataaatatataaacttaattagttttgtctaaattataattattaaaatgaaatttaattttaatgaaacaaatgatgtctaattaaaccgaaaaaacgtatttgtgagaatggttaaagtaaaaaaaaagacgggcaaccagtagcccgacgcgcgtgggctcggtgttcccagacggccagacggctctcgtcgtgccccaactcggcaactccccatcagctcaccccgatctagggtttgtgcaccctccgcttacgcgcctccccaccaagcaactacccatggcggctacagggcaggagggggatgacgtcgaccactacgaggtactctgcctcccgtcgggggaggaaggcgcggcgctgaccatcgagcatatcgagaaggcctaccggacgcagtcgcggctgcgccaccccgataagcgccccgacgaccccaacgccaccgccgacttccagctcctctcgagttcctacaaactcctccgcgacgagtcccttcgccgccagttcgacgcgcgcctccgcggccgccgcgaggccgcagcccgcgccgccgccacgggcgttaagcgccggaaggccgtctccgacctcgaggagcgcgagcgcgccgccgccgcgggccaccccgccgatcccgaggagctcgccaagcgcgaggcccagcggatggccgccgacatgggccgcgagctcgcagcgttccgcgccgccaagcaggcttctgcatttggtgccacatcgacttcggtaagggtctggaacgttctcgctcggatttttcatgctctggaaaactggttaatgagttcgttgaatgaattggctaggatgcatagcgttttgtcatgctctagcctatatttttttgcatttaattagattagaaattactatttcggttcctgggtatcaggaattttccttaatttgtgttgcattatacatattgcctcacgtgaattatcacattgcttcaagcctaatgattagtgtgattagattagaggggaaattgtatgtagttgtacttgtgcctatctggtccatgctaaggatgtgcaagaggctggtaattggatagaatgcatagtcttgacatgttttttttttattttactggattagaaattattatgttctgtatccttggtgccgggaaaaattctgaactgtacctatctagtccgtgattgtagatgtacctatctagtccgtgctaaggtgaagcaagaggttctccaacagagccattgatatttattggctaacagtttgattttgacaatctccacaatttggttatgtgttcaggcacatggagataagaagggtggaaccccacaggatggggtgaaaacggacaagggaaaaatcttgaaggtttcatgggatgggagtgctgattcgtacagtgcggcaaagttggaggagatcttccagaaatttggcaaagttgaagacattgttatcaagacaaggaaatcaaggagtaagggctcagcaattgtagtaatgggctccaaagaagctgcattattagcaatacagaaccatttctctctgtttccgttaaatgttgctcctgttcaagaatctggtggattatcaacaagaccaacagaaacatatgaatcaaggacaaacaatactgatggaactggatttaacgatttggaagcgtcggtgttccgtaaacttcgagaggcccagaaaaggaaacattttggttaattgctttgttctgatgcatgatttggtactatgtatatgacgtcacacagctgaaaaatatctgaggatcgtgatggtagctgagttacagaaatatgaactacacatttgtttagttcgagtcttgtcgcagataaaattctctgaatcatagcaacgtcagatcaatttttctgtcactgtacaagctgtaccatgtatctatgaatagtttgtaaccacaaattcatgcatgacatggcgctacacatctttttgctggaaattgggaacacaacccctttcaaaaaa

SEQ ID NO: 4202 - DNA, 1372 bp, Zea mays
attataagtaaaaaaatcaaagtactctagtgttgcgggatgaaagaagacacatcgagcatggcgctgtaaaatcaaagtagcgtcgtgctgccccaactcggcaactccccatcagctcaccccgatctagggtttgggcaccctccgcttacgcgcctccccaccaagcaaagttgagggcccgcggcatctcccttcgggcgtcatggcggctacagggcaggagggggatgacgtcgaccactacgaggtactctgcctcccgtcgggggaggaaggcgcggcgctgaccatcgagcatatcgagaaggcctaccggacgcagtcgcggctgcgccaccccgataagcgccccgacgaccccaacgccaccgccgacttccagctcctctcgagttcctacaaactcctccgcgacgagtcccttcgccgccagttcgacgcgcgcctccgcggccgccgcgaggccgcagcccgcgccgccgccacgggcgttaagcgccggaaggccgtctccgacctcgaggagcgcgagcgcgccgccgccgcgggccaccccgccgatcccgaggagctcgccaagcgcgaggcccagaggatggccgccgacattgagcgcgagctcgcagcgttccgcgccgccaagcaggcttctgcatttggtgccacatcgacttcggcacatggagataagaagggtggaaccccacatgacggggtgaaaacggacaagggcaaaatcttgaaggtttcatgggatgggagtgctgattcgtacaatgcggcaaagttggaggagatcttccagaaatttggcaaagttgaagacattgttatcaagacaaggaaatcaaggagtaagggctcagcaattgtagtaatgggctccaaagaagctgcattattagcaatacagaaccatttctctctgtttccgttaaatgttgctcctgttcaagaatctggtggattatcaacaagaccaacagaaacatatgaatcaaggacaaacaatactgatggaactggatttaacgatttggaagcgtcggtgttccgtaaacttcgagaggcccagaaaaggaaacattttggttaattgctttgttctgatgcatgatttggtactatgtatatgacgtcacacagctgaaaaatatctgaggatcgtgatggtagctgagttacagaaatatgaactacacatttgtttagttcgagtcttgtcgcagataaaattctctgaatcatagcaacgtcagatcaatttttctgtcactgtacaagctgtaccatgtatctatgaatagtttgtaaccacaaattcatgcatgacatggcgctacacatctttttgctggaaattggg

SEQ ID NO: 4203 - DNA, 3139 bp, Zea mays
  misc_feature (423)..(423): n is a, c, g, or t
tcttgcgttattttcttttctcttactggtacaactttttatatggtttacatcattacctacttgttctattggtccatgctgagttaaaagaaatctttcaccaacacttctatcataaaacaagattgtcacatcttacattgggttgtcatgggcgtgttgggtccgtctttgaagacattaagaaccaatgtttccttttagatgatctatgaaagagatttagcccaattagctttcaatggttcgtgctctgatatttaaaaaaaacttgaaaaatcattaattcgtaaaaatctatttacataactaccggcctacaaaaaaaccattttgttgaagacatttgacaacggcccaatagggccgaatttccattaagtccacttctcattctcaccatataacgcaggaaaaacntcaagaaccctaggaaataacaggagaggggacgcgcgctcactagcaaaatgcaggcctcttccctccggcgagccctccttctgcggggaccgcgaggcgcccagctcttccccattcccgtaggcaacaagccccgtgccttctcctccgcgtcccccgcggcagcgcgctctcccaaagacgctcataatgcgccgccgccgattatgccgacgctgccgtggggtgatgcgctcgcagccacgcagcgcaccttctgcctgccgctcgctgggcgcgtcctcgccgcctcggcgaccgagaacgcggccgtggcccccgtcgcagtctacgcctcgctggccctggccgccgccggcgcgcgcggcgacacgcggcggcaggtcctccaggcgctgggcggcggcggcgggggcaggggcgccgcggttcaagcggccaacttggcgtcgcgcgtggtcaagcgggtgttcaaggaccggtccacgtccggcggcccgcggctggccttcgcaggaggaatatgggccgacacctcaacgagcctatcgccggggttcgtggaggccgcccgtagtgtctacagctgcacggcgcggacggctgacttcattaacaaggtgtggcatattcagacgttcccgcttataccacatgctcattaggtgctcgacaatacgcttgttccaggggtcactgtagcagaacatcttaatttgttgtttgatgttattgcagttcctcactaagctttttttatagatggcatttgactggaccgagccaagtaatttcaattggtctaatgttttttctgctgatctctgcctttgcacccttttctgttcatttatttgatctgatagaaatggtaatgtgcattggagagcttgtggtgacaaatatgcccactatctacctttattgccgtcaaataatactatggtatctctgtaaaaaatgctacttgaactgttctattttttcagtagcaaactgcaaccatgtgatgtgtagtgttgtttctgtgatttttcttttgaaactcttaactctgaaattcacacgttttctgttctattggttttgaaagcctgaagatgccgccaagctaattaacatgtgggtcaaacaatccacaaaagatactgttacctcgctccttccggatggactaattgacaagaatacaggacttgttattggcagcgcactgtattttaggggaagatggcttgacaggactgatacgaggagtgacgcggtacaaaaattctgctgtctggatcgaacttgtgttgacgttccttttgtggaatatgatagaactcgacctttcgcagtccacgatggatttaaagtgattaagcttccttaccagcaaggaaataatgaacggaagttctccatgtacatcttcctgcctgatgctcatgatggcttgtttgaattagctaagaaagttttcgcggaaccatcattcttagaacaacacttgccaactgagaagcggcacgtggatatcaagattcccaagttcacagtgtcattccaggtcaatatgaagcagtttctgaaagaaatgggcctcgaattacccttcctccgtgatgcagatttcactgatatggtcaaggaagatggatccagaaatccgttgtatctatccgacatacttcataaagcagttttggaggttaatgatgaaggcgttgaagaaacttctgtgagaattggcatagggaagccctcaccaggagagcactttgttgccgaccatcctttcttctttgtcattagggaggaggtgtctggctcagtaatgttcatggggcacatactggacccatcatcacaatcttaatttcgggctctgcacttttgtcacctatatattacacatatatcttgtatgatctgactttgtcagtctggttcaatgagatttttagtacttgagtaattcatgtagtggttcgtagttgtttgctttgtttttagtaacatatgagcatatagctactgtactaaactttacatcgtctcctgtgggaaaccatatgaagacaatgcatgcatgtgctcatgtatatcagttttgctttgcagaaatctgtagtcttgtccaatttataaaatagattttttttaatccgaagggttagttattcttgtgaattggacctatacctttttttcttctagtttttatctatgtatgcattggtaatttaaaatttggtttaccatatttctatgtagcttatctcaacattttattgattctctacatgctattttcatagagttgtttcagtttcatgttcttatagtagattggtatttatttagtagaaaatgaaccaaatcacttgggaaaaataaggttcccaaaatagcccttatagttttgtttaatccagaaattagagcaaatttagaattatgtcttcccggactccctgcctggtctgaagttattaaacggccgtcacggcgcaaaaaccacctgtggaccgcacccgtcagaccccacgccagccgcaacaagacaaagccgtcctagtcaggatccgagcccgcccatgcgcttcacacccgcgtgcgccgcgggcgcggatggagatggcagaccgctcgcatcgcaactcgcagacggcgatgacgacgaaccctttctgcctcgcggtcgcagcgccagctagggaatccc

SEQ ID NO: 4204 - DNA, 1106 bp, Zea mays
ccacgccgtccgcacactacagtttctccaagcagctcgtatcgttaatcccgattattaaactgtcgcacaccgcaccttgccatgccaccgcgattatataaaattaatgatgcacgcggcagcatgtgcagcgtacatacaaaaccctggatcagccagcgttccattccaacaacagcacagcagagcaagagcgcaccagcacgacacagccaagctccactccaccgacacgctgcgctcgagcccgccggcgagatccatggcgcggctgctcccgacggccgcggcagcggccatcgtggccgccgtcctggtggcgggcctgccgggcgcccgggcggcgtctgcctcgccggcggcggacgacgcgccgccgtacaggaaccacaccgttggcggcggcgacgggtggttcttcgacgccaacaccaacgcctcgtccgggaactactccgactgggccgccggcgagaccttctacctcggtgactacctcattttcaagacgaacgacaactcgtcggtggtgcagaccaccaacgccacgacatacgggctctgcgacgccagcgacgacctggcggagacgacgtccatctacggcggcggcggcggcgggggcggcggcctcgagcagaacagcaccatcgcggtggcgctcaccgccgagggcgccaactacttcttctccgaggccgacgggggcgcgcagtgccagcaggggatgcggttcgagatcaaggtcgagcacggccggggcctgccgccgtcgctactgcaccagccgccggcgcccaagggccgcgtcctcgcgccgccgccggcgggcacggcgttctcgggcaccggcggggtcgagcccggcgacggcgccggggacaacggcggcgctggcacgagcggcgcgtgcagggcggccagcggccggttcttgggggtggtggctgctgctgctgcggctctggccgttttggttctttgagtagcgatggtttaaaggcattcgtcatttggaaccactgttctgcttatgtatgtgtctgtatttaaattcatcatttaatggagatttgtgttcgatgccaaaaaaaaaaaaaaaa

SEQ ID NO: 4205 - DNA, 804 bp, Zea mays
cacaagcacgaaatagagattattacagactgataggttaccaggaagaaaatggacagctcgagagcactgaaagttatctaacatacgtcgttgcatatgttaaattgtacgcagcaatgattcagacggaaatcaaaggtgttcgtcatcctcatggtttagctgagggatggaagtggctcgccatgttcctcaattctctcccagctactacagccactgcatgtgcccttcacgctttcctcaagatggctggttttgcacttcacaagaaatatgggtcacagttcatgaaaatcctggatgtaatatcacggtgctttttaccggctttgaaggaacaaggcaacaagatgcaggctgaggctgtcaacaatctacagaattacctgaacgacaagatctacctggaggaaccagaagggcagtacctcgtccagcagctactatccaaggagttgttcatgtaaagatcaaaacaccagatcggtatgagacatcgtgtgatcgtctgaagggcggtacctcgcccaagctaccactatcgcaagagcggcttcatgtagagatgaaagcaccagatcgatatggagctgttcgtgtttcagaaacacggtcgagaatttcaaatctcacgaacattatttatgggatagtcccccagatcatttccccctctgcacggcatcatttcgaatttttgcatcacaatttgtatcattatcttaaatgtaagtgcaacagctaaaaagcccaacatggaatgtatatttaatttatttttatcatggttagttgttt

SEQ ID NO: 4206 - DNA, 3785 bp, Zea mays
  misc_feature (3683)..(3683): n is a, c, g, or t
gggaccctcaccactacgcacggacgacatcgagtaaccctagactagagcacattgcaccggcgacggcgcgccaccggtgactggcgtcccctcctcggttctcactccccagcatggcgacgccctgctgcagcagaaacgatcaaccgatcgggaaacattaatttgtattcgatttgaaagcgcacccggcacctgctccgttcctgcgctgcttggcttccggtctgtgtcaaagcgtgcatctcacgcgaggcgcacaaggacgaaccctatacagctccaggaggccggtgccctagccacctaggccaccttcctggagaccgggcggcgacgacgggaacgaccgcgatgggcttcgagcgtgtggagctgcggtgtcccagggagctggacccacggccgagctggacgctcggcgatgtgctcgctgagcttgacgcgctggatgccacccgccgcgctgcgccacccacgcccccctcgcggccgccgggttgggctaacggtggtggtgagaaggcctttgtgatgcgggttgacgacgacgacgaagacgacacagaagatgaagacgatggtacaagtggtgggaagtcccgggctctggtggccaaaggagcaaggttctcgtgtaatgatcttgcatcaagtgattcagaggatgaattagatggtcaggttgccccataccacttaatggaaaaaagggacctagcgaagagcattcttcttgagctggaacgcgagcatcatctaaaagttcaagaagaagttagaagtaagctagcttcattggaggtatgccaccaaaatgaaattcggagaacgatctctgcatttgcccgacttcagaaatatgcagaatcaagaaaagagatagacagaagacttgatgtacacttccagagaagaattgcagaagtactcgataaacacttatctatggtccaaagggatcatgaacaaaaatcccagattgttgaacgccgaataagagatgatgcagctcttgaagaagctaaaagaaaagagcaagctgtcaaggaagaaaagttaaggcgggaaagagcccagcaagaagcagaggctagacagaaggaagctgcaaaattagcagctgaagcacgaaaaacagcatttgaggctgctaaaaaggaagcagcagaaaaggaagcagcagaaaaggaggctgctaaattgagagatgcagcagcttctcaacctagtccgaattcccagaataatactgcaggtactcctagtttacttatttgcaaacttaatatttgtagttctgtgtactgctgttctgaagttcttgtactgattttcataatagatgatttcctttgtaccatatccaatctcatccatgctgaaatcatttgaaaaagaatcggtatcactttgtgcttttcatgaaaaggcttagtatcttttgggttggcacttaattacagaaactggacttgtaattgtgcaataccaatgatcatctgatagtctatttgtcagttcctaacttacagttttttcctctcgaacatttaacttcgtatgttagaactcatctttaacttgtctgttgtatattttaataacttggttctttcgtagaaggcatcaaagtttttggcgataaatacgcactagaagcagagtcacggaggcatgcattagtacagaatcaagtgccagaaaacattcatcacagcaaggtcttattttctgctgaaacttataatatttaattgcctgtttcgaataacttgttgttgttatgttgatttgataactgtgatgaacaatgactgatccatggcttaccatttgatgtatagatgagtatgttgctaacttgtactctggctgacatcatatcttgcaggaattcagcaaatatgaccgacaaattgccaaatccataagtaaacttatgccaactactgacagtgtcaggtgaagttcaataccgcagcttaacttggatatggttacataaactactgaaagctacgctacagtgacaaattgtaaaccaaattgattatgtaaaataaattgtatattcatgaaccataaggttaagtgcttgtttgtagtatgatagacagtcagtttaacaatatgcctttgtaatacttaactttgaatccaatttcaaacttgccaggtgccgcattttgttccttctaaccaccatgtgtcgttccatgatgatttaagtcattaaagtaaactagctagatgttttttttgctatatggaatttttgccttgcagcccaataacaatgaaacaggtattttcttgaaacaataagctagatcatttttggctactgactggacctagtgccaccagcacatgagcatacttccacggtttctttttctgctttattttccactcattctcctttttatcatcatttgttacacacgatgtgaataaatagtgaccacctgttgtttggaaatattgaggtggataatttatctgaggtttgcttttctaattgtatataattttggtgcagaacaagggctagtgagcttgttaaagctttaaatggacaggattgtccccgtccaatctcttgttgtctatttgttaacaaggtagatactttatatttattataacattttcattaaattagtagcataactgttagtgtgtgctatattttaggcagtttaggtggcacggttgcacaggtttgctgccttgtgcgcctgccccttatttggttaattggtctcaataggcaaggatcttcctgataggattgtgtaggattgtttccttttctgtagacatccttgcttatatgtacttgagcctttgctcccattaatcaatcatcatattttctgccaattcattgtctttcatggtatcaagagtccgggttctaccacggatttcctcgcttccgctcaattagcacgccggcctccctgtcttgcagcgcccatgcgccggcctccctgccgtgctgcgacatgtctaccagctggtgtacactgatgttgattgggctggatgcctggatacgagcaggtccacctcgggctatgctacactccttggtgacaacctcatctcttggtcttccaagcctcagaacactgtcttcaggtctagtgttgaagtcgaatatcgccctgtggctaatggagttgccgaagccacatggctgtgccagctcctcctggaactccaccctcattttcgccgtgcaacactagtgtattgtgacagtatcagtgccgtctacatgacctccaaccccatccaacatcaacgcgccaagcacattgaaattgatctacacttagtcagagaacgggttgccgccgatgctcttcgtgtcctacatgtgtcggcgacatcacagtatgccgacatcttcaccgagggcctcccatcctctgtcttcaacgaattcaggaccagtctgaacgcgtgcagtggctgacgatctgactacagggggtgttagtgtgtgctatattttaggcagtttaggtggcaaggctgcataggcttgttgccttgtgcgcctgccccttctttggttaattggtctcaataggcaaggatctctctgataggattgtgtaggattgtttcctattcctgtgattgtgtaggattgtttccttttntgtagacatccttgcctatatgtacttaagcctttgctccctttaatcaatcttcatattttctgccaattcattatctctcaataaccggtgttctgtgat

SEQ ID NO: 4207 - DNA, 643 bp, Zea mays
agctgagggatggaaatggctcgccatgttcctcaattctcttccagctactacagccactgcttgtgcccttcacgccttcctcactgctcgctggtggctggtgctgcccttcccaagaaatatggttcgcagttcatgaaaatcctatatgtgatttcacggtactttttaccggctttgaaggaacaaggcaacaagatgcaggctgaggctgtcaacaatctacagaattatctgaacgacaagatctacctggaggaaccagaagggcagtacctcgtccagcaattactatcgaaagagttgttcatgtaaagttcaaaacaccagatcgtgtgattgactctgaagggcgcacctcgtataagctactactatcgaaagagctgttcgtgtttcagaaacgcaagcgagccttgtagagatgacctgcaaggaaatcagtaccaaatctccccaacatttgtagtcttaaccgtagaggagatgaccctgcatgaaatatattgaatattatttgtacgtgctattaccttagtgtttgaaattattgattatttatttttaactcttcatttatcaaattggcataatttaattcacatgtatatttccgctatttatgctttccttgtttggc

SEQ ID NO: 4208 - DNA, 1690 bp, Zea mays
acgggctgggctttcgtgggccgggagtgggcgacgaacgatggctggctggccgtccgtgattgttttggaacgggcagcgtgtttggttggtgcctgtgctgtgccgccgttcgtctctgggtagcgtagcgacggcgccacggcggcttccggctcgtgcgcgcgcgcgcgtgtccgggcgagaagagctgccaagggatggaggcgctgaggaagcaggcgagcaagttcaaggagcaggtcgccaagcagcagcaggctgttataaagcaattcagtactactggctatgagcggtcagattccattgtaattgatgaggttgaactacagagacatcaacagcttgagaaattgtatacttctactcgttctgtaagggatttccagaaggacatagttagagcagctgaaggtttggtgtctattggaaacaaacatattgaagtgggaacaaaattttctgaggactgctatagatatggaagcgaaaataatgcaagcgacgaagcccttagaaaagcagcatcactatacggaggtgctttgagaaatattgagaaagagtatgaagatttcaacagaattttatcttctcagactatagacccattgagagcaatggctatgggtggacccctggaagatgctcgtggtcttgcacagcgctatagcaggatgagacatgaagctgagatcctctctactgaaattgctagaagaaaggcacgggtaagagaagctccaattgctgagcacactacaaagcttcagcaatcagaagctagaatgatagagcacaaagcaagcatggccgtgttagggaaggaagcagcagctgcacttgcagctgtcgagtctcaacagcaacgagtgacccttcagaggctggttggcacggcggaagcagaaaagttattccatctgagattagctgctatacttgatgacgttgaggcagagatgtcctctgagaagcaaaggagagaatctgcaccacctatcatatcttcacataagcgtgctgagaaagctcagtacttccttgctgaggtaatgcataatttcaatggaaccacggagaaggaactgagcttaattgttggcgattatgttgttgttcgtcagattgctcccaacggctgggcggaaggagaatgccgagggaaggctggctggtttccggctgcctatgttgagaggcgcgagaatatccccccgaataaagttttccctcaagtataagatcataagaggggtcatctgtttccactgataagcagtttggtttggcattgaggagctgcaaggctgtatctaacttctgattggtttgatgctccgtatggcgtatcttgtgcatcctatgttcttgtggtggtctagacttggaataagatatgtcggcacgtgctctgcgcctgtgcctgcgcgcacattgatgaagatgtcgctttgcatgtgtccgcagtgtgctactgcttgcggcagcgtaggtcatgttgaatgagctttcctttactgacagatttcgagtgtaaattggttcttgcacttttttttcgttagggtgtatcagtagttctgtacaatatgtttttaatgagaccattcggccatcagagctttgatctgtctccaaaaaaaaaaaaaaaattcaaaacccagactacacctctcctcgtgc

SEQ ID NO: 4209 - DNA, 1116 bp, Zea mays
  misc_feature (1116)..(1116): n is a, c, g, or t
attatgcgcaacacgatgcagatcgctgggccgcagtagctttctgacacagccccgagagagtagggatagggccatagggggtcacaaaccataaaccaagaagctgctgcgggacgttcgaatcaaacatctctaccctctccttccagcgaaatggcaagagcggcggctcctccgcctctgcaccggctgcccggtctggccttgctgtgccttgccgtggcagtttgcttctccggcggcgaaaacgccgcggcggcggcctggacgaggaagatagtcggcgttcacgagctcagggtgggggatttctccgtcaaggtcaccaactggggggcgactctcatgtccgtcatcctccccgactccaaagggaacttgggcgacgttgtgctcggctacgacaccgtcgctgaatacgtcaacggcaccgcctacttcggcggtctgatcggccgcgtggccaacagggtcgccggcgcgcggttcacgctggacgggaaagcctaccgcctctaccgcaacgacggcaacaactcgctccacggtggccaccgggggttcagcaaggtcgtatggacggtgaaggagcacgtcggcggcggtgactccccgtacatcacgctctactaccatagcttcgacggggagcaagggttccccggcgacctggacgtgtacgtgacgtaccgtctgtcgcgcccgtacgtgctgagcgtgcgcatgaacgccacggcgcggagcagggccaccccggtgaacctcgcgcaccacgcgtactggaacctcggcggccacggcagcgggcccgtcctcggcgaaacggtgcagctcttcgcgtcgcggtacacgccggtggacgccgcgctcgtgccgacgggcgcgctggcgcccgtggccggcacgccctacgacttccgcgcgccggcgcccgtgggggcgcgcctggcggacctgcggccgcgccgtggcactggcggcgtcgcgggctacgacaccaactacgccgtggacggcgccgcgtcgccgtcgctgcggccggtggcgcgcgtctgggacggcgccacggggcgggccatggagctgtgggcggaccagcccggggtgcagttn

SEQ ID NO: 4210 - DNA, 1287 bp, Zea mays
gaaaagagaatacacaggctgacatgtggggtctatatatcaaccaagacacatttagatctaactgatacgtgaacaacgattaaggaccgggttaacacattttaaaagtttatggaatagggtgacatagggcaacaagtttaatgaccaaaaatatattttactcttttttaatatcagaggagtaaaaattatattacagcttccaaaattatataaagtttaccaccagagttagagtgtttggagttttgttctcgaaaccaaacaccaggactggttcggaggaaacacgagcacaagtccaagtccagccgtgcgcacggctgggactgggaggcctctccgttccagaagatccccgctctctcgccacacacgcttggaatccaatccaacgcgaaagcaaccgagaaatttgctgttttgccactctcaaatttggctgcttgttattatgtcatcccgtgtctatgactggtgggaccatctgtgtctatgatttgtgggtccgatggcataatggcgaagcccacaaatgataatggcaaaattgccaatggctccaagcaacctgccccgcccctgcccgtcgctattctggccacccgattcctatcagacggccaccagcaacccgcagggcgcaggccctcccaaactcctcggcctcgcgagcttcctggaaagtggatacccaaacagcgaaagcgaaacggaccccctttcctcccttcccttcccgtcccctacccgcgccgcgcgttctaatttggaccagacggctccagaagcttccgccattgacctaacctaacaaccgtgtcgctttatttatcgaaccaagcccagcggcccagcccctcgtctccgcccagatccacgcgtttcggagttctagctgcgtttattgaccgctcattctctccaaggcatttttcccctcgtcctccctgcgatttcgcgacctccatccaatccctctgcacggagaatcgtctaatggcggaggagggctacaaggtgacgctgaacgtgtacgacctcagcaacggcctcgcgcggcagctgtccacctccttcctcggcaagcccattgaggccatctggcacacgggagtggtggtgtacgggaacgagtactacttcggcggcgggatccagtcgtcccccgcggggacgacgccgtacgggcggccgctgcgggtggtggagctgggcgtcacgcacatcccgcgggaggtgttcgaggactacctccgcgacatcgcgccccggtacacg

SEQ ID NO: 4211 - DNA, 2100 bp, Zea mays
gggggctcggtaagacgctccaagcatctgctattgtagcaagtgacattgcagaagcacgtgcacggaatgatgaaaaaattctgacatctttgattatctgcccttctacattagtggcccactgggaatatgaaatagagaagtacatagacagctctatcttgaaacctcttcagtacgttggttcttctcaggacagagtgacactccgtagtcagtttgataaggttaatgttatcataacatcatatgatattatacggaaggatattgattttcttggaaatatcacttggaactattgtgttctggatgaagggcatataataaaaaactcaaggtctaaaataacgtttgctgtgaaacagctgaaagcgctgcgcacctcgtggccggccgggcacacctattcagaataatgtgttggagttatggtctttatttgacttccttatgcctgggtttcttggaacagaaaaacaattccaagctgcatatggaaaacccttgctagctgccaaagattctaaatgttcagcaaaggatgctgaagctggtattcttgcaatggaggcactgcataagcaggtcatgccgtttctactgagaagaacaaaggatgaagttttatctgatcttccagagaagataatccaggatagatattgtgatctcagtctattgcagctcaaactttatgacaaattttccagctccaatgcaaaagacgagatttcaactatagtaaaagcaaatgaactggaggaatctgcacctcaaccaaaggcaactcggcatgtgtttcaggcattgcagtacctattaaaactatgcagccatcccttgcttgtaactggggagaaccccccaaatcatcttgtggatcttctgaatgaaataggtctgggatctggcagtgagcttcatgagcttcaccactcacctaagcttgttgctcttcaagaaatacttcaagaatgtggtatagggtcagaaatatctagtcctgatgcttctacagctgttgggcaacacagagttttgatttttgctcagcataaggcttttcttgacatcatagagaaggacctgtttcaatctcatatgagaagtgtcacatatttgcggctggatggctctgttgatccagagaagagatttgaaatcgttaaagcattcaattcagacccaaccattgatgtacttctgctaacaacccatgtcggtgggcttggcttgaacttgacatctgccgacacattggtgttcgtggaacatgattggaacccaatgaaggaccttcaggctatggacagagcacatcgattgggtcaaaggaaagtggtgaatgttcaccgtctcatcatgcgtggcacccttgaggagaaggtgatgtctctccagaggttcaaggtgtcagtcgccaatgctgtcatcaatgctgagaactcgagcttgaagaccatgaacactgaccagctgcttgatctgttcacatcaacccctgcttcaagaaaagcaagcgacgagcagagtaagaggaaatctggtggcaaaggcttgaagtccattcttaatggtctggatgagctttgggatcagtcgcagtatgccgatgagtatgatctgaaccagttcctggcgaagctgaacggctgagccaccaccggctggctcgtgtacagtgtataaagcaatttggggcaggttaattttgttgttgctgttgtttgatagaggaaggaaaagattagatgctaacagatataggtggtggttggggttacgatctcaatttttttggtttccatcttcctcaatttttgttttgaggagttgtatatactctgctcacctataatcaaagctgcagctcttatcagaaaaaaaaaaaaaaaaaaaaaaaaaaaaaaaaaactcgagagggggggcggaaaaaaaaaaaaaaaaaaaaaaaaaaaaaaaaaaaaaaaaaaaaaaaaaaaaaaaaaaaaaaaaaaaaaaggaaaaaaaaaaaaaaaaaaagggccctttttaaaaaaacaaatttttacccccggggttgggaaaataattttttttttttggggcccccaa

SEQ ID NO: 4212 - DNA, 773 bp, Zea mays
gttctgaatgatgaaaaaattctgacatctttgattatctgcccttctacattagtggcccactgggaatatgaaatagagaagtacatagacagctctatctggttccctcttcagcacgttggttcttctcaggacagagtgacactccgtagtcagtttgataaggttaatgttatcataacatcacatgatattatacggaaggatattgattttcttggaaatatcacttggaactattgtgttctggatgaagggcatataataaaaaactcaaggtctaaaataacgtttgctgtgaaacagctgaaagcgcaacaccgtcttatcttgagtggcacacctattcagaataatgtgttggagttatggtctttatttgacttccttatgcctgggtttcttggaacagaaaaacaattccaagctgcatatggaaaacccttgctagctgccaaagattctaaatgttcagcaaaggatgctgaagctggtattcttgcaatggaggcactgcataagcaggtcatgccgtttctactgagaagaacaaaggatgaagttttatctgatcttccagagaagataatccaggatagatattgtgatctcagtctattgcagctcaaactttatgacaaattttccagctccaatgcaaaagacgagatttcaactatagtaaaagcaaatgaactggaggaatctgcacctcaaccaaaggcaactcggcatgtgtttcaggcattgcagtacccagtccaccctaa

SEQ ID NO: 4213 - DNA, 838 bp, Zea mays
cgtttagtttcactgacatgtacgcctccagccctgacccgcaacccatgggtccacatgtcatacatcaatatcgctttctgctgcctcgagggcggccgggacctcgccgcttcgtcttccccgtcccctttcgcctttcccctcctatcgacaccaccatgtccaccaccaccgccactccgccacagttcgaatattcctagcttgagattgcaagaggtctccaagaggagggtaggggagccgagcgctcagctctaattttctccatctattgctaacagctcagacctcaggcaagggaggtacaatgccaagagcaaatgagatgttgagggcagattcaagaatgatggtggtctttggtgccttgacatcgaaaccagagcaactgacatttgaagaatccctcatatttgtcaagaaagttaaagcccgtgactacatgctgtacctgtcattattcgacgttctcggcagaacggaattaccccagctcgacgcctaccgagagttacagcagatgtttcaaaaccacccagatctgcgcgaagagctcgagaggttcagaccgccgccgccgccgggtgcctaccacaaagcaggcagcaaacaacaacatctggccctgggtcatcgtctgcgctgctgtcccgttggtcgcagccagcctgctcccgtcactttgaaacccagtgctgtggcttgctcaacaccctgttggccaaaaaatggccgtctgatcgaagaaccgctgcatgcagtacatacattacatgtgcagtggaccgaaccggcctcctgttgctattcgtgccatcacaactgaatcaca

SEQ ID NO: 4214 - DNA, 1597 bp, Zea mays
atacgttcttggatctcagctcgcgcgcgccatggttgtggaggccaactcagggagcacgctggcggccgtcggcgtggccggcaccggcagcagcatggccgtgcacggccaccagctttcgaccgtggtgccgagctcggtgaccggggaggaggtgaactacgagctcgcggacgccgacttgctccacaagctgcactatgtacgcgcggtgcacgtgttccgcgcgccgccgctcaccatccgggagctgaaagagcccatgttcccgtggctggacatgtacttccccgtcagcggccggctccggcggcgtcaagcggccgagggcgaagaggccgccgcggcggcggtggggcggccctacgtgcggtgcaacgactgcggcgtgcgcatcgtggaggtcgactgcgacgccaccgtggagcagtggctggaggcggaggcggagcgcggcgggctgtgcaaggcgctggcctacgacaaggtgatcgggccggagctcttcttctcgccgctgctctacgtgcagatcaccagcttcaagtgtggggggatggccctcggcttcacgtgggcgcacctcatcggcgacatcccctccgccgttgccagcttcagaaagtgggcgcaggtcctcggcggcaacaaggccccggcgccaaccctgcgagacccactcgcggtgccgccgtcggccccacctaccagcgtgacggtcccgccgtcggtcaaggccaccgcggcccccgtcggcgatcactgggtggtcccgaccacccatgacatggtgtccttctccttccacgtcaccgagcagcagctgcagggactccagctcagcgcgatcaagggttaccatcggcgcgaggttgtgggcccgtttgagctggtctccgcgctgatgtggcgggcgctggccgcgatccgaggccccgaggaggaggaggcgacgcgcacggtgaccgtcgtgaagactggagcggcgccgacgtcggggggcagcccccgcccggcgctgaccaacgagcaccgcatcggccacgtcgtcttcgcgaccggcggctcctcgccagcgacggccgacgtcgccaagctggcagcgctgctggccggcgcacacctggaggaggccagcgcggtcgcggccgccgcgttcgcgggagcggacgacgccgacgtggtcgtgtacggcgccaacctgacgttcgtggacgccgagggcctggaggtgtacgagctggagctcgcggggcggcgcccggcgcacgtggagtacgccgtggatggcgtcggcgacggcggcgcggccgtcgtgcaccgcgacgccggcgggcggggccggaccgtcgcggccgtcctgcgccgggggaaggcggaccgcctccgtgccgcgatccgtgacgcgctgcgggttgcttgatgatcttgcggttgcgggcagtctcgtggttcagtacttgtcaggttgaataaattagaggatgttgtaggatgtactcttgtggcgcatatgctcgcctgtatgttggaccgatcctgcccttccatgccagtgcgtacgtgtgttttaattacaaaaaaaaaaaaaaaa

SEQ ID NO: 4215 - DNA, 2138 bp, Zea mays
atactttttaggacattcttggtgctatagaaccgtgcctttgttaggtttttgttgtgtgttttccctctggttggatgcttgcagcctttctcttcattgtttttgttccactattattaatcgtttttgttaaaatcttgctatcagtgtagcatctgtacattacatcagggtatcacatattacatggattggaatctcatgtgtagaccatgtagtgttttgccctcttggttaagtctgtttagaaagatgcatagttgtgtgttttctaatctggcagtcaaccccctcgcccccgcgcgagcccaattcgtggcctccaccacgaagatgcaggagcatgcgggcagcgacaagtcgtgtgtttggcacgctgctgactttgccgatggcgaacttaaggaggagatgtttgccatcaggtttggttcggtagaaaactgcaagaagttcaaggagttggttgaggagatagctgagtcgcttacaaagaacgagggcaaggaaggtgaagatggtggttccacggctggattgctggcgaagctcactgtgagcgagggcaaatctgagggaagtggcaagtctgagtccactgattctggcaaagtgactgaaaccaaagccgacacagccccagctgagtagttggtgtggttgcacttgcacgcagattcgcctggtgctgaactagtttgtctgtccgcgtccagtggaagtttggtgccctttagccatggaatacgattgctatcatttgggcccgggccgagttggaggagtctcaggtgttcggtctggtttggtccgggcttgattttgctaaaaacttgggagtccatgggggttgggaacgtttgatatgtgagtcgctagtatttaactgcatggatcgttgtggattgcggtaaattcataaagtggaccctatatattttttatttcgttcaatacacattcatatcatcaatgatttataatggcagtgcctgtggggagacttgaatgtgtgtccaggagcccatttccatattcgtattttaaccatactttgtgaacacttgtaagagcatcttcaacaactttcaaaattatagctcccaaaacaagaaagttgggatctccttataaatttaaaaagcaatgctccaacagctctctataatttaaaactttttaaaatcagttttgccgtgatatctatgactcaatggtctgtcaagtatcattgttgcacatcaacgaccttcatacaaattgaactaaacaaaagaagtcgatggcctcgatgtcctgcatcctgttctgctactcaaaacaagaaatttactattttgccactctctgttttggctctatgttgttatgtcatcatgtgtctatgactagtgggaccatctgtgtctatgatttgaatggcctatggggagatttgaatgtgtgttcaagagtgatatatcatgtgccttaggattaggggtggatatcgagccagctcggctcgtttttgactcgttactgtaacgagccagctcggctcgactcgttatactaacgagctaaacatctggctcgactcgactcgttaggaagctcgagccaactctttaggctcgtgagccacacaactaaatacaaagatatatgtacataaatatatataaccgaaaaatcatatattaagtacaaagatctaacttttaatattaaattaaataaccaaatatgtattaacttatggatttacaaaccattattataataagatagcaacaagcatcattataaagcaattaatcatccattccacaaacatataacatttcattgcacaacactaacaacatatgctgctagaaacagagttcacaaaaccataacaaataatcaaacattaaatatgcaatgtaggtatgtagccatgcaataatgcaaatatttaagcacatgacacatccacacatgttcatatcacatatcataactacgagaaaacaagactatgagagataagacgacaccaacgactagacaaacttgtattgtggcttggctcgtttggctcgcgagctagctcacgagctaacccgagctggctcattagagaaccgagctagaattctagctggctc

SEQ ID NO: 4216 - DNA, 1263 bp, Zea mays
cggacgcgtgggcggacgcgtgggcggacgccggggccgcacatggggccccactctctgaaagtgacctatcctcgctggctatacgtctcccctccgcgcacaaaaaccctagcacgcaggcgcagccaggcctgcacccaaagcttccggagaattcctcccttgccccgccgtcgcatcctcttcgaagttcgaatcgaatcgcgccgcgatcacccacctcatggcggacaaggagcctgtcgtggagcggccagaggcgggtgaggaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttctcaagcacaagcagaccggcaaggtccgcctagtcatgcgccaggctaaaacgcttaagatctgcgcgaaccacctcgtggcctccaccacgaagatgcaggagcatgcgggcagcgacaagtcgtgtgtttggcacgctgctgactttgccgatggcgaacttaaggaggagatgtttgccatcaggtttggttcggtagaaaactgcaagaagttcaaggagttggttgaggagatagctgagtcgcttacaaagaacgagggcaaggaaggtgaagatggtggttccacggctggattgctggcgaagctcactgtgagcgagggcaaatctgagggaagtggcaagtctgagtccactgattctggcaaagtgactgaaaccaaagccgacacagccccagctgagtagttggtgtggttgcacttgcacgcagattcgcctggtgctgaactagtttgtctgtccgcgtccagtggaagtttggtgccctttagccatggaatacgattgctatcatttgggcccgggccgagttggaggagtctcaggtgttcggtctggtttggtccgggcttgattttgctaaaaacttgggagtccatgggggttgggaacgtttgatatgtgagtcgctagtatttaactgcatggatcgttgtggattgcggtaaattcataaagtggaccctatatattttttatttcgttcaatacacattcatatcatcaatgatttataggtctctcttttttttttttttttagccataacaaacatg

SEQ ID NO: 4217 - DNA, 1148 bp, Zea mays
tccgcttcgaagttcgaatcgaatcgcgccgcgatcacccacctcatggcggacaaggagcctgtcgtggagcggccagaggcgggtgaggaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttctcaagcacaagcagaccggcaaggtccgcctagtcatgcgccaggctaaaacgcttaagatctgcgcgaaccacctcgtggcctccaccacgaagatgcaggagcatgcgggcagcgacaagtcgtgtgtttggcacgctgctgactttgccgatggcgaacttaaggaggagatgtttgccatcaggtttggttcggtagaaaggccttttttgtttgagcccaggcatccaattttggtggcctggggttgacattgctgcctgggaagcttccaaccaaatccaaaaactgcaagaagttcaaggagttggttgaggagatagctgagtcgcttacaaagaacgagggcaaggaaggtgaagatggtggttccacggctggattgctggcgaagctcactgtgagcgagggcaaatctgagggaagtggcaagtctgagtccactgattctggcaaagtgactgaaaccaaagccgacacagccccagctgagtagttggtgtggttgcacttgcacgcagattcgcctggtgctgaactagtttgtctgtccgcgtccagtggaagtttggtgccctttagccatggaatacgattgctatcatttgggcccgggccgagttggaggagtctcaggtgttcggtctggtttggtccgggcttgattttgctaaaaacttgggagtccatgggggttgggaacgtttgatatgtgagtcgctagtatttaactgcatggatcgttgtggattgcggtaaattcataaagtggaccctatatattttttatatcgtccaatacccaaacaaatcccccatgatttataatggcaaagaaaaattaatt

SEQ ID NO: 4218 - DNA, 2316 bp, Zea mays
tttctgttcacttcttagatttaagatttagagagttgtttagataactattggagttgctctaactactacatgcttaccaaaagttcaaagcatctaaagcctagcccacaaaagaggcccatgttcaaacattccaaagataaaaatctctcggcgccgcccgcccccccgggggcgtggtcattccccaatccccaagtccccaacctgcagccctgcttccacacgaccacaaccacaggcaacgcaacccccaaacccaaaaccctaccacggcgcccatggcttcgccgccgcctcctcctgcccggcaccccacctccgcagcaaccgccgctgcggcgggcaatggccacgacacctccgcagcaaccgccgctgcggcgggaaatagccacgccacctccgcttcgccggtggacgccctcttcctccagaacctcatgacccgcgtccagctccgcccgcccttcctcgacaccaactcattcctcacccaggaccttgacgacttcctcctcaacgagttcgccgcgctatccgccgctgcaggggcgtcggatgatgacgaagacgtggaggatgaggatggtgggctcgctggcggggagggctccggggaggcgaggcggcggcggatgctggcgagggaggaggcgaagctggagaaggagattgtgcggatggtgctggccggggaggccgaggacaagctcaagcccaattcgggccagtccgtggctgtcggcgaccaccacctctgcgtcggtttccacgacgatgccagcggggagtatcgcatctgggaatggcatggccacgtcatgctgttcgacgacgaggaaggatactccgcagagtacatttatggcaaccacttcgagccgctcgctgctgccacagccagggccaagaagaaggagaaggagatgagagagaaggaattgagcatgggtcttcgggatttggtcgtggacactgacgacggtggcaatgccaatcgctccaaggagaacggtagcagcggagggcccagggtagtgcgcaggaatgtcgtcaatggcccaaccacgcctgctaggtaatggctttctagagcttgcagtgtgcttggtggaagaagcagtgccgcagtgcatcaatctgtgtgacaaaaacaaataaagatctgttgtccttttctcgcttatagctgtttaagctgtctattgtattctgttgagaaatcaatcacatctatactttgcttctgttaccacaagtacacgttacctcttggggttttaaatatattcgttattcaatacttactctacatatatgttgtctgttgtgttaaatgggtcttctttctcttgctgatcatacgatcatatacaaagctgagagatcaggaatcggtatggtagtatagtaggtactttctgcctttctcttcagtactctgcaccctcttatttacacattgcaacatgctgtcatgcagtcgtgggtccaggatttagtcaagcccgggtcaacttacactattgttgctatagatagtgatgttaataaatggttttagaaacattgttaagtaagtttttatttagtacacaatttgataacacatctataaaattatctaggtgattccgtatatgtgtacaaaacgaacaaaagcatgcttatatatttaaaaggtctcataataccttgaatttaacatatgactttgaatcttgcataaatgatcaggctaagctaacacagttactaaatcacatacacaattcaacatataccctagagtagttttaggctaaactaagcaaataattaattgaaatttagaaattggagggcaccactcacctgaaatgcaaagcagtaaaacagtgccgcagaggaacagtgatgttgccgtagagtgctgcttgcctgcctggtgccctgtcggctagggccacaaacccatggtcaacctatgtgcatcctctgcctgccgagacgttggctggctggctgccgctgttggcggcggacggcacaactgctggggtctgggaaagcagggacggtgcaaagtgaggattgccggtggggactgggggatggcggtggcggcagcagggtgccaacgcgctcacccctcactccctcaggtcggatgacggagacggcggcccagggcctggccgccagggcgaggccgcgtgcccgcgagtaggagggagctctggagctgggcgaggccggaggggcggaccgcggtcggatctgggcgaggagacggcgtgccagaccaccggaggccggagggagctgcag

SEQ ID NO: 4219 - DNA, 1809 bp, Zea mays
tgttgttaaatttagaaagtttatttagagaactgttagagaatagtttttatattaactatctaaattattgatttaggaagtattttagagaactgctgaagttgctctaattaaactcgtatatggatgagctctcgccgttccgacactcgttgctctatatcaatttatcaaacgcccaacccaaagagacaaagaaacagcgcacgcgcaccggcgcacgtgtcgctcgacgccgtgcgccgccgcccgccgttccgcgaggagacaggcgtccacctctcccgcctgcatggctgccacttcgctctcctcccttcgcttattgacgacgcatgcctgcctcagaccctcagaccgaccaccgaagaatcccgcaaccatggcgctccagcttgccgtcctcttactgctcccactactcgccggcgcgtccgccgacgacaaattcatccggcaggtgacgacgcaaggtacccgcgccggcgcgggcccgggtctgctcccggaggcgcagttcgcagcgttcgtgaggcggcacgggcggcggtactccgggcccaaggagtatgcgcgtcggctgcgcgtgttcgcggccaacctggcccgcgcggcggcgcaccaggcgctggacccgacggcgcgccacggggtcacgcccttctccgacctcacgcgggaggagttcgaggcgcgcctcacgggcctgcgcgccggcggggacgtccagcggctcatgagtggcgtgccggccgccccgccggcctcgcaggaggaggtggcccggctgccggccagcttcgactggcgcgacaagggcgccgtcacgggcgtcaagacgcagggcgcgtgcgggtcgtgctgggcgttcagcacgacgggcgcggtggagggcgccaacttcctcgccacgggggagctcgtcgacctcagcgagcagcagctggtcgactgcgaccacacggtgcgtgccgtagcatcacgtcactagcctctcggcgtcttctctcttcgcgaatgaattgttccagtccgtggaaggattgaagcatgctggtttgttttggtttggtttgtatgttccattccagtgcagcgcggtggcgcagaacgagtgcaacaacggctgcgccggcgggctgatgacgaacgcgtactcgtacctgatggagtccggcggcctgatggagcagagcgcgtacccgtacacgggcgcggcggggccctgccgcttcgacccgacccaggtcgccgtccgcgtggccaacttcaccgccgtgccggccggcgacgaggcccagatccgcgcggcgctcgtccgccgcgggcccctcgcggtggggctcaacgcggcgttcatgcagacgtacgtgggcggggtgtcgtgccctctcatctgcccgcgcgcgtgggtcaaccacggcgtgctcctcgtcggctacggcgcgcgcggcttcgcggcgctgcggctgggctaccgcccctactggatcatcaagaactcgtggggaaagcagtggggtgagcaagggtactaccgcctgtgccgcggaagcaacgtatgcggcgtcgacagcatggtctccgccgtcgccgtggcaccggcgctgtgaacgaatccagtgtactcctgaaacggaagtcctggacggggcatggtattgtctgcacgtggtagtgtaggcttggatacaagtgataaaggaataacaaatcccgatacgtacagccgtacagaccccacccatgtgctctttgctactcgttccgttccattctaatataaattatatataaatgagttct

SEQ ID NO: 4220 - DNA, 1353 bp, Zea mays
ccgggagaccgaccaccgaagaatcccgcaaccatggcgctccagcttgccgtcctcttactgctcccactactcgccggcgcgtccgccgacgacaaattcatccggcaggtgacgacgcaaggtacccgcgccggcgcgggcccgggtctgctcccggaggcgcagttcgcagcgttcgtgaggcggcacgggcggcggtactccgggcccaaggagtatgcgcgtcggctgcgcgtgttcgcggccaacctggcccgcgcggcggcgcaccaggcgctggacccgacggcgcgccacggggtcacgcccttctccgacctcacgcgggaggagttcgaggcgcgcctcacgggcctgcgcgccggcggggacgtccagcggctcatgagtggcgtgccggccgccccgccggcctcgcaggaggaggtggcccggctgccggccagcttcgactggcgcgacaagggcgccgtcacgggcgtcaagacgcagggcgcgtgcgggtcgtgctgggcgttcagcacgacgggcgcggtggagggcgccaacttcgtcgccacgggggagctcgtcgacctcagcgagcagcagctggtcgactgcgaccacacgtgcagcgcggtggcgcagaacgagtgcaacaacggctgcgccggcgggctgatgacgaacgcgtactcgtacctgatggagtccggcggcctgatggagcagagcgcgtacccgtacacgggcgcggcggggccctgccgcttcgacccgacccaggtcgccgtccgcgtggccaacttcaccgccgtgccggccggcgacgaggcccagatccgcgcgacgctcgtccgccgcgggcccctcgcggtggggctcaacgcggcgttcatgcagacgtacgtgggcggggtgtcgtgccctctcatctgcccgcgcgcgtgggtcaaccacggcgtgctcctcgtcggctacggcgcgcgcggcttcgcggcgctgcggctgggctaccgcccctactggatcatcaagaactcgtggggaaagcagtggggtgagcaagggtactaccgcctgtgccgcggaagcaacgtatgcggcgtcgacagcatggtctccgccgtcgccgtggcaccggcgctgtgaacgaatccagtgtactcctgaaacggaagtcctggacggggcatggtattgtctgcacgtggtagtgtaggcttggatacaagtgataaaggaataacaaatcccgatacgtacagccgtacagaccccacccatgtgctctttgctactcgttccgttccattctaatataaattatatataaatgagttctaatttctcaaaaaaaaaaaaaaa

SEQ ID NO: 4221 - DNA, 913 bp, Zea mays
ctgcagtgcaccttcaccgcttcaggcacaaccacggccgcgaccgtgatccatctttgtccacacgcatcaaaaccaagcgcccgccgcgcctgcgtggcctccatgcacagtccagtcccaccttggcgcgcgataagattcgccagccggccccagtcccgccgcaccgtctcttcccccgctaaacctccccaagtccaccgtcgccaggcccaaaaaccaccgaggatttttcacacgcgaagcggcacagccatgcgcctcctctgctgcttggccgctctcgtcgtcctcgctctccaacaccaatgccacggcctactcctcccgctcaccaacacgatgctctcctcgctccgcggggccaatggcaccgccacgcccgtgcatcacctcctccgcgcgtcgtccctccgctcggccgcgcgccacggccgccaccgcgcgcgcaggagcccgccatcgcctcccagccccggacgccaccgccagctctcgctcccactctccccaggcagcgactacacgctgtccctgtccgtggggccggcgtccgccgcggcgccggtgtccctcttcctcgacaccggcagcgacctcgtctggttcccctgcgcccctttcacctgcatgctctgcgagggcaagcccacgccgggacgctcgggcccgctgcctccgccgccggactcccgccgcatcctctgcgcgtcgccgctgtgctccgcggcgcacgcctcggcgccgccgtcggacctctgcgccgcggcgcggtgcccgctggaggacatcgagacgggctcgtgcggcgcgtcccacgcgtgcccgccgctgtactacgcgtacggggacgggagcctcgtggcgcacctgaggccccgccgcgtcccgctgggcgctggcgatggcg

SEQ ID NO: 4222 - DNA, 1464 bp, Zea mays
tggccgggtgttagagaagtgcaggctcgtaggtccgatcgccggagtcacatgctctgggctggcttctgctgccaggcgccagctgcctcgctagcccaaccgcaatgcgcgccatcgcctccccactcgcgcctcctcgcccagagccacccattgccgtccgatcaagatccaacgccctcgaacgcgccactttaccaccagtccccctcaccgccgcccgtctccgcctccgccgacaaccggagccagggccctcgccacccacccgattgagccaccccatgcctcctcccactgcgacgatgtcccccgcagctggcggttcctttcctgagctcacctgtcccgcggactttgccaccgtcgccgcccccggcggccgcttctccgtcgtcggcttcggatccctcctctccgagcggagcgcgaggagcacgttcccggagctggagggcttccgggtcgcggtgctgcgggggttccgtcgagtcttcgcccacgctgcccccatcttcttcgagcgcggcatcgccatcgaggccaccaaggaattctcaagcttgagcgtggagccatgcgacagtgaactgatagtagtcacggttttcgaaatcaaggaggaagaggtcccggcatttattgagagggaacatgagtttagatttcttgcggttgtccctgaaggattggatggggtaccttttacaaatcgagcagtaagtactctgcatttgaaatcataattttagttttgcctttgctctttgctgctgcttcccacaacaagaattatttttctttgtcttgttggtatttggtggttaggttgtctgtgcacgctacagcaatgaagaatatttccaagagagatgccgaggaagcaaggaaatatataacaagtactatggacggtacaatattgacaaaatatggagagatgatatcttaccatgtcgcttatacctcaggcattgtgttcttgctgcgaaaaatcttggagaaccagcatacagcaacttcttagaccacacctatcttggtgatcggaaaactacaataagggaatacttggccactaccgctgctggactcatggaagaggagcctcccgagtcgctaaaaagtcgctacggtggctgattcgatggctgactctcatatccaccacaggttgagctatcatgcgctcgcagtttatcatattaacagttactgaattaggatttagtagtagtgttccaggatgttcgaaataatgcatggtgctccgttgcagaagatctaggattctggtttgttcggcaggtggcgccaaaacatgtgatatgtgaccaaattgtgattgatgtgcatctataatttgcgactgtttgctacaacaacagaaattcagggccagacacccaaaaatgaggacaaaatgcatctttcccccctttttcaaaaaaaaaaaaaaaa

SEQ ID NO: 4223 - DNA, 1085 bp, Zea mays
cattgggtacctcgaggccggccggggccgggagctgcgcagcagaggcagcgacacgatcgcgagcgcacgcacgtaagcacgttgtcggaagctcaagttagaagaagcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatcaatgtacaattcctccctagatgcggacaaatttctcctacggccatgaccatggtggatgcacgtgggacgtatttgtagcagaagagagtatgcactctgtgtgtatatccaacggtgatgcgcatgggagcatgtgtgcttagagacaaaaacaacattgcctttcattctgttctatcaccaatatttgcggacagtgagagagagcaaggtcccttgtaaaaaaatgagtatattttggtgtagctaaagtcccatgttttgggggtttgaggatctacgtacgaaccagtatagtttactcatagtacagaatgcttagagattgtttagagctctcaaggaagcttctagcatgaatctaataagaagatgccaaacatttcttc

SEQ ID NO: 4224 - DNA, 2328 bp, Zea mays
ttttattatcaagggagattatatagtcaacgctgaatatgttagagcaatgcatagactttttttttattatatattcgataactcaccggtagggatgaaaacagtcgaaaacagatacttatttggatatcaggtttttgatcgaataaataagatgtagaatctgctatacatatttatattcttgtttttagcatcgagcttgtaaaggttcataaaaggtaaaccttaaatgtacgcatcaaataatttctcaaatgataatcaggatacaaattcagatatttattcatttttttattgtagagagcaaataatgcataaaacattctatgcagaattttattcttatttgtaataatatgtttgataacataataagagcaacatcaaatttcttgcatatctattttaaaatattaaatttgttcaaacaattcagatatctatttttcatccctactcaccgacacgcaatatgataaatcatcttcaaaactatcccagtgttatttagatggtttttagtaggcttttccctgtaggtttcgtttgagcctaaagcgacctcatccaaatgggccaaattatccaacatccatcaccagcctaccatacgatacgcgtgggcgtggcgttccttgggaggaaaaatcttggccaagcgtcgagccttgcgtgcattcctgcggccagctgctgccaaggcctgcgagccacatgcctcggcgaatggcgccccttatcccatcgtacccgccagatggcgcggcgccagtggccccgcggatgcggcctcatctccccggcgcggtttagatttccctgggccccgcacccctctcgtggcacagtcacatactttccgcgcctcttcttctgcgcccctctcctcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaaggtctgtgcgccgtaccctactatagctagtaatccgtccgtcgtcaatctcaacgatggcaagctcgttcgttcttgagaggactacgtactgctgagtgctgactcgattgttttcgtttcgcagcaaggtgccgacaggcagctgtggttcgcgtccaagcagtccctctcctacctcgatggcacgtacgtacctgcgctcgttgcccgccccgcgcgcagcaaaccttctgctagcgacgatagaaaccctatgctcacctgcctcattgttgctgctgcatgcatgcatgcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatcccgccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatcaatgtacaattcctccctagatgcggacaaatttctcctacaaaaaaaaaaaaaaaagggcccacaacgccccggatgcacgtgggacgtatttgtagc

SEQ ID NO: 4225 - DNA, 1395 bp, Zea mays
cctgaggggccggcccgcgccccccgggcgtggccagtcacatactttccgcgcctcttcttctgcgcccctctcctcccaaactgcggatagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatcaatgtacaattcctccctagatgcggacaaatttctcctacggccatgaaaaaagaggcccaagccccctggtggatgcacgtgggatgtatttgtagcagaagagagtatgcactctgtgtgtatgtccaacggtgatgcgcatgggagcatgtgtgcttagagacaaaaacaacattgcccttcattctgttctaaaaaaaaaaaagaag

SEQ ID NO: 4226 - DNA, 1078 bp, Zea mays
gccggccgggtttgggagagcagcgagccatcgacacgatcgcgagcgcaagcacgtacgttgtcggaagctcaagttagaagaagcaccagtgcctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatcaatgtacaattcctccctagatgcggacaaatttctccctaaggccatgaccatggtggatgcacgtgggacgtatttgtagcagaagagagtatgcactctgtgggtatatccaacggtgatgcgcatgggagcatgtgtgcttagagacaaaaacaacattggctttcattctgttctatcaccaatatttgcggacagtgagagagagcaaggtcccttgtaaaaaatgagtatatttggtgtagctaaagcccccatgttttgggggtttgagc

SEQ ID NO: 4227 - DNA, 2072 bp, Zea mays
aatcataattctcttgagaggaggagaagagaggagaggacagcaccggacccgcgacagagagggagaggcagaggcagccagaggcggaggatccggaatcaacctcgccggcggccgccgcggtgatgccggtgggggagttggctgcgcggccaggcggcgccatggcggcggcggccgtgggaggggacgacgctgtcgtcatgcagctggccgccgccgagggcgaggagaccgtcatcaccgtcaactgccccgaccaggccggcctcggctgcgacctgtgccgcaccatcctcgagttcggcctccgcatcacccgcggcgacgtgtctacggacggccactggtgcttcgtggtgttctgggtggtgccccgctcctcgtccatcagaatccggtgggcgagcctcaagaaccggctcatgtcgatgtgcccttcctcctactccatcccgttctacccggacatgagccagccgggcccctcgcagttctacctcctcaagctcttgtcaccggaccgcaaaggattgctgcacgatgtgacgcacatactatcagacttggagcttataatccacagagtgaaggtgtcgaccacgccggacggaagagtcgtggacctcttcttcatcaccgacggcatggagctgctgcacaagaaggagaggcaggaggagacctgctcgacgctaatcgctgccctgggcccttccataagctgcgaggttctgtcggcggaagggttccagcagggattctcctctctcgcgccggagatcgccgaggagctgttccgggtggagctagcaggcgacggcgagatgtgctcgagctcgcttattagcgcagagctgaagaaggtccagactgccaccattaatttcgacaactccctcagccccgcgcacacgctggtccagatcatatgcgccgaccagaaggggctcatctacgacatactgaggacgatgaaggactgcaacatccagatattttacgggcggttcagatcggacaagaaaggcgggcggccaggcagcaaaggctgccgagaggttgacctgttcgtgaaacaagtggacggcaaaaaggttacggatcctgagaagcaggacgctctgcgggcgcgcctgagatccgagatgctccacccgctcagggtcatggtcgtcagccgcggaccggacacggagctcctcgtcgccaacccggtcgagctctgcgggaagggacggccgcgcgtgttctacgacgccaccctcgccctgaaagcgcttggggtctgcatcttctcggctgagattgggagacaggcagcgtccgagcggcagtgggaggtgtacaggttcctcctggacgacagcagggagttcccgttgacgaacagcctcgctaacaggaaccgtgtggtggatagggtgaggaaaacgctgatgggatgctacaactagtagggctcctctcctcggtgtcgacctgtctgtctgccaagaataatgcaaagcttcaaggcaactaactggtgtttctagactccgttgtcgtcgctgcccacagctagctgcctgcttcgtcgtctcaaccccgtcgcagctgcgtgggatttcagagctagcacaacaaagccgtgaatgacttcgacacaaatgatgctgcctgtgtgtgccatggatccgttgtatacatgctgagaaagagtagacagagagagaagagcatgtttggtgggaggtgcggtgtgagccgccggagcaatgattgagcatttgtttggttcagggggggattaccgattactggatgctgacacagatacatgaatctctgcgtgcgtgaccctattttaagtggaaaatgttgttgttgtcctcctcccacagcatcctacttcaccaccttgtttgtatctccttccacacaccttccctgtatatgattgccccgctagtagtacctccgccccaccacgcgaggcggaccctccccgcctcatgcatgtaatgtaagcgcagttgtactggatgcatgctatttacttactattagcaaaaaaaaaaaaaaaa

SEQ ID NO: 4228 - DNA, 2640 bp, Zea mays
gcagcgaagcaggcctccttcttcacaagcgcttctgctaacaggcatcgtcgcatctctgtataggtatttctgaaaccagccgtcgtacgtccatcccaccgggagcaccggcgacgatgccgccgcgaacggtgtccgatgggggagacgacaacggcaccgacgttgctagccgaacgtcgtcgcaccgccgcacggagcacgggcatgggtacaaagtcggcgtcccaccggagaagaacctcctcgccgagatctctgacgcggtgaaggagacgttcttcgccgacgacccgctgcggcagtacaaggaccagcccaggtccaagaagatctggctcggcctgcagcacatcttcccggtgctcgactggagcaggcattactccctcggcaagttcaagggtgacttcatcgctgggctcaccattgccagcctctgcataccccaggacatcgggtattctaagcttgctaacttgccagcagaggtgggactatacagtagcttcgtgccgcctctgatatacgcagtgatgggcagctccagggacatagccatcggcccagtggccgtggtgtcgctgctgctcggtactctccttcagaatgagatcgaccccaagacacacccgctcgagtacaggcgcctagccttcacagcaacctttttcgcaggggtcactcaggcagccctcggattcttcaggctagggtttatcatagagttcttgtctcatgctgccattgtcggattcatggccggcgctgccatcaccattgcgcttcagcagctgaaaggattccttggaattgcaaacttcaccaagaaatccgatattgtatctgttatgaaatcagtttggggaaatgttcaccatgggtggaattggcagacaatactgataggagcgaccttcctggcattccttctggttgccaagtacattgggaaaaggaataaaaagctcttctgggtgtccgcaatcgcacctctcacttcggtgatcatatccacattttttgtgtacatcactcgtgcagataagcatggcgttgcaattgtcaagaacataaggaaaggcatcaacccaccttcagctagtctaatatacttcaccggcccatacttggcgacaggattcaaaattgggatagtagctggaatgataggcctaacggaagcgattgcaattggaagaacatttgcagccctcaaggattaccggatagatgggaacaaagaaatgatggctctagggaccatgaacattgttggttcactgacttcttgctacgtagccacaggttctttctcgcggtcagcagttaattacatggctggctgcaaaacagcagtgtcaaacgttgttatgtcaattgtcgtaatgcttactttgctactgatcaccccattgttcaagtacactccaaatgccatcctttcctcgatcatcatatcagcagtgcttggtttaattgactatgaatcggcttaccttatctggaaagttgacaaactggactttctagcatgcatgggagcattttttggagtcatattttcatcggtggagtatggcttgctcattgcggttgcaatatctcttgctaaaattcttctccaagtaacacggccaagaacagttttacttggaaaccttccacgaacaactatatacaggaatgtagaacagtatcctgatgctaccaaggttccaggggtgctgattgttagagtggactcagctatatacttcacaaactctaactatgttaaagagagaatcctgaggtggctaagagatgaggaggagcaacaacaggaccagaagttaacaaaaactgagtttctaattgttgacctgtctcctgtaattgatatcgacacaagtggaatccatgctttggaggagttggcgaaagctcttgaaaaacgcaaaattcagctggttcttaccaatcccgggccggcggtgatccagaagctccgctcagcgaaattcacggacatgattggtgaagacaacatattcctcacggtcggcgacgctgtgaagaaatttgctcctaagatggtcgataatgtctgatggagtttctgggtcatgacagtacgagcgagaagtctatctattttgtggcaaagttcagtggcaattatggatttatagagcagaaacaaaacagaacagaacgggagtaaataacatggttcgcggaatggtaaataaagaagatgctccggagttggagtgcatcacgtttgcgaggtgtggttggatagaaaacagatggtggcctagttgggcgtctatgtcagtccttgtggttgtggagtctgttccgcgttggcaagcactcagtgatggagatcaaatgcttcatggatcagcagatatgggtgcctgatgattaacatatcatcattgatcgtgaaagaagagttacctcgttggggtttcaggctttgtgtatatcttacagtacttagcccctttccttgtagtttatgtttttatgacgagcttttacatttggcttatatatgtatattctgtaatgttgatgcattgttaactgttaagtgttcctgaccaaaaaaaagggatgcaaaaacgtaaaaaaaaaaaaaaa

SEQ ID NO: 4229 - DNA, 1134 bp, Zea mays
agtcatgcagcaggtcgagtccgcgtccaagaaatgtccgcatcctcctcctccgttccccttctggtatatataacgacgagcagccgccctgagacatcaaacaaaaaaaatctcaaattctcaaagtcgtcgatccagcggtagcagcgcacataccgatcgatctaggagagggagagaaccaaccaatttcatcgccgatcaaacaaggaaaaaagatcccggccatggcgacgcggtcgctggagctgacgctgatctcgggcaaggacctcaaggacgtgaacctgatgtccaggatggaggtctacgccgtggtgtcgctctccggcgacccccggtcgcggcagcgggtccaggccgaccgcaccggcggccgcaacccgacctggaacgccacgctccgcttcgccgtcccggccaccggcgccggctccctccacgtcctcctccgcgccgagcgcgccctcggcgaccgcgacgtcggcgaggtccacatcccgctgtccgagctcctctccggcgcccccgacggccccgtccccgccaagttcgtcgcctaccaggtgcgcaagatctcctccggcaagccccagggagtcctcaacctctcgtacaagctcggcgaggtcgccaacggctacgcccccgcttccgccgcccagtccgcctacgcccatcctccaccgaccgccgcgtacccgcctccttcaggcaaggctgacgcctacgcgcctcccgccgcgtacccgcctccttcgggcaaggccgacgcgtacgcgccccctgccaccgcatacccgccggcagccaaggccgacgcgtacccacctccatacggcgcctacccgcccgccggcggcaaggccgacgctgcttacccgccctcatccggctacccacccgcggcaggcaagccagccaaggggggcgaaccggtgacggcctacccttcggccggtcccagcacggcggcgccctacgctgctcctccgccgcagtacggcggctacggttacccgccgcagcagggcgcgggctacggctacccgcccccgccgccgcagcaggcggggtacgggtacggctacccgccgccgcaggccgccggctacgggtacagcagcaggc

SEQ ID NO: 4230 - DNA, 3522 bp, Zea mays
  misc_feature (127)..(127): n is a, c, g, or t
  misc_feature (139)..(139): n is a, c, g, or t
ccatttgcataacaaagaagaggctcctagccaattgaaaatagttggtgttcaagcaataggggggatttttgctggtgatgtgacctcttgttacaactcccatagatacaatcaagcctaggtngtaggtactatntgacattctgtttgttgattagtcttgtaatttgatttgtgaggcttacccttatactgatatttcctccaatggtggggtattgatgaggtaaactggaatgttgtctatattaaacaatatatatttctatgtttatagttgtttcttttctgctgaaaaaaccagaaccagtttgtcaaacccgaattgcaggttgtggtgtccaccaagagtccaaaattagatagacaaagtgcgtgggaagttatggctgacagtacctcttatttcatcaaggaagagactggtcccgagaaaatgcttacatgtgaaactcggattagactgtttaatatgtattcaataggctgacgataagtatgagtttgcggacttttcagtttgtgtctttccccatatacagatggtaggaaaaatcaagaactattgaggtagggtcttgacaacttcttgcttatcctcttgatcataccagttcttttgatctatgaatttgtaccgccttttcatttatttcactgatgtaacctccctcttgattggcaggttcaagtgcctgaagacccaaaaggtgaagaggcaaagggttgatgaagcttcacttaagaggttgttagcaaatcatgggatttcttgttgaagtatgggctcttgctacatcgcaatggtaattccatacttaaattttaatgataattccatacccttcaatcagtttgatattgaattttcttttccttgtgccagtaagttcatgcaaaaaatggactcaaagctcctataaagaaaggcacttgatctttgtatcttgcatgagtttgtttataaataaagttgtatctaaagtctaaacttcgatgatctatgaaagaccgttcttggtttttgtttttaaataaagtctacttatatgatatatataaatcgtagcaacgcacgaacatctaactatatatcttaaaagttatgagactattacaaagttctagaggccaattaattttgatttacaacacaacacatgaccatacgtatgttattattgtactttttccgttgcaacgcacgggcacttatctagtactacttatgttccaaaattattattcgttttagttctttatttttatgtctatatttaaatagtagtgaaaatatacacttatataaaatatatattaattattgtataaatatattaaaattatagaataaattttaatttgggacaaaattacgatgttctggacaaaatggaataagcatactgtgcgaagaaaccatagcgacggacgagcagcgtcgtcgacgcgtggaaagatccctccggcaaacggcgaaggcgatctttcttttttcgcaagagaatcgccggcgctaccacaactgacggctgagattcgctgagaaccacgccacactggcgttggtcaatgcgcagaaacgtcgccacttgggatattacacaaacagcactgagacaccgacaaggtggcccaacggcactgagcaaaagaaacggtcccattccttcggcgcctttggcaaccgatccgcgtgttgcggtgcggtcgcaaagcgccacagagtaagcccagacacaccctgagaccacgcgtcatacatgctacactctcctcttctcatccgcgtgtaaggaaaccgctgacctccatcacacacgggggtctagattctagaagtacctgcaagccaccaaaggtttcactgacatacagtcccatgttacttggacccaccagtcatgcagaaggcaaagtatccgcgttcaagaaatgtcctagcagcctcctccgagctccgatcccctccctagcataaacacgagccttgtgtcgtggaaacaatctcaagtcatcgattcatccagcacaagcagcatcacacaaaaccgatcaatctcgcacagggagaaccaaccaatccatcatctgtctcgactctctcgcgtctccgccggatccaaacaagaaaaaaaagtgccctcccgcgagctcccggccatggcgacgacgcggccgctggagctgacactgatctcagccaaggacctcaaggacgtgaacctgctgtccaagatggaggtctacgccgtggcgtcgctctccggcgacccccggtcgcggcagcgggtccaggccgaccgcgccggcggccgcaaccctacctggaacgccacgctccgcttcgccgtcccggcaaccggcgccgcctcctccctccacatcctcctccgcgccgagcgcgccctcggcgaccgcgacgtcggcgaggtccacatcccgctctccgagctcctctccggcgcccccgacggccccgtccccgccaagttcgtcgcctaccaggtccgcaagatctcctcgggcaagccccagggagtcctcaacctgtcgtacaggctcggcgaggtcacccagacgacaggcgccaacggctacgcccccgccgacgccaccgacacccaggccgctgcgtacccgcctacctccgcgtaccagccaccgtccggcaaggccgacacgtacccgcctccttcaggcaaggccgacgcgtacccgcctcctgccgcatacccgccggcagccaaggccgacgggtacccacctccgggcggcgcgtacccgcctgcggcaggcaagccggccaaggcgggcgagccggtgacggcctaccctgccgccggtcccagcacggcggcgccctacgccgctcctccgtcgcagtacggcggttacgggtacccgccaccgcaggccgccgcgtacgggtacccgccaccgccacaggccgggtacgggtatcagcagcagcccaagaagaagaacaacttcgggatggggctcggcgccgggctgctgggtggcgccgtcgggggccttctggtcggggacatgatctcggattcgtcggcgtatgatgccggctacgacgccgggttcgacgacggcggtggcttcgatttctagagcagcgcagtggtgacgtgataccgcgcatctgagagacgagttctttcgtcttggatctgactttgtgacttctttcgctttatacgcgatctgattgttaggacgaaatcaaattatgcatcttatatctgatacactgcatgttattgatatgatactggaagcgtgacattatatgaatggcacacagttttcttttgttcagattggcgcctgcttccgaagtttctgatggtctgacgtctgatcgattggagtgtgtgttgaccaaacatttttactgagattttgagggacagtttcatatttgcgcttgcttgcgaagttgcctgtacgtgttgatgatccaatcttggaacaggttgatacacgtagcattgtattgca

SEQ ID NO: 4231 - DNA, 1119 bp, Zea mays
tttttttttttttttttgttagtattagaacatctggtggacgaaacagtccaatggaggcgactgtaccgaaattcgcattacactaggttactgattcatctgttattgaaaacatgatgggatcaaaatctacccccaaaacacgttcaagcatcacagatcccgcagctcttgcggcaaaacccgagagtgtctttggtcccaaccatgtacgtcgggttcctgtggcactccccgatagcagcccatctagggcagagctccttgtcgtcggagcacggcgcgtccgtcctcacgtctggggggttgtcgaacgacctgacgtggatccatttcgtcgccgaccatttctcgccctcgatcaccgggcagctcccgtggagactgcctgtatcggctgtggcgttgacgtggaggttgaagaacagtagcgcgtctcctttctttggcttcactgccaggccagatcttgaacactccgaccaagtttcgtccttgtactgtaaatggcttccctcagcgtttggaaatacagtctctccacctttcttgacatctgtgaggtacataaggacggtcgcaactcgctggccgccgagcttcaggttgtttctgtcgtggaaatagtcgaagtgggcgtcatacttctggccggtttcgtagcgcaggacctggagtgattcggcgttttcttccgggagaaatgtccaagcagctacgcgtttctcaatcgcagacacgatctcatcctcgcgcttggccaagaaggtgccggagctggtgcgcgcctggctcgccacactcttcccggagtcgttatccgccaccatcgacttctccatgctgcctttcgccaggctgacgaggtggtcgcactcggtgtccgagaggaagccgctgtacaggaacgccctggggcgcgaggagagctgagtgacgctcgccgggtcgtagaagccgccgccgccgccgtgggcgtgggagacggcccgcgagagcacgatggcggcgagaagaaacagggcgagcggcggcgccatggaacggatggtagagcaccgcggaggcggtcgtgacggtttcttgtattctctacctttttattggtcggcgtgc

SEQ ID NO: 4232 - DNA, 1240 bp, Zea mays
aaaatataaaaaaatcaccgctcaagctcacggcctcacctcacccacccgcccgcctcgcctccatccacagcgccacagcggccacgccatctccgtctctctgctcacctccacttcttccgttcttcttcaccgtctccgtccttgacacgggcgcacccgtccccctccgacttccccgtggcctcgtcccgatccgtagtcaactcgaccttgttcaagagggtgagcccgaaccacggcgcgcgggagggctctttttattttgacccaccggaggacagccgccccatgggctggtcgcctgagcgcgctatgtatcagctcatcgaccggcggaaaggtactggttccatgtctccttgcttctctagatctggtgaattccgcgtagatctggtccggatggtacactgtgtcggttagttggttattcactagtatcccgtcgcctgcctgctttgaaaaaagcccttcttttctcgccgctttaggttcgggtgaacgtcgtgagcgcgcaccgcatacgagagcaattaagcaaagcagctgcactctttgctcagatttttattgctatctttgctatgctcgagtgtaattattagtatgcttaagcctgttgttgcaagcaattgatgggtttgaggccttgtgagggcgctggtttgagaactagggcagcatctcaaacttatcctttgctggctttgctgataacatcaacaattcgttttttgttgctaaaaaaaaaaaaaaattgctgtttatgtatattcaatgatatttcgttaggcctcgttcgttttcagcggatcagcctattccataccttgttccgggtggaacgaatgaacctggtttggaatttggtataactcattgaaattgttcgtttcggcccgaattggaatcgaaactggcccggattaaaatttcccttcaccccacggcccggaaccaacccttgtgtcgtacccaccggatcgaagcctagacacgacgcgaccggcgcgacggcggctcgacgcgaccggcacggcggcggcgcacagccccgacgacgaccctccccgctgccttctccccggtgaggattttctctcttccttccctctcctatcctctgctctcgctgccccaaactcacgccctcgatctcgctcctctccgctctcgcaccgcgacgctgcgactccgctcccgtcctcgtgctcactgctacggagtcggatcc

SEQ ID NO: 4233 - DNA, 1512 bp, Zea mays
ggtataattgcaggacagcgtccagcttaggaaatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatagcaaaacaccaacgtggcaagaatcaactccacaagcaacttcactgccacaaaaatcgcaacagaaagaaccagttgaaatggatgctaaaccagttgaaaatgcagaggaacaatttgtcgtaggtcctcccagtgccagtgggaagcagctgcatgttgaaattcctaaagatgatctacggcatatttctcctgtgaccggtgaaagtggaatcagtacggtgctagacagcaccagaaatactctgagcagcagtggctgtgatagcacttccaaccagatcaccgcccctactgaaccatcatccaatgtatacaggggcgttcctgaaaccgcaagaccccttggttggcgccccctgagccagcgtgaggctgcactgaacaagttccggctaaagaggaaggacagatgctttgagaagaaggtaatcgactgattgcacattttcattccaatccaattctcggtgtcacttactaggacatgtgatttatgcctttgcattcatttgcaggttcggtaccagagccggaaattactcgcagagcagcgtccacgggtcaagggccagtttgtccgtcaagatcatagcatccaaggaagctagggtccagttactgagctggaactctttcccattatctacaaaaaaaagtcactgtaagtgactccactgcggggtaccctgatgtcaggttttttcgaagagttggaagcaaccacactgagttacggtttgctgtgtatgtttgctaaagcttgtaatatatgtatgtataggctgactctgttctttccttaggttaggcacaggacctggcacgttctagacggtttgtcggtagacgttagaaaatacaggcatacttgtgtcctccagtagcacgtgtgctttaagccttgtattatgtaactagccaagttgtttttgatgtttcggattagatgtacactgtggatgtatggcgtgaaggatgtccaccaaagtatgctcgtttctgtgcagcttgttgcaatgaacattgttggcctggttttagtaaaacaaaaaaaaaaagagtattagtactgtgaaattttctacagacggtatgaagtgctaaatttgggtgacggtttttataagaagatcatgtctccagtttgcctggttgttaagcttgcgaagttaaattcggcttgcagtgaacgtcgtctggtttcggctgctgttactgtctcgttttcagggggatcct

SEQ ID NO: 4234 - DNA, 2574 bp, Zea mays
aaactggcattcgattcgcagcccaccagctccggtttcttccgactgcgagcttccaagtggcgactgcccgagtgcgagaagagggagagaagcggttgtcggaatccactccggccaggggtgcggaggtcggaatggggggaggattggatgaggcggtgaaggtggtggatttggaggacggtgaaggggaggaggaggcagaggccgccgcggcggagggatcgagcatggagatggggatgctgccaaggatgccggtgcgtgtgctgctcgccgaaggcgacgactccacgcgccacgtcatctccgcgctgctccgcaagtgcggctaccgagttgctgcagcctcagatggtgtgaaggcgtgggacctattaaaggaaaaatctttcaaggtagaccttgttttaactgaagttgaactgcctttgatgtctgggttcctcctgttatccacgatcatggaacatgatgcgtccaagaacatccccgttataatgatgtcttcgcatgactcagtaagcatggttttcaaatgcatgctaaagggtgcagcagatttccttgttaagccgataagaaagaatgaattaaggaacttgtggcagcacgtttggagaaaacaactggcaaacggtgggcctaatgttcagcacatacaacgagaagagaatcttgcagaaagaatccaacagaagactggtgtgacaaaagctgataatttggacagagatgtgccctgtaaaaatagagaatgcagtgaacaagaaagtgatgctcaaagttcttgcacaaggtcagagctggaggctgaaagtaagcaaacagacaacattttggagtataagcaatcaactcaaaggcacttgtctattcctagccacaagaatgttgagctaaatggacagaccaaaatacaaagagctaagggtaataacttgatcccagcaagcgaagacgatttatcgccaaagaaaagaacgtgtttgaatgagaataattctgagagagcttcaagagatatggagctagtccacattatggaaaatcagcagaagtataacacacagtgggaggtggatactatgagaacaacatctaggggaaatgatgagaagggctccatcccagcacatcagttggagctttctcttagaagaactgactacggaaaattagagaaccacgagaaaaatgatagaagaacactgaaccattcaacttcctctgcgttttccttgtataattgcagggctgtgccaaccttaggaaatgctggtgatggtcaattatgcagcacctcagaaacactagtggatgttgaaaataaaaatggagattcagcagatccctctcaagacatgactgaaacaaatcgtcctcctattagagttgttcctgtccctgtccaaggtctcacatttgatgggcagccattctggaatggtacaccagtggcatccctattctactcgcagtcaactcctcccatttggaatagcaaaacatcaatgtggcaagaatcaaccccacaagcaacttcactgccacaaaaatctcgacagaatgaaccaaatgaaatgggggctaaaccagttataaatgcaggggaacaatttgccatgggtcctcccagtgccagtgggaagcagctgcatgttgaaattcttaatgatgatccacggcatatttctcctatgactggtgaaagtggaatcagtaccgtgctagacagcaccagaaatactctgagcagtagtggctgtgatagcatttccaaccagatcactgcccctactgaatcatccaatgtatataaggatgttcctgaaaccccaagcgccgaagggtcacggcatctgagccagcgtgaggctgcactgaacaagttccggctaaagaggaaggataggtgctttgagaagaaggttcgataccagagccggaaattactcgcagagcagcgtccacgggtcaagggccagtttgttcgtcaagatcatagcatccaaggaagctagggtccagttactgagctggaactctattctattatctaaaaaaagtcactgcaagtgactccactgcggtctgcgggtatcctgatgtcagattttgccgaagagttggaagcagtcacactgagttacagtttgctctgtatatttgctgaagtttgtaatatatgtatgtataggctaacgctgttctttcctaggttaggcacaggacctggcacgtttgaaggtttgtcagtaggcgttagaaaatacaggcatactttgtttcaggtcaagatgagatgtgaccttcagtagcgcatgtgtgctttaagtcttgtattacgtaattaagttgtttgatgtttcgggttagatgtacgctccgtggatgaaatgtaaaggatgtccaccaaaacatgcttgtttccgtgcagcttgttgcaatgaacatcgttggcctggtttctgtcgaaaaaaaaaaaaaaaatgcactactgtgaaattttctgcagacggtatgaagtgctactctgaactcgagtgatcggttatgtgagcaggggta

SEQ ID NO: 4235 - DNA, 1398 bp, Zea mays
agagagtgacgctgattccaactcccttcaggaaatggagagctgatcgttgtggagactgcagagatcgtttcacggccaaagccagaatgctcggcaaaaggaactccagagacaggcgttctccagatgcggtgaagcccatgaggcgtcctctcaacaagtaccccttcgccaccgccgtgctttggtcggccacgcccctcttcttgggctacgacctcgccgtcgtctacaacacggccgtcagggcgcaggccgacctgaagctgctggcgtgcaccgtcgcgctctcctctagcctcggcgcggtcgcggccgtgggagcgcagcgcctcatcggaggccgccaggccgcgctcctgtccgccgccgtgctctgcgccggcgcgatcgcccggggcctcgccaccggctccgcggcggcgttcacggccggcgtcttcgtcaacggcgtcgggacgggcctggcgctcgcggccgtcccagcctacgccgcggagctcggcccgtcctctgcgcgccgcgcgctcgccgcgcaccccgacggactcgtgtacctcggctgcatcctggggtcggtcgtctactccatgcgactcgtgagggttcctgcccgccacgcgtgctggctgacagttgccactggtatagccgttccggcgttgctcagcgccgtcgtcctcttcatgcccgaggcgccccgttggcgcgtgtccagggaccgggaaagcaaggcccggcgtatgttgagcagaacatcggcgacactggaggaggctgagctccgtctggtcgagataaaagtcgagtgcggcgaactgctgcaggacggctccgacgagccgctggcggtgtccaagcgggcccggtggtggagggaggagattgaaacattgagagagctcctggtgcgacccacggagcctcttcgccgcgctgtcctcaccgcgctcgtcgccaaggtcttccagcaggtgtccagcatcgggtccattctccagtacgtgcagcgcgccttccgcgactcgtccaggggggcgctggtggtgttcgtgtttgtgatgtcctaccctatgtcgctcgtgctcgtggagctcggctggctgctggtgacggcgctcgcccgcagctgccgtctgggcaggcgcgtgccgacgggcggcgtgacccggcggcagaagcagctgaagtgggtgaggggcctgtccgcgacaatgcttctctcgctgatggctctggtgtggatcgcgctcggcccagcgccgtgggcgggcgcgtcgtcacgcggctgcctgcggtggctgcgggcaacggtggcggtggtgaaaaagtctgtcatctcggcgatctagtatcttgtttccgaaaaaaaaaaaaaaaagatcttgtggcatt

SEQ ID NO: 4236 - DNA, 1237 bp, Zea mays
  misc_feature (803)..(803): n is a, c, g, or t
  misc_feature (931)..(931): n is a, c, g, or t
  misc_feature (961)..(961): n is a, c, g, or t
  misc_feature (1021)..(1021): n is a, c, g, or t
  misc_feature (1173)..(1173): n is a, c, g, or t
aaaaaaaaaccgccattcggatagcacgggcgcacctgccgaccggcgaaacccagccgcatactcgcgcccattctcgccgcgcacgatgctccgtctccccaccctcaccgcccttaaaccctcaacccccgccatcagcttgaaccgtgtcggctgcagccatggccgccgccgccgcaagctcatctttgtctcatccgctcctccgccgtcttcttcgtcttcacggcctccgaagccgacgtcgaacccggaaccaccaaagcccacacatgaggcccgcaaccggaacccggatggatccaccgaggcagggttccccacaaccaagccccggaagccacgccgtgggcgccgcagcgaggcggcggccgtggaggacttcgtccgcaaccgccttgagcaggtctttgcctccatccaggagcgcaaccccgacgtcctcgagggcaaaggcgacatcctgaagccgaaggccgatgtggagcgattaccagacgacgagggagagggagaaggagaaggaggagaacagaagcccgtggtggaagaggaggacccgagctggccgctggatgccgatgtcggatgggggatccgggcctcagagtacttcgacaagcactcgatcagaaatgtcacagtggacggggtggagatcgattgggaaggggacgtcgacgaggggtgggtcaaggaaatcaattgcttggagtgggagagcttcgcattccaccccagccccttagtcgtcctagtcttcgagcggtacaacagggctgctgacaattggaagtttnttcaagaattggaaaaggctgctaaggtgtactggaatgctaaagatcgcttacctcctcggacagtcaaagttgatataaatattgagagggatttggcatatgcacttcaagcaagagaatgtccncaattattgttccttaggggaaacaagatnttatatagagaaaaagagataaggactgcagatgagctggttcaaatgattgcccatttntactacaatgcaaagaggccatcttgcgttaatcctgaggccgttgcttctttctagttcttgtatagaattgttgacatagtgttttcatcctcaaccggtgtgttggtgctagtttttgactggtaaatattttatccgaaagtttactnttttgccaattgtaaacagcaatagtgccggttattcatctatttagcaaaaaaaaaaaaaaaa

SEQ ID NO: 4237 - DNA, 1446 bp, Zea mays
gcacgagaccattacctagaacatcctaatcacccagccgcatactcgcgcccattctcgccgcgcacgatgctccgtctccccaccctcaccgcccttaaaccctcaacccccgccatcagcttgaaccgtgtcggctgcagccatggccgccgccgccgcaagctcatctttgtctcatccgctcctccgccgtcttcttcgtcttcacggcctccgaagccgacgtcgaacccggaaccaccaaagcccacacatgaggcccgcaaccggaacccggatggatccaccgaggcagggttccccacaaccaagccccggaagccacgccgtgggcgccgcagcgagtcggcggccgtggaggacttcgtccgcaaccgccttgagcaggtctttgcctccatccaggagcgcaaccccgacgtcctcgagggcaaaggcgacatcctgaagccgaaggccgatgtggagcgattaccagacgacgagggagagggagaaggaggagaacagaagcccgtggtggaagaggaggacccgagctggccgctggatgccgatgtcggatgggggatccgggcctcagagtacttcgacaagcactcgatcagaaatgtcacagtggacggggtggagatcgattgggaaggggacgtcgacgaggggtgggtcaaggaaatcaattgcttggagtgggagagcttcgcattccaccccagccccttagtcgtcctagtcttcgagcggtacaacagggctgctgacaattggaagtttcttcaagaattggaaaaggctgctaaggtgtactggaatgctaaagatcgcttacctcctcggacagtcaaagttgatataaatattgagagggatttggcatatgcacttcaagcaagagaatgtccacaattattgttccttaggggaaacaagatcttatatagagaaaaagagataaggactgcagatgagctggttcaaatgattgcccatttctactacaatgcaaagaggccatcttgcgttaatcctgaggccgttgcttctttctagttcttgtatagaattgttgacatagtgttttcatcctcaaccggtgtgttggtgctagtttttgactggaagaagaagctcccttattcaatcattttccaggacatggtgctcggatagtttggaattgatatgactaaacgaaaaccaagaaaaacatctcaatgctggttgggaaagtgtgaactaaatcatgtatcattctgattagtagtgtagtgtaacaaaatacaactttcaggggagagtgcttagatcatttttatcggttagctatattagatgatttcaaagttgactgcaaactttgtcatggagcaaaacttaggtgctgtttggttcacgaaatataacgtaaagggtaatggtaatggtttaaaaaaaaaaaaaaaa

SEQ ID NO: 4238 - DNA, 2498 bp, Zea mays
gcacgagaccattacctagaacatcctaatcgaaaaaaactgccttttcttccggcttccaacttccaagtggcgactgctgccgactgccgggtgcgagaagagggagagatcagagtatcagacaagctgttgtccgaatccactccggcgaggacgagtgctgaggtcgaaatggggagaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctactcgccgagggcgacgactccacgcgccacgtcatctccgcgctgctacgcaagtgcggctaccgagttgctgcagcctctgatggtgtgaaggcgtgggacatattaaaagaaaaatctttcaacatagaccttgttttaactgaagttgaactgcctttgatgtctgggttcctcttgttatccacgatcatggagcatgatgcatccaagaacatccctgttataatgatgtcttcacacgactctgtaagcatggttttcaaatgcatgctaaagggtgcagcagatttccttgttaagccgctaagaaagaacgaattaaggaacttgtggcagcacgtttggagaaaacaactggcaaacggtgggcccgatgtgcagcacatacaagaagagaatcttgcagaaagaatggaacagaagactggcgtgacaaaagctgataatttgaacagcgatggtccccgtaaaaatagagaatgcagtgaacaagaaagtgatgctcaaagttcttgcacaaggtcagagttggaggctgaaagtaagcaaactaacaacattttggagtatatgcaatcaactgaaaggcatttgtctattcgtagccacaaggatttagagctaaatggagagaccaaaacacgaactaagggtaataacttgattccaacaagagaagacgatttatcgccaaagaaaagaacatgtttgaatgacaataattctgagagaacttccagagatatggagctagtccacattatggacaatcagcagaagcatgacacacagagggatgtggatactatgagaacaacatccaggggaaatgatgagaactccatcccagcacaccagttggaactttctcttagaagaactgactatggaaaattagagaaccacgagaaaaatgatagaagaacactgaaccattcaacttcatctgcattttacttgtataattgcaggactgcgtccagcttagtaaatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatatcaaaacaccaacgtggcaagaatcaactccacaagcaacttcactgccgcaaaaatcgcaacagaatgaaccaattgaaatggatgctaaaccagttgaaaatgcagaggaacaatttgtcgtaggtcctcccagtgccagtgggaagcagctgcatgttgaaattcccaaagatgatctacggcatatttctcctgtgaccggtgaaagtggaatcagtacggtgctagacagcaccagaaatactctgagcagcagtggctgtgatagcacttccaaccagatcaccgcctctactgaaccatcatccaatgtatacaggggcgttcctgaaaccgcaagagccgaaggtttacgacacctgagccagcgtgaggctgcactgaacaagttccggctaaagaggaaggacaggtgctttgagaagaaggttcggtaccagagccggaaattactcgcagagcagcgtccacgggtcaagggccagtttgtccgtcaagatcatagcatccaaggaagctagggtccagttactgagctggaactctttcccattatctaaaaaaaaagtcactgtaagtgactccactgcggggtatcctgatgtcaggttttttcgaagagttggaagcaatcacaccgaagttacggtttgctgtgtatgtttgctaaagcttgtaatatatgtatgtataggctgactctgttctttccttaggttaggcacaggacctggcacgttctagacggtttgtcggtagacgttagaaaatacaggcatacttgtgtcctttagtagcacgtgtgctttaagccttgtattatgtaactagccaagttgtttttgatgtttcggattagatgtacactgtggatgtatggcgtgaaggatgtccaccaaagtatgctcgtttctgtgcagcttgttgcaatgaacattgttggcctggtttt

SEQ ID NO: 4239 - DNA, 744 bp, Zea mays
  misc_feature (689)..(689): n is a, c, g, or t
ggtagaagaaaagtgcccctacactccggccggcagagagaactcacattgcggttgcggacctcagcttgcccactacagagctaaccaaaagagatgaaagggagcctttcccacgagctcgagacggggctcccagccgccgacgtgtgggaggtctacggaggcctccttgttggggacttgattccccagctgcttcctcaagttttctcaaaggttgaactcgtagagggagacggtggagttggaacggttctgctcgtcactctcccgccagggactcctggatcagaggctttcaaagagaagttcgtcaaggtcgatgacgaaaaccgcgtcaaggagtgcctggtaaccgagggaagcttttttgaccgtggcttcaagaaatacctggtgcgaatcgagatcataggagaagatcgggaggcatccaccataagatcaactatcgagtacgaagttgaccaggagcatgcaggcaacccccctgttgccagtaccagtggcttggctactatcgctaaggccatcgcagaatatatcaagcagaagaagaaaggtcctcctgggtaattaagctcccatgtaatcaactccgggaagaagggatattatattatatcgtgtatatgtttgatcagtgaacaactgaagtttatttgtgtctaccaatgaacaaatanaatacggtaacgagcgaatggttgccatttcaaaaaaaaaaaaaaaaaaaaaaaa

SEQ ID NO: 4240 - DNA, 878 bp, Zea mays
cattgggtacctccgggccggccggggctcaatctcctctccttgtccactggcttgggcgtgcctttgcgtgcgacgggagctaggaatccacggcatcggaaaagtggccgcctgaagaaccgatttctccaagatttttttgtccgtcctatcgcttgcaggatcggattcgccgtctctggccatggttctcgccggcctccgccggcacgtcggccagttcttgaccagcagtaatgagcttatggcggcgtcgctctcggccgtgagctgcgcggacgaggtgcagaaggcggagggggcggggtgccgtgacgacgccgcggcgctgcggctcaagaaggtggccatggcggcgatactggtggccggggtgctcggggtggtcctgccgctcgcagggcggaagcggcgcgcgctgcgcacggacagcgccgcgttcctggcggccaaggcgttcgccgccggggtcatcctggccacggggttcgtccacatgcttcacgacgccgagcacgcgctgtccagcccgtgcctccccgccgcgccgtggcgacggttcccagtccccgggttcgtcgccatggccgctgcgctagccacgctggtgctcgacttccttgccaccaggttctacgaggccaagcatcgcgacgaggccgcgcgcgtcaaggcggccgccgccgcgcgccctcgttccgacctcctctggagggtaattgcgcgccgaggacatcaccgtggtcaccgtcgacgaggacgagcgcaaggccccgctgttgcaaacgcactgccatggacacggtcacagccacagccacagccatgtgcatgagccggtgcaagtagagggtagcgagggggaggtgtcggcg

SEQ ID NO: 4241 - DNA, 3262 bp, Zea mays
gagtcctgccgggcggcggcagcacaacatcagaaccttcccaaatcctctcctcccccccccctctcgcgcctcctacctctctccagtcggttcccacgccttgccgcgctttacctctgcggccccccccgccgcccgggaacccgcgcgccggctccggcgagattcgaccaaactccatggggctcgagatggtggaggtcatgtccgagactgttcctacggttgtgcctgcggcagcgagggagaacggggtggatatttacccgctcagccgctactacttcggcgccagggacgccgccggcgtgccccgcggcctcgagaccgccgctgaccgcgcgctacggctcaaggcaaacttcgcggcgcacgggctccgcacgagcgtccacggcgtcctcctggtggagctgttcgatcacccgcacgtgctgctgctgcaggtccggaactcctccttcctgctccccggaggccgcctcaggcctggcgaggaagaggtccgagggctcaagcgcaagctctccagcaagctctccgttgtcgacgatgcggaggccgttcaagaagaagactggcagattgggcagtgcatcgggatgtggtggagatctgaatttgaggccatcccgtttccctacatgcctccacgattccgtgcggcaaaggaatgcatgaagctgttcctgatcaggctgccgatgtcccggcagttcatcgtgcccaggaacatgaagctcctggccgtgcctttgtcccagattcatggcaatgctcaggtttacggtccaattatagccggcattccgagcctactgtccaagttctccttcaacgtcatcagcgactgaattgtgcaaaccaaccagaatgttgaggggtcagtagacgcatgcatacttggctagttgaagtcatagaacagtgtgcgataccgatgggagcttgtattgagaagtagctcatctgtttttttttgtgtgtataacgtatccccctcctgggctcttgctgataatgatatgtatgtactgtatgtgtttctcgcgacctgtgtatgaccgtgtgagaaggattcagttctgtacagtaactcattttgatttatttttgctcttacagtcctgaacttggaacttaattagcacaccgccattccatgaaacaaaagctactatgtaagagcacgcagggtttcgacggttgagcaccgctcccggtgctcaaggtcatctctcgaagagctctgtgatttatgaatatctggagtccgtacacggagacacgccgccagccaccggacgcagccgggattagggttctgttcctcaataaaactctcctctcaccagactcagtatttaccggcagctagcacccctatttcccatgggcctccatcaattacgccattcaggccctatgaagcgcttgttgggtcgtagtattctttggctcttccgaatgcccttctgacttggcccagtaacaccctcttcattgattcctccctggttcgtatttctggcgcccatggttggaatactcccatcctccaggtcgctaacatcttcccttccttgatggccagcttgtccccaagctggtgcgaatgggaacttctgcttgatgtcgacctcgtcttcccagttggccagcgtagcatgccaaccactccatttaatcagcagttgagtcaccaccttcccagcatgacgatgcagcctggtagcgagtatagcctccggtacctaaatatcttgatgcaagttaggtacactaggactcacgtcaatatgggaaccaattacaactttgagttgtgagacgtgaaaaaccggatgtaccgaacttccagccggtaaatccagctcgtacgcaaccggattaacctgcttgacgattgtatagggcccaatgaaacgaaacgcaagtttctggtttgaccgtgccgttactgatgactgacagtatggctggagtttaaggaacactcgatcccccacggcaaatgtacgttcagtcctgcctttatccgcttgcctcttcattcgcgactgagctctttgtaggtgcatgcgcacttgctgcagcatattgtctctattgcataagaagtgttgtaaatctggaactgcacactgtccagctgactcaattcccagctgcgatgctaagtggccataaagtacttcgaatggggatttacccagagacgtatggtaacaagtattgtaccaaaattcagcaaggggtaaccagcttggccaatgacgcgggcatgactgcacaaaacaacgcaagtatgtcgccagacattggttaacccgctcagtctggccatccgactgggggtggtaggagctgctcaaacacaacttggttcccgataatctgaataactctctccacagcttgctagtgaatatagggtcacgatctgatattatagctgtggggagcccgtgcagcttatacacttctgacaagtaaactttggcaactgtaagggctgtgaaggggtggttcaataccagaaaatgagcatatttggagaatttatccacaacaactagtatgcagttgcctcttttggaggggggtaacccggatataaaatccatagtcacaacttgccaggcgtgatctggaattggtaggggcagaaggagtcctggatatttaatcctttcgggtttggcttgctggcatatccgacaggtacggacaaactcccggacctgttgcttcatgcccggccaagcaaaattagacttgatccgacgatacgtcaccgggaaaccagagtgaccaccaatggcacttgcatgtaactctgacatgaccaaacgttgtatctcttgattcattcccagccagatccttcctttgaacctgatgattccctgcgttaaggtatagtgatcaagtttttctcctgtggccagtttactcaataactcctgggcactcgtatcttgttcatatccttttagcacttgattcaaccaactcggtatcacggatgatactgacgtagcattcaactgcagctggggagcatcttgatccaggttgggccggcgtgagagggcatctgccactctgttttcgctgccttgtctgtataagatacgaaattgcagacccagaagtttggttagtgccctctgctgccatggggtcgataacctttgttcatcccaattgagttaaactctggtggtcagtctgtatcataaattcaccatgcgca

SEQ ID NO: 4242 - DNA, 2041 bp, Zea mays
ttttccatttttcagtaggtcattgagtcatatccatagttcctccttgtggtgctctctcacaatgtccagttctgtagttgtcggaagcattccgtagtcagttatgatcatcgacacataatcaggtggggtggcatcgtacgttaaatttagcaattggagatttgcactgtctgcccagttcttaagatggtcctctgccttcccaggaattttcaaaatgacatctggatcgccaagctcattagcacatatagaatcaagttgcactctctcatgaaacttgtatgcctcacaacaaaccagaactggaactccaaatgcatgcgcaaccatagccacagatgctgtcccaactcgagaataaactgtcccatttgataatattgatgaggcacccaacaaaactcgagttacttcatgcatgatgtatgagatggcatttatgtgtgtatatgtgcaattaatgccctttgccactaatctccgcagcaatccctgtccctcaagctttgggcgagaatctaccactacaactcgaaagttcctcccaagttcatgagcataatccaaaatcatttcaacaactgttgatgatccatatgtcagtaagacatcgttgtctctgacctttgtgatggcatggctgacaataactttatctgcaagaactatcttctcatttataaaacgatcaatatcagactgaagactagttttggcttcagactctgacaatgcatgtggtagctttgctatcctgctcttcagaaacctaatagcattgcccatgctgattgaaagaggcctacactcgataagaaatgacacataactgctgatttttgcagtaagatctctgctgagtgttttatttgtaggtgtagtgtaatcttttattgcctctttgaatgcaagaagcattgctacacaacgatcattaccaccagatacttcaccagacaaatattggagaccaaccttgtatacagaaggatgcattggttctaattgaaagaattttgactcgaggtcaggaagctgagtgccatgcacatactgaggaagatgcctgaacagttcaactctgtttcgagcttctgattggttgactaccgcacgtttttttgctttctccaccttatgcacatcatcaaactgcatgcggggatggggagcatctaattttttttctctttctggaggacgttcagtagccttcttctcagaagcaagtgtacttgcagcttggggcacatctttcttctgagcagtttttgctggcttggcttgcttggacatcgcagcaccagcagattttcctgatttatctgcctccttcgctgcagctttagcagcacgttgggcctcctgaattgcacgtctctctgccttcgaggttttctgcttttgtggaatggaagctggagcaccctcattccgtatttcagccaaaccacgcttgttttcttctagctccacagcagaaggcgcgcgtgaccaggagtcgtcgtcgccgatctcggacacgatgtcgaggcgcggggacgaacgcacgggcgcagaagtggcgaggacgacgtcggccgccgccggggggtgtgggcccagggcgaggtggtcggcatggcgcgggggagggatcatgacaggggaaaggcggccctgggagaagtcgtctgacgccggaggcgacgccgtgaccggcctctgctgcgccgatggtgcctggaccaccgcggcggggggcaggggctcggacggcgcggaggcatccggggtgaagaagccgacctggcggatcttgggctccacgccgcccgacgaggagcgcggcgggcggcgaagatccatggccgcggacggcgccgagggtttggttgggggtttggggcggcgctcgagacgagtgtgtgactgtgggaggggagcgagcaagagaggttggggaactggggttccccacggctgcggctgtgcccgccccgcgagcgatgatggtggaccactgctcggcccggccggcctcgagggtccc

SEQ ID NO: 4243 - DNA, 878 bp, Zea mays
aggccggccgggccggagctcccactgccactgccagtaccagaggctaccagcagagagagaaggcgagcgcgccggctcgacccgcgcagaaaagcaaccacctccctccgcctcccccgcagggctgggccgcaccgcatcaccctcgccctcgcgagatccccaattcgccgcaggttcctcgccggagcgagcggcccccattgtggcgtggggctgccggttccgcggccaacagtccccctcctccctgctgctggagctgccttgagtcccgtgactcgactccccccccccccccccccccccggccaaggccaaggcgcgcgcattgcgagggttttgctacctctcggattcaagggtattttatagatgacgaaggcagcaactatttatgggagcaagacacagagcgatgccttgcggccagggccattgcgtccagcaaatattatcagaaataaatttcccacatacaagaatggttcaaatggtatagtaatcaagctggctgatggtcccgaaataccacctctcaaggagatagttgcaaaggagactgcagatctacttgatcgtcgtcagcgtctctctgtccgtgaacttgcgatgaagtttgagaagggtctcagcactgccacattgttgtcgaatgaggttaaatggagacaagtagctttgatggagcgggatatccttttgaagaatctaaagagtgtattagagtcactgagaggtcaggtgacaggcaaaactaaggatgaaatcgaggagtctatatctatggtggagatcctcacggttcagctctccaaaagagaagctgagttggttcaacaaaaagaagaggtcacaaaattagcaaaatcatt

SEQ ID NO: 4244 - DNA, 731 bp, Zea mays
gccccctttttttttttttttttccgttcggccgcgtttttttttttttttttcaaatattcaaccttctctgtggttggaggtggcattccattgaaatatttagagcccaaggatggtactcatcaccgatccatcgactcaacgatgtccgagggcacacgggtgcaccattcagagttgcaagttatacaggtgatcgcaaaacacgacggaccgtcttttggtaaaaaggcaacaaggacagacaaaaaaaaaaactcaggccaacagtgcaatcatttatcatgttgcactcaggcaaaggtcaccaaaaatgctaccatacgccagtagggcagtgagtcatatccatagttgctccttgcggtactctctcacaatgaccggtacactagttggcggaagcattccgtagtcagttatgatcatcgacacataatcaggtggggtggcatcgtacgttaaatttagcaattggagatttgcactgtctgcccagttcttaagatggtcctctgccttcccaggaattttcaaaatgacatctggatcgccaagctcattagcacatatagaatcaagttgcactctctcatgaaacttgtatgcctcacaacaaaccagaactggaactccaaatgcatgcgcaaccatagccacagatgctgtcccaactcgagaataaactgtcccatttgataatattgatgaggcacccaacaaaacac

SEQ ID NO: 4245 - DNA, 5297 bp, Zea mays
  misc_feature (1858)..(1858): n is a, c, g, or t
  misc_feature (3466)..(3466): n is a, c, g, or t
  misc_feature (3579)..(3579): n is a, c, g, or t
attactggcactttgcttaaaatacatttattttattagcaccatcggtttcttcggggaaaaaaaggaaattgcaactacaaattaaaggtttaccaaacggccgcgacgaaatgagaaggaaacataaatatctaaaacacgagtgtgtgcgtaaacaacatgcgtaacaatagccaagcaatgacaagttcgctgcgacgagacgatgcacacggaatcatgcatggatcaacgtgcgttcgtgtgcacgatggtgcaccaaaatcgcgcgggcgcggacgtgcgcgtacatgccggactgccggccgggcgccagcagctgctagtcgaggccgaacgccttcctcatgccgcacacgaactggaacacgtgctcggcctccggcagcgactcggccacgcactggttctcccggacgcagcgctctgcccacgccgccagcgccgggcactcggcggcgacgccgaagccgccaaaccgctcgtaggtcaggaaccacggcgcgaagggcaccagcgcgacgtcaatgtagccgagggcgtccccgccgaagtacggcttcccgcccagctcggcctccagcgtcttgagcgcggccaccgtgtccttcgccgccgcctccaccgccgccgccgcgccccttgggctgccgccacacgcgcatcgcgcaatcgttgagctgcagattaattaaagctagattattagaagcctagactagataggtatattgatctcgacgatagaccatcttaggatggatggacgcgcgcgaccaccttggtgtcgacgtaagaggcccagaaacgggcgtgggcgcgtgcgtaggggtcggcggggaggagccgcagctcgccggcggtagaagagaaggcgtcgtcgatgaattcgaggatgacgagggactcgcacacgggcttgcccccgacgatgaggacggggaccttggcgtggacggggttggaggacagcagcagcgggctcttggccgccaggttctcggccttctcctcgtacaccacgcccttgagcttcagcgcgatgcgcacgcggttgccgaaggggctcacggagcagttgagcagcaccacgcctccctccattgcctccgatagtccgatcccttggaagctgcttgtgctttattatcagcagacgatggggccgggacgctcgatcgctagctgatgactggagcttgcattgccaatggcttcttgattccactccatgtctatatatatagctagcagagcagatgatgcatatggcaatctgctagatgttgagctacgaggacgaggtgctctttggacgggccggaggtgctgccatttttcttgctgatggaaatcaacagcatatgctgataggtcatcatcgaccggacgaccgcaccaataataatgcatcgaacgatgcatgcatgtcttcgattgtttcgtcgctaataaattgttcgtttctgcatgtgagcatgtcctagctctctctatttaatttgcttctttgcatgccggtaaaaaaaatgtcaggctatgcagcttcgtgcggctcccggcagcggcgctgcgaagagttcgagacgtcttcaacgtccgtccatgcatcttccttgtggacgtaggacgccggatgttcctaggctggccgggcgccggatgtcagtgtgacggagaggtaaagcacagcttaaaaatccaaattaaaatacaagttctgcaaagctgcggtagtcttgctatgattcttgtcaatgacatataatatcgtgttgtgaattccaaggttaatcgtgcgtcacgtgcttacgtaggtctgacaccctctccgcttttcgtctaaccatggatntaataagctgttacaccatagatagactataataaaccagttaagccaaacacgacaagaagccaaacgcaacacaccgcttccacgtagtatgtatcacctcactagctgaatgggtatgggcaaccaagcaagctataaaaagcgcggtcagatttttttccaactcataactttctcggcctcttggctaagatagagtataatatttgttattttcggtttaatatcttatatatggaccataaattcttttttatattaaatatataattatcaaatatgattgtgtcatcgcagcgcacgagcattataccagtatcactttagttatcttattacccatcgaggtctacgataacaaaaaaaatgccgtagtatagttttccttcaatccaaatgtttgcaaattccgaaccttaattaatttattttcagtcatgaggtcttctgtttgaagctctttgtgtgaccttcatagaagagatgaaacgagatccaacagtgcgcgtgtctggtgtagatgttggttttagcttagatgtttggagaccttagagttttggatacccgtattgcagagaactcatttactggtatgggagttggaactggaatgaaagggttgtgaggcctgttgttgaaggcatgaacatgggattcctactccttgcttacaaccagatctaaaacaactgtggcgtgcttcactacacttgtgatacgtggccatggtggtgtcggtcaactcggagagcagaacactcacaacgtccggaatcatattttcagtcgatccctggcctggcctaatgaaagctgcctgccatcaggagtgagaaccctgtgttgttgtttgagcacgtactgcaccggtcaatgaaagatccaaagcaaattccccgaatggcacagcctacacgaacattggtcggtaaattggtaactaatgcttgtacaaactgccaaatgtgggtactacagtaaaaattagcgttcaacgtagattatcaaaaaccatatcaaatattcaaccttctctgtggttggaggtggcattccattgaaatatttagagcccaaggatggtactcatcaccgatccatcgactcaacgatgtccgagggcacacgggtgcaccattcagagttgcaagttatacaggtgatcgcaaaacacgacggaccgtcttttggtaaaaaggcaacaaggacagacaaaaaaaaactcaggccaacagtgcaatcatttatcatgttgcactcaggcaaaggtcaccaaaaatgctaccatacgccagtagggcagcgagtcatatccatagttgctccttgcggtactctctcacaatgaccggtacactagttggcggaagcattccgtagtcagttatgacccgcgctcgaatactgatcaaatggcacacatgtcatctatctataaaccctaaacaaatttggaataaactagccatccatgtataaccgcagaagccaacaagttcaggacaatataagaataaatagattacaaggtcaaattaatgtgatgacaaatatcagatttttaaggaaacaaacacaagcataggtgcgtaactgtcagtncgtaaatgcttggagtttagagtggcatgggcctacacaactcagcagatttgtttggtgcaacaaaacacaacaagttagcctagttcaaaggtcgagcactggatggttcntacataggttatcagctgcttctacactctacagaaactgtgccaagtcgtgagtaaatattcgaagagagaaaacactatgttgaagatgttggatacagagagtttgttatggttaatttgagtgcagcatatgtatacagaacaagacgcctaataaaaccagttcaagcagatcaaaccaattacatggttcaatagattcactaacaaaaagggcacatgttttgttgctaacaactgggcagcagtaactagatgcattatgttcaaaaagataacatttgcacacttatccaaaagataacctagaagattgattatagtgagaagtatatcttaccattccgtagtcagttatgatcatcgacacataatcaggtggggtggcatcgtacctattagatgtgcaacattatttacaccgaggggaataaaatcagaaggaatggctggtgtatagaattcacaaacatacgttaaatttagcaattggagatttgcactgtctgcccagttcttaagatggtcctctgccttcccaggaattttcaaaatgacatctggatcgcctgagtaagaaaactcatgtcaagtagctctcatgcacgagtgcaaacatatatttgcaatgcataaacgttcaaaatgatcctctggatcgccaagctcattagcacatatagaatcaagttgcactctctcgtgaaacttgtatgcctcacaacaaaccagaactggaactccaaatgcatgcgcaaccatagccacagatgctgtcccaactcgagaataaactgtcccatttgataatattgatgaggcacccaacaaaactcgagttacttcatgcatgatgtatgagatggcatttatgtgtgtatatgtgcaattaatgccctttgccactaatctccgcagcaatccctgtccctcaagctttgggcgagaatctaccactacaactcgaaagttcctcccaagttcatgagcataatccaaaatcatttcaacaactgttgatgatccatatgtcagtaagacatcgttgtctctgacctttgtgatggcatggctgacaataactttgtctgcaagaactatcttctcatttataaaacgatcaatatcagactgaagactagttttggcttcagactctgacaatgcatgtggtagctttgctatcctgctcttcagaaacctaatagcattgcccatgctgattgaaagaggcctacactcgataagaaatgacacataactgctgatttttgcagtaagatctctgctgactgttttatttgtaggtgtagtgtaatcttttattgcctctttgaatgcaagaagcattgctacacaacgatcattaccaccagatacttcaccagacaaatattggagcccaaccttgtatacagaaggatccacatgagtcaatcatattttgccaaaatggacaataatcagtttaaaaggggagccttgtcgcagtggtaaagctgctgtcttgtgacgggttcgagtcgtggaaacggctcttgcaaatgcagtgaaagactgtactataacctaaatggatccgatccttccccaggccccacgcacgtgggagtacatgcaccgggacaatgatcagtttatataatttttattggttattttctttactactcagaagtcagaaccaccaaagaccaaacatctaaacaatcaac

SEQ ID NO: 4246 - DNA, 1983 bp, Zea mays
  misc_feature (1948)..(1948): n is a, c, g, or t
ttgggtacctcgaggccggccgggagggctctgcggtcagcgcgcgctctcgctacgcgttctccacttcgccccacgcctttcccagccaaaagaaatatccaattcctcaccctaccccctcgctgctttctcctccccgtcgacctcgccaatctccctcccgctaaccctagtccagcacccgagatctactccgcgcaaacagccatggcggagacgctcgacatgaccctcgacgacatcatcaagaacaacaagaagagtaacccctcctctcgcggggcccgccgcagccgcggcggatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcaggaggcggcggcggcgggagggtctcggctctcgagacgggcgccaagctctacatctccaacctggactttggggtttcgaacgaggatattaaggagcttttctctgagctaggtgatttgaagcgtttttcgataaattatgatcgaagtgggaggtctaagggaacagctgaagttgtatttgcaaggcgttctgatgctgtagcggcggttaagaaatatgacaatgtccaacttgatggtaagcccatgaagatagagatagttggtaccaatactccagctgcagcagctgctcatccagtccctaatggtggtcatgctaggaatgctgcgaggagtgcaccaaaggatgctgctccagcaggtatgtcgcagcatagaacccatcagaggggtgggaggcgtgctgctggatctggtggtggtcgtcgtggcaaagagcgcagcaagccgaagtcgactgaagaactcgatgctgatttggagaagtatcatgctgatgcgatgcagaccaactaaatacattcacaaatttgatattcgacatcaaatatcaagtgcattagtccttccattacagctgtttgtgctaccatgttcaggggacaacaaacattttctttgtgttgggggggggggtatcgctttactgagttttgtggattttatgtgtttacaatagaactagagttgggtgatgctgaatacttttatggaaattacttggttgcaagttgctcgacatgtgaaagttggttatgtatgaaggtactcagatgttccctggtgacctagttgtgcgcttccgttctggtgttgctcagacttctctctgctgtaggccggttcaagctctagccatctaagtaggaggtgtccgtggcttttcgggaaacattgtgatgtttattttgggcatcttaagctatcttctctggcacattaatgatttcatgagcttcaaggtgcctttcttttacaagttgattccttgcttgcataatcctcacttccggtgtccacgaagtccgagttaactgacttggctgccactagtccgattgaagcatcatggtgcaaatcctccttcaagatctgctattgatagcttagagatagctgcactattgacgcctctacttcattttggactactataggccctctttgcgtatttatgctatataaacatatgggggcatcctctacaatggttgatcttgtctactgtgctttggagttcctttcaacttcgcttggatcctttgatgacaaatggaatcatgtgcctctgcccagaaaatcagtttctaactgaaactctctcttttgcttgctttcatacttatgtcaatggcgatgcctgatgtggagcttgttttgtcatcaaccttggctgtgcgaatcataagtggtggtggtttatatcatcatggtttcacaatcttgggattcttggccaccatgttgacattgatatagtatatcacattangaactcacagcttggtatgtccttcccgtacatct

SEQ ID NO: 4247 - DNA, 1325 bp, Zea mays
ttgggtacctcgaggccggccgggagtggcagtgcccgtccgcgtcccgctctcgtgggccgtcgcggtgtccccgccttcccctagtctgccccccgggccccgccaaaaaaagatctccaattccccaccccaaagagctaccctgaccagatttggccgcttcctcctctgcctcccgctaaccctagtccagccccccgagatctgctccgcgcgagcagccatggcggagacgctcgacatgaccctcgatgacatcatcaagaacaacaagaagagtaacccctcctccggcggggcccgccgcagccgcggcggatccgcccctggcggcggcagcggcggggtcgggccgaccaggcgctccttcaagagggctgggaacaggcaggcgccctaccagccgccgaaggcccctgacgctgcgtggcagcacgacatgtaccctgcggtcgccgcaggaggcggcggcggcgggagggtctcggcgctcgagacgggcaccaagctctacatctccaacctggactttggggtttcgaacgacgatatcaaggagctgttctctgagctaggtgatctgaagcgtttttcgataatatatgatcgaagtgggaggtctaagggaacagctgaagttgtatttgcaaggcgttctgatgctgtagcggcggtgaagaaatataacaatgtccaacttgatggtaagcccatgaagatagagatagttgggaccaatactccaactgcatctgctgctcttccagtctccaatggtggccatgctaggaatgctgtgaggagtgcaccgaggggtgctgccccagcaggtgtgccgcagcgaagacctcatcagaggggtgggaggcgtagtggtggatctgggggtggtcgtcgtggcaaggagcgcagcaagccaaagtcggctgaagaactcgacgctgacttggagaagtatcatgctgatgcgatgcagaccaactaaatgtgttcacaaatttgatattcaacatcaaatatcaagcacattagtccttccattccagctgtttgtgctactatgttcaggggacaacaaaccttatgtttgtgggggtattgctttactgaattttgtgggttttgtttacaatagaactagagttggatgatgctgagtacttccatggaaattacttgcttgcctttagtttctgtacctaatgccgaggagacaagaatcatccaagttactcgacatgtgaaagttgatgatgtatgaaggtacccacatttcctttgaccccccaccgtataatatatcttggaggtcgacgcggccg

SEQ ID NO: 4248 - DNA, 2011 bp, Zea mays
ttttcctttctcctcacgcctacaacgtgtggcatgccatgccgttccgtcctcccccattccctcgtagtaccaccgccggtcgtcactcgtcacccatctcaagcctcgtctcatgtcatgcaacgcagcgtgcggcggcgccacacacaatcacagccccggccggtcggctcgcgctagcacgagaccattacctcgttctccctcacccgaccactgaccacctctctccccggccggccgtctctcccgagctaaactgtggcaggcagctagctgttacgagctagctccgcgcgcgctaggcggcgtcacgtacgtgctgtgatcaactgtctagttctctactcgacgcggacaccctgacccgcgcgcgcgccgtggccatggtcgccgccgccgccgccatcctcctggtcctgcccgtcgtcgccgtcctcgcgtcgtcgtccgcggcggcggacgggtcgttcataacgtgggacgacctcagcaccccgtccgccgccgccgtgcagggcggcgtgaaggcggccagcgggggaggcgcccgcgagctggacacgatcgtggtggcgcaggacgggacggggcactcgcgcaccgtgcagggcgcagtcgacatggtgcccgccggaaacagccgccgcgtcaagatcctcgtcaggcccggcgtgtacagggagaaggtgacggtgccgatcacgaagccgttcgtgtcgctcataggcatgggcagcggccgcacggtgatcacgtggaacgccagggcgtcggacatggaccgctccggccaccaggtcggcaccttctactccgcctccgtcgccgtcgaggccgactacttctgcgccagccacatcaccttcgagaactccgcgccggcggcgccgccgggggccgtggggcagcaggcggtggcgctgcggctgtccggcgacaagaccatgctgtacaggtgtaggatcctggggacgcaggacacgctgttcgacaacatcggccgccacttcctctacaactgcgacatccagggctccatcgacttcattttcgggaacgcgaggtccctgtaccaggggtgcacgctgcacgcggtggcgacgagctacggcgcgatcgcggcgtcgcagcggagctcggcggaggaggactccgggttctcgttcgtggggtgcaggctcaccggctccggcatgctgtacctgggcagggcgtggggccgctacgcccgggtggtctactcctactgcgacctcggcggcatcgtcgtgccccagggatggagcgactggggcgaccagtctagaacaaagacggtgctgttcggggagtacagctgcaagggcccaggggcgagcacgaggaaccgggtgccttggtcccgctcgctcacctacgacgaggcgcggccgttcctcggcccgagcttcatcaacggcgagcagtggctcaggctgtagatccgatccgtcctcccggctgccgagctgagcttcgtcgacggcgagctatggtccctccgtccgagctgtgtgtaggtcatgcgacttctctggtcttcttcggtgcatatagcgtgacaagcaagcagctagtcagactgtagacatgtacgctgtaccatatactactagtaccatgtacaaacctgatacccatatgtgtagtgagatactgagatggccatgtccatcattcatggcaagatacatagtagtttgcatgcatgtatgtgaaggaaaacaggggaggccaaagtccgataaaaaaaaaaaaaaaaaagaaaaaaaaaaaaaaaaggcctccacctcaggcccgcccaacataccagaaaatcaaaatgatgagatcactgcatggctttcctgatttctagcacgggcaagttcagatccagtatgccaaatgccacaaatagatggcgcatggctttgggagtgaaaaaatgctctcattctgcaaccctttcagatcaacatgcgcaggggtgccggggtccgagact

SEQ ID NO: 4249 - DNA, 1282 bp, Zea mays
ttgggtacctcggggcccgccgggcctgccccgtggtttggacagctagctacatggactcctgctttcacgttctcatacaggcactcctgcactgtgctccttcgtctcctcctcccctgcctgccaccaactgccaaggtttatgttcaggtggcactgccagcagaagtgatccgttgacttcagctatgggcaacctgtgctgctgtgttcaagtcgaccagtcgactgtggccatcagggagcagtttggcaagtttgacagcgtgcttgagccaggatgccactgcatgccttggttcgccggcaagcgtgtagctgggcaactcacactcaggctgcagcaactggatgtgcgctgtgagacaaaaacaaaggacaatgttttcgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggctttgagatcgtgcagactctcatcgtggacatcgagccagacgagcatgtgaagcgcgcaatgaacgagatcaacgcagctgcgaggctcagggcggctgcaaacgagaaggcggaggcggagaagatcgtgcagatcaagcgcgcggagggggaggcagaagccaagtacctgtccgggctgggcattgcgcgccagcggcaggccatcgtggacgggctcagggacagcgtgctggggttctccgtcaacgtgccgggcaccaccgccaaggacgtcatggacatggtgctcatcacccagtacttcgacaccatgaaggagatcggcgcgtcgttcaaggggtcctcggtgtttattccgcatggccccggaacggtgggcgacattgccacgcagatccgcgacggcctcctgcagggatcctttgttgccaaacaataaactgcctgcctgctgttgccgctgctgctgtttaaaaacccccccccccctattatataaataaaataatgatgatcttgggaccaaagtgatgcttgtttatattgttcatcccccatcgtcaccccctggtaggaaagcacaaattatgattgggggttggagaaaaccttatttaaccttttagggaaccggtaatatatatataatgcagcatgagttacctt

SEQ ID NO: 4250 - DNA, 1307 bp, Zea mays
ggtcagctagctacatggactcctgctttcacgttctcatacaggcactcctgcactgtgctccttcgtctcctcctcccctgcctgccaccaactgccaaggtggcactgccagcagaagtgatccattgacttcagctatgggcaacctgtgctgctgtgttcaagttgaccagtcgactgtggccatcagggaacagtttggcaagtttgacagcgtgcttgagccaggatgccactgcatgccttggttcgccggcaagcgtgtagctgggcaactcacactcaggctgcagcaactggatgtgcgctgtgagacaaaaacaaaggacaatgttttcgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggctttgagatcgtgcagactctcatcgtggacatcgagccagacgagcatgtgaagcgcgcaatgaacgagatcaacgcagctgcgaggctcagggcggctgcaaacgagaaggcggaggcggagaagatcgtgcagatcaagcgcgcggagggggaggcagaagccaagtacctgtccgggctgggcattgcgcgccagcggcaggccatcgtggacgggctcagggacagcgtgctggggttctccgtcaacgtgccgggcaccaccgccaaggacgtcatggacatggtgctcatcacccagtacttcgacaccatgaaggagatcggcgcgtcgtccaaggcgtcctcggtgttcatcccgcatggccccggagcggtgcgcgacatcgccacgcagatccgcgacggcctcctgcagggatcctctgtcgccaaacactaagctgcctgcctgctgttgccgctgctgctgctgaagaacaccaccaccactattatatatataatataatgatgatcttggtaccagagtgatgcttgtctatattgttcatcactcatcgtcaccatctgctaggatggctatctttatgcttggggattggagaaaaccttatctaaccttttagggaaccggtaatatatatataatgcagcatgagtttgcagtatgttcatcaaaacaaaaaagagtctagatgcatgaatggcatcatagaatagaatacaagagttgcttccattc

SEQ ID NO: 4251 - DNA, 1368 bp, Zea mays
gatgaatccaatccgtcgtgtggagacatctaagcaggctttactgaatctagttgctatttaaccaggtgccaagtgcagataccttccctgcctcacaaacaacgccaccctgtactagataccatcagggtcttcaaccagggcaggtttatgttcaggtggcactgccagcagaagtgatccgttgacttcagctatgggcaacctgtgctgctgtgttcaagtcgaccagtcgactgtggccatcagggagcagtttggcaagtttgacagcgtgcttgagccaggatgccactgcatgccttggttcgccggcaagcgtgtagctgggcaactcacactcaggctgcagcaactggatgtgcgctgtgagacaaaaacaaaggacaatgttttcgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggctttgagatcgtgcagactctcatcgtggacatcgagccagacgagcatgtgaagcgcgcaatgaacgagatcaacgcagctgcgaggctcagggcggctgcaaacgagaaggcggaggcggagaagatcgtgcagatcaagcgcgcggagggggaggcagaagccaagtacctgtccgggctgggcattgcgcgccagcggcaggccatcgtggacgggctcagggacagcgtgctggggttctccgtcaacgtgccgggcaccaccgccaaggacgtcatggacatggtgctcatcacccagtacttcgacaccatgaaggagatcggcgcgtcgtccaaggcgtcctcggtgttcatcccgcatggccccggagcggtgcgcgacattgccacgcagatccgcgacggcctcctgcagggatcctctgtcgccaaacactaagctgcctgccgttgccgttgctgctgaagaacaccaccaccactattatatatataatataatgatgatcttggtaccagagtgatgcttgtctatattgttcatcactcatcgtcaccatctgctaggatggctatctttatgcttggggattggagaaaaccttatctaaccttttagggaaccggtaatatatataatgcagcatgagtttgcagtatgttcatcaaaaaaaaagcgggccgccgccgcgggggtggcatcatagaatagaatacaagagttgcttcaaaaaaaaaaaaaaa

SEQ ID NO: 4252 - DNA, 925 bp, Zea mays
gtgccaagccctcgcggtcgacttcacttccccacccccacctcttctttccccctctccctcccctcgccgtcgctgtcgtcgccgtccgtgctagccatggatctaggcgctcccgcccgacggcgcctaccgatccgcctcttgctggtgtcgctcaccgtcctcgtggtcctcaccgcgcgctccagtgccgaagtcatcaccctcaccgaagagaccttctccgacaagataaaggagaaggacacggtgtggtttgtgcaattctgcgtcccctggtgtaaacactgcaagaaccttggaacactatgggaggacctgggaaaggttatggaaggtgcggatgaaattgagattgggcaagttgactgtggtgtcagcaaaccagtatgctcaaaggtcgatatacactcctacccaacattcaaggtgttttatgaaggcgaagaagtagtaaaatataaaggacctagggatgtggaatcgctgaagaacttcgtgttgaatgaagctgagaaagcaggcgaggcaaagcttgaagctgattgaggcaggggagtttcagcaagcatgtggcgagtggcgtagacaaggaacaatgctttgcaacattgtcttctatcctgtcatttacaaagccagtttacaggaaagaaatgaccttatgagctcgtatcagagtattcctcttccaaagtaactccgaatcagttcatagaagctgtactccattccatagtttttatcacattgacaaactctccgaatcagttaatagaagctgtactccattccacacattgacaaactgaagtaacgattggaacgcaaccacaaaaaaaaaaaggcacctcgcccgcccggttgcgcgtcttgcaacgataaaaaaaaaaaaaaaaaaaaaaaaaaaaaaaaaaaaaaa

SEQ ID NO: 4253 - DNA, 879 bp, Zea mays
gtacctcgaggccggccgggacttcctccgccccgcccggccgggcccctctccctcccctcgccgtcgctgtcgtcgccgtccgtgctagccatggatctaggcgctcccgcccgacggcgcctaccgatccgcctcttgctggtgttgctcaccgtcctcgtggtcctcaccgcgcgctccagtgccgaagtcatcaccctcaccgaagagaccttctccgacaagataaaggagaaggacacggtgtggtttgtgcagttctgcgtcccctggtgtaaacactgcaagaaccttggaacactatgggaggacctgggaaaggttatggaaggcgcggatgaaattgagattgggcaagttgactgtggtgtcagcaaaccagtatgctcaaaggtcgatatacattcctacccaacattcaaggtcttttatgaaggcgaagaagtagtaaaatataaaggacctagggatgtggaatcgctgaagaacttcgtgttgaatgaagctgagaaagcaggcgaggcaaagcttgaagctgattgaggcaggggagtttcagcaagcatgtggcgagtggcgtagacaaggaacaatgctttgcaacattgtcttctatcctgtcatttacaaagccagtttacaggaaagaaatgaccttatgagctcgtatcagagtattcctcttccaaagtaactccgaatcagttcatagaagctgtactccattccatagtttttatcacattgacaaactctccgaatcagttaatagaagctgtaccccattccatagttttcatcacattgacaaactgaagtagaacgcaaccatacaagggctgtttatgtcacttgcgcagttgcgcgtcttgcacg

SEQ ID NO: 4254 - DNA, 906 bp, Zea mays
tcgagtcgggtacctcgcccccgcccccgctccctcccctcgccgtcgctgtcgtcgccgtccgtgctagccatggatctaggcgctcccgcccgacggcgcctaccgatccgcctcttgctggtgtcgctcgccgtcctcgtggtcctcaccgcgcgttccagtgccgaagtcatcaccctcaccgaagagaccttctccgacaagataaaggagaaggacacggtgtggtttgtgcagttctgcgtcccctggtgtaaacactgcaagaaccttggaacactatgggaggacctgggaaaggttatggaaggtgcggatgaaattgagattgggcaagttgactgtggtgtcagcaaaccagtatgctcaaaggtcgatatacactcctacccaacattcaaggtgttttatgaaggcgaagaagtagtaaaatataaaggacctagggatgtggaatcgctgaagaacttcgtgttgaatgaagctgagaaagcaggcgaggcaaagcttcaagctgattgaggcaggggagtttcagcaagcatgtggcgtagacaaggaacaatgctttgcaacattgtcttctatcctgtcatttacaaagccaatttacaggaaagaaatgaccttatgacctcgtatcagagtattcttcttcgaaagtaactccgaatcagttcatagaagctgtactccattccatagtttttatcacattgacaaactctccgaatcagttaatagaagctgtactccattccacccatttgacaaactgaagtaacgattggaacgcaaccatacaagggcctgtttatgtcacttgcgcagttgcgcgtcttgccacgatacatatagacctgttcatgttacttgcgcataaaaaaaactcgagcctcgtga

SEQ ID NO: 4255 - DNA, 1405 bp, Zea mays
gtatgctatggtactgtattggtggagttgcttacaagctgcctatgtagctactttctaatgaattcatatactttgcagtttgatcgtgcctccagagctgattatatgcaataatagtcattttgcactgacattcatcacatacattcatgcatctgctagattatattttgcactgacactcaaatttaccacttacattcatgcatctgctatatagcttacacttaacgtacatgccacaaatttttagccatttttgttttagaacaattgtatgctttgtaactgccaattgtctatatactacatattctttgtttctccctacttttgtttccacttggtctttgtatctttatgcctgttacaatgcttttgcatgtggacacattcctttttcgtttggttttctgcttcatttgacagtattctctactgacaccaacgtgaaactggaggcgacccagtggctaatagaggacctagggatgtggaatcgctgaagaacttcgtgttgaatgaagctgagaaagcaggcgaggcaaagcttgaagctgattgaggcaggggagtttcagcaagcatgtggcgagtggcgtagacaaggaacaatgctttgcaacattgtcttctatcctgtcatttacaaagccagtttacaggaaagaaatgaccttatgacctcgtatcagagtattcctcttccaaagtaactccgaatcagttcatagaagctgtactccattccatagtttttatcacattgacaaactctccgaatcagttaatagaagctgtactccattccacacattgacaaactgaagtaacgattggaacgcaaccatacaaaggcctgtttatgtcacttgcgcagttgcgcgtcttgcaacgatacatatagacctgttcatgttacttgcgcatcacccaacgctttagctgtgggttcaatgtaaggagttgtttggttcggttgttttggtccgttatcgatttacagcgtgaccggagcacgttgattgctgtttgtttcggccgcgatgtaatctattcacgtgttacagcgcttcagaccagcgatcccgccagtctcgcgccgctatccaatacgcgcctgcgcggccgccgcatctctccctcctgctcgagcgaactgaacaaacgacgcttttctttacaccgtaacaactagcaccgtgatttgtttccatttagggcccgttcgtttctataggaatacaccaaaaattattcatgttgatcaaaacttatacaaattagagaagcaatataggtaggaacaatttcagtcttccattccgtgtcaaccgaacgggccaggagtggcgaatatagtcaaaaatattgttggggtcattaaaaaaactttactaca

SEQ ID NO: 4256 - DNA, 867 bp, Zea mays
gatgtattctcacgaactcacgtgtgtatgagagaggatacatggtaagactatcaaaaaaaaaaaaaaaaaaaaaaactctccctcccctcgccgtcgctgtcgtcgccgtccgtgctagccatggatctaggcgctcccgcccgacggcgcctaccgatccgcctcttgctggtgttgctcaccgtcctcgtggtcctcacagcgcgctccagtgccgaagtcatcaccctcaccgaagagaccttctccgacaagataaaggagaaggacacggtgtggtttgtgcagttctgcgtcccctggtgtaaacactgcaagaaccttggaacactatgggaggacctgggaaaggttatggaaggtgcggatgaaattgagattgggcaagttgactgtggtgtcagcaaacctgtatgctcaaaggtcgatatacattcctacccaacattcaaggtcttttatgaaggcgaagaagtagtaaaatataaaggacctagggatgtggaatcgctgaagaacttcgtgctgaatgaagctgagaaagcaggtgaggcaaagcttcaagctgattgaggcaggggagtttcagcaagcatgtggcgtagacaaggaacaatgctttgcaacattgtcttctatcctgtcatttacaaagccaatttacaggaaagaaatgaccttatgaccccgtatcagagtattcctcttcgaaagtaactccgaatcagttcatagaagctgtactccattccatagtttttatcacattgacaaactctccgaatcagttaatagaagctgtactccattccatagttttcatctcattgacaaactgaagtaatgattgggacgcaaccatac

SEQ ID NO: 4257 - DNA, 2434 bp, Zea mays
  misc_feature (1589)..(1589): n is a, c, g, or t
  misc_feature (1641)..(1641): n is a, c, g, or t
aaatgacttatatggcagtcttttctccaatttataatcattttttagatactgcagtataataatttaaaagcgaaacatacatacacctatatattaataacattgtaattaatataatataaataagtatcattcaatttataataaataagcattatcaaataactcatacataagtgtactttaaatccagactaaaatactaattgaaaaacttgatcatcgactgtttgcgttaacattgagcctaactaaatatatatgaattcaagtctccacacttgtgcggtcaccaaaatttgagttctattccatcttttcctcctcgtcaccctccaaggcatcatcgaaggcatcgttcatcagttcaccaaccatctccatcttctcgttttgcatctcaaactctcgcattatcttctacaaggcaagaagattcatctgtctagtcatctgccacatggctttcgtcacacacttcatggcttcacccatcgcctgtgttgatttcagagtctgaaaaattgcacaccagccaatacaagattttaaagagagctcttatggatattagtaacataaaaaatacagtacagtgaagctcgctatagaagatttagagtcaactaagttgagtcaactaagtcaatagtcatcgatgtcattataaattgcacaaagttacccaactgagtgtctcaaaataaatacaattcttcaagttgtgttgtgtagttacctgtatacgaagagatacaccttgtagctgggacttgagggcatagaattttgtgatttggtgtcttgtgcggataagatagtttgccataatttttacagctccttgtgaacaatttacatcatatcaaaatatattccatgagcatggaaagaaattgcagcaaaaaacagcatgttcttttcaacatgtaaatcaaaatattatagtcacaaaaaacagaacataccattcgtccagaaggcgagcttggagaagttccacatccttggttgaatcttctaataccgaggagctccatccgcagatttgctaaggaagtctttggcaagatcctgaaagatagcaacaatggtcccatattgctttatccagtgaacaaatcgaagtaacttgctttcacttgcaaaaaattatcgtcacaaataataagttaatctagtttcggttaaggtagctgaattggtctatttccttttgatgcaggtgggacaacagaacgtcagtagtcatacgagatgaggaaattttctacctagtggggttcctttcttcagcgccgtctctctcaggttacggcagcattgcacattcaatgaacctgaacaaacagatagtggagttctgtgaagaggctggtattgggatgaaacagtatctggcaccgtacaccacacagcagcagtggaaagcccactttggagcaaggtgggagacatttgaacggaggaaacacagatatgatcccctagccatcctagcgccaggacagagaatattcccaaaggcgtcactgccattgcctttgtgacagttcctgctacttgaaggattctgtagagcatangttgtacaaaagtgtaggtaaaaagtatcccctgtaaagacaatatctacgnaaggtagctagcctgaagaacacagcatagcgactttttttatagtggccaaagatacctcagagcagtacttcaaagtggagcaatgtcacctgaactctgacacctttggaggcaatcactggaggatcgtagcagtccaagaaacatgtctgttgttacagtgttgataattgagacaagctgtgatgatgaactgatcactaaccagtatccccgttatcaacagtgcagaaaggttgcttgagggtagtagtgccttgattaacaaataacactgcctgttatttcacttgtaactagcatctcatcccactcaggagtgcctgcgtaaatgtagcaggtttacattactttcccatgagtcagaatattatatgctcatgcaaaaacagtaaagtctcttatcaatcatggtactcagaaacagaaaacgttttggaattctctcaagttgtccattcaaccttagcaacttgcggtgtgaatttgaataacaaataagaaatcaatatcacagatactgaaacagaaggttggcaagtggtggtggtggtgcgtagtgcatgcaagaaatcaattttaatgctgagatcattcctctggtaacacacaatagtacaacgaaaaatcaatgtatgaaacataatatcatatataatttaattgcaaacatgtgaatcaatttatgaaagaaggcaacaaaataatctgacaatatccattacatgatcttagtaatacaaaatcaacataatcaaaatacttgctcaatggagttcacatattgatg

SEQ ID NO: 4258 - DNA, 1122 bp, Zea mays
atcatatgaatttgttcaacacaaatatttcatccattttttttttttttttgcttcaaaacgtatagatgcaaatcctttaacttaaattccaaagataatccaataacttcaactcaaagtattaaacagtaagcataattgaaaataatcctataactacaaatccagagctattgtaactagctactaaagtagtcataaggttgcaggtcctattggggtcaagcagacttaagatggaaaaacttggcctcaattgaagcttaatagttgatgaagaatattgttatttcctttcattgacctcttcatactatcaatggtgtcctgagatgctccagcctctaaggtttccacttcttcatgaagtccatctttttcttgttgctcgacctccagttgatcctatagttgttgaacctttgcagaaactgtcattgcggagcttttcttggaggcggtatgaagaccagattgcataggaacacactggagctcgatagcacattagaaacaacttttgtaggagatttcggttgttgtccatcctgaactggtgctgccacaatttcttccaagtcaaccttcgcaccttaagttcacatatccatgtgtgttgtaatccttatcaataatatcatctcacaagttcctagctaatagttgtcttgtggaggcttttagaacaacacattttcctttccttgtgagtttaaatcaatgttagcaccatcctcctcagcttaatcctcagtgttcatttccaagattattgcaaagcccgatgttggactcctcggtgttgatggtgtaaaggacgccctcgtacccgatctcgctcttcaaagtcaagctaatgcagctcccgatgtacaactctgcggatctgaccgccccaccgctggaggcagaggtagccgcgaggtcgaggaggaggacgttgaagccgacggtggtgcttcggccgccatggctgtcataggatcacggtgatgtgaggtggtgctggccaagagggagagggggaataaaaccctagcaagaggtcggtcagatgctcagtttgttggtgcgcttgctctcctcactgctcttgattaacgggcttagtagtacaat

SEQ ID NO: 4259 - DNA, 1406 bp, Zea mays
agtactaattcctaaaacacgtttcggggcgaagcaattctatcctcatcaatcatcggtagggttccggcgattccccatggccggccgccaccgaaacccgctgccaccttcctacccccgcgccgccgctgccgccgccggcaaccatctgcctcccccgcttcacccccacctcccgccacaccatcccctcgacgactaccgcgacccgccgcgcctccccccgcaccaccatatcgacgacttccgcgatccgtcccgcctgccgcctggccaccccgacagcttccaggagccgccgccaccgcatcttcgtcatttcgtgggccacggccacggcggtgccggtggccccctgccacctcagccgcatgtggtagcagcgctggaggagcggctgggcgccgagatcgacgaggcgcatgcgctgctcgcgcagaaccagcgactggctgcgacccacgtggcgctcgtgcaggaggtcgctgccgcgcggcacgagctcggccgcaccgcgaacgcgctcacttccgctcaggaggagagcgacctacgccttcgcgaggtttatgagaggtcactgaagatggaagcagagcttcgggcagtacatgaaatgagagcagatcttgcccaagttcgtatggacattcaaaacctgggtgcagagaggcaggaactcatgggccaagttcagggattaacacaagatttggctcggtctgcagaagacttgcagaaggtatctgcattaaaatctgagatccaagagatcaaacatgaaacacaacatttgagatcttgtattgagcttgagaagaaaggatatgcagagagttatgagcagggacaggagatgcagaaaaatttgatttcagtggcttctgaggtggagaaacttcgagctgaggttgctaacgcggagaagaggtcacgggccattgtgtctgcaggcaatcaaggttataatggaagctatgggaaccccaaggccaattatgctgcaaacccttataactctggatatggcattaatcaagcaactgctgccactgattctggttctcagtatggaactggtgcaacgcatggttcttggggtgcctatgacttgcaaagggcgtccgggcgtagataagtactgcgaattcgtcaggtctttcacggaagctttggccatgcctctatgattgttgtggtggatcagatgttgaacaggtggggcacaggtatagatgaatagcgcacacatttgctttagtttagcttctatcggcctgtgcaagggaacatatatctgttgcatcgagtgtcaatgtattggaagttttctatcgagcatgaatatattaaggtaaaaaaaaaaaaaaaaagcggccctcgagatccagtgttgttccttt

SEQ ID NO: 4260 - DNA, 1406 bp, Zea mays
gcacgagaccattacctagaacatcctaatcgaaaaacggatggacccgtcccaccctacttctcctccaccctccgcccagaacccacaacgccgccgcgttcgtctgccactgcctgcccgagccgccgctccccttcctcggtctctcctcgcttcccagtcccagtcctagcccagcgcgccgcggcgctaactggccagctggtagtgatggcaaccgagccgccgccggcagcggagaagaagaaggcgccgctccccaaggtggtcacgctcaataaagccctcaagctggcccagacatgggtggacaaaatgagtgcatcggagccggatgaacccaacgataaggatttcgagggccggccaccaaagctcggtcttggtgctaaagcggcacctggtgtgaagcgtgtggttcccactgacccagttgagaggaggttgcttgggaaggtgaatgcgcagaagaggaaggccttggaggatgatgatagaaatgctcaggtggcgaatgaggctagcgacgacgatgagcctgaaagcaggaccagtgcctttaacaagaagaggccagtgccttcagttacttctacacctttagggaagaaggctaagtgacaagctatatgcatagactacctgagtgatctgcttgttttgatcacgtttcgtactaactcccagactgatgctattttcataaggcatagtataccttctcatactccagtttgtgattcctgaatttaaagggatagctgtgcttgatattgttaaggctcattgccgattcagaaattcacaaactggagcttgagaagaaaggatatgcagagagttatgagcagggacaggagatgcagaaaaatttgatttcagtggcttctgaggtggagaaacttcgagctgaggttgctaacgcggagaagaggtcacgggccattgtgtctgcaggcaatcaaggttataatggaagctatgggaaccccaaggccaattatgctgcaaacccttataactctggatatggcattaatcaagcaactgctgccactgattctggttctcagtatggaactggtgcaacgcatggttcttggggtgcctatgacttgcaaagggcgtccgggcgtagataagtactgcgaattcgtcaggtctttcacggaagctttggccatgcctctatgattgttgtggtggatcagatgttgaacaggtggggcacaggtatagatgaatagcgcacacatttgctttagtttagcttctatcggcctgtgcaagggaacatatatctgttgcatcgagtgtcaatgtattggaagttttctatcgagcatgaatatattaaggatacgagcgtcgtgatgtttaactaattattattagttcccctc

SEQ ID NO: 4261 - DNA, 1710 bp, Zea mays
tcccctattcagctattcgtgcacggagaagaagggaggcgaagagagggggcaccgtcggacggcggctcatcacgccatcggtagggtttcggcgatcccatggccaggcgccacctgcccctttcctgctcccgcgccgcgaccatccgcctcctccacttcaccacctcctcccgccacaccacctcctcggcgactacgacgactaccgctacccttcccgcctgccacccggccacccccgacatcttccaggagtcgccgccaccgcatctccgccattttgtgggccacggccacaacggcaccgatgtccccatgccacattgccaccccagccgcatgtggtggcatcgctggaggagcggcttggcgcggagatggacgaggcgcatgtgctgcttgcgcaggaccagcggttgacgcacatggcgctcgtgcaggaggtcgctgccgcgcggcgcgatctcggctgcaccgcgcacgagctcacctccgctcatgaggagagcgaccaatgccttcacgaatcacgaggcgtggtcactccccctcacgagcttacgggctgaatgcatcttcttttctatgcgttgcaattctgggtacttatctggaagcagcttgctccaattgaaccagaaattgaagttgtccatatccctagaggaacatgtttgtttggtgtctatacagtcctaattttctcccagtcttgcaaatttcgggctaaacttgaaagcagatacattaaacaacctagatactgcagaatacatgcttatgtgtatgtattatgtaggtcatcttccttcatgtttggtgcactgtgctcaaaattttaacatgtcccatattgtttttctctctctttttaccaacatcatgtgaacccactcctttttttgtaaccacgaaattaactttgtgtattttgcttgcaaaaccaattcaagttcaattatgctataatttttaattagttacacttgtatgtatgtgcattttccatgaaatttcatagttttgcattaatcgtaggtttgaaactgcattagcatgattgcaggaatacattggatttcatgttttatcttgatgtaacgccccattttttcgagccaatacatgcatgttaacattatgtaaattcatgtaaataggaacccgcctgacttagttcaataagatagttctgttcgtttgaaatatatttatgttttatcttgaggtaaggccccattttctggaggtcgtctttggacatgtacaaacaatctcaacctatgttgaaaaagtttttattcaattagtgctatccctatcctataacatatgtcatcattctggactcgatcccatcttgtatggacataaatccaacgcaagatacgcaattttgcaacacttatatattgaacatgttgtcttttttgtaggccaacattttgcaccatacaacatagcaagctaatcgctatcctataaaatttgtcttttagtttatgtggtatcctcttgtcatatagaatgtcaggtacttgacgtcacttcatccaccctgctttagttctatgcctaacatcttcatcaatattcttgtctctctgtagcattgatcctaaatacctaaagtgtccttcctaggcattacttgaccttccaaatgtggtagtagtgccgaaatcacatttcatatattcggtt

SEQ ID NO: 4262 - DNA, 2839 bp, Zea mays
gcacgagaccattacctagaacatcctaatcgaaaaattgtcgcggcgcagacctgggagaggagcagagcggccagtcagcggagcggataggaggcagcaggaggagtcgagtcgcgccgcgccggagatggacacgcccgaccgcgccgccgcgcagtccgcggcctcgcgcaccgaggactcgccggtgttcagcttcctcaacaacctgtcgccgatcgagcctctcaggtcgtcggcctacagcaccaacagcctccaggggttccagtccatcaacatcacgtccatctcctccatcttcacctccccgcacgacaacgtgagcaaggaaccgaggctcccaaagagcccgcttggtgaaatttgtgagaaggaggttcgtgccgacgccaacgccgccggtacgaacgggccacccgagccttcgaacgcggccaggttttgcctgcgctagcaccgtgactcgagaaacgcgcacgggtacatgtacgggcgtggctggtcctcctcccaccaccggggggccatgtgatctggccctgcctcgtcagttcgacaataacggcagtccagaccacaacacgacgccctgccacggtgtcaggtcagaccttaaacaggacaaggctaggaagctgctacaagctgcacagaatgctaaaaacgcgttggagaagaggaagtgcttgttttccaccgaagtccggctcctggacggcggcggcggcggtggcggcgagcccgggagtgacagtgatggagtcttgggatgcgagtggtccgacttagtctccccgacctcagcgaagcttttggccttcgacgccacgatggatgagcatcacagaggagtgcatttggcggctcaaaacgcagagtcgtgtgggtatttgctgtcgaaacttgccggagacggtggcgtatcggacggagcatatcctactgcgtctgctcaggtatactatcaggaacttgtgatgggagacgatcagtcagagaacgccgctcctcaaatggatgctcaggaaaccatctcagccgaagaaatccaggataatatctatgaagcggatgtgtgtgttccattagagtacaaggtagtggagagccaacagcagcgtggcatacggagacgctgcctggtcttcgaggcagctggtgggttttcgaatagcgctgtgaaaagggggactattgaagatcgctcggtctcaacatgtagtaagggcaaaagccctgcggaaagccagccgcgtggactgcgaggcatcgggcttcatctgaatgcgcttgcgttaacaccaaaggggaaaatggcctgtcaggatcctcctcctacggcttctgctctccttccatcgtcagcgtctgaaaaggatgcgcgtggcgagctgctttgtgcaggagagaatttcgcacactcgggcggtgagctgttggagtttcccttggatggttgttcggctggaggagggtttcctgtaaatgaccatcatgtctcaggtcagagcgtcagccctcaaaagaagagacggaaaacggataatggcgatgatggtgaggcatgcaagcgatgcagctgtaagaagtcgaagtgcctgaaactttactgcgagtgtttcgctgctggtgtgtactgctcagaaccttgttcgtgccaaggatgtatgaacaagcccatacacgaggaaaccgtcctctccactcggaagcagatagagtttcgtaacccgctagcgtttgctccgaaagtgatccgcatgtctgatgccggtctggaaacaggggaagatcctaacaacactccggcttcggctcgtcacaagagaggatgcaattgtaagaagtcaagctgtctcaagaaatactgtgaatgctaccagggaggtgttggatgctcgagcaactgcagatgtgagagttgcaaaaatgcttttggcagaagagatgccgagactgaactccctgaagaaatgaaacaagaagaaagtgaccagacagaaaatcctcaacaagaaaaggagaacgatcaacaaaaagcaaatgtacagggcgaggatcacccgctcctggaccttgtcccaataacaccgccttttgatttttgcagttctctgctcaaactgccaaatttctcaagcgcaaaaccgccgagaccgaccaaggctcgcagcgtgacctcccgctcgtctgcttcgaaagccactgcagcagtacagccttgtagatcatccaagcttgctgctagtgctagtgctagtggtatcgatgaggagacgccagatatcctgcacgaacctgactctctcagtaactgtgtcaagactactacttcaccgaacggaaaacgggtctcgccgccacataacgcgctcggcagctccccgaaccgaaaaggtggcaggaagttgatactcaagtcaattcccttgttcccgtcactcacgggagacacaaacagcggctctgcaatgaacagcactgatagcgcattctgcgcgtcacctctcactttaggaccatcttaaagctgtgaagttggtggccatgggaccggagtacgacttgtagtccgaacacgtgtgcctcgtatcctacggcaaggctcgaggtactgtagactgtagtaagttaggctttttaaagttgtagtaatctgtatttgtaaaatatgtagactcaataatctgtatgtaagatgctgcgatgggtgaagctgtttatctttatcaaattgtagcaacattacagatcacctcttgagtaggtttcacagttccaccccctgtctttctttttttttttttggaaaggaatccggtccatgttttcc

SEQ ID NO: 4263 - DNA, 662 bp, Zea mays
tgagggcgaggaggcaggcaagggtggacctgctccaggccttccaggcggtggaggtggccgtgagaggattcttcttcgggtaccggcagctggtggcggcggtgatgggcacggcggaggcgtcgggcaaccgggcgctagtccgtgccggcggaggagatggatccgctcgcccaaatgttcctggagccgccatactaccccagcctggacgccgccaagacgtttctagcggattactgggttcagcttcagcagatggcggaggcctctgctccgtcaagacaaagctgaaacggcgaaatggcacggctgagccaccgaatcgcgcagttttgcagggactgaagatactatgcatgcatttcgttggggccttttgcccttgtggcgatagagtgattcatttctatagcgatcatgtgctattgcactacatgtcgcactagattctcttactatcgttgtgcacagcgttgtacgtgttgtgttctacctagatagattgattcagttagatgtcacttgtattgccaagtaggtcaattggatatggaacttttgtaaataccgaaatactgttgttgagcaccgtgtacgtagatagactcgacgcggccgcgcgttccaatgcagagtttggagtaaattcaggagcc

SEQ ID NO: 4264 - DNA, 3666 bp, Zea mays
  misc_feature (2929)..(2929): n is a, c, g, or t
ctcttaacttcacatttagatatattttaaatttcactttttaaatttggtcaaaatcaaccttttaactctttagttatatagtccatgaaatatgaattgttttaaataaatggtccatctgttccaactgaattacctacaattgaagctgcgaaggaaccttatactggattgtcgataccgttcgtgtgtatataatacgtatgctgaaaaggataatgctggagtgttcggggaaccttggactaccgccctagctagcatggacgccggatggagactgccgcgttcttccgtgaaatacagcggcgtgcgcgggccgagcacgagaaaacatcgatacccggacggcagaaacgcatcatgagctgctcctgcggataagctcgaaaaccatttcttccatggtcctttccgccctaatttattgccttccagcgtaccccacgtccccaccccacccccacccccacgctggcatgcgcgctcgcccaccccgcggattgccggacgccgtttcaaacccgcgccgcgtcccaggtctacacgccaggcaacgctcctcctgcccacctggactcgggcgggcattcggctaatcggctccgcgatcgaacagaaccccagcatagccagcggagcactctctatatagcacgccttttccttatcgtccgcggaggctaaactcaaaacaagaacctgataatcaacttcagtctcgtcccgtaggaggaatttgaaaacccaaacgtacacctctgatacttcagctggagctgcaatggcaacgcccgatttgtccccggtctcgccggtgcggcgggacgacaagcagtgcgcgccatcctcctcgtcgtgcacaattctgagagtgcaggacgcgtccgcggccgaggcgtacgagcagtacctgcggctgccggaactgtcgagcctgtgggaggccgggtgcttcccggagtgggcgggcgagggcctggtgaagccggcgctgcaggcgctcgaggtcaccttccgcctggcgtccctcgcgctctccgacccgcgcgggtacgccagccgccgcgagctcgcgcgccggctggagtcgctcgcggcgcgggaggtggggctggtgtccgcgctctgcgagggcgaccggagcgcgccgctcgccgagctgggcgcctccggtggcgtgctcccgcgcgagcgcagcgcgtccgaggtgtggcagctgcccgggagcgccgccgcggtcgtgtgccaggtcagcgaggccagcctgctcccgcgcctcgccgcgtgggacaagtccgagacgctcgcggccaagatcatgtacgccatcgagagccagatgcagggctgcgccttcacgctcggcctcggcgagcccaacctcgccggcaagcccgtgctcgagtacgaccgcgtcgtgcgcccgcacgagctgcacgcgctcaagcccaagccagcgccggagcccaagtctgggtaccgcaacagagagaacgagacgctgttcaccgtgtaccagatactcgaatcgtggctgcgcgccgcgtcgcaactcctcgcccgcctcaacgaacggatcgaagccaagaactgggaagcggcggctgccgactgctggatcctggagcgcgtgtggaaggtgctcgccgacgtcgaggacctccacctgctgatggacccggacgacttcttgcggctcaagggccagctcgctgtacgagcggctccatggtctgacgcgtcgttctgtttccggtccagggcgctcctgcacgtcgctaacaccactagggacctcaagaagcgtgtgccctgggtgctcggtgtcgaggtggaccccaacggcggcccgcgggtgcaggaggcagccatgatgctgtaccacagccgtaggcgcggcgagggcgaggaggcgggcaaggtggagctgcttcaggccttccaagcagtggaggtggccgtgagaggattcttcttcgcgtaccggcagctcgtggcggcggtgatgggcacggcggaggcgtcgggcaaccgggcgctgttcgtgccggcggaggggatggatccattggcccagatgttcctcgagccgccctactaccccagcctggatgccgccaagacgttcctagcggattactgggttcagcagatggcgggggcctctgctccgtcaatacaaagctgaaacggcgaaatggcgcggctggatggcgaccgaatcgcgcagttttgcagcctgaagatactatgtatgcatgcatcgtaatttcgctgtggccttgtggtgatagagtgattcatttctatagcgatcctgtactagtgtagtacatgtagcactaaattgtcttattatcgttgtgcttgtgcactgcgttgtgttgtgttctacatagagattgattcagttagatgccatttgtcactctaggcaagtgtttcaattgggcaccgtgtatatatagaacttttgtaaacactggtagatggattcatcaattacagaatgttgatgttgacaccggatgatgccttgattggcgagaggaagaagaactgagaataggaggaattggacgacggataatcggtgtttattttcttaatagttcacggcgacagaccatcagctgtgtttatagcgctagaacattacacggcccaagttggcccagtaaacttcgtattcaactttttttcgtgcctcggcctgttacgcggaccgccgtcttctgtatccgtagcttcagactctccgctcttttctgatggaacgagcacatcttcaggcccctttgcctgtgtcaccgggaaaaaaatttgatacagcccggctgcaaaccagcccctcacaaaaaagaggatataccctacatgtagatccaccaggtaacgttttagttatgttattgctgctgcnggtatggcctatgttcctttttttgacttgtgagagagctgcaaacattctgttttgtaatcgggctgtagcaaaaaaaaatccgtatcaccaccgtcgctcttctgcagtcttccctcgtcgacacctgcatcatctcaaatctactggccatatcgttagagcagaacagatctagactaattcaataaaattaattcataaaaaaaatcgacaacatatctagctataggagtgttattgcaaaaaaaaaagaaacatacaaatttacttataatgttttatacgagtgatggcgaggaacacgagcggatgtgcgcgagcacttttcaaaaatctaattcgctggcacccgtgcatatcatcaaatcgctgacgttggtttggagacactgctctcccttgatctgttgcacgacagacagacgaagggacgtcggagcagagaagtggcagtgcagagagttgaaaaggcgaggatgagaggtgtgcgcataactccctcgtgcactagacgtctcatatatatagtgagggtcgcatcaacctctcaaattcgatctgttcgattattcccattttatatagattggagtggattgagaggaattgagatgcatacactaatcagtccaacccaaaaacttaagataattgagagagttggtcaatccacttattctaataccccttgttaagatatatgtgtggatatctcttacaggagttgcacgaac

SEQ ID NO: 4265 - DNA, 2253 bp, Zea mays
cgcatcatcccctgtgccttcctgcggataagctccaaaaccctttcttccatccatggtcctctccgccctaatttattgctttccagcgtaccccaccatagtccacgctggcatggcatgcgcgccccgcggtttctccgtttcaaacccgcgccgccgcccgaccggtccacacgccaggctatacgctccccctgtcatccacctcgtctcgggcggcacccacgcggctccagtccaccatcgaacgacaacgaccccagcagccagcggagcactcggtataaaatcacgccttctccttatcgttctcgaggccagccaaacccaaaccaagaacctgatcaatcaacttcagtcccgtccgtaggagggttttgaaaagccaacgtacacctctgagagagttcaaccggagcctgaatggcaacgcccaagctgtccccggtctcgccggtgcggcaggacggcaacgacaagccgtgcgcgccatcctccccctcctcctccccgtcgaccgttctgagtgcgcaggacgcgtacgagcagcacctgcgcctgccggagctgtcgagcctgtggacggccggatgcttcccggagtgggcgggcgagggcctggtcaagccggcgctgcaggcgctggaggtcaccttccgcctcgcgtccctggcgctctccgacccgcgcgggcacgccggccgccgcgagctcgcgcgccggctggagtccctcgcggcgcgggaggtggagctggtgtcggcgctctgcgagggcgacggccggggcgcgccgctcgccgagctgagcgcctccgggggcgtgctcccgcgggagcgcagcgcgtccgaggtggtggtgtggcagctgcccgggagcgccgccgcggtcgtgtgccgggccagcgaggccagcctgctcccgcgcctcgccgcgtgggagaagtctgaggcgctcgcggccaggatcacgtacgccgtcgagggccagatgcagggctgcgccttcacgctcggcctcggcgagcccaacctcgccggcaagcccgtgctcgagtacgaccgcgtcgtgcgcccgcacgagctgcacgcgctgaagcccgaccctgcgccggagcccatgtccggctaccgcaaccgggagctcgagactctgttcaccatgtaccagatactcgagtcctggctccgcgtcgcgtcgcagctgctcacccgcctcgacgagcggatcgaagacaagtgctgggaggcggcggccggcgactgctggatcctggagcgcgtgtggaagctgctcgcggacgtcgaggacctccacctgctgatggacccggacgagttcctacggctcaagagccagctcgccgtacgagcggcgccggggtctgagtccgcgtccttctgtttccggtccacggcgctcctgcacgtcgctagcgccactagggacctcaagaagcgtgtgccctgggtgctcggtgtcgaggcggaccccagcggcggcccacgggtgcaggaggcggccatgaagctgtaccacagccgtaggcgcggtgagggcgaggaggcaggcaaggtggacctgctccaggccttccaggcggtggaggtggccgtgagagcattcttcttcgggtaccggcagctggtggcggcggtgatgggcacggcggaggcgtcgggcaaccgggcgctgttcgtgccggcggaggagatggatccgctcgcccaaatgttcctggagccgccatactaccctagcctggacgccgccaagacgtttctagcggattactgggttcagcttcagcagatggcggaggcctctgctccgtcaagacaaagctgaaacggcgaaatggcacggctgagccaccgaatcgcgcagttttgcaggactgaagatactatgcatgcatttcgttggggccttttgcccttgtggtgaatggtgatagagtgattcatttctatagcgatcatgtactattgcagtacatgtcgcactagaatactagattctcttactatcgttgtgcactgcgttgtacgtgttgtgttctacgtagatatagattgattcagttagatgtcatttgtattgccaagtaggtcaattggatatggaacttttgtaaataccgaaatactgttgttgagcaccgtgtacgtagatagactgaatgttgttgatagtcccaaaaaaaaaaaaaaaaaaaaaactcgagactagttctctcctcgtgccgaa

SEQ ID NO: 4266 - DNA, 1126 bp, Zea mays
gctcggtacccctgttgcttcctgcggataagctccaaaaccctttcttccatccatggtcctctccgccctaatttattgctttccagcgtaccccaccatagtccacgctggcatggcatggcatgcgcgccccgcggtttctccgtttcaaacccgcgccgccgcccgaccggtccactcgccaggctatacgctccccctgtcatccacctcgactcggggggcacccacgcggctccagtccacaccatcgaacgacaacgaccccagcagccagcggagcactcgctataaaatcacgccttctccttaccgccggggaggccagccaaacccacaacaagaacctgatcaatcaacttcagtcccgtccgtaggagggatttgaaaagccaacgtacacctctgagagttcaactggagcctgaatggcaacgcccaagctgtccccggtctcgccggtgcggcgggacggcaacgacgagccgtgcgcgccatcctccccctcctcctccccggtctcgccggtgcagcgggacggcaacgacaagccgtgcgcgccatcctccccctcctcctcctcgtcgaccgttctgagggcgcaggacgcgtacgagcagcacctgcgcctgccggagctgtcgagcctgtggacggccgggtgcttcccggagtgggcgggcgagggcctggtcaagccggcgctgcaggcgctggaggtcaccttccgcctcgcgtccctggcgctctccgacccgcgcgggcacgccggccgccgcgagctcgcgcgccggctggagtccctcgcggcgcgggaggtggagctggtgtcggcgctctgcgagggcgacgaccggggcgcgccgctcgccgagctgagcgcctccgggggcgtgctcccgcgggagcgcagcgcgtccgaggtggtggtgtggcagctgcccgggagcgccgccgcggtcgtgtgccgggccagcgaggccagcctgctcccgcgcctcgccgcggtgggagaagtctgaggcgctcgcggccaggatcacgtacgccgtcgaggccagatgcagggctgcggcttcacgctcggcctcgggagcccaacctcgccggcagcccgtgttcg

SEQ ID NO: 4267 - DNA, 4497 bp, Zea mays
  misc_feature (4309)..(4309): n is a, c, g, or t
actggatagagccggacctagtcgtcaatagggtccactgccaagtaggaaaagttggcgttaatgctactggcgtcgttgtgcgttccctcggcgctaatgataatagcgccgagagtaagtccattttttgaaatgaaactgtaaaggtcatagttgtaaaaaaacttaagaaagtctaaaatccaaaaagttggcccgatatgcatgcatgcatacgcattgaaacatcacgctactactagtagatgcaacgaaccctattttttatggtaaaaaggatgcttgatgcagctgccagtgccaagtatgtatcaggagacccgacgacgacgacgacacggcagcgcagtctacaggactaggctagaggtggtagctactaaaattaatttagagatctaacaaactgtgaagaaatatttaaatacagtccattaccacccctacaaaagcgctgcttattaatctgtagaacccaaagcctgatgtacccgtatacagactggcaacgacaaccccccctaaaagaggacagtcctacctactactcgtcctgcgcaacctagctaacatgcaaccgaccaggctattccagtttggtcagctcttgagcagcggcaccgccacctgtcatatcggctggtagtgtgccacacggatgcctaaaatcttaaattaaaacgcgatcaagcaacagtcaggaggctctccggtaaatcctactatacgcatggcgtgtgatctgtcgccgagtcatcagcgcatgaacggcggggagagggagacgaacgaacgaaacggataacaacgccagcggcccaacacgcgcgtgtacgtttggacggcggcgatggccggctcgccatcgatcggacgacgatggaaaagcagcgcggcgccgtgtccacattaatggccgccgggtctttccaggaaggaaaacggggtcggtcagtagtagtatagagcagctgtagctggataaagatatatccacagggccacaattaatgaacgggaaaaactagcgccaacggaacggaacggaacggaaggcctcctctggctccgcagaaaagaaaacatatcgccgtccaccccccgctgtccgtggccctttcacacggaggcccctctctccccccctataaatgcccgcccgctcctccccggtttcagcactcgtccattcatccgttcgcctctgtgcctctttgagctcgcactcgctcgtgaacgctccccgacctccgtgttgtccagctcactttagcagttcagcctaggactctctgcgagtagcatagcagcagcttcttgcgaagcagaggcagagccttgtgttgcgttgcgtcttccttcctgcttgagcttattagttggctcgcgatggccggcggcgtggtggtgagctccggtgggggcaaggactaccccggcaagctcaccatgttcgtgctcttcgcctgcatcgtcgccgccaccggcggcctcatctttggatacgacatcggcatctctggtacggcgccaagcactgtccccgcccctctatctatctgatcgcgatgttttcggtttttgttttttacccatggctgctgtggttggaaagagagaagaaaaatggcagtcctcgtctgcaccgcatctctcgcacagacccacgcagccacgctgctctgttctcgcgttttgcgaatcaggcagggtattttctcgggcgcggttcacctaccgtccggtcgggagactgggcgcgcatggttcaagagcgtctttttgcgcatgcatacagaactgcgatattccccctcgttttcttattttcctcttgccagattcttgcaagcccgggaagaagaatctttccatgcatcacctcgtcatcttacagtttttgacactattagtggttgtttacgttaacgataaagaaaaaatatatatatatccaagaccattccaaaagaaaaaaaataactcttcaatcaagtaacaaagaagaaaataggttgctgttgctgacgtgtttgtgcaatgctgtgtggtcgagcaggtggcgtgacgtcgatgaacccgttcctgatgaagttcttcccgtcggtgtaccgcaaggagcaggaggcggagcggaaccagagcaaccagtactgcaagttcgacagccagctgctcaccatgttcacctcctcgctctacctggcggcgctcgtggcctccttcttcgccgccaccgtcacccgcgtgggacctcgagccggccgcaagtggtccatgttcggcggcggcgtcacgttcctggtcggcgccgcgctcaacggcgccgccaaggacgtgggcatgctcatcctcggccgcgtcctcctcggcgtcggcgtcggcttcgccaaccagtccgtgcccgtctacctctcggagatggcgccggcgcgcctccgcgggatgctcaacatcggcttccagctcatggtcaccatcggcatcctctgcgccaacctcatcaactacggcaccgccaagatcaggggcggctggggctggcgcgtcagcctcgcgctcgcggccgtgccggcggccatcatcgccgtgggcgcgctgttcctgcccgacacacccaactccctcatcgaccgcggctacaccgacgccgccaagcggatgctcaagcgcgtgcggggcaccgacgacgtggaggaggagtacagcgacctggtggccgccagcgacgagtccaagctggtggcgcacccctggcgcaacatcctgcagccgcgctaccgcccgcagctcgtcatggccatcgccatccccatgttccagcagctcacgggcatcaacgtcatcatgttctacgccccggtcctcttcaagacgctgggcttcgcggacgacgcctccctcatgtccgccgtcatcacgggcctcgtcaacgtcttcgccaccttcgtgtccatcgtcaccgtcgaccgcctcggccgccgcaagctgttcctgcagggcggcacccagatgctcgcgtgccagatcgtcgtgggcagcctcatcggcgccaagttcggcttctccggcgtcgcggagatccccaaggggtacgccgccatcgtcgtgctcttcatctgcgcctacgtggccggcttcgcctggtcctggggccccctcggctggctggtgcccagcgagatcttcccgctggagatccgctcggcggggcagagcatcaacgtgtccgtcaacatgctctgcaccttcatcatcgcgcaggccttcctccccatgctctgccgcttcaagttcatcctcttcttcttcttcggcgcctgggtcgtcgtcatgaccatcttcgtcgcgctcttcctgccggagaccaagaacgtgcccatcgaggagatggtgctcgtgtggaaggcgcactggtactggggccgcttcatccgcgacgaggacgtgcacgtcggcgccgacctcgagatgccctccgccaacgccaagctcggcggcatgcagtagccatggccgtccctcgctgctcatgttgttgggcaataatctacccatacagtattattcttgggggcttaccgggaaatttgaaaatcatcatcaatgtattataatcgtctcattaggtaggatgactggatgatgacgaatagtcaactagtcttcgtctcctgtcttttttttttattctgtgcgggatactgaatgtggagtataattatgtttgcaacagatcaaaccaaatatgaatatcaattgcaagttgcactgcaaaagccctggctcttccttgcatgggtgaatgctgaccgctggtattgactttcagatccacggcaattaaagccattgcataaaaaaggacaaaaaattaattttttgcatttactctttctatttttacgtgttgttttagatttaatctaaaccaaattttcttagctttgactattggtttaaaaaatcttatttagtttcataacatatgaacaatatattatacgaatactttttatagtgaatctaaaaagtatatgttgtttaacttttttcaaaaaaaaactttgaaaaatgatgatcaaagataataataggcaagatgaactttggttgacaatgatagatgagaaaattccttcaatgccatcaaaacttataccaataccttcaatgtcatcgaaatttatagcttctcttcaatgctatcaaatttaaattttaatccctttaatgccattaccgttagtttggagctaacgccgttagttcaatttaaagtcaatctctccaatgccactaaatnatttatactgatccctttaatgccactaaaaattggttcgaccctatttggggtttaaaaattttccagaatcaaaaaataatggattagatttttaaaattctacgatttttaaaaactaatgaacaataccatcagtgacgtcattatgttatactccctctgtaccataaataagacatatattt

SEQ ID NO: 4268 - DNA, 1978 bp, Zea mays
ggtacctcccgcccggccgggccgggtacagctccagattgtattcaaagagaggcagcgcagggtgcaagaagctgtccctccctccctcccctgtgcttctgctagctaggtgcctgcggaggagagatagggatacgatggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggcgccgccctcaacggcgccgcccagaacatcgccatgctcatcgtcggacgcatccttctcggcgtcggcgtcggcttcgcaaatcagtccgtgcctgtgtacctgtcggagatggcgccggcgcgtctccggggcatgctcaacatcggcttccagctgatgatcaccatcggcatcctggcggcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggcccgccaggtgcgccacccgtggcggaacatcctgcgccgccggtaccgcgcgcagctcaccatggccgtcgcgatccccttcttccagcagctcacggggatcaacgtcatcatgttctacgcgcccggacgcgtgggcggacgcgtgggcaagaacgacgcctccctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaagttcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctggagatccgcccggcggggcagagcatcaacgtctccgtcaacatgttcttcaccttctgcatcgcgcaggccttcctcaccatgctctgccacttcaagttcggcctcttctacttcttcgccggctgggtcgtcatcatgaccgtcttcatcgccttcttcctgcccgagaccaagaacgtgcccatcgaggagatggtgcttgtctggaagtcacactggttctggaaaaggttcatcgccgacgaggacgtgcacgtcggcattggcaacaaccacccggccaaaaacggcagcgacaccaagggggccgacgcgtgaacgtgatctcaacatctatattccatctacagtcacaactgaaatgtacatttaggcttccattgttccatcaactagtagctacatgtcctcctagtaaagtaccagtgtttgtttgtgtaatgtttgttacgcccattaaattcttcttggattggatgaactacaagcaaagacattccctggatgcagtacaatgataacagcagccagtaggcaaacacattccagatggaagcaaagagattatttgccttttataacac

SEQ ID NO: 4269 - DNA, 4082 bp, Zea mays
aatttataattctatctttctcagttttgactttctattattatgtcatcccatgtttatgaccgaagatatcatctgtgtttataatttatggttccgatgtcatgttagcaaaacacataatgacaaaattgacgatgagcactataatagctatttactccttgattttaacgcagattcgccccagtttctctgaaacgaagtagacagccaccgtcttcccgggccacggcgatcatcaccgccgcggcgccgcccatatcgacagcagagccgctcgcccagtagcctcacctcgcccgcgcttgtggcggccatggaggactacccagaggagctgcggacgccgccggtgtcgctcgtgtcaatcgtggggtgcccagagctgcacccctcgatctcggcggcactcagctcccagcagccgcccatgaatactctggccctccccgacttcgccaaggtctccatcctggcccgcagcggtaagccccgcgaccctctcgcaccgccgcacccccccgcgggaatcctcaagaaggactggctccttaaacaccgcacccgtgccccggccgccgtcgccgcgctgttccgtgctgaccaggtctccgacgatcctgcccagtggctcaaggcctgctccgatctcgaaaacctcaagtatgttgcgttgttgatcccaaattgacttcgcgcggtcagagatttagttacgagtcttaagatgctaatgtacaacttatcaaccacttgggaactaggaagcaccacccacactttattggcagcagctagtagtataaccgaagttggcggcaagtgatttttgtttgtcgcacaggtctgcaattcagaggaaaaacactaaattattggtggtccttgtgcaggctcaagctagtggtaagtaccccgacttagataattttttgtcttcttttctctgtatgcagtgactagtagactgattatccgggtagttggatcccaactacggtgaagattttaagttgcacctaataaattttttttttcagatgagttaagtgaggatgtaacggttgccctgaggaaacgtgcggaaatcgattccaatcacttggttgtgttggttgagcacgatgaagcagaatggaacagatctctgaacaagtctgtaactttccttttcctgtgtttttactattgcactttgtagaacgatcctaaccattttctatgccaaaatcctttgagatgtggatgattgtaatattctggacctgcagattgaagagtgtgtttgcggagttatgtgtagcattctataaagaggaagggctaaggataaaggctcgcattgagaaattttttttgcttctgtcgagctgagcatccggtactgcttcaaggtaaggacctctctctctccttcaatttagtgctattaatcattctaggtgcagtgtaaaagcatgtaagcatatataattttgttcacatctggttggtaatttgttaatcccttttccacattgttctgatctattcatttgctccattactataatgcatcaggttgctatttatgcggagtttagaagggattggccagaagcattgaagttctatgaggaaggtgttcgtgttttgcgtgaggtctgatcacatcccttttcttatcaggtgttcgtgttttgcgtgaggtctgatcacatcccttttcttatcattaatcaacaagtggcatactgaatcaataatatcataaacaaaagacaaactatggctatcataaatccaaaaaaaaagttcactgttagctgacccgccaatgtttcttaagcagtttctattgcctttgcatcatccattgataataatgtgcttatatttagatgattggaacttcgacaaggttgcctccaacccaacgcctagttgagataaaagcagttgccgagcaatttcactttaagatatcgaccttgctacttcatgctgggaaagcggtagaagcaatcacatggttccgtaagcatatcagaagctatgcacgggttcttggaacaccagaagttgcttttcttcactgggaatggtttagccggcagttcctcgtctttggtgagttgatagaaacaacatctacaactattccagatacattatctcctagatttggcactgcagactatggattgactgagtgggaatttcagccagcatactactatcaggttcaacctacatctttgcacagcactacgatagacactccgtttactcgattgcagtaacaattgacttctcatacattttttctgacagttagcggcaacttacttgagagagaagaggtatgccatcgaatgttcatcatcaatggctaatcttacaacagaagttaatggagtacctgagtcagtaatgccttctgtatatgttggccaatatgtgcgcttgtttgagcaaggagatacagttagtatactaccgtaagcttcttgatacttgttttcaaaaaagttataacatattctttatatgaatatgaatataaatagttatacctcaatctggttgcagcctttctgatactgaatacaccagctatgctttgtcagaagctgaaagatttcaagattcttatgagataatagcactgttcagaaaagcttatgaatcatttcagagcctaggtgctacaagaatcgcttctgtctgtagcggtggaatggccatggaatattatgcagctggggattttagcaatgcaaaacagctttttgataatgttgctggtctgtaccgcaaagagggttggaccactttgctctgggagaacctaggatacttgagagagtgctcaatgaaacttaattccccaaaggattttatcagttattccctagagatggctgcattaccattattttctcgtagtgaagaggaaaatcgagaaaacaaaattaagagtgggcctgcaggttcccctaccatttccaggagagagaatatacagcaggaagttattaatgttttggaaagaaatcagtcatcagagggaaccgatgatggatttaataatgcgatggaagaagttactcaccttgatattgatcagataagttcgctaagaatggtacttactacgtctgttgcttttcttgatcaatctgtaaaacctggttcacctttgcttgtcagcgtgtcactcttatctcatcttccttcccctctctcggttgatcagttggaggttcaattcaatcaatctgactgtaactttgtgatacatagtagacaggaagattctcctcctttctattcaaatttgcatgaccaagttgttcaagatacttctcttacactcttcaccaatagatggatgcggttgacacatgaagcaaaatcaggacagagtggaaaactagaatgtttgtctgtgaaggcgacaataaaaaaaatgccttgtgatttgctgccacgctgaaagccctgcttccatggaagacttcccattatggaaatttgagaaccaagtggagacattgcccacaagggaccctctgctcttgccttttctggacagaaacttattcaagttgaagagccagatgctcaagttgaccttgtcttaaattctgctggcccagctttagttggagaattatttactgtaccggtgagcatagagtcaaaagagcatgcagtccattctggtgagctgaaaattaacctcgttgatgccagaggtggtggtatgttgttgagtccaagggaagcggaagattctgaaagtcaccatgttgaacttcttggtgtctcaactgtgtccgaggacaaagagtcgaaggaagaggccgatagcataagaaatatccagtattcatttggggttatatctgttcccacattgggtgtgggtgattcctggtcgtgcaaactagaaatcaaacggcatcgagcaaaatcagtcatgctttatgtttcacttaaagtgtgtttggtttgaggaataaagtgattcatcttcttctcacccctcacttttttatttggtttgtggaaaataatgggttgatccctccccc

SEQ ID NO: 4270 - DNA, 2190 bp, Zea mays
gggaacatatgatggatttaataatgcgatagaagaagttactcaccttgatattgatcagataagtccgctaagaatggtgcttactgcatctgttgcttttcatgatcaatctgtaaaacctggctcacctctgcttgtcagtgtgtcactcttatctcatcttccttctccagttgtggttgatcagttggaggttcagttcaatcaatctgactgtaactttgtgatgcatagtgcacaggaagactcactcccttcatattcaaatttgcatggccaagttattcaagatacttcttctcttactctcttcaccaatagatggatgcggttgacacatgaagtaaaatcaggaaagagtggaaagctagaatgtttgtctgtgaaggcgacaataagcaaacaccttgtgatttgctgccatgctgaaagccctgcttccatggaagacttcccattatggaaatttgagaaccaagtggagacactgcccacaaaggacaccactcttgccttctctggacagaaacttattcaagttgacgagccagatgctcaagttgaccttgtcttaaattctgctggccctgctttagttggagagttatttactttaccagtgatcatagagtcaaaaggacatgcagtccattctggtgaactgaaaattaacctcattgatgctagaggtggtggtctgttgttgagtccgagggaagcagaagattctgaaagtcatcatgttgaacttcttggtgtctcaactgtgtctgaggataaagagtcaaaggaagaggctgatagcataagaaagatccagtattcatttggggttgtatctgttcccacattgagtgtgggtgattcctggtcatgcaaattagaaatcaaatggcatcgagcaaaatcagtcatgctttatgtttcacttggttactccctaggctcaagtgaagaagaagcattgcaccggcttaacgtccatagaagcttgcaaattgaagggcagatccccttattagttagtcatcagtttttgagatcatttaggcgagaaccgttgttgctatcagggatcaggtccttaggaagtgatgataaaaaatgttctcttgctatgaatgagtctaacatgctaattgtgactgcaagaaactgcactgaagtgcctttgtgtttgcattcaatgaccattcaacctgatggtgattcagagcagctgtgttcagtgcaacagatcagtggaatttccaatcgtcatgcaattgttgctcctagggaggaatataaaggaatattttcggtcaatccacgggctatcagtacaaacttcagactaggtgaaatttgcctgaattggtcaagagattcaagcctcggtgaggatcaagataggcttattatcatgaaagtacagttacctgaggtcaacattgaggagccgccgcttgttgtgggcatggagtgccctccctatgcaatcctcggcatccctttcactatctatgtgaagattcacaattcaacgtctttgcttcaggaaatcaagtactcccttgttgattctcagaatttcgttttttctggtgctcacaatcatgctgctttcattctaccgaaatcagagcacactgttagtcataagtttgtaccgcttggttctggctctcagcagttgccaaggatcacagtaacttcagtgcggtattctgctgcattgactccttcagcctcagcagcgactgtctttgtgtatcccagtgagcctaaattcaacttggaaactagccattcaacatccgatgagatcgtgagttgagacctaagcagcctgaagtctcccctctcctgacacttagctcgacccgggctgcatgtgaggtaaggtatgctactggaaagaccaccagcttgacatttcatgttgattgttgaagaaacgaatcagattcctgtcggcgagaaggtcgctgtgcaaaagttttggcattatatttcgaggtttcgattttgtagcgcttctggattaaccacatatgtgtaacttatgattacttcattgtttttggttcaatggtgcaacatacacaggaagataggctcttgtaaattaccatcccaccagtaaagtgggggaacaaaccagccccatgtcagtttttactctttgatgcttgccaactcgtc

SEQ ID NO: 4271 - DNA, 1444 bp, Zea mays
ccggtctcgcggcccggggggcctcggcctctccgactctgggttcattcgcctgcgctgcaacccatctcggaaccctccctcgcctccctcgcgttcagtttgatccaggacgaagggaacggtgagccgccatggtgaaggacagcgcgtactacgacgtcctggagatcagcactgacgcctccatggccgagatcaagaaggcctattacctcaaggccaagctggtgcacccggacaagaatccgagcaatcctgatgctgcgcgcaagtttcaggaactaggcgaagcctatcaggtcctaagtgatccactgaaaaaggagtcttacgataagtatggaaaggaaggacttccacaagataatatgattgatccaactgctgtctttggaatgctttttgggagcgactattttgaagattatgttggccaacttgcgctagcatctgttgcctctgtagagattgaggaagaatcaaacacacctgaggcaaggacaaggattcaagagaagataaaggacgtgcaaaccgaaagagagcaaatacttactcaaagtctaagggatcggctgcaaccatatgttgatgggaagcaagatgagtttggtgattgggcaagtgcagaagctcagcgtttgtctcaagctgcttttggtgaggctatgcttcacacgattggctacatctatgttcggcaagcagcacgagaacttggaaaaagcaaactgtatatgggtgtaccttttattgctgagtgggtaagggacaagggccaccacgtaaaatcacaggttaatgctgccgcaggtgcaatttctctgatacagctacaagaagggataaaaaagattgaagagggtgacaaggaagagcagcttattaagagtatcgaagagaaaaaagatgcaatgctgaattctttatggaaaattaatgtggtcgatattgagtcaacgctttcacgggtctgccaagcagttttaagagaaaatgatattcccagagacgtactcaagttgcgagcaagaggactgaaaaagctagggacgatatttcaaggcgcaaaatcaaactaccgtcgtgaaaacagcctgcgtgttgaagatgacgcggcagaagccacaccgtcgcactgaggatggtggacaaatctggatatgatgtcatatactgcgtcaccggctcaccgagactgagcccgaaagccgaccactgtggaaggagacaaacgatgctgtttttccaaagatttttgtacggtataagcgcaaggtattgctaccatgccatactttatcgctgtccgcactgcatatagttctgttggacgaaaaatgtaatatttgaagtcaaaatgtgatgcgtaatgatttaagcgcatgatcataggctttgaatgccatttgcgatcggactcagatccttggtggatctt

SEQ ID NO: 4272 - DNA, 5094 bp, Zea mays
cttgcggtaaatccgatggaccgattcttcagtgacatatcctcttactatacggtgcaatttatttgatacagctacaagaaggaataaaaaatattgaagagggtgacaacaaggaagagcagcttatcaagagtatatccaagagagaaaggatgcggtgctcaattctttatggaaaattaatgtggtcgatattgagtcaacgctttcacggggtctgccaccaagcaggaaaatgaagtctgacaactccattttcatttctgtttttacccttttctccaggttttgagagaaaatgatattcccagtgacatactgaagcaataaccaaatatagaaagcctgctattttagaaatctgaaaagcaataattcaaaaatcaaatatcctccatctttattcagaattcagactttaattttgctatgatagattcattcattgttaatatatatgagactgaaaccagaaatttgctaccccggacgaccatgtgaagaagataacgtacgtactcctcctactcccgttcattcattcgcctggaacgttcagagaaaaccaacgtggcacgcccgtgacacgcgccttcctctcgtcatacgtcgcggccctatgtgcctgcaatgcgcgcgcgtgtcctcctccgctcttgcgcatgccgtctctatcgcccccgttcccggtactatatagacacgggcgcatttcgcctccattccgctacagctaccagacaacagtcaccggcacgcagacgctcagcaagagccaacaggacatcgtcgctcagcaagaaacaaggggggcaataatggcggagtaccagggcgagtatggacacccgtacccgcgcgtcgaccagtacgggaaccccgtgccgccggtggaccagtacggcaacccgctcccgagggagccggcgtccggtttcggcgccatcgctcccccctacagcgctggcgacagcgccgcggggcacgtggcggcgcctgtcgagtacggtgccgacgccaagtatccgcacgatggcacggggagcggtggcggcggcggcgtcaccgctccgaccggtgtggtggcgtactccagcggtggcgtcgcaccagccgagacggcgcttgcgtcgtacgaggagggcatggtccacctccagccgaccggggaggagcacacgtttggtatggcctcgcagctccagccgacccacggggaggagcacacgtttggcatggcctcgcagctccagccgaccggggaggagcacacgaccctcggcgagaagctgaggcgctccggcagctccagctcggtaagataacgtactccatcgtgttggcggtgttgccctacgctcacactgttggtggcgttctaactggtgggatgtaacgacgacagtcctccgaggatgacgagcaaggtgggcgccggaagaagagcatcaaggagaagataaaggagaagctcccaggcacccacaagcacgaggagcagaaggctgggcacgtgacgacgacgacgacggggacgcatgcagcggggacgcacgagaagaagggtttcatggagaagatcaaggagaagctaccgggacaccaccatgctcactgagcgtgtgttcctcagttgaggactcggacttgagggggtccggaatcgtgtgtgtcgtgcacaggtctctgcagtctctatatatgttgtgtacgacttcggtagcctcgacctcgatcgcttgtacctagtcatgctcatgcgtgcatattgctgtgctccttatatatgtagcattagaagctgcgcgcaagtagaatttgggttctagtctatatatacactgttatcgtcgtgtaggtttggctctggctcggagttgagtaattatgttgggctcgtttggtttgtgtttgtagtaatccatttgcatgttggctcttgcgactgtcaacgagtcttaatctcttaaagtataaactacaaattctgcttgtctaagcagagtaattacaacctggaaacttcagaggcacacgcgtgcgattatcaccaggggatgggacgacggcgagcgaactcaactcatcgcgagaacccggaagggaacgtcacggggccattcccatctcttacgcgcgccctcgtaagttggactgtaggaataacatctttctactctaaaaagcatctctttactctactttgggaacctggattgaaaatgaactaatttttcgttcaccaaagcggctccattcttcgttctcaaaaactgaaatattctagttgttcttcaaccaatagcatttttttgtgagaggctgtaaatatcctgtttcgcagtcgggttatgggcatatctatttatagtgtggtatccattacacggaacctaaaaagcatctctttactcgtcaaagcaggagtgacaccatcggctaaggagatgcttggttttcaattttttggatctctttctaactaaagaggaacgcagcggttcctaacttcctcaatgctcccgctttgtcaaaatctctcctcccatccacaatcataccatccacaatcatatgactctccactttaactaaaacggcgggttcattcttcattctcagaaacttgaaatacggagtatttagtctactctttaataaagcggctctgttctcaaaaactgaaacattctagttggttgaagttcaaccaagagcattggccgagagcaaattgatgatgtgtggacgaggctgaatggtgtgacatgaggagagaagaagcaggctcacttggtttagactggaaccattcttagacacaggaacaagaattttcggtcgtgggagcaacaaaacaagtgcacattactatatagatagacaaactgaacccatatatattctttagggctaaattgcaggttcatatggatacactgctcctatgttattatatctattagtaaaccatggtgttagttctgtatagattttatacacgttgcattgcagttgcagcatgcatatttcatttttcgacaattgaacaaaagtctccgcctggaccgcctctacgtttccgcacatagcgcacatttcatagtttactaagctgcgcttttcaccaataaactaacaagctcagtttattaagcgatgtgtgtgtttacgtactaatgatgcgtgctttatccgtatacctgatcacggaaaaggttttcctttgctttcacaaatcacaatatctgttcgacttcagagaggacatcagtacgtgcgctccaacgtgggcatataccattcatctgtatgccaactaatgcataggcagcttcaggaccatgcatttgcacccacgacgcgccaacacgttcgcacttgcattcgtgtcgcgccaacgcgccgcgccgtacggcggctgagcagagcggccggggccaatgcgcgacagggcctgcccccgcgcgaggccgaggcccttgccgtttcgatcaccgcggccgcgacaagagcagagacagcagagcaggctgagaccccctcgcgcgcggcctgacatccatcttcggctcttcttcgtcgaactgtcgccccagactattgactcttcgtgttgtctcgatctctccccggaatgtgcccccaccggccaccgagctaccccccgccctcactcgattgatcgttactgagtgggactgccagcgcaagacagatcagcgggctcggctgcttggcttgcttatttcatcatttcatgttaatgactgtctacgctggtctctgaatgatgccttcaactgcaaaagctgatcttgctactcctatgtcttgtggtcagtgacacactgacatgcatgtactaagcgtacaaatgacgtccggaggccttgttcctgtcatgttctagtatctgctgtgcgtccggcaaggacaccgtcggcgtggggtcgatgactgtaatctccgacgcgcgacttgagccggagtagcaggagtacgtactccactgcttgctgaagatcctatgcggcggccccagacggcttttatggatgtccccttgatgttcatggccgtccgcataactacgttcagaactagtttggaaagcctgaaaattggtgaagattagagtggataaaatctttttcttattcaattttaaataaaaagtaggttttagcctctctacaccttcgattttttagcttccaaattagcaacggtgtttgtgtcgctacctgcgtctagattctgacgtacgtcaaggaagcaacagcatcaccataaactccgcccgtccgacaaacgtgactcgtgttgtgtgcaatgtcatgaccccatggcccaccgatttgctacccatttaagttctatgtgacactaaggtcctgttcgtttcagacttttctatcttctggtcaccaaaagctactatagacggctaaacgcctagcttttcagccagtttttataaaaatcgatttggtaaaaaccatctaaaatcaacataaacacataatcgatctagttgttgtaatagtaagaatctgtcactttctagttcctggatcttatggacatctttatttttctccgtatgtaatcctcataatacttggattctctccacagacagattctccacacagccaaattctcacaaaagttggtcagaaaaagctaaaccaaacggatcctaagataattctccaattatagtttctttagtggcacactgtgaatcttgggcaccaaaatccatcctcgtctccatgtgtggtctcttgcgtctaggacactattcatctccaaagctagtctctaccagattaattttttaattaaactaatcaatttttcgaaatgaatatagcaggttcaatttatctccaatcgatggcagacgaagctacaccatgccatgccggctcttcccgatatgagcatccgtcaacttgggatcaatcatggtaaatatttgattcaattcctttctattgtaccattatataatacacccgttcgaacttttcaaaatctatccatccccacactcataactttcactgaatccaccaaaaa

SEQ ID NO: 4273 - DNA, 1619 bp, Zea mays
ttcccctcgcctccccccacgcctccgccgacgcgtggggttcgatgaccgccgtgtcccctacaacataatgtccggcacctccatgtcgtgcccccacgtcgccggcatcgtcggcctcctcaagacgaagtacccagcttggagccccgccatgatcaagtcggcaatcatgaccaccgcgaccaccacggccaacgacggcaacccgatccaagatgagaccggcgccgtcgccacgccgttcggctacgggtctgggcacgtggaccccgtgaaggcgctggacccggggctggtgtacgacaccacgctgctcgactacaccaacttcctctgctcactgaagcccacgcagaacccgcttccgagcctccccgtcgacctcctcccgctcctggtcctgggcaacctctcccagcctctcgtcggcctcctgctcccactgttcgacgccgccggcgagccgtgcaagtgtagccagggcccgtacggccgccccgaggacctgaactacccatccatcgccgtgccgtgcctgtccggcagcgccacggtgaagcgccgcctcaagaacgtcggcgcgcccggcaagtacagggctaaagtcacggagcccgcggggatcaaggtcaccgtagtgccgagcgaattgtacttcggggtcggagaggagaaggagttcaccgtgaagatggacgtggacgtcaacgccccggcggctaatgatgactacgtgttcggcagtgttgtgtggtcggatgcggccgcgtacgcgtcggacgtgagcaaggcccatcgcgtccggagccccgtcgtggttaagaccaagtgcggctagcggactagcagagcacacaaggcatgctcattgctcgattaagaacactcctaaagattcttccaaaagctaatgtaattggtaaactagcaactataccaaataaataaaatcaaataatttttgttttttatctttttctatttccatagttagcttcttaagagcaagctcaatgactaaccaaaaagagcttcttaataagaaagacaaatctttatactaaactcccaatcgatctacactcagaaaacaggtatgtgccagctatagatgtccaataagcacgaggcccgcgagcccggcatgaagcccgttgtttgggcccggtccgagcccggcatgaagcccgttgtttgggcccggtccgagcccggcacgacccggttatatgcgggcccgggccggcccggcacgaataagcggcccggctcggacaggaaattagatacgatgggttagcccggcacggcccgtttagctctaaacccgttaagcacgcttttttacactaaaacgtgcttttcggcccgcataacccgtttttcggcccgcttttttcgtgctaaacgggccggcccggcccgtttaggcccgttgcgggccgggctcggacaagaaattgagcccgcgtgcttagccggcccggcctagttttctaatcgtgcctagcgggccgggcccaaaacgggccgggcttcaccgggcccgggccggaccgggccgggcggcccgtttagtgccagccaacaactaatattccctgtcaatacaggtt

SEQ ID NO: 4274 - DNA, 1622 bp, Zea mays
gcacgagaccattacctagaacatcctaatcgaaaagcgcgcgcgcttgcgcttccttccttgcttcccctgccctcttctttttattccccgtctcctttgttcgcttgcgggctgcgggaagggggagggagaggacgtgacgaggggaggggaggggaggggaggagggagggcaggcgggccgacgaatgcacagtcccggagaatattggtgaagcaataacttgatatagggttctagaccaaagaagcaatggaaaaggaatcatctgccacatacgagccaaaaaggaacagtgaaataagggtttttgagagttcagatgagatttcaacggatcttgctgagtatatctcacaagtttcagaaatttctgtcaaagaaaggggatactttgccatcgccttatctggaggtcccctagtcagttttttggggaaactttgtgaagctccatacaacaagacactggattggtccaaatggtacatcttctggtctgatgaacgtgctgtggcaaaaaaccatgcagagagtaactataggttaacaaaagaaggattcctcgccaaggtacctattctgaatggccatgtctactccataaatgacaatgccacagtggaggatgcagcaacagactatgaattcatgatcaggcagctggttaaggtccgcacaataggagtctcagagagaaacgactgtcccaagttcgatctcatccttctcaccatgggctccgatgggcatgtggcctcgcttttcccgaaccaccctgccatggagctgaaagacgactgggtcacctacatcaccgactctccgcagcctcctcctgagaggatcaccttcactctcccagtgatcaactcagcatccaacatcgcaatagtgtccaccggtgatgacaaagcaaaggctgttcacatagcagtttctgacatggccgaaggtcttgatgctcctacatcgctgcctgctagaatggtccagccaacggacgggaagctggtatggtttctggacaaggcggcggcatcattccttgactccaagaacgacgatgacgacgcttgctacgagcgtcatgagtgactaactccgaggatccttggtcgttttgaagcgaatgaacggaggtgtgtgtaagtaggtggttgcgtatgatggaagacgcgctgttccccttttagctcgatgcatgggttaattttgttctgagggtttttagctccggaaatctgaaattgctcttggtccttttgcagtgaggtgatttaaagcgatgaaatgtgtatgcgatgttgagtcgtcaaagaacaccggaatttaactgtggtcgtataatattatgtgctacattctatgctatggcagtttgtttttttttttgttttgtattaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttttaaaaggacccagattttacttcacccttgcttgcgaaagaaaaagttttttttttgggtgccccctaaatttaatttcattggcccgggtttttaaaacgtgcggaattgg

SEQ ID NO: 4275 - DNA, 2385 bp, Zea mays
tgagggcatcaggatgaacagggagcgaagcagctaccacttgatgtctgctgattaccgctttcagctgcgagacatgaaaaactggatgaatttgagctgaatcaggtaattgtagtttgtacgcagcagcacccacacgctgtgaaatggtatatgggccaaaatatcggaaagctagtttttgattggagcgccgggtcaccgaggactgaacataaggttgtaatttgagatatacgcgatcgccaacagagaaaactcgctcagatcggtgctggtcagcatacttcttcatgcgactttgagctctgaggaggtgctgctggacaagttttgaaaccacttccctttcttgcatccattgatccagatctgtcacaagaatagctgagttgtgatgtagaccgaagtgtttaggaggatgcccatataacacctcaaatggggatcggtctagcgaggaatgagagttggtgttgtaccagaattcagctaacggtagccagtgactccatttgctggggcaagcatggacgaaacatctgaggtatgtctcaatacattggttcaccctttccgtctgaccatccgattgcgggtgatacgatgaactcatgcaaagttgtgtgccggacaatgtaaacagttgctgccaaaaggcgctggtgaagacacgatcacggtcggacacaatgttgtcgggcataccatgtagtcgataaacctgatccaaaaaagagtttggcgactttgggggctgaaaaggggtgagacaaagctagaaagtgtccatacttggaaaaacggtccactaccaccagtatacagtccactgtaccagacctcggaagtccctcaatgaagtccatggaaatggaatgccacgcatgaggaggaaccggtagaggagccagcagtcctggataacgagatctatctggtttggcctgttggcaggtgctgcacgactgaacataatttcgcactgcttgtttcattcctttccaatagaacagatgtttaattctgctgtaagtcactggaaaacctgagtggccgccaataggtgaatcatgaagggccgaaatgatttggcgttgtatatccgggctactccccagccacacgcgtcctttataacgaatgattccctgagatagggtgtatggagcagcagcggttgcggatacagacagtttggtcaagagttcctgcgcctgcggatcatcattgtagcttgcaacaaccccttggatccacagtggagtaccctgagaaatatgcatgacttgcccctctgtcggaacccgagagagagcatcagcagccatattatcgcagccctttttataaatgatgcgatattgcaaaccagccagcttaacgtataacttctgttgccaaacagtatggagccgctgttcatttaattgcaccaggctttgatggtcagtataaatatgaaactcagccagctgtaaatatgatcgccactgcgtcactgcaattagaatggccaaatactctttttcatatgttgagagtccttgatttttgggtcccagagatttgctgagaaaggcaagtggatggcctcgctgcatgagaactgcgccaacaccagtgttgcaggcatccgtataaatgcagaagggaactgcgaagtccggcaaagcaaggacaggtgctgaacgtaacgcctgcttgagtaactcaaaggctttttggtgttccacagtccaaataaacagcacattcttctttaacagatcagtcagaggacgggatatcatgccaaaatgccttacaaacttacgatagaaacccgcgagtcctagaaaactgcgcaactctttgctatttgctggtgtaggccattgttgcaccacagttatcttgtcgggatctgttgagacaccttgtgcactgattatatggccgaggtaggaaatactggtttgagcaaattcacatttggacaactttactttccactgatctttccaaagcaattgaaataccgatgacaaatgagtcaaatgagaatcaaaagtggggctatatataagaatgtcatcgaagaataccagggcacatttacgtaagactggtgctaaagtggtattcatggcttccagaaaagtgttgggagctccagtgagtccgaaagccatcacccgaaactcaaattgtcccaaatgcgtttgaaaggctgtttttggttcttcgcctggtctcaaacggatttgatgataaccggccttcaattctagcttgctgaaccacttagcttgagtgagtttgtcgattaactgatcaaataccggaactggatattttccttttactgtgatagcattgagataatcggtagtcgacaca

SEQ ID NO: 4276 - DNA, 1313 bp, Zea mays
tctatattaaataaagttatacattaattaacaggctgaaaccaaacgctatcttagataatgtgcagtgtctagattctagaaatctgctggatccaaacgcggccatagtgtgtagtccgcctctgcccacacaagcacacggcgcgcgcactcccgcgacaaaaaaaaaaaaaggaagtggcggaagagaagcaagaaataaaaaaaagaagcgagtggagaccgcagcacgcccgggcggcgtctggggatgacgcgcgcccgccgccaatggccgcaccgacgcagacgctagtgctggcggggatcatcctcctcaacttagtcctcgccgcggcagcgctctaccgccgcatccgcggccgccgcaggccccggcagcacgtcccgccgccgccgccgctcgagccggccgccgcggaggaggcggaggcggaggaggaggaggaggaaggaggcggtggggagaggcggcagagccagcggaggaggaggagagcgcggaggaagcggcagcagcaggaggagggggcggcgtcggagggtggcggtggcgacggcgcggacggggccgccgcgaaggcgacggggaaggaggagctgctgccccgccggccgcagttcccgctagcctccgtggcgggcgcgctgcagcggcggatccacgcgcggtacgacgacctcgcgcgggccagcgaggcgcagtgcctcaccatcgagcaggtgcgccgcaccgcattacccttctgcttgcttctgccaggcccagggctctacagtctacatgcctttgcttcctctctctttcagtgtgtctgtctgcgagttaaacgtaggctgcagcctagctgcttggacgacaagtgttgctgctgcttgcaatgtggcgggtgaccaatgaaaatcaaagctacctgctgttgattcctcgcctgtttctttgctcaggttgcaatctagggatagattagggcttcaaatgcgcatttccgacgccaatttggcttcaatgatgcacgcctgatgagggctactacctactaggacgcctatagaattttgccattttggttttaacatatgggcatgaaatgccaggtatcctagttgcgctggtgctcacgtatagaacttaacttcatactgtcaccttgcctaaaacttagaagtaaaccaaactaaggagaatgaatccttcgtccttccacatgtacgtgcaggtacacacactatattggggaatcacaaatttctatgcaaaactcaagaacttacccaccttgccatgtgtgatctgtgatctttgttct

SEQ ID NO: 4277 - DNA, 1285 bp, Zea mays
aaaaaaaggaagtggcggaagagaagcaagaaataaaaaaaagaagcgagtggagaccgcagcacgcccgggcggcgtctggggatgacgcgcgcccgccgccaatggccgcaccgacgcagacgctagtgctggcggggatcatcctcctcaacttagtcctcgccgcggcagcgctctaccgccgcatccgcggccgccgcaggccccggcagcacgtcccgccgccgccgccgctcgagccggccgccgcggaggaggcggaggcggaggcggaggaaggatgcggtggggagaggcggcagagccagcggaggaggaggagggcgcggaggaagcggcagcagcaggaggagggggcggcgtcggagggtggtggtggcgacggcgcggacggggccgccgcgaaggcgacggggaaggaggagctgctgccccgccggccgcagttcccgctagcctccgtggcgggcgcgctgcagcggcggatccacgcgcggtacgacgacctcgcgcgggccagcgaggcgcagtgcctcaccatcgagcaggttaacgagtttcttaactgtctcgtagatgctagaaacgagctgctgcagaggtacgagaatgtacaaagaagcttcaaaataaagaaggcgatgctatccaaccatcgaaactataggacttcatacgaccgcctctttgaacaggtacgtagactggaaaccgaaagcgatagcctaaagaaagacgccgccatctacaactttgtgcaagagcgtcttcagaagtcagcgccatacaaaatgatcatggagctgagtgcaatggagctggaggctcaagaaatatcgttcgaggagcttctggctcgggagaaggaggacaccgccttctggcagcgcaacgggaagatgagatcagtctcgtccaagtaggacacaatgcccctgctacttgggctcactgacgatagcagacctcaacatcggtagtgtctaggcatgaaacccttgagagcagctgctgtatgcctgcatcgaaccgtttggtgtaacgccgcggccttctgtcaagatcctggcctgattctgggcagattgagttgtgtcgtgatacaagccggccctgagggttctgttccagcgagtgccggcatagggctgttttgatcgtgtggccatggacctcctgacccagccgcagcgccagcaattctgtgcaagctgaaagaactgtcgctaatatcaccacgttcgacaaaaaaaaaaaaaaaaaaaaaaaacggacgcgtggg

SEQ ID NO: 4278 - DNA, 2921 bp, Zea mays
  misc_feature (1067)..(1067): n is a, c, g, or t
  misc_feature (1077)..(1077): n is a, c, g, or t
  misc_feature (1083)..(1083): n is a, c, g, or t
  misc_feature (1098)..(1098): n is a, c, g, or t
cgcgtcctcgccgcgccgctcgcgtcgggatcccgccgccgccctactcggtcgaccatggggacggcgacgatggcgactgcggtgggcgcggccatgctgctctacttcgtgctgagccggcggctggcgggcgaggacgtctcagcccgcggcggtggagggggaggagtcgggtctggaaagcggcggagggggcgcgcgctgcggcggccggtgcagccgccggcgacgtggatcgaggcggtgggcacgctcgcggaaacgctgcgtttcacctactcggagacgctcggcaagtggcccatcggggacctcgccttcggaatcaagtacctcatgcgccgacaggtgagacagagaaccgctcctcctcgctattccaacatcggcttgcctgccgcttggatccaagtgaaatggcgcggtttggtttgcctctcaaggcttgcgttttggatctgaaatgcgagtttctttgctcgaattgtggtttcccaatagtattctgcactgctggcaagaatggatttgatactaagtagatagatgcacataaaatgggtgagttctagtgctgatagcctttcatgctgcgaaaaaaattgctgctatgaaagtatcaagctggtggattttggggtggagctactgcttattctagtgttatgcacttgtatctgttttgtaaagctggtatgttttggtttacagatacttcggttgagagaattataccttttcaatcttcaagttgtgcttgttgtgagtaaatatgccttttaagacgaagtttctgtctgatcatcatacttaatcgtgagagaactgttaatataagataagatggttgttaataaactgattatggctcaacttttcaaccgagggattcagagctaagtactaccttaagttactaaaggataccaaaacttgtgtattgttcctattctcatgttgggtgatgaaacttgatacttgagtaatctaatgttcactgaaacctggtgttacttgtcagggcaatttacatgttgccagtgtatatgctggaagtgattgcnattgaactgnaaaggnacctcaaatcatggnaagagctgattgttctacggcggttgattgacctgtgctttcttttctctaagaagccatttccagtgtttcgggaattagctggattttcacaggaggatgttcttattgaggaaccaaagcggggattttgaagcctgcccatacaattatacgtgatgagtgcaccaaatccttccttgttttgatccgagggactcatagcatgaaagatactctgactgctgctactggggctgtagtgccatttcacctctcacttttggatgaaggcgatgtgagcaaattagtgttaggttatgcacactgtgggatggttgcagcagcccgctggattgcaagaggtgtaacaccatgcctccgtgaagcagtcagacaatgcccagagtaccaaatcaagattgttggccattcattgggcggtggtactgctgcattgctaacctacatccttagagaacacaaagagttttattcaacaacttgtgttgcatttgcacctgcttcttgcatgacatgggaattagcagaatcaggcaagcattttgtgacaacggttgtcaatggagctgatctggttcccactgtatcaactgcatctattgatgatctccgttctgaggtaacagcttcatcatggttaaatgatctgagggatcaaatacaacagacacgtttcctaaatgtcgtttaccggtcagccactgctttaggaactcgcctgcagtctttttctggtgcgagagagagggttgcaggtgctggagcatttctacgtcctgtttcaaacaaaacccaggttgtgatgaaacaagcacagaatgtcgcacaggctgttgctagaagtcggtctgcattttcgtcatggtcatgcatgggtgcacgtcgtcgaggtgtaggtgtagttactgcatgttctaaagatgatatgagagtggaaacccatgcaacatcaacagttgagtcaaagtctgtccttgtagaacattgtggcgccaagaccatagaagaactgcagtatactgcagctagtgtttctgttcatgatgcagcagaggaagaagaggctcttttgagtgaacatgaaacctccagggagaatgccgaagaagaaacaacagagggtgagttgtggtatgagtttgagaaggacttggatcgacaagctgaaatggaggcacgaacaagggaggaagaggcagctgcagccaaagaaataatggaagaggaaagtgctgtgctaaaaggtgtagatgacaggcagtccttcacaccagatagcttggagaggcagcaattctacccccctggtagaatcatgcacatggttgcaatgcctcccacagacgctgacccagatgatccggttgctgctgacgagtgctgtgttggaatatatgagacccctagagatctttacagcaagattcgactctcaaataccatgatcaatgaccactacatgccaatgtataagaaaatgatggaaacattgattgagaagttcgcgagggatgaggactgctattgtacaggttctactgcagaataacatggaagcatgaatgacctatgtacatcgataactgtacaatactccgtgttagctgttattagcctatctgacattgcaatatacaagaggtgatgtcctcctgacccgtgaaaaaaggattttagttagggtcatgtgagtgtgtgatgtgtaaatgtaaaagaaaccagaatcagcaatttaataccttttccagtcaaaaaaaaaaaaaaaaaaaaagcatgtgatgcttggatcttgaaaaaaaaaaaaaaaaaaaaaaaagaaa

SEQ ID NO: 4279 - DNA, 2653 bp, Zea mays
tagcgatctccccgcccccccctcgcccccccccacgcgtccgccctgcttcgctgttccctttccccgcccctacctggggcatctgcctctgaatcgcggcggctcccgaggcgccgcctggcgagcgtctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggaattaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtcccaggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaatcaaaggaaacaagcaccatgaagaaagagaaatagcatttggtcaacccatatacaagtgtcagaataatgcatatggtgcattccctcaaaacagcccagcagttggaggattgcaaccttttgcagcttggcccaataacaaagttggtatgactgattcaacaagcacattgggaaatgtgggcaattctcaaaatagcaatatgctattgcatgaattgcagcaacagccagacaccttgctgttaggaacccttcacaatattgatgccaaaccttctggtgtagttatgccatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacagcattggaaacagtggagacatagtgaaccacgacatatttggatttagtggacatatgtgaaactttcttgaatttgtaagtagcgttgatcagtgagcactggaaacaaatctagtggtttgatgaatggttgctagtaatttcgtttcttttttttttcttctgtaattggtttataaagggaataatctatgtggcagcatgtggaatcttactttatagaagtttgttcagttcaaaggacttaaaattggtcagtcccttgtcatatagcttcttttctttgttctctttttctgtaattaccaattgtagcattatttttatgaccgtcgtaattcagcctagtcgatttattcccggccaaaaaaaaaaaaaaaaaaaaaaaaaaaaaaaaaaaaaaaaaaaaaaaaaaaaaaaaaaagggcggccgc

SEQ ID NO: 4280 - DNA, 3043 bp, Zea mays
ctgaggcaatccagcaagagtcctgatcggtagaaagtcgcaatagatggaaagctcaagaccatgtatggggcctaaacaaatggaaggaaatcaagacaaaatcaattcgtgccgtttttaaaaggaagcaccaggtagcggccagctaataataagcgcgcacgcagccatctcgagggacagaaaagggcgccggggaccggcccgccccgccgcaagtggaaagcaagcagagacagggaggagagaggagcagagcacagacgcagcgcagccgcagcagagcacccgccagcggtgttattagcagtaactcgtaatcgctgcctgagctctccggccaatcgcgtcatttacttgctttactaatcacgcttagcgattttagtctcctcctcctcttcaccccacctctttctccctcccttccctccctgttccctttcccacccctgcctgaggccttccgccttcgtctctgaatcgcggcggctcctgagtcccgaggcgccgcctgatgagcggctaggcgccggatctacggcagcgttggaggtctgatttggacgggagagagcgaggtgaggtctcggttttctcgatataggagatggcggcggcagaggcgcggggagcggacttccccgtggggatgaaggttctggttgtggacgacgacccgacgtgcctcgtcgtgctcaagaggatgctccttgagtgccggtacgacgtgacaacatgtccgcaggctacaagagcactaactatgttgcgagaaaataggcgtggttttgatgttataataagtgatgtccacatgccggatatggatggattcaggctacttgaacttgtaggccttgagatggatcttccggttatcagtcagtatatatttcttcttgtttttctgtttagtatgttaacatgtggtgttggaacacatcagaaataattgctgatgaaattgcagtgatgtctgctgattcaagaacggatattgtaatgaagggaattaagcatggagcatgtgactatttaataaaacctgtcagaatggaggagttgaaaaacatctggcaacatgttgttaggaaaaaatttaatggaaacaaggatcatgagcattctggtagcctagatgataccgatcgtaacagaccaaccaataatgataatgaatatgcttcctctgcgaatgatggaggtgatggcagctggaaatctcagaaaaagaaaagagagaaagaagatgatgaaactgacctagaaagtggcgatccttctacatcaaagaaaccaagagttgtttggtcagttgagcttcatcaacaatttgtgaatgcagtcaatcacctcgggatagacaaagctgttccaaagaaaattttggaattgatgaatgtccctggcttaaccagggaaaatgttgccagccatttgcagaaattcagactctacctgaagagaattgcacagcatcatgctggaatacctcatccatttgttgcgtctgcttctagtgctaaagttgctccgttaggaggactggaattccaagctttggctgcttctggtcagatccctcctcaagctctggctgctttgcaggatgaactccttggtcgacctacaagcagtttggcattgcctggaagagaccagtcatctttgcgactggctgcaatcaaaggaaacaagccccatggagagagagaaatagcatttggtcaacccatatacaagtgtcagaataacacgtatggtgcattttctcaaagcagcccagcagttggaggattgccatcttttgcagcttggcccaataacaaacttggtatgactgattcttcaaacacattgggaaatgtgggcaattctcaaaatagcaatatgttattgcatgaattgcagcaacagccagacaccttgctgtcaggaacccttcacaatattgatgtcaaaccttctggtgtagttatgccatctcagtcgttaaatgtgttcccggctagtgaaggcatctcacataatcaaaatccattggttataccatctcaatccccaagctttctggcatcagttcctccatccatgaaacatgaatcccttcttggatcaccttcaccatcaaccagtctgttgggtgggcttgatatggttaatcaagcttcaacaagtcagcctttgattagtagccatggagcaaatcttcctggtctcatgaaccgcagctcaaatgcaatgccttcaccaggaattagtaattttcaaagtgggaatattccttatgtggttactcagaatgctatgggagttagctcaagaccaccaggtgttctaaagactgagtgcactgaatcgctgactcatagttatggctatattggtggtagcaccagtgtggactctagcttgctctcttctcaggccaaaaatccacagtatggtttattgcagagtcaaaatgatgttagcagcagctggttgtcttcacaagattttgatagttttggaaattctcttgggcaaggccaccctggttccacttcgtctaacttccagagttccgctcttggcaaattgcctgaccaaggacgagggaggaatcatgggtttgtcgggaaaggcacttgcattccaagtcgctttgcggtggatgaggttgaatctccaactaacttgagtcacaacattgtaaacagtggagacatagtgaacccggacatattcggatttagtggacagatgtgaaactttcttgaatttgtaattagggttgatcagtgaggaccggaaacaaatttagtggtttgaatggttgctcgtattttcgtttcttccttttccttctgtaattggtttataaggggaatcggctatgtgacagcatatggaatcttgctttatagaagtttgttcagtttaaaggacttgaaattaatcagtcccttgccatatagctcctttcctttgttctcttgtagcacaatttttatgacagtcgtaactcaacctagccgatttattcctaaaaaaa

SEQ ID NO: 4281 - DNA, 2632 bp, Zea mays
cattgggtccctcgaggccggccgggggccaatcgcgccatttacttgctttactaatcacgcttagcgattttagtctcctcctcctcttcaccccacctctttctccctcccttccctccctgttccctttcccacccctgcctgaggccttccgccttcgtctctgaatcgcggcggctcctgagtcccgaggcgccgcctgatgagcggctaggcgccggatctacggcagcgttggaggtctgatttggacgggagagagcgaggtgaggtctcggttttctcgatataggagatggcggcggcagaggcgcggggagcggacttccccgtggggatgaaggttctggttgtggacgacgacccgacgtgcctcgtcgtgctcaagaggatgctccttgagtgccggtacgacgtgacaacatgtccgcaggctacaagagcactaactatgttgcgagaaaataggcgtggttttgatgttataataagtgatgtccacatgccggatatggatggattcaggctacttgaacttgtaggccttgagatggatcttccggttatcatgatgtctgctgattcaagaacggatattgtaatgaagggaattaagcatggagcatgtgactatttaataaaacctgtcagaatggaggagttgaaaaacatctggcaacatgttgttaggaaaaaatttaatggaaacaaggatcatgagcattctggtagcctagatgataccgatcgtaacagaccaaccaataatgataatgaatacgcttcctctgcaaatgatggaggtgatggcagctggaaatctcagaaaaagaaaagagagaaagaagatgatgaaactgacctagaaagtggcgatccttctacatcaaagaaaccaagagttgtttggtcagttgagcttcatcaacaatttgtgaatgcagtcaatcacctcgggatagacaaagctgttccaaagaaaattttggaattgatgaatgtccctggcttaaccagggaaaatgttgccagccatttgcagaaattcagactctacctgaagagaattgcacagcatcatgctggaatacctcatccatttgttgcgtctgcttctagtgctaaagttgctccgttaggaggactggaattccaagctttggctgcttctggtcagatccctcctcaagctctggctgctttgcaggatgaactccttggtcgacctacaagcagtttggcattgcctggaagagaccagtcatctttgcgactggctgcaatcaaaggaaacaagccccatggagagagagaaatagcatttggtcaacccatatacaagtgtcagaataacacgtatggtgcattttctcaaagcagcccagcagttggaggattgccatcttttgcagcttggcccaataacaaacttggtatgactgattcatcaaacacattgggaaatgtgggcaattctcaaaatagcaatatgttattgcatgaattgcagcaacagccagacaccttgctgtcaggaacccttcacaatattgatgtcaaaccttctggtgtagttatgccatctcagtcgttaaatgtgttcccggctagtgaaggcatctcacataatcaaaatccattggttataccatctcaatccccaagctttctggcatcagttcctccatccatgaaacatgaatcccttcttggatcaccttcaccatcaaccagtctgttgggtgggcttgatatggttaatcaagcttcaacaagtcagcctttgattagtagccatggagcaaatcttcctggtctcatgaaccgcagctcaaatgcaatgccttcaccaggaattagtaattttcaaagtgggaatattccttatgtggttaatcagaatgctatgggagttagctcaagaccaccaggtgttctaaagactgagtgcactgaatcgctgactcatagttatggctatattggtggtagcaccagtgtggactctagcttgctctcttctcaggccaaaaatccacagtatggtttattgcagagtcaaaatgatgttagcagcagctggttgtcttcacaagattttgatagttttggaaattctcttgggcaaggccaccctggttccacttcgtctaacttccagagttccgctcttggcaaattgcctgaccaaggacgagggaggaatcatgggtttgtcgggaaaggcacttgcattccaagtcgctttgcggtggatgaggttgaatctccaactaacttgagtcacaacattgtaaacagtggagacatagtgaacccggacatattcggatttagtggacagatgtgaaactttcttgaatttgtaattagggttgatcagtgaggaccggaaacaaatttagtggtttgaatggttgctcgtattttcgtttcttccttttccttctgtaattggtttataaggggaatcggctatgtgacagcatatggaatcttgctttatagaagtttgttcagtttaaaggacttgaaattaatcagtcccttgccatatagctcctttcctttgttctcttgtagcacaatttttatgacagtcgtaactcaacctagccgatttattcct

SEQ ID NO: 4282 - DNA, 5595 bp, Zea mays
  misc_feature (2341)..(2341): n is a, c, g, or t
ctgcagagtgaactgagatctgagcgacttttgtgtttttttattgttacagcacttatctattctttcattgtagaatgcaatgtaattgcaccaaaccctcacactattcattgtttgactgaaaacattgtgaaaacatgttactaaagttgacttctcctgttctctatggtacatatcacaaaaataaacagctattgacactatttaaaaaaatatttgactataaacattgctctgagactcattagatgattatcatatgtcctctttttattaaacattttgaatgtaccctgttaccttatgtaataccattaagtttactagtttctgttggctgttgttgagctccaggtgcaaccaatatttaataacctcatagcttaaggcatcaatgatgataagatgcatttattttctatttgcagaaattcagactctacctgaagagaattgcacagcatcatgctggaatacctcatccatttgttgcgtctgcttctagtgctaaagttgctccgttaggaggactggaattccaagctttggctgcttctggtcagatccctcctcaagctctggctgctttgcaggatgaactccttggtcgacctacaagcagtttggcattgcctggaagagaccagtcatctttgcgactggctgcaatcaaaggaaacaagccccatggagagagagaaatagcatttggtcaacccatatacaagtgtcagaataacacgtatggtgcattttctcaaagcagcccagcagttggaggattgccatcttttgcagcttggcccaataacaaacttggtatgactgattcttcaaacacattgggaaatgtgggcaattctcaaaatagcaatatgttattgcatgaattgcagcaacagccagacaccttgctgtcaggaacccttcacaatattgatgtcaaaccttctggtgtagttatgccatctcagtcgttaaatgtgttcccggctagtgaaggcatctcacataatcaaaatccattggttataccatctcaatccccaagctttctggcatcagttcctccatccatgaaacatgaatcccttcttggatcaccttcaccatcaaccagtctgttgggtgggcttgatatggttaatcaagcttcaacaagtcagcctttgattagtagccatggagcaaatcttcctggtctcatgaaccgcagctcaaatgcaatgccttcaccaggaattagtaattttcaaagtgggaatattccttatgtggttactcagaatgctatgggagttagctcaagaccaccaggtgttctaaagactgagtgcactgaatcgctgactcatagttatggctatattggtggtagcaccagtgtggactctagcttgctctcttctcaggccaaaaatccacagtatggtttattgcagagtcaaaatgatgttagcagcagctggttgtcttcacaagattttgatagttttggaaattctcttgggcaaggccaccctggttccacttcgtctagcttccagagttccgctcttggcaaattgcctgaccaaggacgagggaggaatcatgggtttgtcgggaaaggcacttgcattccaagtcgctttgcggtggatgaggttggatctccaactaacttgagccacaacattgtaaacagtggagacatagtgaacccggacatattcggatttagtggacagatgtgaaactttcttgaatttgtaattaggtaagcacacattccacctgatgtgaaattccacaatgacttttgccctccttttgaacttgatgcaataatgccgaacatgattatcctttttagttcaaaaaaaaaaaaaaaaaaacttatttggattggtgcagggttgatcagtgaggactggaaacaaatttagtggtttgaatggttgctcgtattttcgtttcttccttttccttctgtaattggtttataaggggaatcggctatgtgacagcatatggaatcttgctttatagaagtttgttcagtttaaaggacttgaaattaatcagtcccttgccatatagctcctttcctttgttctcttgtagcacaatttttatgacagtcgtaactcaacctagccgatttattcctaaccatattctttctactagccgatttttatgacaacggactctatttctatttatttttgaactaaaatttatttagggctctaataaattatgaaaaaacatttgaattgtgactcattaacatctctaggccctagctgtaactgaagtaccaaattcagaaattctagaagtatatacntgtatgattttatagggatggtgacgggtaaaatatccgcggatagtatctctggacatccatatccgcgacttatatccgatattcgaacccgtacccgttacccgccatggataacaaacggtatccacatccgttaaccgcgggtaacgaatatccgtggatatatctatttgcccactgcacatacaaaatatataaatccagcaaattcaaacaatcaacaagtcgttgcatctggaataacctgtacttgcatttgggtaaaaaaaacaatcaacaagtcattgcatctggaataacctgtactttacatcggaccggtagcgggcagcggcagcgggagtctgggaaaggtgagatggagtgggcggcggcggtaggagtggccgagtgggagaggacagaggaggagagaatgagagatggaggccgactggccgagcgagggcttcgctggattgctggaagcctggagaacgcttgtggcgatgtggcccgtgggcctatgggatgggtgtaattttaacggatattcgggtatttgggtatggatattgatttttcgtatccgttttaaaaatatccgcggatatcaagtgctatccgtatccgtatccatgggtacagactcgtacccaaaaccgtgcccaacgggttttttatccgcgggtacgcggataaatgacatccattgccatccctaatgactttcatttgcattgaaaccattcaacagcctttttttacagcacaataaatctttggtattttgtatttgaaacgcttgtatatcgaatatgtccattgtttagccaggcaagtatgcattcttgagaatttgctactccgttcttgtcccggcaagtagcgcctggttcaagccctcggctcctgcagcatgggcaactgaagttgcttcacagtcgcagtcctgatcgcccgccgccgcctgcagagcggccatctgcgcgtgccgtctgtccgcggggtaagtccagtacagcgcggtgtaggtgaggcaacagacggcaactggcacggcgatctctgcgaataccgccttgccgagagcagcggcgttctccctgtcagcctccacgctcgtgccggacgaggccggttggtacccgaagacgcgctccgccaggatgcccacgagcggcggcgcgaaagaggcaaacactgactcgaagcacctgtccatagcgtacaccgtcgtcctcgccttctccggcacgatctccgcaaaaattgggctgcaaaatgactgcagggtgagcgacttgccagatggagcaaaaaggcccttttaccgttggcaggggcgcaggggctgacagtggtgtcactctcacttgtttgtggaggcggggcaccagggcgagacgaagccgaagacgaagaacatggcggcgtacgcggcccccgcagaggggttgtcggggagcgccagcagcatgacggcggcgagcgggatgctcgacgcggtgcacacctgcgcaagcgcgatcctgcccgtgttggggaaccgcagcgccactgggtccccgacgaaccccgcgaacagcgagccaagcgcgttagcgagactgttcaggctagtgatgacggtggtctgccagtgcgtgaacccgacgagttccagccacatggcggcgaagctgagcgccgaccacggcaccgacccagccacgccctgcgccactatgatctggaacgtcggcaccttcaccacgtccttggcctctcggacgagttgggccagcgtggccgcagccgtggccttcacgctgacggggcgcgggtcggcgccgaggagccacgttagggcggcgatcgaggcgctgacgagcgcgagggcgtagaatgccagccgccagcctgggacgccgaggaagcttgtagccgctagcagcacgccgagggagttccccgcgacgtggcccatgctttgcgccatcgtcacccacccgaacgccgcgccacgcgtgccgtcgtcgctgtagtcggccaccagggagtagaccgcaggcacaacgaccgccagcccgacgccgttgaagccccttgccaacgccatctgcaacacactttagcgctcagatagcgcgcgcacgtgcagcaatcgctaaagccaaaggatgccccctttgttagtgtccggtccgatgtccagactccagtggccagtggcagtcactgacctggagatatgtgcccgaggcgccgacgagcagcgtggccacggcccagaggaatgccccgacagcgacgacgcgcgcgcgatcgtagcgcgccgcggcgcacgtcgcgagcgggtagcacagggtctgcaccagcgcgcggcacagcgtgagggagcccagcgcggtgggcgacacgcccagcgactcgcctacctccttgtacaccgcgggcagcagcgcctcgtccgcgcgctccagcagcgccgccgtggtcaccagaaccagcgtcaactgccgcctacgccgctgcacctgcaccgcgctgctccccatttcctccacaaacaacactcgcgtgccaacgtacgcaagggttttaatatgaaacggaggccagggatgacagctccaacatggcatcgtttttcttctctgctcgtacgtgcaagcattttttttagggaagtacgtggaagcattgacctaccatttcttatacgattaataatgcttgcaagcaagtgactggctaatgtattttgcgggatagcgatggcggtgagacgcgagtttcacgagcgaaagcttgggtttctgactggcattgtagaggctgcgacaaagtcttgtagaatctagtgaccttgtcctgaatcctgatgtccaagattggacttcaattctctggttgatagccagtgcccggtgctgcagattgagaaaaggtgtaaatcctcagctatcactgtccttgattttgctcccaaagacgggattgatttgtcagtaaggtgtagccagccgctgagctatgctgtcaagaatcgggataggctaaggaagacccgagggacacatcagagagagagagagagagagagagagagagagagagagagagaggagatgggaggaggaagccgacatgtagtctgttatttcccaattctttcatgcctcctccgttaccgttcgactctcttatatggcataatatggggcttagcctagctcagttggcccactttggcccgactacctttctatttgtttgaacgacaggct

SEQ ID NO: 4283 - DNA, 1380 bp, Zea mays
gaatctccaagcacatcatgcgcccccccgaaaaaaaattccccacgtactagaccaccacccgttggctttctcccctcgcaccggggaacgcggctgccgatccgctcccgatcccctgccctcctccttccagccgactgagattccaccaaatcggcgcccgtgcagtccccgattcgattggcaagcacgattggccgctcctgatcagctacgggacagggctggatttgatttgatcggatccccaattgggtgtccgggtccgcgcgttcgggcgggcgggcgtgcgggcggggggattgctttagggtttcagcgggtgcggtcgctgtgtaggcgggtagggttttgccatggcggagaaaggctgcctgaaccggctccagaaggagtaccatgcgctctgtaaggaaccgccgccgcaggtcgtggctcgcccactgcccaacgacatattggagtggcactatgtacttgaaggaagtaaaggcacaccctttgaaggtggatattactatgggaaactcaaatttccaccggattatccttttaagcctccaagtatcagcatgacaaccccgagcggcagatttgcgccacacaaaagaatatgcttgtcaatgagtgactttcatcctgaatcttggaatccgatgtggtctgttgcaagcattctcactgggcttctgtccttcatgatggacgatgcactgacaactggaagcatcaagacatcagatgcagaaaagaggcgtttagcaaaagcttcccttgtctacaattgtgagagcaaaaactgtccgcacttcaggaaacttttcccagagtatgttgagaagtacaatcaacagctacaattggagaacactgctgcagagccggtgcctcaggagaatcctgcacctgctccatcccctgctgtccagcaagccccgaccgtggccaatagggcacaaccactggcggaggcgcgccgtgacaagaaccagaagaaggcggtgcccttctggatggtgctggtcatgttttcagttttcggggccgtgatggcgttgcccctaatgcaactttgacaataataaagacaataagaacgtgtgatgccagggccgtaattttgtatagttttccattggtttgtctgagtgactcagttggtcccctagactacctaccacctcggagtcgtattgatgaacctgtgatggtatatctgaagaacttttgttctcagttctcaaaaaagaaaaaaaacgccagaaggtccttcgtgtttgctttctgtttccgaaatcgtatacttaattttttttgttgcctcccagttcgtctttgtgatgtgtgctgacttcaaggttgagttcgcattttcac

SEQ ID NO: 4284 - DNA, 1434 bp, Zea mays
aacaaaaaacaccccagctatacggtacactcgctcgaatctccaagcacatcatgcgaccccctcctaaaaataatgtccccacccattagaccaccagccgttgcccgttggcttggcttttctcccctcgcaccggagaacgcggccgccgatcccctcccctcccctttcccgccgactgatcccaccaattctgcacccgcgcagttcctgattcgattggcaagcgcaattggccgctcctgaccagacgccggatagggctggatttgattggattggatccccaattgtgtttgccacgtccgtgcgttcgggcgggcgggggagttactttagggtttcggcgggtgcggtcgccgtgtaggcggtagggttttgccatggcggagaagggctgcctcaagcggctccagaaggagtaccacgccctctgcaaggagccgcctccgcagatcgtggctcgcccgctgcccaacgacatactggagtggcactatgtactggaaggaagtaaaggcacaccctttgaaggtggatattactatgggaagctcaaatttccaccggattatccttttaaacctccaagcatcagcatgacaacccctagcggcaggtttgcgccacataaaagaatatgcttgtcaatgagtgactttcatcctgaatcttggaatccaatgtggtctgttgcaagcattctcactgggcttctgtctttcatgatggacgatgcactgacaactggaagcatcaagacgtcagatgcagaaaagagacgtttagcaaaagcttcccttgcttacaattgtgagagcaaaaactgtccgcacttcaggaaacttttcccagagtatgttgagaagtacaatcaacagcaacaattggagaatactgccgcagagccggtgccacaggagaatcctgcacctgttccatcccttgctgtccagcaagctccagtcgtcgccaatagggcgcaaccactggctgaggtacgccgtgacaagaaccagaagaaggcggtgcccttctggatggtgctggtcatgttttcagtttttggtgccgtgatggcgttgcccctaatgcaactttgacaacaataaagaccatgaggacgtgtgataccggggcagtaattttgtatagttttccattggttcgtgagtgtaacaaagttgccccctagacttacctaccaccttggagtcatattgatgaacttgtgatggtaacatgtgtagaaccgttatctatcttgactagtagcgtcagaagctcgttcgtattttgctttcgtttccaaaatcgtatagttattacttttctggccaaaaaaaaaaaaaaaagcgtgtgctggctttaaggctcagttcacaatttcatattccctttccaagcggcaaaaaaaaacccacgcgtccg

SEQ ID NO: 4285 - DNA, 5373 bp, Zea mays
catacatgtaggagatgatgaactatatggatggatatcttgaccagttcaatgaatatcggacgctgggacaattcaaggctcatttcctaccttacatgcctgccaactaatatgacctactgcactcctgccaaagcttcttgccttcgaaggaggaggaggaagaagatgatgagcagctaagaagaattcggcaacatctccatgaactctccaaaaatggagctttctccatggcttgtgttctccttgggtttccttgcgcaggctctcgtcatcttggctgacacgaatgcacaagacggtatgttccagtttttccgtcccttgtgtccttgttatttctgtgctcacttgctcattctgttgctcttctgtgcagcttctgggctgaatgggattcaagattcctggaacaagaagccatcaaactggagggtgggcactgacccatgtggagataaatggaacgggataagctgcaccacaagccgggtcacggctatgttagtatcagcagctagaagatattatcacatacggtcgtttccttctagtcatccattttatagatgagcaattcatcactcattctgctgctgttgttgttgttgtttcgtggtggccgtgcctgcagaagactctcgagtttaggattgtcaggatccctttcaggcgacatccagtccctgtccgaattgcagaccttgtatgaaacattccgacttttacagtctgatttgatttgatttgatttgagtctccatacaagcacatgaattggaatttttagcatttgtttcaagcatgtgaggtgattgcttcctgtttttgttttttggcagggatttctcctacaacaaggacttgggcggtcctcttcctgcgtccatcggaagcctgagtaacctcgaaaacctgtgcgcaaccaaactttttaaggagttccaatcgtccactgatttcaatattttcactgcctggattgttccttgacttatttgctctccgactcctccgcaggattcttgtcggttgcagcttttctggagaaataccgaaagaactcggacagctcaccaagcttagatttttgtaaggagaccaaaccaaccctgaaacctttgtgtctatgcctttgatctattagcaaccataaacaaacaaggatataatcattttttgggattgtatcttctgttgaacaaaaagcttttacctatctatatctatccaactgtcacttgggaaatcaactttagtttgtcctctttggtcagaacagaaaggaagtaaaattgaggtcttacgttctgtatatgcttgaaaatcaaacaagtttatgcgcttaggtccaggcagcacaatgtgatctttagctttttgactgccactacaatagggtaaaaaaaagaaaagaaaagaaagatttggtcattgtattccatcgctgcagatctttgaactcaaacaagttcagcggttccattccggcatcactcggaaggctctcgaatctatactggtttgatctggctgacaataagctctccggaggactcccggtgttcgacggcacgaatcccgggctggataacctgacaaatacaaagcacttgtatgtaccagttccagtccccagaattaagttcattgacattatattgggatctgacattttgatccccttgaagagttgtggttcatttgatggccgtttcttcgcagccacttcggggtcaatcagctctcaggaacaataccgagccagattttcaactcaaatatgacgctgatacatgtgtaagtgagaggaaactcatacgacttggtcgttttttgttatgaaggctagctcaggcttgtgttctgtatgtatgcaggcttcttgacaacaacaacttcaccggacgcattcctcctactctgggccttctcaatacactagaagtcatgtgagtacaaaacctgcatggcatggcatggcatggaaaagaaaatctacaaaacttgagcccaacaacctcacaaaacttgcaggcgttttgataacaactaccagctgactgggccggttcctagcaacatcaacaacctcacaaaacttgcagagctgtgagtgttgttgtttcattcacttctgtcagtatcagtaggactagtagcaggaagctataacgatttgtcatctctttcgatcgattctttctgtcggtccacactagccatctggaaaacaaccagctgactggtccactgccagacctcacagggatgatcgcgctcagttttgtgtaagtgaattcgctcgagagctagtttctccttttcttgagcccaagacatgagtagcttgtgaagctgttgcaactctgtggcagggacatgagcaacaacagcttcaatgcatctggtgttccttcctggttcaccactctgccatctttgacctcactgtaattctgtctctctgcactcctcctactcaagtccagaacctgtgtctgaatctttgtttgtcggttacattacatacaggtaccttgaaaacctgcgtgtcacagggcagctgccccaagccctgttcagccttcctgcagttcagacactgtgagtcagtagtgtttccttctccaaaaaattcgtgctgtccttgtacatgtagaaaacgatcgatcatatatagagtttgcaggaggctccggggaaaccgtttcaacggcacgctaactatcggatcagactacagcactcagctccagctaatcgatctgcgagacaaccaaatcagccagataactgtcggcgggtcacagtacaacaagcagctcatgtaggaagagaggaaccgagctcatcatgtagcaagcaacagcttatttttgcagttcatcgttcgttcctcacaaatcgcacgcgtgcatctgctgtcttcttccacagactagtcgggaaccccatctgcagcccggggacggggagcagcgagaaatactgcgcgtcgccggggcagtccaaccaggcggcgccgccgccgtacagcaccccgatgaactgctcggggctgccgccgccgtgcctctcggaccagctcgtgagcccaggctgcgtctgcgccgtgccctacaggggcaccctgtacttcaggtcgccgtccttctctgacctcagcaacggctcgtactggggccagctggagaccagcatcagagccaagttccggagtctcagcctccccgtcgactcggttgcgctccacgatccgtccgtcaactcggtcaacaacctgcagctcgcgctggaggtgttccccagcggcaagacccagtttggtgagcaggacatctctgacatcgggttcatactcagcaaccagacgtataagccaccctcagtattcggtccgtactattttcttggccagccgtacagctttgccaatggtaacaacaagatcattcattttcattcacgaaaggaaagtagttacacctcctgctgctttttttactatttactgcttttttttcatggacgtagtggtgctaataccttccaaatcgaaggcgaacaaccgcttacctctgatcgtcggagcctcggtgggtggagcggttcttgttgcaatagttcttgctcttgttaccatcgtcgcaaggaggaagaagagaccaaagcagaacgaagagaggagccagtcttttggttcgtacttcgtagtactgtacccttgttgccattttgcctttatttggttcacagtttctctgtagtgcttgttactgacaggagtagagttctatctataatgtaaccacaagtccacaaccatgaaccatctctgctgctgctacagtttcttgggacatgaagagcacgagcggcagcagcgtcccccagctgcgcggcgcgcgcacgttcaacttcgacgagctgaggaagatcaccagcaacttctcggaggcgaacgacatcggcaacggcggctacgggaaggtgtacagagggaccctgccgagcgggcagctggtggccgtgaagaggtgccagcaggggtccctgcaggggagcctcgagttcaggacggagatcgagctgctctcccgggtgcaccacaagaacgtggtcagcctagtgggcttctgcctggaccaggcggagcagatcctcgtctacgagtacgtccccaacggcacgctcaaggagagcctcacgggcaagtccggcgtgcgtctggactggcggcggcgcctccgggtgctgctcggcgccgccaagggcatcgcctacctccacgagctcgccgacccgcctatcgtgcaccgcgacatcaagtccagcaacgtcctcctcgacgagcgcctcaacgcccaggtctccgacttcggcctcctccaagcccctcggagaggacggcaggggacaagtcaccacgcaagtcaagggcacgatggtcaggctggcattgcctgcttcattcatcagtcatcacacacacacacacaacgaactaattcactcgttcagacaagctaacgttgatggatgtgatgttgcagggctaccttgatcctgagtactacatgacgcagcagcttacggacaagagcgacgtgtacagcttcggcgtgctgatgctggagatggccacggcgaggaagccgctggagcgcggccggtacattgtcagggagatgaaggtggcgctggaccgtaccaaggacctgtacggcctgcacgacctgctggacccggtgctgggctcgtcgccgtccgcgctggccgggctggagcagtacgtggatctggcgctgcgctgcgtcgaggaggccggcgccgaccggccatcgatgggcgaggtggtcggcgagatcgagcgggtgctcaagatggccggcggcccggggcccgagtccgcgtccaactccatgagctacgccagccggacgccgcgtcacccctacggcggcgacagccccttcgaccacagcaacagcgggttgccgtccgcgagggttgagcccaagtgaatctacagcgcgcgccgcgagtacatgcggaaaagcttcactcttcaacaaaagctagctctgaatgtacagggtattgtaattattagtgttataattttggttactatgataggtgtgcgattggattaagaactgatttcttgataacgattgtttacatgataattttggttgctatgtatttaagatagatatgcaattggattgttgacatgctaatatatttcatgtatgtcatcaaatacacaaatgattatttatgttcaaatattagacaatttcacaactaattttgaaagagtaaaatacgttggtggtccctaatcttataccgttg

SEQ ID NO: 4286 - DNA, 614 bp, Zea mays
  misc_feature (596)..(596): n is a, c, g, or t
gctatgccaaactgctcgcctcgctaaatccgctccattccctcgccctcgccgatcgtcggatctctccctccgcctcgcttccgccgcacgccagggcgcacggcttcttcctccgctccctcgcctcagcgcagttcctatggggttcctgcaaagcactttttcgctgttgatcggcaccggctgcggcatctacattgcccagaactacgacgtcccaaacataaagaagctcatgaggagcctggtgggcaaggccaaggaggttgaggagtcgtacaagaagacgggcaacagcaagaacaaggataacgagtagcgttgacccgcagtctgcggtccaccataggaaagctaattgttgcaagagtattctgattattggaggtatactatcttggttagtaccttctgtctacttatttttttttctcttaaagaaaatatgagatggcatactgaaaaagcaatcaagtaaaaaaaaaaattgaatctgtctagacgtggcaatacaaattttgaggtgaaagagccggacgtgggatccatgctacgaattgggttttggaattggaaagtattgggatttattntatatatttatgttggct

SEQ ID NO: 4287 - DNA, 1718 bp, Zea mays
cccgagtgtgtagtccagccatcgccattctacatatcagcccctgattagtgggcgatccggtccctacgccaggacgctcaatttcctgcgactttacagggcctgcctcgccgccggccgcgccgccactcccccaatccccagcagcctcctccaacccacgaggccacgagagagagagagaggcagaggcagccgctgccccggagccacgcctcccctcgcctcagacccgcggctggtgctcgctcgccggcggcggagcgccggggcaggtaagccggcccccccgtgcccgtccttcggaagtgtctctgcagcagaggaggacacgctgctgacagtgtgatccactgctatcattactgccctattttgctggctgcaggcttgtgataatggacaaccttgggcatagagaaaatggcaggcaaaggcctgagcaatataaagcgcttcatactcagtggatgatacctcaaaggcagctaaaagaccatcaaagtatgaatctcctggcactgatgaatgagaaggacagtgccatccgagaaagggaccatgctctcgctgagaagaaagcagctatagctgagcgagatatggcattcgcccagcgggatgctgcaatggctgaacggaatgctgcaatagtggagagggacaacgccctagctgcactcgaactcgcccgtacaaatgggtttaatatgaatagtgggaatggatttcaccaaggacctcctctcaatggaacaaagaacatccatcaccatgaccatctgtcacatgtccaaacatccccgctgcagctggccaattctccatatgaccatgtcagggagatgcacatatcagaagcataccctatcgcaacagctcccgcaagtgtcgggaaggctaagaagccaaggaagagcaattctcaagcttctccatcgaagaggccatcaggtgtactccgaaaaaccaagaaagcaaccagcgactggaagaatgcggggactactggtggagcaggagattcagcccgcgcttctgtgatgaagaacgagtggaaggaccaggatctcggcctgaaccaggtggtgttcgacgagtcaaccatgcccgcgcctgcctgctcatgcacaggggagctccaccaatgctacaaatggggcagtggtgggtggcagtcgtcttgctgcaccatgaacatgtccatgcacccgctcccggtgatgcccaacaggcgccacgctcgcatggggggaaggaagatgagcgggggcgcgttcgcgaagctgctcagccggctggcagcagaaggtcatgacctctcgactccggtggacctcaaggaccactgggccaagcatggcacgaaccggtacatcaccatccggtagccagccggcggccacgttgaagcctgagcctggaaggggggagagatcacacaaacgtcgccttgtcctgcatcccctaaaccctctcttttgctatgctctgtaatgccattggtttgtagtggatggagcacttctgcgttcatgaaaccacagcgttgtaggttctcccctccattgtgctggactagtaaactgtgctcgcgagctggagtgctgaagtccgcgagaatccatgtgtaattgtagctcagaagtattcgtcgcgtgataaaaacaaaaaaaaaaaaaaaaattcgagtcgagtggtggtagttggaggtc

SEQ ID NO: 4288 - DNA, 1999 bp, Zea mays
ctctctatatctaatttctcgtggaggcgagcagatagacaggagagagaacgcacgcaagaacgcgctctcctcgcgattggacagggcgcgaacaccccgaggacgcgcgcgatccccgaggacacgggggtgacagcctcgccgtcgccggggcggccgtttcgagctccgtcccgcctcggcccggctcagatttggtgggatccggccaagaaatcccgcagttggtgaggaggagaggaggggagaggaagggagggcggaggggatgggcgtcggtgcggagcccaaggatcaggcggcgacggccgctggggtgccggcagagcaggacgaggcgggcgggaaggaggacaaggccgccgcggtgtcctgctcgatctgcctcgacgcggtgctcgctgcgtccggggagaggtccaccgccaggctgcactgcggccacgagttccacctagattgcattggatcagcatttaatgccaaaggggttatgcaatgccccaactgccgcaaaatcgagaaagggaattggctttatgcaaatggttctcgatctgcccatgatgttagcatggatgaatgggcccatgatgaagacctttatgatgttagctactcagatatgccatttcgcttccattggtgtccgtttgggcgcttaacccaacttccatctttatttgaggaaggagaatcatcacctccagttacatttcatgacttcatgggacaacatgtgtttacggagcaagtagctgtatctgctgcagcagggacaactaatccttgcccctatgtggcatacttgcatcctcttacaccattgacgtcattgtcaagctcccatgtccctgacagaactatggatcgtcctgcataccatgatcattggaaccccatggctgggccatcagatgttaggtccatgcaaacaatgcaacctgctgattttcatcatagccattgggcacatgtgccccattcttatggtcaacccaacagcaataacgagcagccaggaatcccttttggagcaagggctgtacgggtcgatggtgatagccaacgccgagcatctgttgtctctccatcttacttcagtaatggatctggttccagatctagacctcccaatgttcctcctctgatgcctcagttcatgagggctcatggcagcatcagcgaacagtaccaacagaattcatcatctagcttatttgctggggcccataggtcaggaggcatgcgacctgccccaacacctctaccagagaaccccacctttaccttgttcccgccaggttcatctggccatagctcgatggagactgatgatgctgggggaagccggttctacgcctgggagggtgaccggtttgccccatacccgttgatgccggtagactgcgagacaagctggcggacctcacagcagcagtcccaccagagcacatcagagcctacatctgctccaaggaggctgtttgggcaatggctcgctgtcggcaggccatccccatcacccgaggggtcttcgtatcgtcaattgcactcaccgcggatgtagaccctcgccgctgaaagaaacgatgggaagcccattgtattaagttaagccgggctgtgccgtgaaactttgggacgatgctcgaggggacagaaactggaaacgatccggctgaggatatttcgatttggtttatgtgaattccatctcgtacatatttgaaatcaagttgggatgctgggagcttcgaatgtaacgtgatttcttatgctgcaattctgttgattgacggattttcaaacgcgattgaatttccgttgcaagggtaaaaaaaaaaaaaaaagcgttcccagtacgggccccagcatgtgaaggcctacgttccatgcagtttccaacaaagtagaatagaaatttggtgaaacactcgattgcagtggtttggcattcgtaatgttagtaaggcaaaatgttccaatcccgatt

SEQ ID NO: 4289 - DNA, 2521 bp, Zea mays
caacctgtctatctgttcagttgctgtgaatcccgctcttttcctgttacctgttatgaaaaaattagtgctattcacttacaccttccctttttctgtcagggaaggagaatcatcacctccaattacatgtaagttctgatttgcattaagaaatttgtagtaaaattgaaattatattgaacatgtttggatattggttgggaaggagaatcatcacctccaattacattccatgacttcatgggacaacatgtgtttacggagcaagtagctgtatctgctgcaccagggacaactcatccttgcccatatgtggcatacttgcatcctcttccaccactgacatcgtcaagctcccatgtccctgagagaaccactgatcgtactgcataccatgatcattggaaccccatggttgggccatcagatgttaggcccatgcaaacaatgcaacctgctgatttccatcatagccattgggcacatgtgccccattcttatgctcaacccaacagcaacaatgagcagccaggaatcccttttggaacaagggctacacgggttgatggtgatagccaacgtcgaatatctgttgtttctccatcttacttcagcaatgggtaaattatactcatccctcgggagttatgttatgactatgctacgaaaatatgagattttgaattcatgcattgtactctgagaagatggaaccatttttttagtaaaatgaatctaaacaaacagtgaacacctgagtctcttagcagatgtgagatatcatctgtgaacactgttaaaaaaattctttaccatatttcttgatgttacattggtgccgttgctttgactgcattactcaatttcccattgtttaacctttatctgacataataggctgggaggataaatatagaacaaaagctagattgttagaacatcaagtattgccatacaatctagcatcttatccatcgctgtgaatactgctgttatgatgattttcttgtttgcagatctagacctcccagtgttcctcctctgatgcctcagttcatgagggcccatggcagcatcaatgaacaataccaacagaattcatcatctagcctatttgctggggcacataggtcaggaggcatgcgacctgcgccgacacctctaccagagaaccccaccttttccttgttcccaccgggttcatccggccatagttcgatggagactgatgacgctggaggaagccagttctatgcctgggagcgtgaccggttcgccccatttccgttgatgcctgtggactgcgagataagctggtggacctcacagcagcagtctcatagcacatcagagccttcatctgctccaaggaggctattcgggcaatggctcggcgtcggcaggtcgtcccctgaaaatagaccacccgagggctcttcgtatcggcaaatgatgcctgtggactgcgagacaagctggtggtcctcacagcatcagtctcatagcacatcggagcctacatctgctccaaggaggctattcgggcaatggctcggcgtcagcaggtcgtcccctgagaacagatcgcccgagggctcttcgtatcggcaaatgcactcgccacggatgtagaccatcgctgctggcaatccaatttaatttggaacccgagatgcttgtaagaaacgatgggaaacccattgtattatgttaggccaggctgggccgtaaaactttgggacgatgttcgaggggcgagaaacaggaaatcatccggctgagaggatattttgatttggtttatgtgaattctatctcgtacatatttgaaatcaagttgggatgttaggagtcatgctgcaattctgttgatcgacggctttcaaatgctattaatttacgggcaaaaaaaaaaaaaaaaccgaagatggttttatgttcgtgtcgcatgtgaaggattacctttcatgcggttttcaatagggcaaaataaaatcttaattaaactcttaccattgacttgcagtgattggtattttgttagcactgtaaaatgttgaagtacgacacagaatatcggcactagggcagaaggttctttgtggaaggttcatattaataaaaaaaaggctgctgttttagtgtatttttagtggcggaagtgagaggggagacagcttatctgttagagctagtttgagagtctaaaaactggaggggttagagaggctaaaatcctcttcttatttaaaattgaataaggatgacattttagccccttcaattctctccgggtttgtggctcctaaactaaccttaggtcaactttcatcctgcaacagataacttaatactggactgcaccgtcgtcgtcgaggcagattccgaccacaaatgcagcacacgcgcgccaggctggcgtcaggcacagggagttaagtgcatgcaaggtgacaggtgttaaaaaccctttgctagtgattgtagtgtacgtacacaagttttcttattagtggag

SEQ ID NO: 4290 - DNA, 2124 bp, Zea mays
agtccagccctgcctcggttcttcctccccgtcccatcgtgctgtagaagttgcccgctgccgtctcctgtcctgactcctccatgtctctcacttccctcacttctcggctttgacctcggctcgcaatgaactctctcctgcgtccgccgctgccgggcccgacgccgagcctgagcgcgagacgcatggtctcgccgccgccagcgccggtgcgggtcagctcggcggcgctggccggcagcgggcgcagatgccggctggggctggcagtggcggcgtcggcggctccgtcgtggatggaggaggccggggtggccgtgctggaggaaggcgggcggaggaacccgtctgtgtcggactcgtaccgccctgctgggctgccgcggcccaacgccacggtgctggaggcgcaggcgcgggtgtgcacgggccccgcacagacgcgcccgctcggggaggagcaggccatgcgcgtcctcgacactatcctccgctccgcattgggagaactcaaagaggagccagtctctagtgcacagttaggtgcattctttgcaggcatgacaataagatccaactcgtttccagaggccacacagtggagcgagggtgaacggcgtgccatgagcatattttggccacgccttgtacaaattcttcctccggaggtgaagtttatagcagaccctgaagggacgatcatgggtgcaaatggtttaacagggcctcggtatgttggtcaaggaactggagagatgagactagtcggtgctctgagggaagtgcttgctggtggccatttaggttatgaggaggttcaatgtgtgctaaaggatattttaccaattggaccgagttcagatttgacagtgactagtgaagcattgctggcggcatttttgattggacaacggatgaatagagaaactgatcgtgagctcaaagcgtattgcctagcctttgatgatgaactaggtcctcctctggttgctgatgtcaagtccttgacacactatggtgaaccatatgatggcaatacacggttttttagaagtactctatttgttgcagcggttcgagcctgctatagtgaatcatgcctcctccatggtgttcaatggatgccacccaagggtggaataacagaaggacaaatgcttaaattcatgggcgcaaacatacacttatctccaacacaagccaagatactgttggaggatgagactgctggttttgcatatttgaatcttcaggaagcatgtccaccattatattcaattattgggctcagggagcatattaagaaacggccaccattggctacctctgagaaagttcaacaatttgtgagggcacgggggagagaatcaatggttgcaggattttatcacgaaggctatgaagatccattgcttatgctgatgagaaggagaactgttcatgctggactagttgtgaagggtgaggaaggtgcgctttccttgacaaccaaggaaagatcagcccatgcatcaaaaggactccctgttaaccactgttcagggtttcggacaccaagcggcataaatttctctgagactgatggtattcctagagaaagcttcagggtcattgtgaatgcccaggaacttggttttgaatccactgaaactccaagaactgatagatcaattctaaggaacttggagcttggtctggcagcactaggtggcgaaaaaggagcagcgtatgaccgaatcgttcttaacgcggctatggctgaccacttactaggctgcagcggagctgaggatatcgacgctgcacttgaccgggcgagggaagccattggtagcggtgaagctctgagaaggctcatgagttacataaagatctcgcacaaagtgtcctagtgttgacccgtgagtctgtgaccatgtactgactgtacaattttggcgtgagtcacgactggatatcttcttcgcgttgtctgagtgccttccccactcaatgttacaaagccaccatgaaaaagtatactcccttgccctcaaggacatgtccaaaaaaaaacagttgaaaggaaacaatgccttgttggcaaggaatgtgtttttataagatttttgttttgcaccg

SEQ ID NO: 4291 - DNA, 2301 bp, Zea mays
gagcgttaggcgtcgggtctcgtcgccagcgccggtgcgggtcggctcggcggtgctggccggcggcgggcgcatatgccaacgggggctagcagtggcggcatcggcggctccgtcgtggatggaggaggccggggtggcggtgctggaggagggcgggcggaggaacccgtcagtgtcggactcgtaccgcgcggcggggctgccgcagcccaacgccacggtgctggatgcgcatgcgcgggtgtgcacagggcccgcacagacgcgcccgctcggggaggagcatgccatgcgcgtcctcgacactatcctccgctccgcaattggagaactcaaagaggagccagtctctagtgcacagttaggtgcattcttcgcaggcatgacaataagagctaactcgtttccagaggccacccggtggagtgagggcgagcgacgcgccatgagcatattttggccacgccttgtgcaggtccttcctcctgaggtgaagtttatagcagaccctgaaggcacgatcttgggtgcgaatggtttagcagagcctcggtatgttggccaaggaactggagagatgagactcgtcggtgctctgagggaagtgcttgctggtggccatttaggttatgaggaggttcaatgcgtactaaaggatatcctaccaattggatcgagttcagattcgacggtggttagtcaagcactgctagcggcatttttgattggacagcggatgaatagagaaactgatcgtgagctcaaagcgtattgcctaacctttgatgatgaactaggtcctcctccggttgctgacgtcaactcgttgacacactatggtgaaccatatgatggcaatacacggttttttaagagtactctatttgttgcagcggttcgagcctgctatggtgaatcctgcctcctccacggtgttgaatggatgccacccaagggtggaataacagaaggacaaatgcttaaattcatgggcgcaaacatacacttatccccaacacaagccaagatactgttggaggatgaaactgctggttttgcatacttgaatcttcaggaagcttgtccaccattatattcgattattgggctcagggagcatattaagaaacggccaccattggctacctctgagaaagttcaacaatttgtgagggcacgggggaaagaatcaatggttgcaggattttatcatgaaggctatgaagatccgttgcttatgctgatgagaaggagaactgttcatgctggactagttgtaaagggtgaggaaggtgcgctttcaatgacaaccaaggaaagatcagctcatgcatcaaaaggacttcctgttaaccactgttcagggttccggacacccaacagcataaattcctctaaaactgatggtattcctagagaaagcttcagggtcattgtgaatgcccaggaacttggttttgaatccaccgaaactcccagaactgatagatcaattctaaagaacttggagctcggcctggcagcactaggtggcgagaaaggagcagcctacgaccggatagttctcaacgcagctatggctgaccacttgctaggctgcagcggagccgaggacatcgacgctgcgctcgaccgtgcgagggaagccattgatagcggcgaagctctgagaaggctcatgagctacataaagatctcgcacagagtctcctaggctagcgctgaccccgtggcttactgattgatcctacaatttcggcttcgagccacgactcgggtatcttcttcgcggagcccgagtgcctttgccactcggtgtcggtgtttacaagccagcgtgaaatgttccctcgcctcctcaacgacctgtcaaaaaaaaaacagttgaaatgaaacagtgccttgttgtttttgtttttgtttttgttttgccctgagatagagaagttcatgttgagtaacacgtgcagattctcctcggatcagatttatagcggcattttgaatgaaatactgtgcatggtctcgtcaaggttgaaaccatgatcagatttatagagaacctagaagttttcaattagcagcagcaattgctccattccagatgctaccaagtcttctgcgagcagaggacaatgcgtgacatgttaaatcttaaagaggagatgattaggaccttgctcaaagtccaaaagaaaaaaccgaggatgatcaggcatgccggtcagctgtgaccagtcctttgggtacaaaaatgtgatcagtccacgcacaattttaatcctactgtatactcaa

SEQ ID NO: 4292 - DNA, 1742 bp, Zea mays
gtgggttcgttagatcaaaccagattgagtgttatctatttccttaattctggagagtccctgccgtatggtgcagctgccatctggcagcatggtagcgctgcttgggttctgggtcgtctaaagtatgtccatgataatagggcatcatctgctcttttctagtatggattgccactcatggcaaggaatcggtctactgctacctaagttaggaatatgtcaactgttttgtacttcaaattttctcctgtaccttggcaacccattcatattaacatgatttttcatgtgcctaagctaggaatatgtcgttttttatgaaatgatttcaggcttatgggctttatctttcaggtattcctagagaaagcttcagggtcattgtgaatgcccaggaacttggttttgaatccactgaaactccaagaactgatagatcagtaagccttttctcccctggctccttggcagtatacattgatgtttgctagtgatcatgtatgatcaataatttgtcggcatgggatatacggacgcttactttatttcctaatctgaatcagattctaaggaacttggagcttggtctggcagcactaggtggcgaaaaaggagcagcgtatgaccgaatcgttcttaacgcggctatggctgaccacttactaggctgcagcggagctgaggatatcgacgctgcacttgaccgagcgagggaagccattggtagcggtgaagctctgagaaggctcatgagttacataaagatctcgcacaaagtgtcctagtgttgacccgtgagtccgtgaccatgtactgactgtacaattttggcgtgagtcacgactggatatcttcttcgcgttgtctgagtgccttccccactcaatgttacaaagccaccatgaaaaagtatactcccttgccctcaaggacatgtccaaaaaaaacagttgaaaggaaacaatgccttgttggcaaggaatgtgtttttataagatttttgttttgcaccgagagacacgtacagattctcctcttgagatgtccgaatctggttattgtggctattgtgaatactctgcatagcctcatcgtcaatcgtcatccaggttgagaacttgtaaaccgtatttgattttgtttatgaatgtatgtgctcttctttatgttgtgtatcgtgatcctgtgttgttctgtgaaatcacactgattcggtgattccgacatcacgtttcagatgttgtgatgctcagccgactgaaaaaaattgcttcgtttcagtaggcacatactctctcctattctttagaagtcgttttggacagcatttcgtatataaggcactgtctaatttcctgtcgtgtccttattaaatatgatacgttgtgtcgcccaatatattgtccttctgatctcaacaggttaccaccgctttttgcatcattttgctgcatgcagcgcttgcatgccgccacccattcggtttccaggtcgcatgcacccgctgttgatgcatttgactcaccccttacccctaggccttcccacggccgtgctggtggataaatgcggcgcgggggacgacgcctaatcgccgcctcgcgtgtgccgcggcacgcccgccacttgctcaatgctcatcctcgctcctcggccccgcgcccatttcggttcgccacctgctcatctctattctgccctgcgtccggtcttcatatcacgtcaggttatctcgccgg

SEQ ID NO: 4293 - DNA, 2373 bp, Zea mays
cctccgagccggccggggcggttgcgtctggccccggcgccgtctgcttcccttgctcgccccggcgccgtctgcttcccttgctcgccccggcgccgctcctcgctctctctttactccaactgctcccactcgttccccaaccacctcccgcctccctcgccgcccccccgccccacgtggccgcgctgaaagcggcggtgcgtgcccgggcagccaagcaccagcgccgcgccatggctccgtgaattcgctcgcccgccgcgatcaagccagggttaatagttactcagctgcgggtttggcgcgagctcggtgccaccgcttagacttggccatgacgaggcgccgtgctgaggcggcgacggcgccgagcctcctccaactcctccttgccttgcactgcggggtgctgttcctacaatgctcggcagcatctgccatgggcgccgacgtgtcggcgctcatggcattcaagcgcgccatcatcgaggaccctcactccgtgctctcggactggactgacgcggacggcaacgcctgcgactggcgcggcgtcatctgctccgcgccccagggctctgtcatttccctgaagctgtcaaactcatctctcaagggattcatcgcacctgaacttgggcggcttagtttcttgcaagagctgtatttggaccataacctgctctttggtacaattccaaaactaattggctcactgaagaaacctgagggttctggacttgagcgtcaatcgactcactggaccgatcccttccgaattaggtggcttgagcagtgtgagcatagtaaatttccattccaatgggttgactgggaatatacccgtcggagctgggaaaattacagaatctcgtcgaacttaggttggataggaatagattgaagggatcaattccaggaagcaatactgccagtttttctcctgcttcaaatattggatccacagctcacaatggactatgcccttcttcccgattatatgttgcggatttttcttacaactttcttgtcggaaaaattccatcctgcttgaaatatcttccaaggtcaagtttccaagggaactgcttccaggatgagtactctgtccaacaacgacctttgcaaatttgtacaagtggttctactggccagcaaggtgtcatatacggatccaaacatcctggccataaacatgaaaaaatggagcaaccaatttggcttcttgctttagaaatcgcaactggtgttcttctggttgtttttgtgattactggtatagttactgcttccagaagttgcaagctgaagccttctataagaatatcatcatggaatcgatcgaaaagttggagcgacgagataacagtgttgattgattctgatatgctgaaaagtctaccaaaattaagtcgccaggagcttgaagtggcctgtgaggattttagcaacatcattggctcaactccagagacagtagtctacaaaggaaccatgaaggatggacctgaagtttctgtgatatcgttgtgcgccttcgaaggtcattggactagccaccatgaactcttttaccaaaacaaggtcattgatctggcaagattgaatcatgagaacatagcaaagttcttagggtactgcagggagagtgatccattctctcggatgctagtcttcgagtacgcaccaaatgggacgttatttgagcatctacattatggagagggaggccaattttcttggctcaggcgaatgaagatagccattggaattgcccaggggttaagatacctgcacacggagctgcagcccccatttgctatatctgagctgaattcgaactccgtgtatgttacggaagattttactccaaagctggtggattttgaatgctggaaaatgatgttctcgagacactccatctcgagagacgagaaggctcgtgggcacttgaacagcaagtcctcttttcccggccacggggattctgcagcggatagacaagccgatgatatccaggccaacaccttcgctttcggagtgattttactggagatcatcagcgggcggcttccatactgcaaggataaaggctatttggtcgactgggcgagcaagtacctccagcaggcagaggagatcgggaagctggtggacccggagctgggcagcgtgcggagcgaggacctggcggtgctgtgcagcgtggtgagccggtgcatcgacccggacccgtcgaagcggccgtcgatgcagatcatcacgggcgtgctggagaacgggatcgaccttccggcggccgccatcctcaaggagtcgtcgctggcgtgggccgagctcgccctcgccttgtgacacgctactcccacc

SEQ ID NO: 4294 - DNA, 2113 bp, Zea mays
atatttctgctctctgctctactacctaccgtggcgcagggtggagtacctcgagaagttctcgcaccgcgtgcagctaggcagctgggtttccaggacgtgagcgagtgcccacagctctgcaggctggcgaacaactacctcagcagcagcaagacatgcatggaggacatctacgggttcttcgccggcgccaaggcgacgccgccgagtgcctgctttatgtcaagctcatagaggagctggacagatgcatcctcggatattttgcgttccactgggaccatgccacctacctcatcacctcggccttgaccgcggacaccggcagcaaaaggaagctcaggaacatggtcttggaagcaacaaggaagcagcgtttcgagcgcgtgacgcgtgacctgaaggtgacgcgggtgttctcgacgctggtggaggagatgaaggcgatcggcatcatagcggcgggcggcggcggcggcgaggcgtcgcagtgcacggacgtgatggcccccgtggcgcactcggagcgcagcccggtgctgctgctgatgggcggcgggatgggcgccggcaagagcacggtgctcaaggagctcaagcaggaggcattctggaccaacgcggaggccaacgccgtggtggtggaggcggacgcgttcaaggaggcggacgtcatctaccgcgccatcagctccatgggccaccacaacgacatgctccagacggcagagctggtccaccagtcgtcgacggatgcggcgtcgtcgctgctggtgacggcgctgaacgaggggcgggacgtcatcctggacggcacgctgtcctgggagcccttcgtggagcagaccatcgccatggcgcgcgccgtgcaccgccagcgctaccgcatgggcgtcggctacaaggtggccgacgacggcaccgtcaccgagaactactgggagcccgcgagcgacgacgccaccgagcaacccccgcggaggccctaccgcatcgaggtggtcggggtcgtctgcgacgcctacctcgccgtggcgaggggcatccggagggccatcatcacccggcgggccgtcagggtcaggtcccagctgcagtcgcacaagcgcttcgccgccgcgttccagcggtacagccgcctcgtggacggcgccaggctctacagcaccaactccatgggctccgccaagctcatcgcgtggaaggacgggatcggaaacagcctgctggtggagccccgggagttcgactgcctggagaaggtgagcgggctcaacgagcacgccacctccgtccacgacctctaccccgacggcaccaccacctgcggatcgcgctccatctgggaggacatgatcgtctccacggcccgtgccgacacccagcgcgagctcagggaggccatccgctccgtcgagtccggcggcgggcagccggacacaccaccaacaacgccccagcgcgagctcctgggcttcatccgctccctggaggccgccaacgccgagccagctgcagttgacaatggtctctaaattttaaaccataagatttaagaatcgaatcagataatcggaccatatttctatttatttttgaaaccaacatttaattgagactattttattttgtgaaaaagtatttggatcgtgatccattaccacccttagctgcagcaggtcagacaccgacaactacctcttagctagtgctggaaaaatacgggacatgctttttggtcagcacaaacacaacccaaaaacaataggttaaagcacggaccgacacgaaataatatggaccgagttagtacggtccgaaggcgggcctaaaccgagcctcaaattctggcccgtcgagccccggcacagcccacacagataggttgggcttgagccggcacggtctgatgaaactcatgtgtttaattttatttaatttagtaagtgatagactttatattgttatggtatttagagtttatgtggtcaaataatgatgtgattgtttaacatctttaattgagtaagttatgtattttatatgattgtaatattttgattttatgcggttcaatatatgtgtcggccctgccccgacacggcccaat

SEQ ID NO: 4295 - DNA, 907 bp, Zea mays
gggtttcacttccacccatccccgtgtgtttccgattccccccgttcgggagcagagcatccgcgcgcgatggccaaagatggtggcttcgccaaggcgctgctgctccacgtcgccgcgctgtcgacggccggcgccttcgcggccgccgctgccgccctggcgcggcgccggctgtggggaggagacaggcggaagaagcagctgccggcgccggccatggccgagatgccccggctccagctggcggagtccggccgcctggagtacctcgagaagttctcgcactacgtggctaggcagctgggtttccaggacgtgagcgagtgcccacagctctgcaggctggcgaacaactacctcagcagcagcaagacatgcatggaggacatctacgggttcttcgccggcgccaaggacgacgccgccgagtgcctgctttatgtcaagctcatagaggagctggacagatgcatcctcggatattttgcgttccactgggaccatgccacctacctcatcacctcggccttgaccgcggacaccggcagcaaaaggaagctcaggaacatggtcttggaagcaacaaggtgaggccagcatgaatgcagctccattcctatatttttttgtttatttctcttctctatatatattttctctttctgagagcacagctatgcacgcgcgcggtacaagcagaggataattgcaacaaaaaaaagtattctttacaaataattggacaaaggcgtattagttatgtcatagtattcatctacgtacgtggagtgtttgtacgtgtaaaccaaaatttgttaagtattaggcaaccaaattgtcattgtttcaaaaaaaaaaaaaaaacgcatcaacggtttttatttatttttgtgttggttgagtg
